United States Patent 8,535,880 (ORGAN-SPECIFIC GENE, METHOD FOR IDENTIFYING THE SAME AND USE THEREOF) - sequence listing, part 2

SEQ ID NO: 5013 - DNA, 551 bp, Mus musculus
  misc_feature (287)..(287): n is a, c, g, or t
gagacaaaatcttgcttaggtagcctggccttgaacttacagaaatcctgccttcgtttccccaagtactggaattatacacacaagctaccacacctagctatacatcatctttgtctatttctgcccttgctgggtcatgggccttgggcagatgccaaagatccaaggggtggtagggccagctaggcaggccacctggagtgggccaggagcgctttaccctctctaatcgcctccacctgagaagtgcatcacctgaagtggtaggagagtgcgcgtacaanggggccactgtgggccttctacttcatccaccccgcccttccacagacccaagcccaccctttcatagcctgtgtgctcacccaggagcttctagatgggaggcttagagccaaccaaacccgtcactcccctgtgtccactccctgccccatgcagagctcccaccaccccatcccaggtccggtggctgccagctggagcgaaaggggtctctggttgccccgaatgcagctctcaaactggtcttgtacttgctgaataaa

SEQ ID NO: 5014 - DNA, 520 bp, Mus musculus
  misc_feature (46)..(47): n is a, c, g, or t
  misc_feature (129)..(129): n is a, c, g, or t
  misc_feature (210)..(210): n is a, c, g, or t
  misc_feature (311)..(311): n is a, c, g, or t
  misc_feature (321)..(321): n is a, c, g, or t
  misc_feature (325)..(325): n is a, c, g, or t
  misc_feature (370)..(370): n is a, c, g, or t
  misc_feature (380)..(380): n is a, c, g, or t
  misc_feature (415)..(415): n is a, c, g, or t
gctgcagcccaggaccaagttagaggcttcctagagaaggaggcgnncatcgtgagccggcccctcaaccccttcatgcccaaggctgccaccttgcccaacacagagggtgaacagccagggcccagntgtgggtcccgtaggcaaggacaaggacaaagcactgcccagcttctggattccctcactaacgcccgaggcaaaggccancaagctggaaaagccgctggacgactctgtggaccgcgtgggactcatcacacgcagtgagcgctacgtttgcgcagtgacccgagacagtctgagcaatngccacgccgntgcngcagtgctgcgtccctctggggctgtggtcaccctggagtgtgtngagaaactgnatccggaaggacatggtggaccccgtgaatggggncacgctgacagagcgcgacatcatcgtgctgcagcggggcggcaccggctttgcgggctccggagtgaagctacaggcagaaatgtctcggccagtgatgcaggc

SEQ ID NO: 5015 - DNA, 480 bp, Mus musculus
cactgtggcttgtgactagcctcattagttgcctgttaataaacattagctgaatagttaccagtgttgttaccagcatttgtcctcttgtgaattcaagagtcctcgcactctttaacatgttctttataaaatgtataaacccttccaaactatttaaagaggagtgttattgcatgcagataatcataattttgagtttgcctcagaagactactaaagcaaatttgttcatttttttttaaaaaaatgccctttaatgtttcaaaaaaaaataacagtgtaatttgactgactttaagatcagccataaataatgagcagtcttcaaaagcacttttcacacagatcatctgggctccagggaggaagagtctgtgccactgatgttttcaagtgcaggactcactcaaacctctcagcatcttaggactgtttcaagtaatcatattgatgaactcgtaattcatggttgacctt

SEQ ID NO: 5016 - DNA, 584 bp, Mus musculus
  misc_feature (326)..(326): n is a, c, g, or t
  misc_feature (337)..(337): n is a, c, g, or t
  misc_feature (370)..(370): n is a, c, g, or t
  misc_feature (372)..(373): n is a, c, g, or t
  misc_feature (382)..(382): n is a, c, g, or t
  misc_feature (415)..(415): n is a, c, g, or t
  misc_feature (418)..(418): n is a, c, g, or t
  misc_feature (446)..(446): n is a, c, g, or t
  misc_feature (451)..(451): n is a, c, g, or t
  misc_feature (454)..(454): n is a, c, g, or t
  misc_feature (472)..(472): n is a, c, g, or t
  misc_feature (504)..(504): n is a, c, g, or t
atcaaggacgatctgtgccatttcagaacatttgtacaaaaagaacagtgtgacttagcaaattatttaaaatgtacagctgtagaaataagaaatattattgaaaaagtaaaatgttctctagaaataacactaaaggaaaagcatcagcaagaactccaatctttaaaaattgagtatgaatgtaaacttgatgctctagtaaaagacagtgaagaaaatgtaaataaaattttaaaattgaaagaaaatttagtatcccttgaagaggctttacaaaataaagacaatgaattcacttcgattaaacatgaaaaggatgctanttgtctgtgtncagcaagaaaaggatcagaagttgttagagatngnnaagataatncatactcaacattgtgaaattaaagaactgaancantcacgagagatggcattagaagacctgnaaaanctncatgatgaaaaaatcgantcattgagagctgaatttcagtgcttagaacnaaatcacctgaaggaattagaggacacactgcacatcaggcacacacaggagtttgagaaagttatgacagaccacaata

SEQ ID NO: 5017 - DNA, 497 bp, Mus musculus
  misc_feature (257)..(257): n is a, c, g, or t
  misc_feature (268)..(268): n is a, c, g, or t
  misc_feature (273)..(273): n is a, c, g, or t
  misc_feature (276)..(277): n is a, c, g, or t
  misc_feature (305)..(305): n is a, c, g, or t
  misc_feature (309)..(309): n is a, c, g, or t
  misc_feature (326)..(326): n is a, c, g, or t
  misc_feature (347)..(347): n is a, c, g, or t
  misc_feature (378)..(378): n is a, c, g, or t
  misc_feature (392)..(392): n is a, c, g, or t
  misc_feature (398)..(398): n is a, c, g, or t
  misc_feature (419)..(419): n is a, c, g, or t
  misc_feature (421)..(421): n is a, c, g, or t
  misc_feature (451)..(451): n is a, c, g, or t
  misc_feature (454)..(454): n is a, c, g, or t
tacctgatactctacttgaacttggagaaattcctacactaaaaacgctacaagtttttggaatcgtgccagagggaacccttcagctactgagggaagctcttcctcggctgcagattaactgcgcctatttcaccaccattgcaaggccaactatggacagcaagaagaacctggagatttggggtatcaagtgccgactgactctgcaaaagcccagttgtctatgaagtgcttaccgcagagcggtgtttccntctggaacgangaaancanncagcaagtccgcatgctggagaccttgnttantcttcctattggctttnccttagccttcactttatatntatgttagggaaccatttgcgagggggacanccacgaagtgttantttttnaaaactatagagccgattctntncagtgctgtgccctaagggcctaagcggcnagntctttggagattttaggagagcctatgatttcagcatgctttt

SEQ ID NO: 5018 - DNA, 240 bp, Mus musculus
attttctccactttgtgatcggaagtcaacaatggttgcccagtcgcaaataggtttcattgatttcatagtggagccaacgttttctctcctgacggactcaacagagaaaattgtcattcctcttatagaggaagcttcaaagtcacagtcttcaaactacggggcaagcagctcgtccaccatgattgggttccatgttgctgactctctgaggcggtcaaatacaaaaggctccgt

SEQ ID NO: 5019 - DNA, 534 bp, Mus musculus
  misc_feature (172)..(172): n is a, c, g, or t
  misc_feature (471)..(471): n is a, c, g, or t
gatccgctggcgactgacaaaatggctgctgcaccaccggaagtgacgcgcgggagcggggcggggccgccaccccgattggagcgcgctacggctctgcgctcccagggagccggcggtgtgacgtcaacactgcgggaggacatgttggaagagggaacgcgctctctcnggcagatacgggggtcctcagcagacatcttaagtcttggcagggccctcccccaccgccctccctttcctttcccacgctctctgtaaagccacgtgtttgagcggttcgctgtttgtttccctgagaccctccccgtaaacggtaactgagtcagttgttctgtatactctgagactagatataccagataccgccgagtttgaaactgtagcaattgattgccactgtctgagcctctgggccaaatactgtcgcagtattaccgagcattaagtgcttcagtgttacgaattttntccaaactacctaagtaattttctagaaacatcaccatggtgacgactatgcaggtccagatt

SEQ ID NO: 5020 - DNA, 577 bp, Mus musculus
  misc_feature (256)..(256): n is a, c, g, or t
  misc_feature (258)..(258): n is a, c, g, or t
  misc_feature (345)..(345): n is a, c, g, or t
  misc_feature (401)..(401): n is a, c, g, or t
  misc_feature (404)..(404): n is a, c, g, or t
  misc_feature (432)..(432): n is a, c, g, or t
ttcctttcgaggtgtaccacgtacactttgggcagcaggacacttggcttcaagtcaactcccggatggagccagaatccatagaaatttgtccttataaccctcaccaccgaatcccgctcagcaggttccagtaccacctggcgtcatgcaggaagaagaaccccaagaaagccaaaaagatggccagctgtaaatacaacgcctgccacgtggttcccatcagaaagctggctgaacatgaagctacctgtgncnacaggagctccgtggaggaagaggacacattaggccctctgcaagtcagcctcccacagccgcagaaccaggacacactacaggttngttggctttccaaccctgacatttggaatgttgacggcgccaactgtcacccaatnttngtccttaagagttttgttccccaaaaanttgtttgtgaaagtgacatccaagagtcacggggaggagaccaatgcccagaagatcctcagactaggaccaggaaggcaaacttctagcaggaggaagagggctctcaaatgcgtggatggatcgcgcatctcatctgaataaa

SEQ ID NO: 5021 - DNA, 368 bp, Mus musculus
  misc_feature (153)..(153): n is a, c, g, or t
  misc_feature (163)..(163): n is a, c, g, or t
  misc_feature (175)..(175): n is a, c, g, or t
  misc_feature (190)..(190): n is a, c, g, or t
  misc_feature (195)..(195): n is a, c, g, or t
  misc_feature (222)..(222): n is a, c, g, or t
  misc_feature (281)..(281): n is a, c, g, or t
aagtctgccaagtactggtcgcagatcccactgccccacggaacgcacgcgtttcacgccgcctgtccgttctgcgccacgcagctggttggtgaacagaactgcatcaaattgattttccaaggtccagtggactgacaccctggacggccnatctccacgncattaacacgtnactgtgaagattccnccacnaactgtagattctacctttttgtaatnctgtttgttaaggggaaggcggactgggttgggaaatgggggctggtgacgaaatgtgncaggcgctgacagataccactgtgttttgcatgctcagaacagcagcatcagcatcgtcactgaggtctgcctgattaaactttaat

SEQ ID NO: 5022 - DNA, 536 bp, Mus musculus
  misc_feature (221)..(221): n is a, c, g, or t
  misc_feature (281)..(281): n is a, c, g, or t
  misc_feature (294)..(294): n is a, c, g, or t
  misc_feature (302)..(302): n is a, c, g, or t
  misc_feature (308)..(308): n is a, c, g, or t
  misc_feature (324)..(324): n is a, c, g, or t
  misc_feature (338)..(338): n is a, c, g, or t
  misc_feature (378)..(378): n is a, c, g, or t
  misc_feature (407)..(407): n is a, c, g, or t
  misc_feature (413)..(413): n is a, c, g, or t
  misc_feature (417)..(417): n is a, c, g, or t
  misc_feature (419)..(419): n is a, c, g, or t
  misc_feature (499)..(499): n is a, c, g, or t
aaatccctgcccctgaacatgagatccattataccctgcctgatgggaaagagatccgtctgggtcaggagaggttcctctgctcggagatgttcttcaagccatctctaatcaagtccatgcagctgggcctccacacccagacagtgtcctgccttaacaaatgtgacatagcactcaaacgagacctcatggggaacatcctgctctgtgggggcagnactatgctcaggggtttccctaaccgtctgcagaaggagctgagcagcatgtgccccaangacaccccccagntcaatgtnctgccngagagagacactgcantctggactggtggntctatcctggcctcactccagggctttcaaccactgtggntccatcgcctggagtacgaggaacatggncctttnttcntntacagaaggtgcttctgagcagacacagcatgctcaccgtggtggcaatgccagctttactgtgtgagggctgaaccttntacaagtggtgttgagttggcatgttcatttctgtag

SEQ ID NO: 5023 - DNA, 383 bp, Mus musculus
  misc_feature (306)..(306): n is a, c, g, or t
  misc_feature (350)..(350): n is a, c, g, or t
atgctgttgcagatattcgtatatgctaaaatataacctgcaaacatgttctaaatacacatgctataagttcgccttaagatttcaattcttggataatcaggctccaattgcactttatattttagcaaatacagtctcttagtcactaggctttgcattcgtatgtagccgtatatttctgtccattttctcaaacagaaacatgtatgttaagtgaagatggcatttctttcttgtatagtacttgtattttctttcgccgatgcagccctgtctcaatttttcaacctttgctgttaaatncaatactttataaagaatgaacaaaattactggaagcagtattntcagtaatggagtagtattcaccagttttatct

SEQ ID NO: 5024 - DNA, 557 bp, Mus musculus
  misc_feature (334)..(334): n is a, c, g, or t
  misc_feature (345)..(345): n is a, c, g, or t
  misc_feature (454)..(454): n is a, c, g, or t
  misc_feature (463)..(463): n is a, c, g, or t
  misc_feature (465)..(465): n is a, c, g, or t
  misc_feature (496)..(496): n is a, c, g, or t
tcttcatttcacactgactgtgctctccatataagtaaaaaaactacagacttcttttcttcatggccaggtggagagagagagaaagagaaagagaaaaagactaccccctgggagtccaacacctctgcagaaagggcaagtgggtaaatgtaatcaatgtttccattttatgttgattagaaagaaaaatcatggcgcctgcccaaactcaacactgtcagcgccagaacacaatgacactaagaacaaccttggaagctatatactacatgggaagaagaaactaactgtacttctcagcctttgagtatagatttacactttattaccnaggtataaatnttcatatttccaccagtaggggaaaaaaggacccacacaaattcaaaataacaaaaaaccatactaaaaccacagacttcatagacctaaggaaccacttatttataanccaactggntntttgcagtttgtttaaatcatatatatattnttccaattcacttaaaactgttacttaaaactaacacttccctgcagagtaaatttgtcaa

SEQ ID NO: 5025 - DNA, 367 bp, Mus musculus
  misc_feature (26)..(26): n is a, c, g, or t
  misc_feature (32)..(32): n is a, c, g, or t
  misc_feature (35)..(35): n is a, c, g, or t
  misc_feature (65)..(65): n is a, c, g, or t
  misc_feature (110)..(110): n is a, c, g, or t
  misc_feature (119)..(119): n is a, c, g, or t
  misc_feature (122)..(122): n is a, c, g, or t
  misc_feature (158)..(158): n is a, c, g, or t
  misc_feature (162)..(162): n is a, c, g, or t
  misc_feature (172)..(172): n is a, c, g, or t
  misc_feature (178)..(178): n is a, c, g, or t
  misc_feature (187)..(187): n is a, c, g, or t
  misc_feature (217)..(217): n is a, c, g, or t
  misc_feature (219)..(219): n is a, c, g, or t
  misc_feature (222)..(222): n is a, c, g, or t
  misc_feature (229)..(229): n is a, c, g, or t
  misc_feature (233)..(233): n is a, c, g, or t
  misc_feature (238)..(238): n is a, c, g, or t
  misc_feature (258)..(258): n is a, c, g, or t
  misc_feature (261)..(261): n is a, c, g, or t
  misc_feature (266)..(266): n is a, c, g, or t
  misc_feature (274)..(274): n is a, c, g, or t
  misc_feature (277)..(277): n is a, c, g, or t
  misc_feature (322)..(322): n is a, c, g, or t
aggctgtcctgcaatggattgcagcntctcanttnaatgtgcccatgctctacttcatgggagangatgatggacaactagagaagctccctgaagtttcagctaaggcngcagagaanggntacagtgtaggagatcttcttcaggaggtcatgaantttnccaaagaaangacaantggatgaanccgtgggcaacatggctagaaagcagctgntngantggcttntcgntaacntgtaagctgagaattccttngantcccntccatccntcntcccccccagcagcaattccaccccagctggagccaccctcaccntcaggctggtgaactgcacaattgggatcacatttaccaatacat

SEQ ID NO: 5026 - DNA, 275 bp, Mus musculus
caaaaccaacggcatatacttctttctttcactttttattccttaaattgcatacgtgtgtaagtcattgtgccggataaaatcaatctcatctcagaatatttttgacttgaaaattgtttcttctctgtctactttgcaaccaaatgcaatcagtgtgccttgaattatttagcttattattaattaagttaaactagggctgtagaatagttaaggccaagtgaagcacaacgctatgatttaaagcgctttttagacccagcgctccttta

SEQ ID NO: 5027 - DNA, 489 bp, Mus musculus
tgaccgagtccctgcaggcgtgtaagctggcccaatccaatggctggggcgtcatggtgtcccaccgatctggggaaactgaggacactttcatcgcagacctggtggtggggctctgcactgggcagatcaagactggtgccccttgccgatccgagcgcctggccaagtacaatcagatcctcagaattgaggaagagctgggcagcaaagccaagtttgctggcaggtccttcaggaaccccctggccaaataaagcatggaccggagatccctggagccaccagctgctaggtcctctatccctgatgtcatcccagcagctcaaggccagcccagtgcgtgcccctcccatgtcactgcttccttaggcatccacacctgaccaccagaatccctgctggagacccagttttgcaatcatgtgattggtctgaatcattgtttctgtcacctgacttcccagctagtgtctggagccctcggaa

SEQ ID NO: 5028 - DNA, 567 bp, Mus musculus
gactattacgtcaagcctgtagcctcggaggaaacacaagaaaaagtgcagccaaacagcactttgaccaagacactggtgctggtgcccctactggctaacaacagagaaagaagaggcatcgcgctggatgggaagatcaagcatgaggacacaaacctggcctccagcaccatcatcaaggagggcatcgaccggaccgtcatggggatcctggtgtcataccatatcaaggtgaagctcacggtgtcgggctttctaggagagctcacatccagtgaagtggctaccgaggtgccgttccgcctcatgcacccgcagcctgaggatccagcaaaagaaagtgttcaggatgaaaatttggtttttgaagagtttgctcgccaaaatctgaaagatactggagagaacacagaagggaagaaagatgaggatgctggccaggatgagtgaagacttagcctagatgcctagaaactgcttgtagttccgggtgccttgagggaagcccccggtagactctcaaagttatgctagatatcaaagcatgagcattcctcccagaaa

SEQ ID NO: 5029 - DNA, 509 bp, Mus musculus
tgtggttacctctacatctgtcaatgggcgtgtctcttctcacacttggagagatgccagtccccccagcaagagatttcggaaggaaaagaagcaactgggctctggactgttaggaaacagctatataaaagaaccgatggcacagcaggacagtgggcagaacacaagtgtccagcctatgccatccccccccttggcctctgtggcttctgtcgctgattcctccacaagggtggactctcccagccatgaactggtgaccagctctctgtgcagcccttctccatccctgcttctccagacaccccaggctcagtctctccggcagtgtatttataagaccagtgtggccacacagtgcgacccggaggagatcatcgtgctttcagactctgattagcaggccccatgctccccgtgctccctgcatccagaaggttttttgtatggctgttggaagatgatggagtaaaagatggacagagctcctcccgttttgatggtgt

SEQ ID NO: 5030 - DNA, 156 bp, Mus musculus
  misc_feature (26)..(26): n is a, c, g, or t
  misc_feature (33)..(33): n is a, c, g, or t
  misc_feature (67)..(67): n is a, c, g, or t
ggcgctcagcagtaatgacccccatntaccttntgatgcctgagcagaggtggggaagtccaccctntcctcgatgcagcttgcgcctgtttgggaggggtgagaacacttcagaagcaccgtgtctgaaccgttgcttgtggatttagtagttga

SEQ ID NO: 5031 - DNA, 509 bp, Mus musculus
gccaacatttcccatgccagaaagggggaagtgatttacagagtccagattgtggatctcagtcagattctggaaggaatcaacgtgtcaaagaggaaggagctgcactggcctgatgaaggaattcggttaaaagctgggaggaacagctggaaagactggagtccacaggagggcatggaaggccatgtggttcaccgatgggtgccttgcagcagagacccaagtacaaggtcccacatcgacaagacagtgcttctcgttcagatcgatgataaatacgtgactataattgaaaccggggtactagaactgggggccgaagtgtgagcctgcgctgcatacctgggttcctttctctggcttcccagccctcggagagaaagcaaggttgcagaagagccacctgtggggaccgaccgcctgcccttcgcagcaaagacttgaccagtggcttggttaagctcctctccaccctgactcctgtcactgtcttcatccccaaataa

SEQ ID NO: 5032 - DNA, 418 bp, Mus musculus
gctgcctccgggacatactggatggcttctttccctcagagctgcagaggctgtatcctgatggagtcccctttaaggctccaggatgactgctgaacaattcctgaacaggcttcccaagtgtataatccgacaaggcgaggtgattgacatccggggccccatcagggacaccttgcagaactgctgcccaatgcctgcccggatccaggagatcatagtggagacacctgccttggcttttgagcggcagaggagccaggagtcacctgacatgccaatgcctttgctctccatgcttcgcatcaagtccgagaacggagagcaggccttcctgctgatgatgtggcctgaggataccattggcgacgtgcggaaacttttagcacaggccagggacatggattcagctgccttt

SEQ ID NO: 5033 - DNA, 401 bp, Mus musculus
cagaagaccagtggcgtttctctgccggactgtgattcagtagctgatgaagaacttgccttgctcagcacccaggcccttacgcctgactccgtgggaggaaatgaacaagcgtttcccggtgattccacaaggaacccccagccagcacagaggccagaccagcaagtagggcccaggtccaggaaggagtctctcagggactgtagaggcgacagcagtgagaaattagctgttgagtcttagcctcccggtttgtaagatgtgtacagttccaggctactcataggtgttcgtgtgagaaggcgggagtagctgcactctactgaagcgtgtgtttactgctcagatgctctacctggtctgtgttggtgtaactaaagctggttgtcatcgactga

SEQ ID NO: 5034 - DNA, 493 bp, Mus musculus
  misc_feature (336)..(336): n is a, c, g, or t
  misc_feature (344)..(344): n is a, c, g, or t
  misc_feature (350)..(350): n is a, c, g, or t
  misc_feature (398)..(398): n is a, c, g, or t
  misc_feature (402)..(402): n is a, c, g, or t
  misc_feature (404)..(404): n is a, c, g, or t
  misc_feature (444)..(444): n is a, c, g, or t
  misc_feature (446)..(446): n is a, c, g, or t
  misc_feature (451)..(451): n is a, c, g, or t
  misc_feature (464)..(464): n is a, c, g, or t
ggcatgaaacctgctttgtgtgtgagcactgccgacagccaataggaaccaagcctttgatctccaaagagagtggcaattattgtgtgccatgttttgagaaggagtttgctcattactgcaacttctgtaagaaggtgataacttccggtgggataaccttccgtgatcagatatggcataaagagtgttttctgtgcagcggctgcaggaaagagctttatgaggaggcatttatgtcaaaggatgatttcccattctgcctggattgctacaaccatctttatgctaaaaagtgtgcagcctgcaccaaacccatcactggcctcagaggtnccaagttnatctgntttcaagaccgccagtggcacagtgagtgcttcaactgcggaaagtgntcgntntccttggtgggtgaaggattcttgacccataacatggaantnttatnccgcaagtgtggntccggggcagacactgacgcttagaaaga

SEQ ID NO: 5035 - DNA, 431 bp, Mus musculus
  misc_feature (363)..(363): n is a, c, g, or t
gagctctgtgccgaggacagagatagagtgtgtgcacagagcatacctagctacccggagcttacatttaaaatcagaatatttttcttaacacttcctaatcagtaaatcaacatttgatgtggtaattaacaggtaccaaaattttaaatttgtatgtggaatccttagagttaaagatagtttttatattttggtttttataaaccgttaaggttgatctaatgattgtgttttagtttttattaaaactcactacagtatcaataaaccaacagtctttcttgtgttcttttgtactctgttatttgcttgtgttttatgcttagaaacataccattaattttttcaaacaggcacttntaaaccttacctaaattaaatgggttagaaaccaaggaaaataaatttcaatgtttacactgtttgtt

SEQ ID NO: 5036 - DNA, 471 bp, Mus musculus
  misc_feature (334)..(334): n is a, c, g, or t
gagcgagcctcagacaagtcgaagatggattccagtcaaccggaaagatcttctagaagacctcgaagacagaggaccagtgagagccgtgacttatgtcacatgacaaacgggattgacgactgtgatgatcaaccaccgaaagaaaagagatccaagtccgccaagaagaagaagcgctccaaggccaagcaggagagggaggcatcccctgtcgagtttgccatcgatcccaatgagcccacctactgcttgtgtaaccaagtgtcctacggggagatgataggctgtgacaatgaacagtgtcccattgaatggtttcacttttcatgtntttcactcacctataaacccaaggggaaatggtattgcccaaagtgtaggggagacaatgagaaaaccatggacaaaagtaccgaaaagacaaaaaaggagagaagagcgaggtagtgaaggccatcggttttaaag

SEQ ID NO: 5037 - DNA, 505 bp, Mus musculus
  misc_feature (418)..(418): n is a, c, g, or t
  misc_feature (434)..(434): n is a, c, g, or t
aacggtgccatttacttcacggaagccaagagaagacgaaaaggatggacaagcatataaatttgtgtcccgatcagagatggaagcagatattaaggctgggaagtatttggagcatggggagtacgaaggaaacctgtatggaaccaagatcgactctattctcgaggttgtccagactgggcggacttgcattttggacgtcaacccacaagcactgaaagtgttaaggacttctgaattcatgccttatgtggtgtttattgctgctccagagctagagaccttgcgtgccatgcacaaggctgtggtggatgcgggaatcaccaccaagcttttgacggactctgacttgaagaaaacagtggatgaaagtgcccgaattcagagagcatacaaccactactttgatttgatnatcgtaaatgacaatntagacaaagcctttgagaaactacaaactgccattgagaaactgaggatggagccacagtgggtcccaatt

SEQ ID NO: 5038 - DNA, 464 bp, Mus musculus
  misc_feature (146)..(146): n is a, c, g, or t
aaggacgtcttcaagcacttaggcctgccctaccgggagccagctgaacgggactggtgacctaggacttggagcaaggggaaccatgttgaatgaactgactcatgtagccatctcccaccctcttagctgtgcctcgctttgtnggttacgcttgccctgagtgaccaagctaggagctttgggcctgcggggaagagccagtctgattctgagagcccgcaagctctctctcctggacaggatttatgctgctgtcccctctcctcccagtgacaggttttcacacggccccttccctgttcaagcagaacaggtggctggtttcaaggcggtttcctgcactgaaggcccgagcttccctttccaccccaagactgatgtagctgtgtggggtcagcaggggctgcaggagagggaagcagctgtgggctcagcgtcttccgtgagccttcacagtagag

SEQ ID NO: 5039 - DNA, 471 bp, Mus musculus
  misc_feature (266)..(266): n is a, c, g, or t
  misc_feature (319)..(319): n is a, c, g, or t
  misc_feature (339)..(339): n is a, c, g, or t
  misc_feature (342)..(342): n is a, c, g, or t
  misc_feature (348)..(348): n is a, c, g, or t
  misc_feature (360)..(360): n is a, c, g, or t
  misc_feature (362)..(362): n is a, c, g, or t
  misc_feature (369)..(369): n is a, c, g, or t
  misc_feature (396)..(396): n is a, c, g, or t
  misc_feature (442)..(442): n is a, c, g, or t
  misc_feature (445)..(445): n is a, c, g, or t
aaaaacgctactcggcatgctgaaatggtggccattgatcaggtcctagactggtgtcatcagcatggacagagcccttccactgtattcgagcacaccgtgttgtacgtcactgtggagccgtgcatcatgtgtgctgccgccctgcgccttatgaaaatcccgctggtcgtctatggctgtcagaacgaacggtttggtggttgcggttccgtcctaaacattgcctctgctgacctacccaatactggaagaccgtttcagtncatccctgggtaccgagctgaggaggctgtggagctcctaaagaccttctacnaacaggagaacccaaatgcnccnaaatcnaaagttcggaananaggattntcagaaatcctgattctgtaatgatcnacgtctagtacagtttggagacctggacagaattcctgaccgaganccnctgacgtcgctggtcacgtttatatg

SEQ ID NO: 5040 - DNA, 439 bp, Mus musculus
  misc_feature (389)..(389): n is a, c, g, or t
  misc_feature (410)..(410): n is a, c, g, or t
tgaggacccacctgaagacagcctaaagatcatagagagcaccctagacagcctggacctggggctcacctacaaccctctgcatgttgggagccacttgtactcacatctgagcagcgcccatgccaagcctcagggacggctctacacaagctgcgcaagccggggccttagaaaggggggtcagctgcagaccaacagagttcgagccgcagtggttcccctcccagtggctcctgccccacgtagagctctgaagatgacagcagccagcaaagcatcctcagcagccttcctgccttcggattcggaggagggagaggaggagcgtccttctcacacctaagtccccggtgccagcacacagccatgcactcacccgatggctntctgggggcagatctgcctgntcccaacctgtgcctgtaaatgagctccg

SEQ ID NO: 5041 - DNA, 406 bp, Mus musculus
gattagtgatctggcagagctggccaaactgcgggacctgcccaaacttcgagccctggtgctgctggacaacccatgtgcggatgagaccgactaccgccaggaggccctggtgcagatggcgcaccttgagcgcctggacaaagaattctatgaggatgatgaccgggcagaggccgaggagatccgtcagaggctgaaggaggaacaggatcaagatctcgatccggaccaggacatggaaccgtacttgccaccagtttagtggctcttccagcctgcagggacagtaaaggaagccatggacactggccccaagaactgataagactccagtgggggaccaccacattcatagccccgtcacaggaagtgggagatgctcctttttgtcccagactggaaa

SEQ ID NO: 5042 - DNA, 386 bp, Mus musculus
  misc_feature (101)..(101): n is a, c, g, or t
  misc_feature (316)..(316): n is a, c, g, or t
  misc_feature (319)..(319): n is a, c, g, or t
  misc_feature (321)..(321): n is a, c, g, or t
  misc_feature (332)..(332): n is a, c, g, or t
  misc_feature (340)..(340): n is a, c, g, or t
  misc_feature (342)..(342): n is a, c, g, or t
  misc_feature (344)..(344): n is a, c, g, or t
gaagcgaaaccctagttctaagcttcccaagagatcttcacactctttactttgttctctttctcgttcctgttgttgctgtcgctgtcgttgttgctgtnactgtcgttgctgtcgttgttgctgtagtcgttctcgtcgttttcgtagcagaactacattaagggtgagagatcccaagttctttcagattacggagaagggggagcaatcacttcaaagaagaattaggagacaattgacgcggagccaactggagctgatcgaaccggaaccgaccatggctttggagccaagcgagattacagtggcattnttntntcataagaatnccaatgtntntngatccagaggaagttccaccatgccttgacagtgacccattt

SEQ ID NO: 5043 - DNA, 476 bp, Mus musculus
  misc_feature (32)..(32): n is a, c, g, or t
  misc_feature (37)..(37): n is a, c, g, or t
  misc_feature (66)..(66): n is a, c, g, or t
  misc_feature (86)..(86): n is a, c, g, or t
  misc_feature (88)..(88): n is a, c, g, or t
  misc_feature (91)..(91): n is a, c, g, or t
  misc_feature (99)..(99): n is a, c, g, or t
  misc_feature (151)..(151): n is a, c, g, or t
  misc_feature (208)..(208): n is a, c, g, or t
  misc_feature (250)..(250): n is a, c, g, or t
  misc_feature (322)..(322): n is a, c, g, or t
  misc_feature (367)..(367): n is a, c, g, or t
  misc_feature (371)..(371): n is a, c, g, or t
  misc_feature (375)..(375): n is a, c, g, or t
  misc_feature (386)..(386): n is a, c, g, or t
gaagatctcagactttgggtggtctgtgcatnccccntctctcaggagaaagacaatgtgtggganctctggactacttgcccccngnaantgatagcncagaaaccgtacaatgagatggttgatctgtggtgcattggggtgctctgcntatgagctgctggtggggaagccaccctttgagagcagcacctccagtgagacatanagacgcatccgccaggtggattttaagtttccttcatcagtncctgcaggagcccaggacttgatctccaagcttcttaggtaccatccttcagagcggctgagcctggcccangtcctgaagcacccctgggtcagggaacactctcgaagggtgctncctngctntgttcaggggncttcctgagccctgtccatctctatccctatgtatttcttcaggaaggtctccaggctctgtttgttagtgcatgtggttcgcttgtttt

SEQ ID NO: 5044 - DNA, 574 bp, Mus musculus
  misc_feature (218)..(218): n is a, c, g, or t
gtttatggacacactgtgcccaggtcccccaaagaatgctcagacaaaggccacagctggagactgaggagacagtggaggaagagagagcagcagatgaggaagagaggagaaagactgaagctctgagcgagatcgaggttctgagggaggcccaggagcccagtggtcccctcatgctgtcttcagagctctccctagaagcagcagaagatganaagtctcgtactagcctcatccccccagaatggtgggcctggtctgaggaggggcagcccgagccccctgcactgcccatgctgcctgaacttcctgaagtgcccatggagatgcccccaaggcctgaactctcttcagaggctgtgctcagggcagtagcactgaaactgcaggccaacaaggagctggacttcagcagcctggtgccccctctcagcccccgaaagttggcttctcgggtcttctatctgctcttggtgctgtccacacagaagatccttcttgtggaacaacagaagccatatgggcccctcctgattcgtcctggacccaaattcccctgagcaagttcatt

SEQ ID NO: 5045 - DNA, 553 bp, Mus musculus
  misc_feature (67)..(67): n is a, c, g, or t
  misc_feature (253)..(254): n is a, c, g, or t
  misc_feature (269)..(269): n is a, c, g, or t
  misc_feature (327)..(327): n is a, c, g, or t
  misc_feature (352)..(352): n is a, c, g, or t
  misc_feature (371)..(371): n is a, c, g, or t
  misc_feature (383)..(383): n is a, c, g, or t
  misc_feature (402)..(402): n is a, c, g, or t
  misc_feature (414)..(414): n is a, c, g, or t
  misc_feature (469)..(469): n is a, c, g, or t
  misc_feature (484)..(484): n is a, c, g, or t
aagccttcagttgtttttctcaccttattgtgcaccagagaattcacactgcagagaaaccttatgnactgcagcgaatgtgggaaagcctttagtcagctatcttgccttattgtccaccagagaattcatagtggagatctcccttatgtgtgtaatgagtgtgggaaggccttcacttgtagctcatacctactcattcatcaaagaatccataatggggaaaagccttattcgtgtaatgagtgtgggnnggccttcagacagangtcgagcctcactgtccaccagcgaacccacacaggagagaagccctatgaatgtgcnaagtgtggtgcagcttttatttctnactcacacctcatgagacntcacagaacccntcttgttgaatagcaaggnaagagtacgatnccctgcttttgggtcataacctactgctcctaatagtaggcacttctgttctttnttcttccttttgacnaaatgaggactataccctttaaagttatttttctggaaggtaatgtaaacacacattcagaggctaatt

SEQ ID NO: 5046 - DNA, 307 bp, Mus musculus
  misc_feature (91)..(91): n is a, c, g, or t
  misc_feature (142)..(142): n is a, c, g, or t
  misc_feature (153)..(153): n is a, c, g, or t
  misc_feature (189)..(189): n is a, c, g, or t
  misc_feature (214)..(214): n is a, c, g, or t
  misc_feature (219)..(219): n is a, c, g, or t
  misc_feature (240)..(240): n is a, c, g, or t
  misc_feature (252)..(252): n is a, c, g, or t
aagatcaggaggcaatagagctacagattgagcaagattttgccacagctccagagccctcagagcaggatgcctctgggaggcaggagantctggctccgaggccagcttctgagacagagccacagggagacaagcaacnccgagaggatnctgagcttgtgaaaggagcagttctggatccctttnaaccaaaagccacaatagagctgcntccgnctttacatcaagctgtgcccncatcagatggtncactctcacctgtagatgttactgcagatgaggcgacaggtgtggctgcagatga

SEQ ID NO: 5047 - DNA, 541 bp, Mus musculus
agcagacacttcagaccatcaagtctgagttggaaatggtacaagaagatctgtctgagacgcagaaggataagtttatgcttcaagccaaagtgtctgaactgaagaacaacatgaagactctgctgcagcagaaccaacagctcaagctggatctccgccgcggtgcagccaagaagaaagagccaaaaggtgagtccaactcatccagtcctgcaacacccatcaagataccagattgccctgtcccagcctcattgctagaggagctgctgaggcccccacccgctgtgagcaaggaacccctcaagaatctcaacaactgtttgcagcagctcaagcaggaaatggacagtctccagcgccagatggaggagcataccatcactgtgcatgagtccctgtcctcgtgggctcaggtggaagctgccccagcagagcatgcccatccccggggagacacaaaactgcataatcaaaacagtgttcccagagacggggctgggccatatgaccactgttgtcctcatcacacaagtat

SEQ ID NO: 5048 - DNA, 543 bp, Mus musculus
  misc_feature (389)..(389): n is a, c, g, or t
  misc_feature (480)..(480): n is a, c, g, or t
  misc_feature (512)..(512): n is a, c, g, or t
attcagctcagtgcccagcatcagtctgctgacgtagttgacaagttaaacgacttgaatagctcagtgtcccagctagaattgaaaagcctgatatccaagtcagtcagccgagaaaagcaagaaaagggaagggctaacctggcccagctgggagccttgtaccagtcctcctgggacagccagtttgtgagtggcggggaggagtgcttcctcatcagtcagttttgttgtgaggtcaggaaggacgagcatgcggagaaggagaacacctacaccagctatttggacaagttttttagcaggaaggaggattccgaaatgctagaaactgagccagtggaggaagggaagcgtggggagagaggccgtgaggcagggcttctgancggcggtggggagttcctcctgagcaagcagctggagtccataggcaccccgcagttccacagcccagtggggtccccactcaagtccatncaggccaccttgacaccttccgctatgaaatnttcccctcaaatccctcacaagacatacagc

SEQ ID NO: 5049 - DNA, 538 bp, Mus musculus
  misc_feature (49)..(49): n is a, c, g, or t
  misc_feature (96)..(96): n is a, c, g, or t
  misc_feature (113)..(113): n is a, c, g, or t
  misc_feature (118)..(118): n is a, c, g, or t
  misc_feature (401)..(401): n is a, c, g, or t
  misc_feature (447)..(447): n is a, c, g, or t
  misc_feature (466)..(466): n is a, c, g, or t
tgctggtgtacttcgtggtcaggaccgtcaggatgagaagaagaaaccngcaagactaggaggtacggtgttttggatacgaacatagagaacatnggaattgacacctttangagcnaagacgatgaggatgatgacaacacattgtttgatgccaatcatcctagaagatgagtatgtgcctttcatgagaagatttccatatttctactgaagaacagagtttctatgtctaaggaataagaagccactctatcaaggggaggggaatttaagttacatacattatgtcaacctttaatttgttgatactcaatccatagtgcatcatttggttacaactttgtatatttggaactgctgtatttattagtgtgctctgtgttattagggacaaactntactatgctggattttctgtttgaaaattattttaaaactgttttntgcagagcttttgtccctntcttttaccatattattgtaacttggctttctttattaatccattgttgttgctttcgttttgtcagtgtca

SEQ ID NO: 5050 - DNA, 515 bp, Mus musculus
gacaatggagacgatgccccacagaacgccaagaaagccaggcttctgcctgaaggggaggagacagtggaatcagatgatgacaaagatgagcgggcatctaagattcgcagagtggagccaggagaagcagccaagaagaagaagtagagaattgtgactcctgagatgtgtcgttgagtggagtgtttgcttttgtgcgttactatgacagacatctccatgaacgtatttatgttaacgaactaatgagtgtcgcctcaagactttccactgtagaattcactttttttatttaaaacctgtacgtatttacaactctaatggtgacctgtgattgtgaactgacagtacttggaagcattctggttatcacaaaattggtgacaggctttgagagtttgtcacatggacatgccaatgttctatgaaccttttataaaggaatatatttttaaagtaaatatattgtattgtactgtgaacttgtgggtgcttttcattagtatctgtac

SEQ ID NO: 5051 - DNA, 254 bp, Mus musculus
  misc_feature (33)..(33): n is a, c, g, or t
  misc_feature (166)..(166): n is a, c, g, or t
  misc_feature (186)..(186): n is a, c, g, or t
  misc_feature (199)..(199): n is a, c, g, or t
tggttatttggagagcctcgggccaacagaganggccatctgagccaaaacctccacacagacatcatggccaagaaaatgcaaaggcgaagaagacagaaaagaacccgctcccagagaggtgagcttcctcttagccttgtagatcgtttcctacgagaggaantccattccagtcgcctgagntcttccgcacttncattcctcacgagtgtgctcgagtacttaacatcgaacatcctcgaactggctgg

SEQ ID NO: 5052 - DNA, 262 bp, Mus musculus
gtaccctctgtacactatcgtgttcgtttattacgctttctgcttagtattgatgctgctgcttcgaccactactggtaaagaagatccagtggcacctatacgtgtcaaaccagctggaaagcatgtatgcggccctctacttcttcccgggtttgaccgtgctgcaagcagttgcaggaggcctcctatattatgccttcccatacattgtgttggtggcatctttggctaatctggctgtttatctggtttttgccaaa

SEQ ID NO: 5053 - DNA, 193 bp, Mus musculus
  misc_feature (87)..(87): n is a, c, g, or t
agcactagctgctgtactcagctctatagacagccactcccaagcaggctgctgaggaggattgtccacatggaactgcaggaggcngatggggactgtcacctccaggctgtcgtgcttcacctggctcggcgcagtgtctgtgttcatccccagaaccgcagcctggctcggtggttagaacgccaaggga

SEQ ID NO: 5054 - DNA, 484 bp, Mus musculus
  misc_feature (156)..(156): n is a, c, g, or t
gagccaggttcagcatttcggaactgggcatcaagaatggaatggaaactttgggcatcgaagacagcaagcatatattcctactagtgttaccagtaatccattcacgctttctcatggaagtcctaaccacacagcagtacatgcccatctggnctggaagtacacacctcggaggacagcctactctgcttccatacccatcatcagcctccctcagtagtgctgcacccgtggcccacctcctagcctctccgtgtacctcaagacctatgttacagcatccaacttacaatatctcccatcccagtggcatagttcaccaagtcccagtgggcataaacccccgcctgttaccatccccaaccattcatcagactcagtacaaaccaatcttccctccacattcttacattgcagcatcacctgcgtatactggatttccattgagtccaacaaaactcagccagtatccatatatgtg

SEQ ID NO: 5055 - DNA, 303 bp, Mus musculus
aagcctttggacatagctcatctcttacctaccatatgagaactcatacaggtgactgcccctttgaatgtaatcaatgtggtaaggcctttaaacagattgaaggccttacccaacaccagagagttcacacaggggagaaaccctatgagtgtgttgaatgtgggaaagcctttagtcagaagtcacacctcatcgtacaccagagaactcatacaggggagaaaccctttgaatgttatgagtgtggaaaagccttcaatgcaaaatcacaacttgttattcatcagagatcccacactg

SEQ ID NO: 5056 - DNA, 303 bp, Mus musculus
gcagaggtcataaaggactcacctgattctccagaacctccaaacaaaaagccccttgttgaaacggatgagacaccacacatggaaaagtctaaagggccagtgtccttattatccttgtggagtaacagaataaacactgccaattccagaaagcaccaggagtttgctgggcgtttgaactctgtcaataacagagcagagctgtatcaacaccttaaggaggaaaatgggatggagacaacagaaaatgggaaagccagccgccagtgaagagtgacttgagaaaccaaatttagaata

SEQ ID NO: 5057 - DNA, 505 bp, Mus musculus
  misc_feature (139)..(141): n is a, c, g, or t
  misc_feature (156)..(156): n is a, c, g, or t
  misc_feature (160)..(160): n is a, c, g, or t
  misc_feature (176)..(177): n is a, c, g, or t
  misc_feature (192)..(192): n is a, c, g, or t
  misc_feature (341)..(341): n is a, c, g, or t
  misc_feature (345)..(345): n is a, c, g, or t
  misc_feature (356)..(356): n is a, c, g, or t
  misc_feature (390)..(390): n is a, c, g, or t
  misc_feature (433)..(433): n is a, c, g, or t
agggccagtgtccttattatccttgtggagtaacagaataaacactgccaattccagaaagcaccaggagtttgctgggcgtttgaactctgtcaataacagagcagagctgtatcaacaccttaaggaggaaaatggnnnggaggttggactgantggnaggaccccgaactgcnnatccctttcttaaantgcccacgttctcctgttgtgaataggatggagacaacagaaaatgggaaagccagccgccagtgaagagtgacttgagaaaccaaatttagaatattgtgaaaaatattttgggcagaatttgatataagtacttttacagcaagatngtanagctatgttgnctggactggttttttacatttttagagaatttcnatgaattatcttttttgtactaattctgagattggcagagtcnaaatatatacattggagatttgccctcccagaccacacagtttattttatggtaaaaggtgttccctctgga

SEQ ID NO: 5058 - DNA, 510 bp, Mus musculus
actcatgaccagctgtacttctatgcccatctgggctaccaactgggtgagcctgtgcagggtttggccttcaccaaccgtcgactgtccaccactgtcctacgtgccttctctaagccaccctgcccccagccaccctgcaaggagcctatcctagctgcccaagctgtcccaaggagctccaagggacccccattgccaccacctcctcccctaccccagtctctgaccgcctcaccgcctccttcacccgagccccttcctcaaagcccactagagacatgctatcgagatctgaaggggtgccctatattctggatggaaaaagacatctgatggctctgtctctctgggacactggattgcccagaacagagccagcctcagcccacaggccatacttcagcccccacaaccccctgtggacaaccttaccctgtgtatctttcatgggtcccagcaggccagggggtggctttggagctctggctcagagctgtcagtgtggct

SEQ ID NO: 5059 - DNA, 320 bp, Mus musculus
  misc_feature (113)..(113): n is a, c, g, or t
atgaaggccagacagctctgcacgaggcatgctttggaggcagagaagcgatcatcagtctcttgctggaatttgaggcaaacgttaacattttaacaagaaatggggagtcncccatttacatgtaccttcagcgcagttccaacatcagagacagatcgcttctggccagactactttaccgcacttatcctttaagactgagcaataaacaggggattctaccagcaggaatcatgctgccagaataccagctcctaagggaaaccctagtaaagttatcaaaaaaacctttaaccctcgaggccatctgtaagaga

SEQ ID NO: 5060 - DNA, 522 bp, Mus musculus
  misc_feature (183)..(184): n is a, c, g, or t
  misc_feature (339)..(339): n is a, c, g, or t
  misc_feature (381)..(381): n is a, c, g, or t
  misc_feature (386)..(386): n is a, c, g, or t
  misc_feature (404)..(404): n is a, c, g, or t
  misc_feature (430)..(430): n is a, c, g, or t
aaggagcggctgcagtccctagtaaggcagaaggagaaggaactagaagacctgcgggcggtgaacacacagatgtgcagtgagcgggccagcctggcccaggtggtacggcaggagtttgcagagcagctggcagcctcccaggaggagacccagagggtgaaagtggagctcgcagagctnnaggcccgccagcaggtggagctagacgaggtgcaccggagggtgaagacggctctagcgaggaaggaggcagccgtgaacagtctccgcaaacagcatgaggctgctgtgaagcgggcggaccacctagaggaactgctggagcaacacaaaggntcatctctgagttctaagtgacatcgcccttgggatgacganccaancctgaggctgacactcantcctgcggctggtgtccaggtcacgntccaagacacagggctaagggtaggacagcagctggtgtgtgagaggcaccatggagcccagtgcccgggacgttactgtcagcatgcctgc

SEQ ID NO: 5061 - DNA, 339 bp, Mus musculus
tctctgtcaccttgttggtcaaagggccaaataagcatactctcatacagatcaaggacgccttaagagatggactccgtgcggtcaaaaatgctattgaagacggctgtgtggttccaggggctggggcagtggaagttgcgatagcagaagctcttgttaactacaagcaccgtgtgcagggaagagttcgcctggggatccaagcctttgctgatgccttgctcatcatcccgaaggttcttgctcagaattctggttatgacctgcaggaaacactgataaaaattcaaactaaacatgccgaatcaaaagaactcctgggcatagacctgaaca

SEQ ID NO: 5062 - DNA, 508 bp, Mus musculus
  misc_feature (233)..(233): n is a, c, g, or t
  misc_feature (260)..(260): n is a, c, g, or t
  misc_feature (271)..(271): n is a, c, g, or t
  misc_feature (273)..(274): n is a, c, g, or t
  misc_feature (277)..(277): n is a, c, g, or t
  misc_feature (282)..(282): n is a, c, g, or t
  misc_feature (321)..(321): n is a, c, g, or t
  misc_feature (349)..(349): n is a, c, g, or t
  misc_feature (351)..(351): n is a, c, g, or t
  misc_feature (365)..(365): n is a, c, g, or t
  misc_feature (387)..(387): n is a, c, g, or t
  misc_feature (389)..(389): n is a, c, g, or t
  misc_feature (422)..(422): n is a, c, g, or t
  misc_feature (439)..(439): n is a, c, g, or t
  misc_feature (441)..(441): n is a, c, g, or t
  misc_feature (471)..(471): n is a, c, g, or t
aaggaagttggcgaagatgcatcagatgagaagttaaaaaactacatctggaacacactcaactcaggacgggttgtcccaggctatggccatgcagtactgaggaagactgaccctcgctattcctgtcagcgagagtttgctctgaaacatctgcctaaggatcccatgttcaagctggttggtcagctgtacaagattgtacccgatatcctcttagagcaagggaaggntaagaacccttggcccaacgtagacgntcacagtgggntnntgntccantactacggcatgagggagatgaattactacacagtcctnttcggagtgtcgcgggcactgggcgttntntcccagctcatctnggagcagagccctaggcttccntntggaaaggcccaagtccatgagcacggatgctntgatgaagtttgtgaantntgagtcaggataaaatgggagacggggggnggggggggacgactgcccataagaaaacgaggataaa

SEQ ID NO: 5063 - DNA, 325 bp, Mus musculus
  misc_feature (142)..(142): n is a, c, g, or t
gtagaacctgccgtgcttctagtcctccttaacctgtcctttgtgtacctgaagctagaccgacctgccatggccctgcgctatggggagcaggctctgctcattgacaaaaggaacgccaaggccctcttcaggtgtggancaggcttgcctcctcctaactgagtatgagcgggcccgggattttctagtgcgagctcagaaagagcagccctgcaaccatgacatcaataatgagctgaaaaagctgtccagccactacagggactatgtggacagagagagagagatgtgtcaccgcatgtttgctccctgtggaagcaga

SEQ ID NO: 5064 - DNA, 439 bp, Mus musculus
  misc_feature (38)..(38): n is a, c, g, or t
  misc_feature (140)..(140): n is a, c, g, or t
  misc_feature (369)..(369): n is a, c, g, or t
ttaaccactactcaagtcttagaagacatcagaaggtncatactggagaaagacattatacgtgtaaacagtgtggcaagtcttttactaggggctcaactcttagagtacatcagagaattcatactggagaaaaaccntacaaatgtagtgaatgtgacaaatcatttacccaggcctcacaacttagaacacatcagagagttcatactggagagaaaccttatgtatgtaaggaatgtggcaaatcacttactacatgtgcaattcttagagcacatcagaaaattcatactggagaaaaaccttacaaatgtatggaatgtgacagatcctatatccaatactcacatcttaaaagacatcagnaagttcatactggagagaaacataaaattgtaaataatgtgacatagcattcatccagtattctctctgt

SEQ ID NO: 5065 - DNA, 445 bp, Mus musculus
tgtcggtgaacccaagtccatagcagatggttgggaaactgcaagaagactggacagacccccggtgttagaagctagtgagaatggccttctcctggtcccgggttgtgagtgggcagtgttccgattggcacatcctggagtcatcactcaaattgaaattgatacgaagtactttaaaggcaactgtcccaacagctgcaaagtggatgggtgcatcctgaccacactggaagaggaagacatgatcaggcataattggaatcttcctgcccataagtggaagtcgttgcttccagtcaccaagctaattcccaaccaaaatcacttgttggacagcctgaccctggagcttcaggatgtcatcactcatgccatgattaccattgcccctgatggcggtgtcagccgccttcggctcaagggtttccctagttccatctgt

SEQ ID NO: 5066 - DNA, 382 bp, Mus musculus
  misc_feature (197)..(197): n is a, c, g, or t
aattggattcttctgatccccttaaactgaatgatccatttcagcctttcccaggcaatgatagtcccaaagaaaaagatcctgatatgttttgtgatccattcacttcttctaccactaccaataaagaggctgacccaagcaattttgctaacttcagtgcttatccctctgaagaagatatgattgaatgggcnaaaagggaaagtgagcgggaagaagaacagaggcttgccagactaaatcagcaggagcaagaagacttggaactggccattgcacttagcaaatctgagatctcagaagcatgaagagttatctgtcctttgtcagcagtacagtgctctctggaacactgaagctatttaccatgtgcatcaaa

SEQ ID NO: 5067 - DNA, 469 bp, Mus musculus
aatgtgctgtgtgggaatattcctcctgatctatttgctagaatgacagcagaggaaatggctagtgatgagctcaaagagatgaggaaaaacctgaccaaagaagccatcagggagcatcagatggccaagactggtgggacccagactgacttgttcacttgtggcaaatgtaaaaagaagaactgcacttatacacaggtgcaaactcgtagtgctgatgaaccaatgacaacatttgttgtatgtaatgaatgtggaaatcggtggaagttctgttgagtttggaagaattggcaaagtatctggaccattaagaaaaacttaattttgttaattagctttaaaattaagccaggcaactcgtttccttgcaagtgaaatttgtaaacaacatacatctcatgggttggtctttgttgttcacctgacagtcttgtcttaaatgccttctgtggtctcagatcag

SEQ ID NO: 5068 - DNA, 303 bp, Mus musculus
  misc_feature (268)..(268): n is a, c, g, or t
tggatctggcgagtgtgctgaccccagagatcatggctcccatccttgccaatgcagacgttcaggagcgcctgctgccctacctgccctctggggagtctctgccccagactgcagatgagatccagaacacattaacctcgccccagttccagcaggccctgggtatgttcagtgcggccttggcctcaggacagcttggccctctcatgtgccagttcggccttcctgcagaggctgttgaggccgccaacaaaggtgatgtggnagcatttgccaaagccatgcagaacaatgccaaat

SEQ ID NO: 5069 - DNA, 482 bp, Mus musculus
  misc_feature (437)..(437): n is a, c, g, or t
  misc_feature (439)..(439): n is a, c, g, or t
  misc_feature (442)..(442): n is a, c, g, or t
gtacgcaccaagagtcgtgaccgcagcccagcagaaagctgggaagacaattacagcccggatcacaggtcggtctgattttggttccaaagctagaatcaacagcagtttggcgataatgggagtctctcctcccatgggctcagtcgttgtggagaaacatcatccagtcacagtgcaaaccattcctcaggcaactgctgccaagtacccacggaccatccatcctgaaagcagcatctccgcttctaggtctctcggagccaggccgggccacgcccagtctctctcagttcagtcgataaaagtggttgactagaggggctgtgttcacactcatggctatgagtcctctgataaggactttcctgggagcagcaagcttcttggttttgacttttctgtactgtcagagcatcatggacatatcatgtgcntnttntcagaattacaagagacttccccatcctttgtaactgtat

SEQ ID NO: 5070 - DNA, 497 bp, Mus musculus
ggacttcccctatggtcaatatggttacgggcaggacttgagtggcttcggccagggcttctcggaccccagccagcagccgccctcctatgggggcccctctgtaccaggttcggggggtccccccgctggcggcagtggcttcggacgcgggcagaaccacaacgtgcagggcttccatccctaccggcgctagccaggggcatggcggcggggcaggcaggattcgggactggtgaacttgtgacaatcacactcgggacaaaataaatgaccactcgacctggggggaggggcagcggaggccgcatctggactgaggttttaaatatatttcttttctctgacccatcagcacaataaaaacacgtcactggttcaacaacagggtttaaaaaacgccttcagctttaattcagaatttcaggtttctttttcttcttccttttttttcctttttttgagattattttcttgagccttttgttttatggtat

SEQ ID NO: 5071 - DNA, 366 bp, Mus musculus
tgtgtatgcacctgaagacgatccagagatgaaggtcgagcggtacaaacgcacctttgaccaaaatgaggagctcgggctcaatgacatgaagacagagggctatgaggcgggcctggccccacagcggtagcagtggccagctcactggccagctacagtgccactcacactgcagggttatctgttactgtggggaactgacgaggagtgctcaagccctcgtccatggtgaagaggttaccacttgagttagaaatgtaagcacccaagattagcagctgacggacgaggcagctgcagccctactgtgctccttgaccttcttttggaggttttaaagtcggcgtgagaagaatcccagaa

SEQ ID NO: 5072 - DNA, 518 bp, Mus musculus
  misc_feature (372)..(372): n is a, c, g, or t
  misc_feature (374)..(374): n is a, c, g, or t
tcaagggcccatacgacgacgtgaggatcagtcctgttatctaccactttgtcttcaccaatgagagcaatgagacagactatgtgccgctgcccatcatcgactctgtggagtgcaacaagctgctggccgccaagaacattaacctgcggctcttcctgttccagatacagaagtaagatggacccgggcacctgaggagcagagggctgcagtccggtagtgctgtcccacccatccctggcttggcagcagcttcacacaactatatgatcattttagcaaaggaggagaacaaacagaatcaaacactgagaaagtctgcatgcgtgtgcaaccgggtccctgcctctggctcaccttcctcccctntncctcccacctcctgcaggcagccagaggctgagctgatcacagtggagacagcactctgggcgcctcaggtacaggtggtgaggagggcaagaagccacccttatcccagctcccatcctcacatcgaggtggcacggtggttc

SEQ ID NO: 5073 - DNA, 125 bp, Mus musculus
ctttctaaagcagcaaagcccagcttccatcggccaggtaattcaagagggcggagaggaccggctggttctctgagccctgtgtcggccgggcttaagtcgcatctgcgtaacgtgatttcttc

SEQ ID NO: 5074 - DNA, 469 bp, Mus musculus
aacgtgatttcttctcggaagtgacttattcatcctttgctttcagactagccgtcccttctcagttgtcttggaaatgaagtgaaggcagatgaggttttaaaggtctttttaactgcaggagaggctttcgttgtttgtttagcttagccgtctagtggtgtctcctgagttttatgggaaagggctaagtttgctctctgtaatgtaagcatgtgtccattaagaaccacgtagcttctcaagctgtgaggactgacgggtaatgctcttctcagtctgtctctgacttggaggactcttttaggaactaggagttcgtttgaagaagcttttgtctgaagtcagcagtcgctacagtttcacttcagtttctttctcttctataaaatacaaaccagttaatgttgtgaaaagcaattgtgatgtgatgtgattgcaaagtaaataaagcctgcggtggcctgcc

SEQ ID NO: 5075 - DNA, 538 bp, Mus musculus
  misc_feature (378)..(378): n is a, c, g, or t
agaagtactagtggctcctgctgttcctgcctgtgaagtgcccacttctgttatgactggaagtgtggtggagctacgatgccaggataaagaaggaaacccagctccggagtacatctggtttaaagatggcacaagtttgctagggaatccaaaaggcggcacacacaacaacagctcgtacacaatgaacacgaagtctggaattctgcaattcaacatgatttccaagatggacagtggagagtattactgcgaagcccggaactctgtcggacaccgcaggtgccctgggaagcgaatgcaagtagatgttctcaacataagcggcatcatagcaacggttgtggtggtggccttcgtgatttctgtatgtgnccttggcacatgctatgctcagaggaaaggctacttttcaaaagaaacttccttccagaagggcagtcctgcatctaaagtcactacgatgagcgaaaatgatttcaagcacacaaaatcctttataatttaaaagaattccagttttgagctgcaccaa

SEQ ID NO: 5076 - DNA, 489 bp, Mus musculus
  misc_feature (89)..(89): n is a, c, g, or t
  misc_feature (227)..(228): n is a, c, g, or t
  misc_feature (250)..(250): n is a, c, g, or t
  misc_feature (256)..(256): n is a, c, g, or t
  misc_feature (277)..(277): n is a, c, g, or t
  misc_feature (345)..(345): n is a, c, g, or t
  misc_feature (432)..(432): n is a, c, g, or t
  misc_feature (464)..(464): n is a, c, g, or t
gagtcttctgagtaaggcgatgcttgatatgcaaaagctgaaggaccataatggcaataaaatcgcccagagcaagccaaggagcaacngctatgacattctcaccatactgcctaatgaaaacataaacagagatccaggaaatccccaagatgaagaattcttggactgtcacacagagaatgactattatgtccggaaaattggcaaaatggaaacatggctcnntgaacaagaagcccggggacancttttntgggacagttccagctccgantctgatgagcttgagaaagatgagaggagaccacaagcactggtgaggaccaagacagagaagatccntctttatgatgacttttacgacagtgcttaagaaagctagacgctaccccaggtagtaacggcacagaatgccttgggcttgttttnttccataaaatcattcatatttgcatatggantcctctgagggatataagctatttt

SEQ ID NO: 5077 - DNA, 528 bp, Mus musculus
  misc_feature (34)..(34): n is a, c, g, or t
  misc_feature (71)..(71): n is a, c, g, or t
ttggttgtggctcagcaccgtgatcgcaccaatntcctgtctggcattaagatggcagccctagaagaggncctgaagaagatatttttagcagcaaagaaaaagaaagcaagcgttcatcttccacgaattggacatgctacaaagggttttaactggtatggtaccgaacgacttatccggaaacatttggctacacgaggcatcccaacttacatatactactttcccagaagtaaggcccgccattcacagcctgcatcctcctcctcagcaccactggttccctagcaaccagcccagcattgggtccagttttcagcaaccagttagattcttgctcccagattgactgttagttttcaggaaacaaggctatctttggtcatattctctgctctggaatttctgggctagtctttcctgaattctaattttgttgctctggaagtgttaactgtgatccagtacctgtaatacaggaacacacaatgtatatggggaagccctttggcttcagattgccta

SEQ ID NO: 5078 - DNA, 547 bp, Mus musculus
gctgctgaagatcatctgctacctggacctggaagatattgccagcctctcccagacatcaagcaagtttgagaagttgtgcaagagtgacttgctgtgggaacagatagtccagtccacctgtgacaccatcacccctgacatgcgggccttggcgaaaaacatgggctggaggcagatgttcctcaccaacaacatccagctccagaggcagacccgcaagaagaagcaaagacaggaaaaccaggcagagaagcttgcttaggggatggctgtttccaacagcggagccacagtggtccgaatctccaggtccaaagctcactctctcttaacaacaggttctgccgattccagcatcacttgaaaaccagattttgcacacacatgcaaatccacctagtgccttgctcaagcaaccccctcctattgcccaaccagggcccaagtactaagggcttcgagccaggaagtctcttagactaccacctccctgatccccttttgccccaccccccaggaaagaggcacttgtatatgaactaac

SEQ ID NO: 5079 - DNA, 549 bp, Mus musculus
  misc_feature (270)..(270): n is a, c, g, or t
  misc_feature (287)..(287): n is a, c, g, or t
  misc_feature (395)..(395): n is a, c, g, or t
  misc_feature (458)..(458): n is a, c, g, or t
  misc_feature (481)..(481): n is a, c, g, or t
gaatcgacaacgtcaagctgagtcagaaatgtgggcttctgggtaaggaatcactcctccgagacttggaagaaaaggtggagaagacagaaatgctcaacaggcgcctggaatccctgaagcgccatcatgccgggctcgccttgtcctgcaaaggggtgaagcaaaagatcagggaagccaaaactttcctcccctcttgacagcccttgacaggacagttggcaaaaacttctgcaaccccagaaactctcttactctcttctgccntctgattgtccattctntggaacttgggggtgcaactttattttttggctgttttccagctttcaaattcctgctgaacacttccagctagcagtagctctacatgagcttaagaaaaatatatntagagagtgcggtgattaaactgacttctagtgaaaagcctttatagccaagtagccccagtntaaaggagtgttagaactgtctnttgcctatgtctaaggatggcttaaatgagtgggcaaggtacagaaaatctctatgcactgatctgat

SEQ ID NO: 5080 - DNA, 489 bp, Mus musculus
  misc_feature (64)..(64): n is a, c, g, or t
  misc_feature (248)..(248): n is a, c, g, or t
  misc_feature (451)..(451): n is a, c, g, or t
  misc_feature (464)..(464): n is a, c, g, or t
tcgactctcagaaggccaagggcatctctggctctgctgggaaggtactggctgtctggagtcnggacgatcagcagtccctgcaggtgaagaagactcatgaactcaccaatcctggaattgccgaagtcaccatccggccagaccacaagatcttagccacagcaggctgggaccatcgcatccgtgtgtttcactggaggacaatgaaaccgttagctgttctggctttccacagcgctcctgtntactgcgtggcctttgctgctgatggcttgcttgctgcggggtccaaggaccagcgtatcagcatctggtcactctacccctgcccatgacttagctgtgggacactgctattttactccagtcttgacccagccctgtggaagatcttcaagtccctctgaggacagcaaattgtggccaaagatccctggggtccactttncttcgtgaggttntctgttccttttgtgactgtcattc

SEQ ID NO: 5081 - DNA, 364 bp, Mus musculus
gagcagacaatttatcccatccagattatccgctactggaactacagccacacagccccacaggatgacctcatgcttattaaactagctaagcctgccaccttcaaccacaaagtccaggttcttcccatagccaccactaatgtccggccaggcactgtctgtacactttcaggtttggactggagtcaagaaaacaatggcaggcaccctgacttacggcagaacctggaagctcccgtgatgacggacaaagactgccagaaaactcaacaaggaagcagccacagaaactccttatgtgtcagatttgtgaaagtattcagccgaatttttggggaggttgctgtagctactgtcattt

SEQ ID NO: 5082 - DNA, 250 bp, Mus musculus
tccaaggtggatgtcggaagcacgtgaacagatggcccaagttcttgtaaacaaagacttggtggagaagaagaaaacgggcttgctggatgaggaaacactatgccccgggattttggaaagggaccctgaattgcctcccacaggctttcgggatgttcctatggaatccccaccagatccgagaaaaccgtgtttttcgacaacgtattctgaagatttcactccacagtatgaatatccaccacct

SEQ ID NO: 5083 - DNA, 461 bp, Mus musculus
  misc_feature (48)..(48): n is a, c, g, or t
  misc_feature (176)..(176): n is a, c, g, or t
  misc_feature (208)..(208): n is a, c, g, or t
  misc_feature (284)..(284): n is a, c, g, or t
  misc_feature (353)..(353): n is a, c, g, or t
  misc_feature (419)..(419): n is a, c, g, or t
  misc_feature (423)..(423): n is a, c, g, or t
aactatgctgtgctgatgtccatgcgctttgatgggcgactggacttnccctggtggttttgtggacgatcgtagccccagcctggaggaagggctgaataaggaactgttgaagaaactgggcgagggagtgtccactttcagcatcttatccaccgactaccgaagctccctcnctgagtccaaatcaaaagtggtggcccatttntatgtcaaatgcctaacactagagcagctccaggcggtggaggctggggcaccacaagccaaggaccatgggctanaggtcttgggcctggtgcgggtacccctgtacaccttgcgggatggtgtgggaggcctgcctgcttttntggagaattccttcattggtgtcgccagggaacagctactggaagccctccaggacttgggaattntggntcccgaaactgcctcagacctcaaggaacgaacagttc

SEQ ID NO: 5084 - DNA, 285 bp, Mus musculus
  misc_feature (157)..(157): n is a, c, g, or t
aatcacaagacccaaagcactgctgatcattctgggaaaccctcatgtgcttgtcagagatccctgttttggagcgctgctagaatacagtgttagcaatggtgtctacacagggtgtgatctgcctcctgaactccaggctctccaaaagtgagcnctccagtccacttcctaaaaggtaaagcaccgtggaggaaagagtgtggctccacgtgttcaccttaagcaggctgtggctagacagctgtgccaggacctgtggacatggtggagtctgctacaaca

SEQ ID NO: 5085 - DNA, 562 bp, Mus musculus
  misc_feature (419)..(419): n is a, c, g, or t
atacaaggcttacctacggtggctggctgatggcggcaaagatcagcgactgccgggactgaacctgacctatgcccagcttttcttcatcaactatgcccaggtgtggtgtgggtcctataggccggagttcgccgtccagtccatcaagacggacgtccacagtcctcttaagtacagggtgctgggctcactacagaacctgccaggcttctctgaggcattccactgcccacgaggcagccccatgcaccccatgaagcgatgtcgcatctggtagccaaggctgagctatgctgcggcccacgccccgccacccagaggcttcgcgaatggtgtagctggcagagatgtgcaggtctttgcctgaaggccaccggagccaccagccagccctccgcgcccagcctagagtgtanccacccgcccacacccgggatgagtggtgccggtcctgcgccccctcaggccagtgagggtcagcagcccaggaagagcagtcagctgccttccaccctctccatagtgtgtggctaaatgttctcgagcttcagacttgagc

SEQ ID NO: 5086 - DNA, 507 bp, Mus musculus
  misc_feature (305)..(305): n is a, c, g, or t
acaaggcgcgcacggtcattcagaccctggaacccaagcagaggccacccactgtggtgtccccagaattccataccttgaggtcacagctctgggagcggaacctgcggatacggcagatggagatggactatgagaagagtcggagacggcaggaacaggaggaaaagctgcttatcagtgcctggtacagcatgggcatggccttggagcatcgggctggggaagagcacgctcctgcccatgcccagtccttcttggcacagcaaagactggccaccaatgctcgccgtggacccctgggncgccaggctctgagcctccgccccactgacaagcactgacaagacctcgacttcctgctgcctgctggagtcttccagtttacatttacccagctgggcctttgaccttgattgagcctgacttctgccctttgcttccttagatgggagagaaggggacaggcaggtagcaggtgtggaactattccttttagcaatgtga

SEQ ID NO: 5087 - DNA, 523 bp, Mus musculus
gcagagatctatgggcccgacagaattctcctaagaccacgagagaaaaagctgggtctcggaactgcctacattcatggaatcaaacacgccacggggaactatgtgatcatcatggatgctgacctctcccaccatcccaaatttattcctgaatttatcaggaaacaaaaggagggtaattttgatattgtctctggaactcgatacaaggggaatgggggtgtttatggatgggatttgaaaagaaagataatcagccgtggggccaattttataactcaaattctgctgagacctggagcgtcagacttaacaggaagcttcagattataccgaaaagaagttctacagaaattaatagaaaaatgtgtctccaaaggctatgtctttcagatggaaatgattgttcgagcaagacagatgaattacactattggtgaggttccaatttcatttgtggatcgagtttatggtgaatccaagttgggaggaaatgaaatagtctcgttcctgaaagggt

SEQ ID NO: 5088 - DNA, 547 bp, Mus musculus
  misc_feature (74)..(74): n is a, c, g, or t
  misc_feature (102)..(102): n is a, c, g, or t
  misc_feature (108)..(108): n is a, c, g, or t
  misc_feature (111)..(111): n is a, c, g, or t
  misc_feature (116)..(117): n is a, c, g, or t
  misc_feature (120)..(120): n is a, c, g, or t
  misc_feature (141)..(141): n is a, c, g, or t
  misc_feature (182)..(182): n is a, c, g, or t
  misc_feature (219)..(219): n is a, c, g, or t
  misc_feature (318)..(318): n is a, c, g, or t
agcagcagagctatggtccttcgcagggcggtccaggtcctcagtatcctaattatcctcagggtcaaggtcancagtatgggggctatagaccaacacagncaggancancccanncanccccagcagaggccttatggngtacgaccagggacagtatggaaattaccagcagtgaaaantgtccttacattccaatagccagtacctattagcagncacgttgtcacagcactgcaccatggacacccccctgggaagactccttccattccagctaggtttttgggaaaacctttggctaagtggctgcttcgncagcaagtagctgttatggtttagtttgtaaaggcttcgtagctaccgatgcacctgatttcacgtttctactctagatggcaacattggacagaaaatgcattgacgtgaggagtttgcagcggtttcagaactgtgctgcaaatggactgtcacagcctgaaaggtgtgagcagctgggtgtgtgttcgcggagcttcagggggtttcatacttttccaccgattat

SEQ ID NO: 5089 - DNA, 524 bp, Mus musculus
gctccaagacttgtcacatctgttggacacctggcatatgggcataccacaacagtccttaatagagtggccacattggttcccagtgtcctgaagccaccagtcagagctctaacatactgcagcacacggaaaggcaagagaaagacggtaaagtcggtcgtgcatcgcttcctccgacttcattctggcctttggctaaggagaaaggctggctataagaaaaaattatggaaaaagtcaactgcaagaaagaagcgcttgagggaatttgtgttctgcagcaagacccagagtaaactcctggataaaatgacgacatctttctggaagaggcgcaactggtacgctggcgatccttaccagatgtaccacgatcgaacaaacctacgagtatagttcagagctatcatagttcccagctatggaatgtgggtctttgtgtacataatgcccttgcaaagtgagtatgcgttaaactgtaaactgtaccagctgatcggcaagcttagattaccaccatt

SEQ ID NO: 5090 - DNA, 561 bp, Mus musculus
  misc_feature (403)..(403): n is a, c, g, or t
  misc_feature (422)..(422): n is a, c, g, or t
  misc_feature (447)..(447): n is a, c, g, or t
  misc_feature (449)..(449): n is a, c, g, or t
  misc_feature (451)..(451): n is a, c, g, or t
  misc_feature (484)..(484): n is a, c, g, or t
  misc_feature (512)..(512): n is a, c, g, or t
aagagaaagagcatgtccggaacgggccttagatcttgaaaatatcatgaggaggttttctggtagctgcagatgctgttcaaaaaagattatattttaaccaataatttacagattaaattctatcgcatgagacatcattacaaatcttgtaagaagtatcaggatgaatatggtgtttcttctgtcattccaaactttaagatttctcaagattcagtaaggagcagtaataggagtgaaacatctgcatctgataacacagaaacttatcaagaggatacaagttcttctgggcatcctacctttaagtgtcccttatgtcaagagtcaaatttcaccagacaacgtttattggatcactgtaatagtaaccacctatttcagatagttcctgtgaatnttcagctagatgaggaaancccaatatcaaactgctgtggaagnantnttttcaagtaaacatgtgacatgtatagacatntctgcctccttgcaacctacaagtgccntctttaaggagaagacatgaagtcaccattttcagtaatttgctgtgca

SEQ ID NO: 5091 - DNA, 532 bp, Mus musculus
ataccacagttctttgtagtcagtatttctcactgggtgatgaaacttttcagccagtgaatgatacattcaattagttttttaaaaatccaaagttgcagatgtatgtggatatgtacatagacttttgcatgtatatatacacatatatatctttgcctagagtttgtcaggttatgtatagaatttctattaaaaagttttaataatggacaagcaatataggattgaagtatttatctcctttgtttaaaattttgtatgttaccaagtttttaaaacagtaagccaaatactatgtggtacagttggctgttattacacctgaaaaatgttaaatggtgctcacttgttacgtttgaaaatgatgcataactgacgtgtggtgagagattttaccagctactgtttcactacattttagtcaaaacaaagtttgttcttaatctttggtataaagtgttgtagagaaggccaagtcacaaagtaaagggtgaagggggaattctgacattccacactaacataacac

SEQ ID NO: 5092 - DNA, 577 bp, Mus musculus
  misc_feature (436)..(436): n is a, c, g, or t
  misc_feature (440)..(440): n is a, c, g, or t
  misc_feature (551)..(551): n is a, c, g, or t
aactccgtgtcgaccagctaaagtatgatgtccagcacttgcagactgccctcaggaactttcagcaccggcgccaagtcagggagcagcaggagagacagcgagacgagcttctgtctcgcaccttcaccactaacgactctgacaccaccattcccatggatgaatcactgcagtttaactcctccctccacaacattcaccacggcatggatgacctcattggaggcgggcacagtattctggagggactgagggcccagagactgaccttgaaggggactcagaagaagatccttgacattgctaacatgctcggcttgtccaacacagtgatgaggctgattgagaagcgggccttccaggacaagtacttcatgatcggtgggatgctgctcacttgtgcagtcatgttcctcgtggtacagtacctgancatngagccagctgtacccagcactggacagccttcccattgtgtgcgcatgtgcaagcaagaagtgggctgggaggcccttttgaaatgtatgccttaactgtgaagacacctnctcccctcaggactaatcgtggctta

SEQ ID NO: 5093 - DNA, 399 bp, Mus musculus
aatgtggttttgacagtcctttctgaagcctggatgtagaaaactgcagatcggcttgtcttactccatttaggacggaagaccaggagaaggacgcacctgagcactgacgtgcagagtgacagctggaccaagggttgaaacctgtgcttgcctcagatcagctgatagctgtagtatcttacaaccattttaacatggggccaagccttggggggcttgagatagaggggcagcctctgccctaccattggttacgttctggcacagccctttcccagtccggcatccttttcatagccctggatccgttggaaggtttacctaagttaactgcaaaaggcttgaactgaaataggttgtgttgtccacttagatgttccccattttctggttcca

SEQ ID NO: 5094 - DNA, 561 bp, Mus musculus
tttgccgttggttcacaatgtcatcaaatgcatggacaaggacagcccggatctccaccaggacctgaacgccctcaaaaccaagttccaggagctgcggaagctcatcggcaccatgcccggcatccacgtgagccccgagcagcagcagcagcagctccacagcctccgagagcaagtgaggaccaagaacgagctgctgcagaagtacaagagcctctgcatgtttgagatccccaaggactaggccagcccccaggagagccgccgccagacggaaagcatcacgcggtgctccagctccttgggagccccgctcaaaactgggaggccacattcagctggtgtggggcctcagtgctatctcagccctgaccatgtcccagcagatctacagggcacagagggagaggaaatagctgttcccttctttccctcagctcctcccactcccgatagcatcagcatggtatcaggtacatactgttcccattaacagcagtttcatgaaacatttgcatagaattcacggggtaaattaggcctgtactcagatggcat

SEQ ID NO: 5095 - DNA, 387 bp, Mus musculus
  misc_feature (229)..(229): n is a, c, g, or t
  misc_feature (235)..(235): n is a, c, g, or t
  misc_feature (250)..(250): n is a, c, g, or t
  misc_feature (272)..(272): n is a, c, g, or t
gtgtcatttgcaacccagatgtaaaactctaatgatttggccatgaggcgctgctattataagcagctggaaatgaatattaatggcagagattaaaagtattccatgctcagtgtttttattgtcctgctccagctagtgtgcttttagagttttcgccgcagactacatttctagtgttagagaaacctgctttttgaggctattgtcctttgttccttcatgtatnatattnatagttttttttttnaggattagtgtgattttttttnttgcttcttttctatttctttcttgtttttctttctcccccccccccccttcagttaactactttttaattgcaattctaggtaattgtgcatcgtgatgtgattgcttggctat

SEQ ID NO: 5096 - DNA, 362 bp, Mus musculus
  misc_feature (69)..(69): n is a, c, g, or t
  misc_feature (71)..(76): n is a, c, g, or t
  misc_feature (79)..(80): n is a, c, g, or t
  misc_feature (82)..(83): n is a, c, g, or t
  misc_feature (86)..(90): n is a, c, g, or t
  misc_feature (92)..(107): n is a, c, g, or t
  misc_feature (109)..(114): n is a, c, g, or t
  misc_feature (116)..(116): n is a, c, g, or t
  misc_feature (118)..(120): n is a, c, g, or t
  misc_feature (229)..(229): n is a, c, g, or t
ctcttctactcctttttcaagtctcttgtgggcaaggatgtagtcgtggaactcaagaatgacctgagnannnnnnganncnnccnnnnngnnnnnnnnnnnnnnnntnnnnnncnannngtcggtctagttttgatttttccctccacgctgatttcagcataaaccaatgcttcttccctctttgcccttgacagcatctgtggaaccctccactctgtggaccagnacctcaatatcaaactaaccgacatcagtgtcacagaccctgagaaataccctcacatgttatcagtcaagaactgcttcatcaggggctcagtcgtccgctatgtgcagctgccagcagatgaggtggacac

SEQ ID NO: 5097 - DNA, 201 bp, Mus musculus
ttgcgggggtgaatcctcagctgcagagtccagaagtcagatttcagcaacaactggaacaactcagtgccatgggattcttgaaccgtgaagcaaacctgcaagctctgatagccacagggggcgacatcaatgcagcaatcgaaaggttgctgggctcccagccgtcatagcagcatctctctatcctgagaaaatgta

SEQ ID NO: 5098 - DNA, 263 bp, Mus musculus
gctggccaagtttgccgaagatgaccgcattgagctcatgaatgcccagaaacagcgaatgaagcagctggagcacaaacgcgccgtggagaaactcattgaagaacgccggagccagttcctcgcagacaaacaacgtgagctggaggaattgcaactacagcaaaggcggcagggctgcatcaatgagattattgaagaagagaggctgagactcctcaaagaacatgctgcaaagttactaggctatctccccaaaggag

SEQ ID NO: 5099 - DNA, 279 bp, Mus musculus
ggcatcaatgtaactatttccatgtgttgaaacggcaatcaaatatttctggccagtgtttaaaatttgcatttgacttcacagagaataagccacccatctgcctgccaacctaaaacattcctggtaggtagaagctagacatgaaggtaaagaaaaagaaaagctgttaatacaggaaacagttgcatgtagtaacactaatagatttaaaaataattcaacagtaaaccactgaaaaaccatatatactcaagatgggcatcttttgtattaaga

SEQ ID NO: 5100 - DNA, 490 bp, Mus musculus
  misc_feature (113)..(113): n is a, c, g, or t
  misc_feature (330)..(330): n is a, c, g, or t
  misc_feature (345)..(345): n is a, c, g, or t
  misc_feature (361)..(361): n is a, c, g, or t
  misc_feature (415)..(415): n is a, c, g, or t
  misc_feature (444)..(444): n is a, c, g, or t
tgagcctcctgacactcaaagagatacctcctggggctgacttcagcaatgacctgatgctgctccgcctcagcaagcctgctgacatcacagatgctgtgaagcccatcacncctgcccacgaaggagtcaaaactggggagcacatgcctagcctcaggctggggcagcattacacccacgaaatggcaaaagccagatgatctccagtgtgtgttcctcaagctcctgcctattaagaactgtatagaaaaccacaatgtgaaggtgacagatgtcatgctgtgtgcaggagagatgagtggaggcaaaaacatttgcaagggtgantccggaggcccattnatctgtgatagtgttntccaaggtatcacatcaacaggccctataccatgcggtaaacctggtgtaccanccatgtacaccaaccttattaagttcaantcctggataaaagatactatgacgaaaaattcctgagtgtcacatt

SEQ ID NO: 5101 - DNA, 392 bp, Mus musculus
  misc_feature (270)..(270): n is a, c, g, or t
  misc_feature (281)..(281): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (298)..(298): n is a, c, g, or t
  misc_feature (311)..(311): n is a, c, g, or t
  misc_feature (343)..(343): n is a, c, g, or t
  misc_feature (365)..(365): n is a, c, g, or t
ggttttgcctcccatagtagtatttcctcaggtgagggatgcccacctcgccagagccctggttggcagagcggtacaacacaaatttgagaggaaagatggctctgaggtcaactggaggggggtggtgctagcccaggtgccaatcatgaaggatttgttttacattacctacaagaaggatccagctctctatgcttatcagctcctggatgactacaaggaaggtaacctccacatgattccagacactcctccggctgaggaganatcaggagatnacantnatntgttgatnggtaactgggtgnagtacaccagaaaagatggttccaaaaagttnggaaaggttgtttaccaagttntagccaatccttccgtgtactttatca

SEQ ID NO: 5102 - DNA, 431 bp, Mus musculus
  misc_feature (105)..(105): n is a, c, g, or t
  misc_feature (285)..(285): n is a, c, g, or t
  misc_feature (312)..(312): n is a, c, g, or t
  misc_feature (315)..(315): n is a, c, g, or t
  misc_feature (326)..(327): n is a, c, g, or t
  misc_feature (330)..(331): n is a, c, g, or t
  misc_feature (335)..(335): n is a, c, g, or t
  misc_feature (357)..(357): n is a, c, g, or t
  misc_feature (359)..(359): n is a, c, g, or t
  misc_feature (370)..(370): n is a, c, g, or t
tggagatcaccttcagctactgggatggctccggccaccggcgcacggtgcgcatgagcaagggcagcacggtgcagcagttcctgaagcgggcgctgcagggcntgcgcagggacttccgggagctgcgggcagcgggcgtggagcagctcatgtacgtcaaggaggatctcatcctgccgcactatcacaccttctacgacttcatcgtggccaaagcccggggcaagagcggcccgctcttcagcttcgacgtgcacgacgatgtgcggctgctgagcgatnccacgatggagaaagatgagtcacacncgngcaaggtggtnnttnncagntggtacgagaagaacaagcacntnttccctgccanccgctgggagccctacgaccccgagaagaagtgggacaggtacaccatccggtgatgccaa

SEQ ID NO: 5103 - DNA, 524 bp, Mus musculus
  misc_feature (41)..(41): n is a, c, g, or t
  misc_feature (316)..(316): n is a, c, g, or t
  misc_feature (323)..(324): n is a, c, g, or t
  misc_feature (349)..(349): n is a, c, g, or t
  misc_feature (436)..(436): n is a, c, g, or t
  misc_feature (467)..(467): n is a, c, g, or t
  misc_feature (485)..(485): n is a, c, g, or t
gaaagctgcactagcaggctgacaagtggagtcattttatnagaaaaggcaaccgaagaatttcattcagtatgaagattttttcctctcaattttcttcagtaatgcaaaagaaaaaccaaaaagtaaccagaagtgctttttatttcaaagttcttgaagtaaaagagtaaaactcttgtcctttgctaacagccgtgtctgcagtaaaacaatgaaggagcctgcgtgtttcctaagtgtggagaggatctgcgggaatgtggaacagctttccttgcctactggaaccacaaacaagcacacaatgggactntctgagnncctgacaaagtgaacgcaagtacanccaagcacacatggtgaactgtcagggaacacaagcactttatggcgtcaactttcaaggaacatattttatatggattttgaagantcttgtttgctgataagaacttcaagaagtntaagcttggctttgattntcttgtattccttatattcctcaagcaccggaacacgat

SEQ ID NO: 5104 - DNA, 567 bp, Mus musculus
  misc_feature (52)..(52): n is a, c, g, or t
  misc_feature (145)..(145): n is a, c, g, or t
  misc_feature (373)..(373): n is a, c, g, or t
  misc_feature (378)..(378): n is a, c, g, or t
  misc_feature (386)..(386): n is a, c, g, or t
  misc_feature (437)..(437): n is a, c, g, or t
  misc_feature (530)..(530): n is a, c, g, or t
aagttatgtcgtctctgtttgtggacacttctctacctgatgatgaaagaancagctttaggtccattcggagcataactgagttttggaagttcatggaaggacccctcatcgacggcttgtactgggactcgtggtatggcancaaacagctgtacagtgtgaagaacagcagccgcatctactacgagaacgttcttctcggcatccccagagtgcggcaactgcgagtccgaaacaacacttgcaaggtctacccagctttccagtccctggtcagcgactgctacagcaagtacacagtggaaaacgaagacttctctgattttggcctcaaacgcaatccagaatggacgcacacaccttcttcccncactnccccatgncactgggggtttgttggcgtataccgagatggaggatatatagtcacgttntcaaaatcaaaatctgaaaccaaagccaaatttgttgaccttcgactgaacaactggattagcagaggcaccagggctgtttttattgatttntccctgtacaatgctaatgtcaacctgttttgcatca

SEQ ID NO: 5105 - DNA, 486 bp, Mus musculus
  misc_feature (325)..(325): n is a, c, g, or t
gaaagatgagatcggttcccagccattcacttgctattttaatcagcatcagagaccagaggacgttctcctacagcgcacacacgacgagattgctctcctgcactgcttcctctggccggtggtggcgtttgtggtgggtgttctcatcgtggtcctgaccatctgtgccaagagcctggcggtcaaggcggaagccatgaagaaacgcaagttctcttaacggggaggaggaggattgtgggaagccgagaccagaggttgcctcgtcggcactcgcctgccctgcagagcccacatttggtggcgcaggagatggaagggnccgcaagaggcccccgagaggcccctccctcgtcggcagcagaaacaggcacagttggaagactggggggacttaactgcctgtattccatgtgctgtagcaacggctaaagggtcaagctcttagctctatggagtgactaactgtttgggaaaccctca

SEQ ID NO: 5106 - DNA, 551 bp, Mus musculus
  misc_feature (300)..(300): n is a, c, g, or t
  misc_feature (373)..(373): n is a, c, g, or t
  misc_feature (379)..(379): n is a, c, g, or t
  misc_feature (416)..(416): n is a, c, g, or t
  misc_feature (426)..(426): n is a, c, g, or t
  misc_feature (435)..(435): n is a, c, g, or t
  misc_feature (507)..(507): n is a, c, g, or t
tgtatatcttcacttgaacccaagtcattttgatattatgttaacggaaactggaaagtacgaagttcttggcaaccccagggttggagacttagaatacttttctgaacattttaaatgcagctgttttagcagaatgacatgtaaggagacatctgatgtaaaaaatgtacaagacgtgaatgtgtgcgtcggtgacaatgtttgtataaaagccaaggtagaacccaacccagccttctacctcctacctggcaaaagccttctatttatgacaacacttggtcatgtgctgtaccntctgccacaagatatttttgtttttccacggaagacactagtcagtactccttagttttctctacccacagcntttgangtattattattattatttttgcaggcctcagtaattngggattatgnatgggattntattttaccaaagtaattcaatttttataatcaagattctatttttgagtttcaaagagaaattatatattnttctaccaaagattgattacaagcaaggctacttagggattagt

SEQ ID NO: 5107 - DNA, 570 bp, Mus musculus
  misc_feature (273)..(273): n is a, c, g, or t
  misc_feature (506)..(506): n is a, c, g, or t
aagttctccatggtgccagaatcatccagtcacaactggtcattctcacaggaaggcagaaagcagaaacagtccctgcggcacgaggagggccatgccagacgacaggggccgaccagcttgatggagcttcccaaactgaggctgtcgggaatgaccaaactgtcatcatgttccagccctgcactgcggtcagtgctgggcactggagcaaatggaaaagtccctgtgctgagacccctgaagtgtgctgctgtgaacaagaagacaganacgcagaaggacatcaaacctcacctgaaacactatcacctgcccacgatcaacaggaaagggggcgaatactgaacggcccgccacccagtcgtcctcttggagagcaagggctggcaccatggcaggcgtaggcctctgcggctgagagtggatgggccagaggctgccccatgctggtgctcctcgcactgcgtggtggccaggacatgctgccttgcagcctgtctctntccacaagctggagccttgcgtgtttgcagctccagagcggctgcactgaatgtttccgtttaa

SEQ ID NO: 5108 - DNA, 99 bp, Mus musculus
  misc_feature (38)..(38): n is a, c, g, or t
  misc_feature (44)..(44): n is a, c, g, or t
  misc_feature (52)..(52): n is a, c, g, or t
gcgctgaccccgctggtggatgaggtgaagcagaaggntctggntcctgccngccccagttgccagaggctacacaagaagattctggagctggagcgc

SEQ ID NO: 5109 - DNA, 107 bp, Mus musculus
agggcgagcgtctcccgggccgaaggaggaagatggcggtggagtcgcgcgttacccaggaggaaattaagaaggagccggagaagccgatcgaccgcgagaagacc

SEQ ID NO: 5110 - DNA, 537 bp, Mus musculus
  misc_feature (313)..(313): n is a, c, g, or t
  misc_feature (324)..(324): n is a, c, g, or t
  misc_feature (505)..(505): n is a, c, g, or t
gaggagcttattgagtcctcgcctctcagtgacaaccaaagaatggagaaattggagaaaaccaacagcagcttgcgcaaacagaaccttgacctcctggagcagttgcaggtggcaaatgctaggatccaaagccttgaagccacggtagagaaacttcttaccagcgagagtaagctgaagcaggctgcgctgaccctggaggtggagcgctccgccctgctgcagatggtggaggagctgcggaggcaaagcgcccggcccagcactccagagccagactgcacccagctggagcccacaggcgattganccgctgccagnagagactgtgcaccattaacactgtccaagccttaatcaagagagatggaagtcagaggcagagaagagagaacttctcagggaggaaactggctgaccagcctgcagatccttttgagctcagaacttgggattggaggacaaaagtctcagagttattgttgtttttggttctaatccntcccctttccagtcctggttgttgtagcttta

SEQ ID NO: 5111 - DNA, 480 bp, Mus musculus
  misc_feature (220)..(220): n is a, c, g, or t
  misc_feature (358)..(358): n is a, c, g, or t
  misc_feature (360)..(360): n is a, c, g, or t
aaggctgcctatgagagtctgatactagatgggctttttatggaaattctcaatgactgttctgatgtggatgagatcaaattccaggaagatggttcttggtgtcccatgagacctaaaaaagaagctatgaaagtaaccagccagccctgtacaaaagtagaaagttcaagtgtctttagtaaaccttgttcagtgactgtagccagtgatgcaagcnaagaagaagatagatgttattgatctaacaatagagagctcttctgatgaagaggaagaccctcccgccaaaaggaaatgcatctttatgtcagaaacacaaagcagtccaaccaaaggggttctcatgtatcagccntnttctgtaagggtgcccagtgtgacttcagttgatcctgctgctattccaccttcattaacagactactcagtaccattccaccacacgccagtgtcaagcatgtcatcagatttgccagg

SEQ ID NO: 5112 - DNA, 506 bp, Mus musculus
  misc_feature (57)..(57): n is a, c, g, or t
  misc_feature (68)..(68): n is a, c, g, or t
  misc_feature (74)..(74): n is a, c, g, or t
  misc_feature (88)..(88): n is a, c, g, or t
  misc_feature (96)..(96): n is a, c, g, or t
  misc_feature (122)..(122): n is a, c, g, or t
  misc_feature (326)..(326): n is a, c, g, or t
  misc_feature (353)..(353): n is a, c, g, or t
  misc_feature (416)..(416): n is a, c, g, or t
  misc_feature (434)..(434): n is a, c, g, or t
ttgtcagatttcacccggcgggcatatggcacgaactacatcgagaccctgagagtngcagatccatngcaaantgccgtatccgaangggtttancttctcagacagactctactcagaangatgagctgccagcagagttcaaactctatctaccagttcagaacaaggccaaacaataactggatagcagctaaggggacagactctggatgtgagtcttagtttaaaaggaaactacatggagaccatgcaaaaacattttaaaataaatccactgtgctgtggctcgctgaccactgtgtccttgtcatggacaccagtgnccatgcacagttgtgttccttgcattntaagtcagtggagggaagcagagctttgagtgacacacgagtgttggggtttcctgctgcctnccctggcccgtgagagancgcacgcaacaaacggaagaattagagacgtcctacaaggcagattcagaccaatatttcttcgtatagttt

SEQ ID NO: 5113 - DNA, 550 bp, Mus musculus
tggcagtcactttcttggatcgcgtggcctgcgtggctcgggtggaaggctcgtcaatgcagccttctttgaatcctggaggaagccagtcctcagatgtggtacttttgaaccactggaaagtgagaaattttgaagtacagcgtggtgacattgtgtcattggtgtctcctaaaaacccagaacagaaaatcattaagagagtgatcgctcttgaaggagatattgtaagaacaattggacacaaaaaccggttggtcaaagtcccccgcggtcacatgtgggttgaaggcgatcatcatggacacagttttgatagtaattcttttggaccggtttctctgggactcctgcatgcccatgccacacatattttgtggcctccagagcgctggcagagactggaatctgttcttcctccagagcgctgtccactccagactggtgagaaataactgcacaagagcccaccataggaggagctgaacacaccagatgcctccttctggagggagatgttccagtgatgctgaacacaagacctctgtat

SEQ ID NO: 5114 - DNA, 511 bp, Mus musculus
  misc_feature (245)..(246): n is a, c, g, or t
  misc_feature (323)..(323): n is a, c, g, or t
  misc_feature (332)..(332): n is a, c, g, or t
  misc_feature (345)..(345): n is a, c, g, or t
  misc_feature (347)..(347): n is a, c, g, or t
  misc_feature (390)..(390): n is a, c, g, or t
  misc_feature (401)..(401): n is a, c, g, or t
  misc_feature (414)..(414): n is a, c, g, or t
  misc_feature (426)..(426): n is a, c, g, or t
  misc_feature (434)..(434): n is a, c, g, or t
  misc_feature (448)..(448): n is a, c, g, or t
  misc_feature (460)..(460): n is a, c, g, or t
agctgctcctagatcgtcgttgactactgtaagaccaagctcttcacacgttcaagtcacgacagcacatcgcattactaacacatcagcacagataacaggtcagcgtcctgccccagcctcttcagctacagcgactcctgttcactcgattccacagtacaagtatgctgcaggagtccagaactcccagcaacatcttaatgcccagctggcgcaacagcccgctgtttgcatacagggtnnggaaccttggactgcttccatgttagtaaccgctcctcaagagccgaagcaaatgctgggtgaaaggctattccctntcatccaanccatgcacccgantntggctggtaagatcacgggcatgttgctggacattgataactnggaaccacttngtatgcttgaatnctccagtgtctncggtgttntagggctgaggaanccgtggccacantccaagcccaccaagttaaagaggctgcccagaaagctgttggcagtacct

SEQ ID NO: 5115 - DNA, 542 bp, Mus musculus
  misc_feature (86)..(86): n is a, c, g, or t
  misc_feature (90)..(90): n is a, c, g, or t
  misc_feature (96)..(96): n is a, c, g, or t
  misc_feature (162)..(162): n is a, c, g, or t
  misc_feature (164)..(164): n is a, c, g, or t
  misc_feature (166)..(166): n is a, c, g, or t
tcaagcaggccatgttcgactatttccaggtgccagatcggcttggaatcctcacccatttgtatagggactttgataaatgcaantttngctggnttttgccagaaaattgcagaaggtgcacatcagggagaccctctttccaggtacatcttcaggaangngnctggagagatgctgggcagacatgttgtggcagtattgccagagattgacccggttttgttccaaggggagcttggcctccccattctgtgtgtgggctcagtgtggaagagctgggagctcctgaaggaaggctttctcctggcgctgacgctgggccgagagcagcaggcacagaactccttctccagcttcaccctgatgaagttgcggcattcttctgcattggggggtgccagcctgggggccaggcacattggataccaccttcccatggactacagtatcaatgccattgccttctattcctataccttctagagtctgtccccctgcccaaccagccaacaccgagagctgggagactttccttttta

SEQ ID NO: 5116 - DNA, 284 bp, Mus musculus
  misc_feature (98)..(98): n is a, c, g, or t
cacagagaggtggtgccaagatgttgtatgaagaactatgccaggtgaaggcacccatgcggccgggtccaagagtggatttagacacagcgcacgtncttctgtcagtggcagtcctgtctccagatggggttatatctcaaccagctgctgtccactcctctgccagagccaaacctaacttggttgtacaacggaagcctggtccacagactctgccagcaactgccagcatctagttctgtagaaagcctcctgagtctatgtcctgaggcaaagcaact

SEQ ID NO: 5117 - DNA, 525 bp, Mus musculus
gaactatgccatctagatgccctgtatcttaatgtagaaaacatgcattttgaagttcagcatgtgaagaatacctcaagaaataaagatgcaattttgtatacttacaaactttccaggggactcacagaagaaaagaactatggattaaaagctgcagaggcctcctcacttccgtcatcgattgtcttggatgccagagacatcacaacacaaattacaaggcaaattttgcaaaatcaaaggagttcccctgagatggatagacagagagctgtgtaccatcttgccacaaggcttgtccaggccgcccgaaactctcagttggagccagacaggttacggacatacctgagtaacctcaagaagaaatatgcaggggactttcccagggctgtgggccttccagagaagactgaggagtgaccagtacacggtgtgcacaggggttgcaacttagttgctcagctttatgttttaattaaaaattatagtatattaacctcagaatggtcacctactatg

SEQ ID NO: 5118 - DNA, 416 bp, Mus musculus
  misc_feature (247)..(247): n is a, c, g, or t
  misc_feature (275)..(275): n is a, c, g, or t
  misc_feature (282)..(283): n is a, c, g, or t
  misc_feature (287)..(287): n is a, c, g, or t
  misc_feature (298)..(298): n is a, c, g, or t
  misc_feature (304)..(304): n is a, c, g, or t
  misc_feature (313)..(313): n is a, c, g, or t
  misc_feature (324)..(324): n is a, c, g, or t
tacagaaccttctggaaggaggacaaggcattctggagagaggataatgctttatgggaaagagaccggaatcttcttcaggaggacaaggccctatgggaggaggaaaaggccttgtgggtagaggaaagagccctgcttgcagaagaaaaggctttgtgggaagataagaagtccctctgggaggaagagaatgccctctgggaggaagaaaaagccctctgggtggaaggtggtggtttccatntccttggggaacagaggcaccaaaatgntccctannaatnccaatgaaganccacantcaacatcnttcccccgggnccgtgcttagtggacaactgaacacagagggtgatggggtgcagacatcactggttggactgaaatccagggtgaccccataatctagaaga

SEQ ID NO: 5119 - DNA, 525 bp, Mus musculus
  misc_feature (189)..(189): n is a, c, g, or t
aagacaggctgggacacgtcagaaagcgagctgagtgagggggagctggagaggcgaaggcggacactcctacagcagctggacgaccaccaatgaccccacgagctactttctgccttggacttcgtgaggcagtggctccagggtcgcctcagcatctgcctcagactccttcgtcttgtctggtcngtgtccacttttcctaaagtaacccacccccaacacactactgttagcacctctcaaggttgcttttggtgttcaagggtcccctagttctcagactagtgcagtccttgccctcagccccagaccagagatgggcagtctataccacggggtgggtgatgccagtagatagtgtgagaaggggtctccaggaaagagacaggctgcttggacacagcctgggtggccgagggcagggtcctcaccctctagcatcagtgcctgctcttgcctgacctggccctggggctccaccactacttcctctcccctgggacccgatgtatgtgttctgtt

SEQ ID NO: 5120 - DNA, 561 bp, Mus musculus
  misc_feature (313)..(313): n is a, c, g, or t
  misc_feature (322)..(322): n is a, c, g, or t
  misc_feature (407)..(407): n is a, c, g, or t
  misc_feature (480)..(480): n is a, c, g, or t
  misc_feature (509)..(509): n is a, c, g, or t
  misc_feature (520)..(520): n is a, c, g, or t
cacgctccaagaacctaactggtgagtgcaaggacctcatctaccgcatcctacagccagatgtcaaccggcggctgcacattgatgagatccttagccactcatggctacagccccccaagcccaaagccatgtcttctgcctccttcaagagggagggggaaggcaagtatcgagctgattgcaagttggatactcgaccaggctccagacccgaacaccggcctgaccacaagctggcgaccaaaccccagcaacggatgctggtgacacccgagaatgaagacaggatggaagacaggctggctgaganttccagagntaaagaccatcacatttctggagctgaggtggagaaagcaagtacctagtggtggagagggccctgggggtatcgtggtgtgcantctgcacccacataagctaagtaggcaggtaggagctgaagaaggcacaggtgcaaggaacaagtaaaattcntcaattaaaccactattttgattacgttntattagctttnttccacttagtagcaaagccattaattactgaccaccaaat

SEQ ID NO: 5121 - DNA, 360 bp, Mus musculus
  misc_feature (328)..(328): n is a, c, g, or t
agagataactagctcctgtttcgagcccaacagccagatggtgaagtgtgacccacgtcatggcaaatacatggcctgctgcatgctctaccgcggtgatgtggtacccaaggacgtgaatgtcgccattgctgccatcaagaccaagagaactattcagtttgttgactggtgtcccacaggtttcaaggtgggcatcaactaccagccacctactgtcgtgccaggaggggacctggccaaagtccagcgagccgtgtgcatgctgagcaacaccacagcaatcgcagaggcctgggcccgccttgaccataagtttgacctcatntacgccaagcgggcctttgtacattggtatgt

SEQ ID NO: 5122 - DNA, 549 bp, Mus musculus
  misc_feature (154)..(154): n is a, c, g, or t
  misc_feature (339)..(339): n is a, c, g, or t
  misc_feature (448)..(448): n is a, c, g, or t
  misc_feature (523)..(523): n is a, c, g, or t
gttggagccatgtagacttcagtcagaaccttgacctttaacacatggagacagtaaccaaccgggggaaagttgagtgtgacctggaggtatctcaaaggaaggaaccagatcactttcttatgttgctggttgcaaccccgtgtggggcttnattaccgtaagtgacagtcacaagatatttaggaacactacaagctttctgcatatccagggaccaaaacctcagaattcaacaggttctaggagcttctggcagctcttacccatgatgcaactgtgtgacttcactgcagccttcctcagaacacaccatcaccacacacagggcccagcctnctctgctcagggtcggcgttgttgtctatgacaaattgcatggctttctacagtacacatgctttctgttcttccggaagcgttgctcacggagctttcctgttctcgntcttctagttcagctgcagactctgttgtgtgtctcagtgggattttgaccatcctcattactcccctttacagnaagtgttccacggcactactgtgcaa

SEQ ID NO: 5123 - DNA, 340 bp, Mus musculus
  misc_feature (304)..(304): n is a, c, g, or t
attcctgtacctactatgagtgtcattatcctccttgtacggtgattgaaaagcagcttcgagagttcaacatctgtgggcgttgccaggtggctcgatactgtggctctcagtgccagcagaaggactggcctgcccacaagaagcactgtcgggagaggaagcgtcccttccagcatgagcttgagccagagcgatgacgggctgaagagctgccactgctgcaggttcaaagtttccagctcctcatgagcacagcggaagacagactgtcagttgaacctggaggtgccaaagaagccancaatggatccagagcagctgccataagacctcacag

SEQ ID NO: 5124 - DNA, 401 bp, Mus musculus
  misc_feature (45)..(45): n is a, c, g, or t
  misc_feature (52)..(52): n is a, c, g, or t
  misc_feature (286)..(286): n is a, c, g, or t
  misc_feature (289)..(289): n is a, c, g, or t
  misc_feature (361)..(361): n is a, c, g, or t
aaggctgtcaagtcctctacaggtcccggggaacagctccgaaancgcactntggcacacgggggacacagcatcccaggtgcggctgctgtggaaggatcctcgaaacgtgggctggaaggataaaacatcctaccgctggttcctgcagcaccggcctcaagttggctacatcagggtgcggttctatgagggtcctgagctagtagctgacagcaatgtggtgttggacacggccatgcgtggtggccgcctgggtgtcttctgcttctcccaagagaacatnatntgggctaacctgcgctaccgttgcaatgatacaatccctgaggactacgagagtcaccggctgcagagagtntagggaccagtggggtcccgctgcctgatggactgtggtg

SEQ ID NO: 5125 - DNA, 492 bp, Mus musculus
  misc_feature (296)..(296): n is a, c, g, or t
  misc_feature (424)..(424): n is a, c, g, or t
  misc_feature (453)..(453): n is a, c, g, or t
  misc_feature (456)..(456): n is a, c, g, or t
gaaccgtgtgtgtggacactgccaagattcacccttcaaggaggaagcctgggccctgcttgtggatgagagtcctcagaaggctctggatgctgaccctggtagcctcaagcaggctttggatgatcagaatatagttgagactgttctggacttggaagaagactacaacttgatgacttcttttaaataccaaatagagtgaggagagtggatgtcagcagccacagtggttaccagaacaagtcttcacgaggggttggcagagcccaaattgccacaccttgtttaatttntgctgaatcccattttgagctgagagcccaggttttagttctgttattttgaaatgtttgaaaagttttttttttggacttgacattttttttaaagtgtattcttggttagtgttgaatatatacantccccaggataggttataggttgtgcctntgntctttgtccttgtattcttttatatgaatccctgga

SEQ ID NO: 5126 - DNA, 473 bp, Mus musculus
  misc_feature (90)..(90): n is a, c, g, or t
  misc_feature (129)..(129): n is a, c, g, or t
  misc_feature (260)..(260): n is a, c, g, or t
  misc_feature (369)..(369): n is a, c, g, or t
  misc_feature (385)..(385): n is a, c, g, or t
  misc_feature (394)..(394): n is a, c, g, or t
  misc_feature (421)..(421): n is a, c, g, or t
aatcaccttgattatcctccgaactgtacctcataatttacattcactgggcatagctgtgacctatacaactttgagattatttggatncatccctgggccactgctttttcaattaacagcaagtcnttcttgtatttactgggacataaataaatgtggagacaaaggacgttgttggatctataataagttaaaaatgatgttcatactgatgggattctgtattttttgcaaattggccacaaccttctttactntcttggcattttttaaatataatgtttccagagttggaagcaagaatgcaaagaaaagaagcaaaaaataaaaaataaaagaggcaaaaaataaaaaataattattaantgatttcttccttggnttcctgaantctgagggaaaggatttgatggagacntcccatttaaaggactggagagcctgtgattgcccaggttctaaggacagca

SEQ ID NO: 5127 - DNA, 334 bp, Mus musculus
  misc_feature (287)..(287): n is a, c, g, or t
acatgtcgatggcagtctactttgaccgtgatgacgtggcccaggagaacttcaagcgtttcttcttgaccaagtcacacaactgccagaccagtgcagagatgttcatgcacctgcagaataagcgtggaggctgcatctcccttcaggacatcgcgagaccagaacgtgacagctggcacgggggatttcaagccatggaatgtgccttccacatggagatgctgatcaaccagagcctgctcaacatgcacgaagtggccaaggagaaaggcgacccccacctntgccatttcctggagcaaaactgcctagatcagcaggtcgacatttt

SEQ ID NO: 5128 - DNA, 500 bp, Mus musculus
  misc_feature (327)..(327): n is a, c, g, or t
  misc_feature (329)..(329): n is a, c, g, or t
  misc_feature (355)..(355): n is a, c, g, or t
  misc_feature (370)..(370): n is a, c, g, or t
  misc_feature (384)..(384): n is a, c, g, or t
  misc_feature (387)..(387): n is a, c, g, or t
  misc_feature (440)..(440): n is a, c, g, or t
  misc_feature (469)..(469): n is a, c, g, or t
gaatgagcccggcaatccctttggcagcgtgccacatgatggagaagacaccttaagtgaaattcaaggaaaagacgccatgacctctgacaccttagcgaagaaactcgcagcccctgacactttgggaaccagttatcagggtgaggagcaagaaagcagcggtgcgcatagcagcaaattcttcctggacaaacaagaaaggcaacggcaatttgagttgaaaaggaagttacactacaacgaaggattaaacatcaaattggccagacaactgatatcggaggagctacaatctgaagtagaggaagatgaaaaccaaccatntntacattcaaattattgaagaaaagantactacagaagaagntccgacaattgaanatntagaaatttaccatcaaacacatataagatctgctgttgccgctgcctttgcntctgtttttgtctataccaccactgcttnttgcttcttagaacccatggccttagtgtga

SEQ ID NO: 5129 - DNA, 535 bp, Mus musculus
  misc_feature (105)..(105): n is a, c, g, or t
atcactggatatcagctgcctgtttataactaccagatgccaccgcagtggcctgctggagagcagaggagttatgttatacctccggcttatacaactgttaantaccactgcagtgaagttgatccaggagctgatattttgcccaatgaatgttcagttcatgatgctgctccagcttctggaaatggcccgcaaaagaagtctgtggaccgaagcatacagacagtggtctcttgtctgtttaaccctgagaacagactgagaaactctcttgttactcaagatgactacttcaaggataaaagagtacatcacttcagaagaagtcgggcagtgcttaaatctgatcatctctgctaactcatctcagggggttgttggttttgaatattaaaagaaactgaaaagttttcaatactatagaaaatttgacaaatcactcagactttctataaaagttatattagattgcatagttttatgttaaacttgttagatgtttatatagaaactggttttgtgttcatcatat

SEQ ID NO: 5130 - DNA, 333 bp, Mus musculus
  misc_feature (78)..(78): n is a, c, g, or t
  misc_feature (228)..(228): n is a, c, g, or t
tggaacagcaccttgctacctaaaacaattggctgaacatcaatctgacctgccagggacatgagttttaaaatgccntgttgatctatcttgtattagtcctttccttcaaacatggattccacttactcttacttagtggaactaatgggtcatatcacaactgtccctaatgatctttaactcttaatcttattctgcatctaaagtcaaaattcttttatgtcnccaagtcagtatataccagaaaactaagaagtgtcctgaaatttaattctttttagattttgtccccttacttcagtgtatttgtagtgtatgtccttacatgta

SEQ ID NO: 5131 - DNA, 529 bp, Mus musculus
  misc_feature (53)..(53): n is a, c, g, or t
  misc_feature (55)..(56): n is a, c, g, or t
  misc_feature (60)..(60): n is a, c, g, or t
  misc_feature (64)..(64): n is a, c, g, or t
  misc_feature (66)..(66): n is a, c, g, or t
  misc_feature (131)..(132): n is a, c, g, or t
  misc_feature (150)..(150): n is a, c, g, or t
  misc_feature (162)..(162): n is a, c, g, or t
  misc_feature (166)..(166): n is a, c, g, or t
  misc_feature (168)..(168): n is a, c, g, or t
  misc_feature (171)..(172): n is a, c, g, or t
  misc_feature (187)..(187): n is a, c, g, or t
  misc_feature (383)..(383): n is a, c, g, or t
  misc_feature (392)..(392): n is a, c, g, or t
  misc_feature (405)..(405): n is a, c, g, or t
  misc_feature (414)..(414): n is a, c, g, or t
  misc_feature (423)..(423): n is a, c, g, or t
  misc_feature (429)..(429): n is a, c, g, or t
  misc_feature (433)..(433): n is a, c, g, or t
  misc_feature (438)..(438): n is a, c, g, or t
  misc_feature (441)..(446): n is a, c, g, or t
  misc_feature (448)..(448): n is a, c, g, or t
  misc_feature (450)..(451): n is a, c, g, or t
  misc_feature (469)..(469): n is a, c, g, or t
aaatatcaatgcttaaccagaaccattcttaagttatcagtaaaaaagtaaanannagtnaaantnaatgtctttcaggagtccatgaaacttgccatattcaatatacctgcgattaagtgttaaaaaannacgctgtaactctgtacntgctagtattanaacnanaanntcttcccatacagcnaaatgcttaatgcttacattaatgtggatgtgtcggcctttatgtaatctgtattatatatagcagggaataagagctacagatacatgcctttaaagggctgtttcttaaggctgttacaaggagataatggtatttcaactaattatcagcaagtgacaatacattccaccacagatggactcttgttcttctnagcgtttanactatatgaaaanactgggtgnttcaaagtntggaangagngaagngannnnnnancnntgtcatggatgaagactncctgttcattttttaaatatgatctttcaggtcctttgcttaccaaaggaggcccaattc

SEQ ID NO: 5132 - DNA, 376 bp, Mus musculus
gatgaccgggactattacagcagatcatacagaggaggaggtggtggaggaggtggatggagagcagctcaagacagggatcagatttacagaagacggtcaccttctccttactacagtcgtggaggatacaggtcacgttctcgatcacgatcctactcacctcgtcgctactaaagcatgaagttgaagactttctgaaacctgccatagagctgggatattgtttgtggacaatattttctattgtctcctgtttaaaaagtgaacagtgcctagtgaagttaggtgacttttacaccttttatgatgactacttttggtggagttgaaatgctgttttcattctgcatttgtgtagttcggtgctttgttc

SEQ ID NO: 5133 - DNA, 155 bp, Mus musculus
tcaggcccaaccaaacgctaatgaagactacagagaaggtccttgtgcagtcaaccttgttttaagattaagaaactccagaaaggaacttaatgacatacgatttgagtttactccaggaagagatacagcagacggtgtgtctcaggagctct

SEQ ID NO: 5134 - DNA, 176 bp, Mus musculus
  misc_feature (86)..(86): n is a, c, g, or t
  misc_feature (99)..(99): n is a, c, g, or t
ctggacatttagaatactgtaaccttgctgccgttctgttagattgctaactacgtcccccgtctccaatttggctctccttaggngataggatttgtngtttttaaggcaataaacttgacaacaccagaatccaagttttacttgaaaagctcggcagaatacacagtggtgtg

SEQ ID NO: 5135 - DNA, 379 bp, Mus musculus
caggagatcatctcaagcgcgagagaacaaacagatattttttctgagcagaaagctgaaacagaaagtatggaagatttccagaatgtcttgaagccgtgtagcttatgtgaaaaaaggcctcgggatgggaacattattcatgggaagacgagccatctgacgacatgtttccactgtgccaggagactgaagaagtctggggcttcgtgtcctgcttgtaagaaagagattcagttggttattaaagtttttatagcatagttgagtcagtcacagagaaatactaggaggaccaggtcatttatcaaaaaaatcagtattcttagaggcaggggcagaagatcaccaattttgatgccagtctgggccatataat

SEQ ID NO: 5136 - DNA, 253 bp, Mus musculus
  misc_feature (26)..(26): n is a, c, g, or t
  misc_feature (45)..(45): n is a, c, g, or t
  misc_feature (61)..(61): n is a, c, g, or t
  misc_feature (128)..(128): n is a, c, g, or t
  misc_feature (136)..(136): n is a, c, g, or t
  misc_feature (186)..(186): n is a, c, g, or t
  misc_feature (213)..(213): n is a, c, g, or t
  misc_feature (215)..(215): n is a, c, g, or t
  misc_feature (224)..(224): n is a, c, g, or t
gaaagcagagggattcagagatcatncaacaaaagcagaagatanccaatgagaagaaatntatgcagacaacagaaaaatgatgactggctttttggaaaacctgggtgctattgccagtgggtgcntcatacgntctaagattaaaatttcacagtgactaatcattatatgtgttataacttntccttataaaactattttaaactttantnttcagcctntcttaatgtgatgttttaagaccatcaaa

SEQ ID NO: 5137 - DNA, 380 bp, Mus musculus
  misc_feature (178)..(178): n is a, c, g, or t
  misc_feature (195)..(195): n is a, c, g, or t
  misc_feature (201)..(201): n is a, c, g, or t
  misc_feature (246)..(246): n is a, c, g, or t
  misc_feature (250)..(250): n is a, c, g, or t
  misc_feature (252)..(252): n is a, c, g, or t
  misc_feature (283)..(283): n is a, c, g, or t
  misc_feature (302)..(302): n is a, c, g, or t
  misc_feature (318)..(318): n is a, c, g, or t
aggtgggacaggtgcccgcctcctaggtgcgggtgtgcgtgaggaccgcgcccaccgggagcgtgggcggctgcccagcgggaccagtccgccgagacgtagcgggcgcctgaggtctggaagcccagggtgccctccagctcttttgtcctcgaaggtggaaatcaaagagaaattncccgacagaaaaacatngaaaangacccaggaaattagcaaagggaaaagaaaagaggacagcttgantgcntntcagagaaagcagagggattcagagatcatncaacaaaagcagaagatanccaatgagaagaaatntatgcagacaacagaaaaatgatgactggctttttggaaaacctgggtgctattgccagtgg

SEQ ID NO: 5138 - DNA, 466 bp, Mus musculus
gtcgccacatcgagggcccttgtggggctcagccttcttcagcgcccggcggcaacggctgagcgtgcaaagccgccgtttgcttctccaggtcgctgtcttccagtctccggccggtggacagcatggcccgtggaaatcaaagagaaattgcccgacagaaaaacatgaaaaagacccaggaaattagcaaagggaaaagaaaagaggacagcttgactgcctctcagagaaagcagagggattcagagatcatgcaacaaaagcagaagatagccaatgagaagaaatctatgcagacaacagaaaaatgatgactggctttttggaaaacctgggtgctattgccagtgggtgcatcatacgctctaagattaaaatttcacagtgactaatcattatatgtgttataacttgtccttataaaactattttaaactttactcttcagcctatcttaatgtga

SEQ ID NO: 5139 - DNA, 246 bp, Mus musculus
  misc_feature (42)..(42): n is a, c, g, or t
tacgcattggtgttacataaacgagagtgcatgggtccccanccctgtctccccttccccttagctgtcctcgagatgctccaggcctcctggcaccttccactcatgtgtttcttattatctctcccaccccactgcaggccaggctgctgttgcctcctgcggcgggcggggctcctcctaagcacccaggagttccctcttaggctcttggcctcacatcaaagcctagaatacatatgtgta

SEQ ID NO: 5140 - DNA, 345 bp, Mus musculus
ggctgcagatggaggccattgctctgtgattgactggatgataaaggacggttgtgaggtagatgttgtagacactggttcaggatggacgccactcatgagagtctccgctgtgacaggaagccagaaggtggcctcactcctcatcgaggctggggctgacgtgaacatcaaggacaaagatggaaagacgcctctcatggtcgctgtcttaaataatcacgaacagctagttcagctacttcttgataaaggggcagatgcaactgtgaaaaatgagtttggcaaaggtgtcctagaaatggccagagtttttgacagacagaatgtactttccttactgga

SEQ ID NO: 5141 - DNA, 519 bp, Mus musculus
  misc_feature (26)..(26): n is a, c, g, or t
  misc_feature (33)..(33): n is a, c, g, or t
  misc_feature (113)..(113): n is a, c, g, or t
  misc_feature (148)..(149): n is a, c, g, or t
  misc_feature (154)..(154): n is a, c, g, or t
  misc_feature (349)..(349): n is a, c, g, or t
  misc_feature (375)..(375): n is a, c, g, or t
  misc_feature (384)..(384): n is a, c, g, or t
  misc_feature (420)..(420): n is a, c, g, or t
  misc_feature (431)..(431): n is a, c, g, or t
  misc_feature (445)..(445): n is a, c, g, or t
ttgtgagcaagaaggatgccccaganaaacctnacgtcataatttggttattacctattatttgtgtggctgtagttttatctgtattgttttgcttgtctggggccactaanaaatcacgtgaagcagcagcaagtcaaccagcagnngaganagttaaaccaccatatgaaggggctgaaccctcatatgagacagttaaaccaccggatgaatgggctaacccctagataaagaacaaaaggattaaaccaccagatgaggaataagagactaaatcataagacaagaaagaagaggctaaaccatccaatgagaaaagaggctaagcccatccatcatatgagantagcagctccttgtcaacagcttcanttcttcaanttcaaccaacacagaatagaaaaatctaatgagttntcaaaataatntttaagatttaatncaatttaccacacagcatcctggtgtgagagatcctaatgtgtattataaaccactgatagaagatcccagcaa

SEQ ID NO: 5142 - DNA, 486 bp, Mus musculus
  misc_feature (394)..(394): n is a, c, g, or t
gacgctgtacaagaatgtcaccttattgtaaatgggatgttcaacgggacaaagatgtttgtatcagaaaagaaggagaccgcatctggagatgttgatagcttctataactttgctgagatccagatggggatatgaagcggattgtggtattaagccccttccatcctttatatacagacagtttgataatatccttacatatgttagtcatttagcaattagtaatttttactaatgctataattgttaaaagctatttttaaataactctttgaataccatattatttacttgagtatctaaaataattcatttaaattgagtagttttaatcataaactatttaacttgcttcagtaagcttgcagttttatttcttttcatacaatantcttattaggaaataatcatgattttattcctaattaaaagttctttcatatctctggtaatttaaactttccaacttaccttagtgctcta

SEQ ID NO: 5143 - DNA, 475 bp, Mus musculus
  misc_feature (206)..(206): n is a, c, g, or t
  misc_feature (335)..(335): n is a, c, g, or t
  misc_feature (369)..(369): n is a, c, g, or t
tcttctgtactagagccaacacctttatatttaataactatattcagaacttggcaaattatactctagcttataatacattttcttttaatgacctacccattaaaaatttaaaatacattctttgtggtggcagttctttcaggtttgacagcaatcagtgactttagtcctttaaaagcaaatgttagcagttgcgactccancactttctgtcccactcaaatgcacaaaatccactttagagaagtggcttactgtcacttgagatgaaattcaacacttaatgtctatgagatcattattagtttattaatttagagccctaaaggagntactttttctaatatttagtgtgactttgtcttntacattgcttgtaagcaataaaactgtatgaaacaaattcaccctgcttttgtatttgaattgtcccccaccccaactttttgttttctgctttatttctttactc

SEQ ID NO: 5144 - DNA, 471 bp, Mus musculus
aagtgaacatccaggagtggctgcagctgactatgtattcctgaatgggagtggcagacctgccccctcacagctcactatggagccaccttgaaccctgatcctgactgcagccgcattttcatggtcatgtcctgctacccagaggcctttcgtctccctgttctggtacccagcttcccaatcagcagccagagctcaacatgccacaccttgctgcaccctgagttacccctggctctgagacaagctagcttgttctactgaagggtcaccccaccctagcacacccaatccacgccatctgttaccttcatcctgtctgtgtgccaagcctagcactcctgctgcttccatgtcccaagggccctgtcttagttctgggaggatcacacctgtccctacacaccctgttacacactcacacagttacctcccaggcagccagatgaactccaggccatggcaggt

SEQ ID NO: 5145 - DNA, 511 bp, Mus musculus
  misc_feature (461)..(461): n is a, c, g, or t
gaatcttcaagtgggtgcctgtggtggatccccaggaggaggagaggcggcgggcaggaggcggggcagagagatcccgtggccgggagagacgtggtaggggcaccagtcccagagggggaggccccctcatcctactggatctcaatgatgagaacagcaaccagagtttccattctgaaggttcattgcaaaagggtgctgagcccagccctggggggacgccccagcccagccgccctggatcaccaactggacccccagaagtgattactgaagatactcagcccccacaattgggtcaggagagagatccaggggggacacctgcaggcggtactgatgaacccccaaagctgaccaaggaggagcctgttccagaattgctagaagctgaggcccccgaagcttaccctgtctttgagccagtgccatctgtccctgaggcagcccagggtgancacagaggactcggagggcgcccccccactcaagcgcatctgtccaaatg

SEQ ID NO: 5146 - DNA, 476 bp, Mus musculus
  misc_feature (72)..(73): n is a, c, g, or t
aactatctaatctttttcgacaacaacaaaagatttttcagcagtctagaattgttcagagccagagaatgnnagcaatcaaacagatacacgagcagttcataaagagtttggaagatgtggaaaagaataatgataatctatttactggcacacaaagtgaacttaaaaaagaaatggctatgttgcaaaaaaaagttatgatggaaactcagcagcaagagatggcaaatgttcgaaagtctcttcaatccatgttattctgatgagtctttgaagaaagaacttgaacctatgtaatatgatacaattaaaacattagctaagaggcatgcctttagtaaattatagtttaaactataatatccgaaatcattagcttatttaagtggaagatttttgttcctgttaacctaaaaccttataaacctaaactatgttaagtaccagctattccaatgtatcaaactttcagg

SEQ ID NO: 5147 - DNA, 313 bp, Mus musculus
  misc_feature (247)..(247): n is a, c, g, or t
  misc_feature (252)..(252): n is a, c, g, or t
tggccctggccgcatctacgctgttcgtgctgcggcagctgtggccgtgggtccggggcttgggtagccggggcaccgcggtgaagacgcagacatgccagaaggcacaggtgcgcacgttcacgcgcctcagcgacctgtgcgccatctgcctggacgactacgaggagggggaacggctcaagatcctgccttgcgcacatgcgtaccactgtcgctgcatcgacccctggttctcgcgcgccgngagcnttcatgccccctgtgcaaacagtcagtggccagcactcacgacggttccacggacggcagc

SEQ ID NO: 5148 - DNA, 571 bp, Mus musculus
  misc_feature (454)..(454): n is a, c, g, or t
  misc_feature (468)..(468): n is a, c, g, or t
  misc_feature (470)..(470): n is a, c, g, or t
  misc_feature (480)..(480): n is a, c, g, or t
  misc_feature (486)..(486): n is a, c, g, or t
gtcacctacaataacttcatccagcccatctgcctcctgaactccacgtacaagtttgagaaccgaactgactgctgggtgaccggctggggggctattggagaagatgagagtctgccatctcccaacactctccaggaagtgcaggtagctattatcaacaacagcatgtgtaaccatatgtacaaaaagccagacttccgcacgaacatctggggagacatggtttgcgctggcactcctgaaggtggcaaggatgcctgctttggtgactcgggaggacccttggcctgcgaccaggatacggtgtggtatcaggttggagttgtgagctggggaataggctgtggtcgccccaatcgccctggagtctataccaacatcagtcatcactacaactggatccagtcaaccatgatccgcaatgggctgctcaggcctgacccagtccccntgctactgtttctnantctggcctgngcttcntctttgctgaggcctgcctgagcccacacgtgtacgtcacacctgtgaggtcagggtgtgtctcttttgtatcttgcttgctaat

SEQ ID NO: 5149 - DNA, 447 bp, Mus musculus
  misc_feature (67)..(67): n is a, c, g, or t
  misc_feature (88)..(88): n is a, c, g, or t
  misc_feature (90)..(92): n is a, c, g, or t
  misc_feature (94)..(98): n is a, c, g, or t
  misc_feature (100)..(100): n is a, c, g, or t
  misc_feature (103)..(105): n is a, c, g, or t
  misc_feature (179)..(179): n is a, c, g, or t
  misc_feature (236)..(237): n is a, c, g, or t
  misc_feature (239)..(240): n is a, c, g, or t
  misc_feature (249)..(249): n is a, c, g, or t
  misc_feature (254)..(254): n is a, c, g, or t
  misc_feature (278)..(278): n is a, c, g, or t
  misc_feature (281)..(281): n is a, c, g, or t
  misc_feature (284)..(284): n is a, c, g, or t
  misc_feature (300)..(300): n is a, c, g, or t
  misc_feature (306)..(306): n is a, c, g, or t
  misc_feature (309)..(309): n is a, c, g, or t
  misc_feature (327)..(327): n is a, c, g, or t
  misc_feature (337)..(337): n is a, c, g, or t
  misc_feature (356)..(356): n is a, c, g, or t
  misc_feature (380)..(380): n is a, c, g, or t
  misc_feature (397)..(397): n is a, c, g, or t
  misc_feature (404)..(404): n is a, c, g, or t
gatcgcagagagtggccttaaaagcatagaggatgaagccataaagttggaaacatcaaacagaatnttaaagaagaaaataaaagtnannnannnnnanatnnngcagctcttactaaggagtaagatcagcgaggaggaaaggcaacgaacatctggatcggcgatggagatgctgnttcttatcatctgtcccactggagcgtcagtgtggaacgtgctccatcctcggcttnntnnatcgatgtntcctncaggtgactccttccactttatangtntanacatatactttatatncagttnatnttttattctgtaactttngaactggacnaaacaggtttaaatatttnataagaatgaagtttttttttttntcctgctgagatggaantcaattntgtttaagtgttgacatgtttccacacgtgcatttaataaaat

SEQ ID NO: 5150 - DNA, 470 bp, Mus musculus
  misc_feature (96)..(96): n is a, c, g, or t
  misc_feature (117)..(117): n is a, c, g, or t
  misc_feature (119)..(121): n is a, c, g, or t
  misc_feature (123)..(127): n is a, c, g, or t
  misc_feature (129)..(129): n is a, c, g, or t
  misc_feature (132)..(134): n is a, c, g, or t
  misc_feature (208)..(208): n is a, c, g, or t
  misc_feature (265)..(266): n is a, c, g, or t
  misc_feature (268)..(269): n is a, c, g, or t
  misc_feature (278)..(278): n is a, c, g, or t
  misc_feature (283)..(283): n is a, c, g, or t
  misc_feature (307)..(307): n is a, c, g, or t
  misc_feature (310)..(310): n is a, c, g, or t
  misc_feature (313)..(313): n is a, c, g, or t
  misc_feature (329)..(329): n is a, c, g, or t
  misc_feature (335)..(335): n is a, c, g, or t
  misc_feature (338)..(338): n is a, c, g, or t
  misc_feature (356)..(356): n is a, c, g, or t
  misc_feature (366)..(366): n is a, c, g, or t
  misc_feature (385)..(385): n is a, c, g, or t
  misc_feature (409)..(409): n is a, c, g, or t
  misc_feature (426)..(426): n is a, c, g, or t
  misc_feature (433)..(433): n is a, c, g, or t
gaaaacatggtgcactcgggagtatttaagatcgcagagagtggccttaaaagcatagaggatgaagccataaagttggaaacatcaaacagaatnttaaagaagaaaataaaagtnannnannnnnanatnnngcagctcttactaaggagtaagatcagcgaggaggaaaggcaacgaacatctggatcggcgatggagatgctgnttcttatcatctgtcccactggagcgtcagtgtggaacgtgctccatcctcggcttnntnnatcgatgtntcctncaggtgactccttccactttatangtntanacatatactttatatncagttnatnttttattctgtaactttngaactggacnaaacaggtttaaatatttnataagaatgaagtttttttttttntcctgctgagatggaantcaattntgtttaagtgttgacatgtttccacacgtgcatttaa

SEQ ID NO: 5151 - DNA, 467 bp, Mus musculus
  misc_feature (182)..(182): n is a, c, g, or t
  misc_feature (308)..(308): n is a, c, g, or t
  misc_feature (345)..(345): n is a, c, g, or t
  misc_feature (347)..(347): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (401)..(401): n is a, c, g, or t
  misc_feature (415)..(415): n is a, c, g, or t
gataaatgcaatgaggtcctttcctggctggaggccaaccagctggctgagaaagatgagtttgatcataaaagaaaagaactggaaaatatgtgtaatccgatcatcacaaaactgtaccagagcggatgcaccgggcccacctgtacgccagggtatactcccggcagggctgccacagnccctaccatcgaggaagtagattagccttttccagaattgcagggtgctagggtgcctctaggcgaattttattcatcttcaaacatcaatatgattcttgaactgactggactcaagcctacgtncaccatcctttgggatcccgatggagaagcctcgaantngaccttttcacacccccaccntntnatctatgatcctgaactggacctttaggnaaaccaggcccctntttgagccatttgaagaatttggatgtctgttatttattatccacaccccac

SEQ ID NO: 5152 - DNA, 550 bp, Mus musculus
  misc_feature (360)..(360): n is a, c, g, or t
  misc_feature (418)..(418): n is a, c, g, or t
  misc_feature (450)..(450): n is a, c, g, or t
  misc_feature (497)..(497): n is a, c, g, or t
ataagaagtgtgtcagtaagtcaatttggagaagtcagtgttcacctaagacatgcaacatgaaaggtgtgtgcaacaatttacaccactgccactgcaaccttgggtgggacccaccacattgcctgaaaagtggccttggagggagtattgacagtggccctccgaactatactgaaaactatactgaaaagaaacacaagaaaagtattgggctagtaattcttttttggattctttttgcttgtttttccgtattgttcattgtgttcctttttttcttgaggagttacgtagaactacctatgagtgaagaacccaaagttcccaccccagaaaacaaagaagataccaatgaantaatgaacactgaaacagaataacaacaatttgtaatttcaaatgtcattatcaaatnttcctccatttcccatgttctaccatgtgttntcttggtatgtgaaacactgtatgtttctgaattcagtgacacaaantcctagagatatttagtatttcagcatgaaatacctcatcattcaataaagct

SEQ ID NO: 5153 - DNA, 280 bp, Mus musculus
atgccacttagtgccgaaagctctcaccaaagcactaagtcccatgtgtcaccagcacctcagattctgagttcctgggctgcctgccaagcatgccacacagtccctggagtgatagggattaggtagggagacagcttcaagcatctctggatttggtctgataaacgggaaggctgctcagagtcctgaccttgctgggcgtggctacaaagaggacggtagcgtggccccagagatgaagcaatctagtaggggctgaatcctacaggagtattca

SEQ ID NO: 5154 - DNA, 574 bp, Mus musculus
gctgctcattaaagttcttcccttgatctcttaagtatggaggtctttaccaagaaatggcttagcatgagtgggagctgaatcccagtggctccaccgtatgaaccagagaattatggctaattcggctgttacagccactggctggctgcattttaaaccttaaaacttgactatctgcaaaaaaggaacagtgtggctacaagcctgagctttaatgaaatagacatcctcacagagaagttggaaataacagaactgaagtcttaatttaccttcagtttaatctgtggatttattgaaatactgacgatcctcaggtccagaattccagcatcatttattcttttaaaataaatttttaagaacttgatccatcttattcagtacctcacaatcaaagttggcaaatgatggatgaatgattcaagcgttgcacccggtagaagctgaatccatttgtgaatggactgaagtgaacgcgaatgctgactctatcctggaagcatttttataccatcttgaaatttcaacaaactggcacttgccggtttatccagctgtctttcaagaa

SEQ ID NO: 5155 - DNA, 499 bp, Mus musculus
  misc_feature (97)..(97): n is a, c, g, or t
  misc_feature (131)..(131): n is a, c, g, or t
  misc_feature (136)..(136): n is a, c, g, or t
aggcatggacaccagaggcccagtacctggacctagaggacctatgcctagtggaatccaaggtcccaatccaatgaacatgggggcagttgttccncagggatccagacaggtaccagtcatgcagggancaggncatgcaaggagcaagcatgcaaggtggaagccagcctggtggctttagtcctggacagagccaagtcacaccccaggatcatgagaaggctgctttgattatgcaggtccttcagctcactgcagaccagatcgccatgctgcctcctgagcaaagacagagtatcctaatcttaaaggaacagatacagaaatccactggggcaccttgaaaggttctcaaaatagctggcaacaaatctggaaatgtaattccataacatttttgaaattttgaaaacataatgacgtctgcatccgaacctccccggatgaggcagatggcgccaggtggaggtcttacatcgccattgctccaaaggaa

SEQ ID NO: 5156 - DNA, 557 bp, Mus musculus
ctggacttctggacccttgtgaaaaggatccctttgacactttggcaacaatgactgaccaacagcgtgaagacattacatccagtgcacagtttgcattgagactccttgcattccgtcagatacacaaagttctggggatggatccattaccacaaatgaatcagcgctttaacatccacaacaacaggaaacgaagaagggatagtgatggagtggatggatttgaagctgaggggaagaaagacaaaaaggattatgataacttttaaaaagtttgtgtaaatcttcagtgttacagtaggtgccggtttattggctgttttccattcatattaatctctactttaaaagtttatcaagagtataaagagtttcatgggaagaaccaagtttttctatgattaaaaacttattgtacagtgtcaggtattatatggatggaaagaaagagatttgactagggggaatatattggtctttccccccccccaccctttttcattattttgattttattgactggttgcccttactccctgtatttttgtgtcttt

SEQ ID NO: 5157 - DNA, 257 bp, Mus musculus
  misc_feature (209)..(210): n is a, c, g, or t
agaatggtgtttacagtgctgcaaattacaccaatgggagctttggaagtaattttgtatctgctggcatacagaccagttttaggactggtaatccaacagggacttaccagaacggttatgatagcactcagcaatatggaagtaatgttgcaaatatgcacaatggtatgaaccaacaggcatatgcatatcctgctaccgcagcnnctgcgcctatgattggctatcccatgccaacagggtattctcaataa

SEQ ID NO: 5158 - DNA, 498 bp, Mus musculus
  misc_feature (461)..(461): n is a, c, g, or t
aatgtggaggtcctgcaccacactaagcccgacaaataccagctgcacctgcacgagagctgcgtgctgtccctcaagttcgcctattgtggcaagtggtttgtgagcactgggaaagacaaccttctcaatgcctggaggacgccttatggagccagcatcttccagtcaaaagaatcctcatctgtcttgagctgtgacatttcagcggatgacaaatatattgtaacaggctctggtgacaagaaggccacagtttacgaggtcatctactgaacaaggactctaacaggcctgtcaaactctgggagagacacccacgtggccctgacagggagatgctggccaggccccgaggacggcagaaggagggagcagcattgtggggctgccctccagaaggtggagaggacgcacgccccttcgtggattgatgtgtctgacagacttgaaggactttntcctctccccctaaccagtgctggcagatgcttcaat

SEQ ID NO: 5159 - DNA, 521 bp, Mus musculus
acagagttaacagctgtctcaggaagaatcttcctgttaatgtgcggtggttgctttgtggctgcctgtgctgctgctgcacgttagggtgcagtatgtggccagttatttgcctcagtaaaagaacacgaagatcgattgagaagttattagaatgggaaaacaataggttataccacaagctgtgcttgcactggagactgagcaaaaggaaatgtgaaacgaacaacatgatggaatatgtcatcctcatagaatttttaccaaagacaccgatttttcgaccagattagcatttgctttatttatagagactttccaagtgtgttgtctttccaatggtgccttgcttggtgctctcctgctggtgacatgatgctggttctacagaattgggtggtgttcttgtttgttttgttttttaaataaccgcatgttctatgtgtgcatatttgtcaaactttgcaagttatttcatacagatgtttaatacttaagttattgtgctcttttctgttata

SEQ ID NO: 5160 - DNA, 541 bp, Mus musculus
  misc_feature (413)..(413): n is a, c, g, or t
gctgaaccaggttcccttggtagatgcactggtggtaccagtaggaggaggaggaatggttgctggaatagccattacaattaaggccctgaaacctagtgtgaaggtatacgctgctgagccctcgaatgcagatgactgctaccagtctaaactgaaaggagaactgacccccaatcttcatcctccagaaaccatagcagatggtgtcaaatccagcattggcttgaatacctggcctattataagagaccttgtggatgatgtcttcactgtcaccgaagatgaaatcaagtatgcaacccagctggtgtgggggagaatgaaactgctcattgagccgactgctggcgtggcactggctgcagtgctgtctcagcatttccaaacagtctctccagaagtaaagaacntctgcattgtactcagtggggggaatgtagacctaacctccctgaactgggtggggcaggctgaacggccagctccttaccagacggtttctgtttaaattcaggcaagattgtctctagatgaaaat

SEQ ID NO: 5161 - DNA, 513 bp, Mus musculus
  misc_feature (350)..(350): n is a, c, g, or t
accagcaatgctaccagtgacttaaacatcaaagtcgatgggcgtgcaattgtgcgaggcaacgaaggcgtcttcatcatgggcaaaaccattgaatttcacatgggaggagatgtggagttaaaagctgaaaacagcatcatcctcaacggcacggtgatggtcagccctacgcgcctgcccagttcctccagcggggaccagtcagggagtggtgactgggtgcgctacaagctctgcatgtgtgcagatggcacactcttcaaagtacaagtaacaggtcacaacatgggctgccaggtctcagacaacccttgtgggaacactcattagacggtgcatccgcaggnctcagcgcgctcagatctgacttgaccttcccctttttaagaatgcatgtgaaccatgtttgtacagcgtttgccataacttgtaattattttacctggggagcaccactgtgtctattatgtactctccatatttaagggatcttgagtgcctacattctaa

SEQ ID NO: 5162 - DNA, 489 bp, Mus musculus
  misc_feature (28)..(28): n is a, c, g, or t
  misc_feature (52)..(52): n is a, c, g, or t
  misc_feature (78)..(78): n is a, c, g, or t
  misc_feature (117)..(117): n is a, c, g, or t
  misc_feature (164)..(164): n is a, c, g, or t
gcagatgacctcaaggcacacccgttcnttcaacaccatcgacttttcccgntgacatccgaaagcagcctgcacccntacgtccccaccatcagccaccccatggacacctccaanttttgacccggtggatgaagaaagcccctggcacgaggccagcggangagagcgccaaggcctgggacacgctggcctcccccagcagcaagcatccagagcacgccttctatgagttcaccttccgcaggttcttcgatgacaacggctatcccttccggtgcccgaagccctcagagcccgcagagagtgcagacccaggggatgcggacttggaaggtgcggccgagggctgccagccggtgtacgtgtaagcctcagttaaccacaactcgaggaaacccaaaatgagatttcttttcagaagacaaactcaagcttaggaatccttcatttttagttctggtaaatgggcaacaggaagagtcaaca

SEQ ID NO: 5163 - DNA, 481 bp, Mus musculus
  misc_feature (385)..(386): n is a, c, g, or t
  misc_feature (411)..(411): n is a, c, g, or t
tcagccctgacttcaacgagaaagttggcatcgcctttgaccacatgaaggtctgctttggagacttcccgacagtgcccaagctgattcccccactgaaggccctgtttgcaggtgacattgaagagatggtggaacgcagggagaagagggagctacggctggtgcgagcagccctcctgacccagcaggcagacagcccagaggacagagaaccccaacagaagcgggcccacacagatgaaccacacagcccacagagcaagaaggagagcgtggcaaacactttaggagcgcgagtgtgacacggcgaggacttggcctgccttccctggcgaggacttggcctgccttccctggcgaggacttggcctgccttccctgnnctggcggcgctctgctcacttcctnatgaggcagcacaggatgttgtgactgccccgcagccttcaccgaaacaagaccatgtgccaagctcagg

SEQ ID NO: 5164 - DNA, 549 bp, Mus musculus
  misc_feature (258)..(258): n is a, c, g, or t
  misc_feature (266)..(266): n is a, c, g, or t
  misc_feature (275)..(275): n is a, c, g, or t
  misc_feature (278)..(278): n is a, c, g, or t
  misc_feature (286)..(286): n is a, c, g, or t
  misc_feature (289)..(289): n is a, c, g, or t
  misc_feature (302)..(302): n is a, c, g, or t
  misc_feature (331)..(331): n is a, c, g, or t
  misc_feature (337)..(338): n is a, c, g, or t
  misc_feature (359)..(359): n is a, c, g, or t
  misc_feature (376)..(376): n is a, c, g, or t
  misc_feature (434)..(434): n is a, c, g, or t
ccttgctggtggacccactgaggaggctcagagagctagcactgtacaggtttgaaccagatcccccaagcagctcatttggggcagacgttgggagcgctccaggaactttcctgcacccatctggcccactggctttcagttctgctgtttaactggtgggaggacaaaattaacgggaccctgaaggaacctggcccgtttatctagatttgtttaagtaaaagacattttctccttgttgtggaatattacatntctttttnttttttatntgnagcttttnttnttttttctttaantcttcttgttggagacattttaaagaacnccactnngaggaagcattgattttcatntggcatgacaggagtcntcattttaaaaaatcggtgttaagttataatttaaactttatttgtaacccaaaggtntaatgtaaatggatttcctgatatcctgccatttgtactggtatcaatatttctatgtaaaaaaaaaaaaaaattctgtatcagaataatgacaatactgtatatcctttgattt

SEQ ID NO: 5165 - DNA, 244 bp, Mus musculus
tggcgcagctgcacatcgtgctcatcgactttgggctgagctttgtctcaggactgccggaagataaaggcgtcgacctctatgtcctggagaaggccttcctcagcacgcacccccacaccgagaccgcgtttgaagcctttctgaagagttacggggcctcgtccaagaagtccagtccagtgctgaagaagttagatgaggtgcgcctgagagggcgaaagcggtccatggtcgggtagtg

SEQ ID NO: 5166 - DNA, 459 bp, Mus musculus
aagcctcaactgtaacctgcagcaaacagagaaataacattcctggcaggaagatacaagtctttttaaagtttactgatgcttaactctgtgggctcgtagtcctctgaaagtggttgttttcctatgcacagtgagctcagaaataaaaactccattttgagacattcagaatgtcccaacattacgacaacattttttttttttttttctaatccagtccaggttggaaagaagtctccttagtgtcagattaagccccatctcttaacaatatggacagatgagtgtgccatggccatgagctatttcctaacgcagaaggaatttgttgttactttttggattgtactcttctaggctggaccgaattcatatgcagattgaagtgagacctgctctttacagatggtattttgatagatactggagtttgtctgtattatatctgtgcccctt

SEQ ID NO: 5167 - DNA, 533 bp, Mus musculus
  misc_feature (92)..(93): n is a, c, g, or t
  misc_feature (293)..(293): n is a, c, g, or t
  misc_feature (337)..(337): n is a, c, g, or t
  misc_feature (349)..(349): n is a, c, g, or t
  misc_feature (392)..(392): n is a, c, g, or t
  misc_feature (404)..(404): n is a, c, g, or t
aagatgcgtggatggaacagtcgatgagtgcagagagcatggatttaataggcccagaagcacctgtgatacacacctctcaagatgagaannctttgaattatggccatgctctgcttcctggtgaaggtgcagcaatggctgaatatgtaaaagccgggaagcgtatcccacgaagaggtgaaattgggttgacaagtgaagagattgcctcatttgaatgttcaggttacgtcatgagtggtagcaggcatcgccgaatggaggctgtaagactgcgtaaagagaaccanatttacagtgctgatgagaaacgagcccttgcatcctttaaccnagaagagaggcngaagagagaaaataagatcctagccagctttcgagaaatggtntacagaaagacnaaagggaaagatgacaagtgacaacctgtttgtttcactgtgggacgtttaacaacaaaggctttgtatggccaaagtaatagtaaatggttttaccatttaccagtgctattgtacctactgtgttag

SEQ ID NO: 5168 - DNA, 354 bp, Mus musculus
  misc_feature (205)..(205): n is a, c, g, or t
  misc_feature (226)..(226): n is a, c, g, or t
  misc_feature (259)..(259): n is a, c, g, or t
  misc_feature (282)..(282): n is a, c, g, or t
  misc_feature (290)..(290): n is a, c, g, or t
  misc_feature (294)..(294): n is a, c, g, or t
  misc_feature (296)..(296): n is a, c, g, or t
  misc_feature (301)..(301): n is a, c, g, or t
gagaaccttgaggataaagacacagagttcacctgggaggtgaaggccaatgacagaacctatcacaagcagttcaagaagaagggctttctatgctggaggcagaagaagtacaaggcaggatttttctgccttagcctcctgagtgctgtgatgacaggcctgtgctaccatgtgttgctgttatgtctattctcaccaagtntcttaacttcgcctccttccntgcgagctaatccagcggctgacagtgcaggantcccatcaggcatatccacaatntcttgctntctnantcagntccatgactttgcactaagtagaacctcaattaatgcctgctggaggccttgc

SEQ ID NO: 5169 - DNA, 492 bp, Mus musculus
  misc_feature (89)..(89): n is a, c, g, or t
  misc_feature (164)..(164): n is a, c, g, or t
  misc_feature (167)..(167): n is a, c, g, or t
  misc_feature (227)..(227): n is a, c, g, or t
  misc_feature (229)..(229): n is a, c, g, or t
  misc_feature (231)..(231): n is a, c, g, or t
  misc_feature (237)..(237): n is a, c, g, or t
  misc_feature (250)..(250): n is a, c, g, or t
  misc_feature (275)..(275): n is a, c, g, or t
  misc_feature (277)..(277): n is a, c, g, or t
  misc_feature (279)..(279): n is a, c, g, or t
  misc_feature (293)..(293): n is a, c, g, or t
  misc_feature (309)..(309): n is a, c, g, or t
tcattctcttttcaccatcagcttccccctccctttccccccacttctctttataataacaagaagggagttatgttggtatcaggacntccaaaacccgtgacatcacatgggtgggacctgcagtcctgttgccaaggtaacaatcaccatattccagaatntanttggcttacctcccacctttacctgtgatatgtcatcacccatatataacccctcccatntntntctttntcttccccccttntctttctgccaccacgttgcccctntntntcctaataaacctntgacaggtggaactgntttggcatggtgtgctatatttagacacaagccgctgttctaacacatcaacaatgggtcagcaacaagtttccagccccacgccccagtaatggttctggaatgtccctagagatagaggaagataaaggtcacccgccctggaattcccttcatgtgctctaaatctggcctgcaagctca

SEQ ID NO: 5170 - DNA, 561 bp, Mus musculus
  misc_feature (378)..(378): n is a, c, g, or t
  misc_feature (466)..(466): n is a, c, g, or t
  misc_feature (530)..(530): n is a, c, g, or t
agtctttttggcaacagaatcgagccatggaagctcagatcacagctctccggcagcaagagaaagccttccagaatgaggctaaggctctgcatgaggagatcaaatccctgtgtgaggagaccaaggctctgcaacaccaggagagggctctcagaatggaagagaaagctctgatgagggatggagtggcggcggagctggccgaggccctgaccaaggagggggctgctctggagatggaagaacaggctctgtggaaggaggagcaggctctccgggaggagaacaaagcactgagagaagagcatggggctctccaagatgaagaagttgccctgcaggaagaggcgaaaatcctccaggagtggaataatnttcttcaggggaagatcacaaacaacctcccagggaaaacgcaaaaccaagacccaaagaagtgtggcccaagaatgtaaccacgaantcatgacaataagtagctttccagaacataaaagtagaattcgatcgatcgtgtaaccttattntcagaagcctcagaagttgatgtgctcgata

SEQ ID NO: 5171 - DNA, 207 bp, Mus musculus
gtgccaaaaccatcaattagatagaaatgatgattgcgctttgttctccttaaaggcaaaaccagttaacacctttgttccacattcagaaattctaattcccctctaatctgtgactacacatacaaatatcactgttttaaccatcaaaggggttataagatttataatggcagaatagataacaagacaactacctgacactga

SEQ ID NO: 5172 - DNA, 552 bp, Mus musculus
  misc_feature (190)..(191): n is a, c, g, or t
  misc_feature (195)..(195): n is a, c, g, or t
  misc_feature (197)..(197): n is a, c, g, or t
  misc_feature (199)..(200): n is a, c, g, or t
  misc_feature (212)..(213): n is a, c, g, or t
  misc_feature (217)..(217): n is a, c, g, or t
  misc_feature (230)..(231): n is a, c, g, or t
  misc_feature (252)..(252): n is a, c, g, or t
  misc_feature (267)..(267): n is a, c, g, or t
  misc_feature (345)..(346): n is a, c, g, or t
  misc_feature (354)..(354): n is a, c, g, or t
  misc_feature (360)..(360): n is a, c, g, or t
  misc_feature (366)..(366): n is a, c, g, or t
  misc_feature (375)..(375): n is a, c, g, or t
  misc_feature (378)..(378): n is a, c, g, or t
  misc_feature (385)..(385): n is a, c, g, or t
  misc_feature (397)..(397): n is a, c, g, or t
  misc_feature (421)..(421): n is a, c, g, or t
  misc_feature (517)..(517): n is a, c, g, or t
  misc_feature (525)..(525): n is a, c, g, or t
  misc_feature (527)..(527): n is a, c, g, or t
agcgtgtgtctgtccgtacttcctgggttgtctatgagatcagatggcagagacagcgcatacgtggctgacggcactgtgtgtggaccacaaatgtattgtataaacggaacctgcaaagaagttaatttcacaggaaatgactgcaacgccactaagaagtgcaaagggaatgggatatgtaataacnntggnantnnccaatgctttcnngacnacaggcctccagnntgtaacttacagattggatcnccggggggcagcatngacgacgggaacactctcagaactgagtcggcttttgctacaaagcgcctgagtaagaatgaggacagctgggtgatnntgggcttnttcatntttctncctttcatngtnactttcnttgttgggatcnatgaagagaaacgaaaggaaaatngtgcctcagggagaacacaaaatatgagggccattcattgcaccagaaatcggccaaggaagctagcagttgatggacccaaggaggaagtgtgtnttctaacngntctgttaccggtggatacactttaa

SEQ ID NO: 5173 - DNA, 455 bp, Mus musculus
  misc_feature (350)..(350): n is a, c, g, or t
  misc_feature (378)..(378): n is a, c, g, or t
  misc_feature (381)..(381): n is a, c, g, or t
  misc_feature (387)..(387): n is a, c, g, or t
  misc_feature (415)..(415): n is a, c, g, or t
aagctgctgcaaggatcgtcccagaatgggtcacatatgatacagaaatccggacactattagatcatcttgaaaataagaagaaaagtgcgaattcagttcatgatgaactctagcgcgggtccagaagatgaaacgtgataaaaatccgccacctgctggagacctgtggaactgccacgactagtaggccatttcattcacgttgttgtcatgaggttgactgctcataagctttatttaaacacatggaaagttgtaaataacctcatttatgtgattggtggactagtccttttaccagcacttaaggtgccgccgccgccgccgctgctgctattgttgttgtngttgctgttttcaccagctaatttgatnttntcagangtccttgaaggtttttgaaggtccttgntggtttagtattccagcttcaagtacacctatatttcctt

SEQ ID NO: 5174 - DNA, 545 bp, Mus musculus
  misc_feature (296)..(296): n is a, c, g, or t
  misc_feature (312)..(312): n is a, c, g, or t
  misc_feature (339)..(339): n is a, c, g, or t
  misc_feature (389)..(389): n is a, c, g, or t
  misc_feature (422)..(422): n is a, c, g, or t
  misc_feature (484)..(484): n is a, c, g, or t
  misc_feature (514)..(514): n is a, c, g, or t
aagcgattcttataaatatagccaggtggtcatttattcatgtgacaaaggcttcatcctgtttggaaattctaccatatattgtactgtgagcaagtctgatgtaggacaatggagcagtccaccaccccagtgtatagaggaatctaaggtcccaattaagaaaccagtagttaatgttccaagtacaggaatcccctcaacgcctcagaaacccacaacagaaagtgttccaaatccaggagaccaaccaactcctcagaaaccttccacagttaaagttccagcaacccagnatgaacctgataccangacaagaacatctacagacaaaggagngtctaactcaggtggtgaccgttatatatatggatttgttgctgttattncaatgattgatagcctaattatagtcaaaactntttggactattttaagtccaaacagaaggtctgactttcaaggaaaggagaggaaggatgtntcaaagtaagaagagagcaagaatccagtntccaccttttcaacctgtttgggtgtgtgct

SEQ ID NO: 5175 - DNA, 239 bp, Mus musculus
  misc_feature (41)..(41): n is a, c, g, or t
aatattggaatactgatgtctagcaagaacaagtatatatntgcagaaaggtgggctgcaatggcattggatttccttggccaccttagcaccctcaaaacaagctatgaagcaaaggtgaatcttctgtatgccaacctcatggaaatattagataaaaagacggatttaagatctacagagatgactgaacaattaagagcacttattgttcctccggaggatcaaggttcagtttc

SEQ ID NO: 5176 - DNA, 507 bp, Mus musculus
  misc_feature (350)..(350): n is a, c, g, or t
  misc_feature (362)..(362): n is a, c, g, or t
  misc_feature (365)..(365): n is a, c, g, or t
  misc_feature (393)..(393): n is a, c, g, or t
  misc_feature (465)..(465): n is a, c, g, or t
ataggagcagcaacatcagcaaaaagatgccttaaaattttattatggtatctgataaaaacaagaaataattcatatttctatctctgtgtagagttttttttatatgagtttaaaagtatctgaagtattaagttaaatgaaattgtccatataagacactaaggaccactctgagtttagaatagccatttgataaatattaactcatttttattattactattatagttgtcggtagtggttgtattttacatgtgatatcaaaacatcaaatgtttttttatattttatgtatacttgtaaaatagtttactcaatactattcccttgtgttagaagatttatanatgtataatttntantccacggccagtaattcatcagactttntctaatatttgtcaagtaggtccaagaaatgaaaaacaatcactcattgtaagtaagcaatatagctgcttntacatttatataataaagtagatttcacgttactcagtatgt

SEQ ID NO: 5177 - DNA, 560 bp, Mus musculus
  misc_feature (360)..(360): n is a, c, g, or t
gaaggtgacactgactcctgaggaagaggcccgcctgaagaagagcgcagacaccctctggggaatccagaaggagctgcagttctaaagtcttccccgtgtcctagcacttcactgtccaggctgcagcagggcttctaggcagaccacacccttctcgtctgagctgtggttagtacagtggtgttgagatggtgtggggaaacatctcactccccacagctctgccctgctgccaagtggtacttgtgtagtggtgacctggttagtgtgacagtcccactgtctctgagacacactgccaactgcaggcttcgattacccctgtgagcctgctgcatttgctgccctgcaccaaanatgcctaggccgacgagttcccagttaagtcgtataacctggctccagtgtgtacgtccatgatgcatatcttgtgcataaatgttgtacaggatattttatatattatatgtgtctgtagtgtgcattgcaatattatgtgagatgtaagatctgcatatggatgatggaaccaaccacccaagtgtcatgccaaataa

SEQ ID NO: 5178 - DNA, 375 bp, Mus musculus
tgactcggaacagagcgattggctcggcttcgactgaggcctgggaccgtgcctgcctgcctgcctgcctgcctgagcccctgagccttaaacttcacctgctccccgacatgctgtgtgacggtgtggcttcctcacctctcccctggtgggcatggcagggctagaccttgctcatgccccccaccccccacttctgccttcattccttccaccaccctgcctctccggtctcctcccccacttcctcctctcccatgtgcctgagtctcctaaccgaagaaaagggttgagccccaaggaggctatctgagaggagggacctggggtggggtttacctcttccaccccaagccatagggagctctattggga

SEQ ID NO: 5179 - DNA, 301 bp, Mus musculus
tttggaaactcctctacgtcagtattagctacgttagctgccttagctgaagcttctgccccattgtccaattcttcagaaactccagtagtggccacagaggaagtggttaccgcagaatctgtggatggtgcaattcagcaagtagttagctcagggggtcagcaagtcatcacgatagttacagatggaatccagctggggaatttgcactccataccaaccagtgggatgggtcagcccatcattgtgacgatgcccgatggacagcaagtattgacagtaccagcaacagacattg

SEQ ID NO: 5180 - DNA, 487 bp, Mus musculus
  misc_feature (325)..(325): n is a, c, g, or t
  misc_feature (334)..(334): n is a, c, g, or t
  misc_feature (361)..(361): n is a, c, g, or t
gacccgcctctcaacgtggataaaaccttccatgacctagttagagtaattaggcaacaggttccagagaaaaaccagaagaagaaaaagaagacaaaatggcgaggagacagggccaccggcactcacaaactgcagtgtgtcatcttgtgacagcctgaagccctgggcatagcaaccgtgaactgccagcccctgggaccagcccactgcctaactgcactgagaaccacttctaactacagcccttggctcttggactgggcattggaagggaatgagggaggagggggcagaagcaggccggggctggctttgctgcctntcccagganacagggctacagcttccaaaccttttntgtgttgactgagcccagttcccagtctcttggtgggcttgtttcttttaactccatagggctggtttgctatggaagtgcttacccacatacaacgcaccagacaagccatgagcaagcttcctc

SEQ ID NO: 5181 - DNA, 504 bp, Mus musculus
  misc_feature (417)..(417): n is a, c, g, or t
  misc_feature (431)..(431): n is a, c, g, or t
gagtacagtgaattccttccagctccccctgctcatcgctggcacccttccacagtgcagatgactcccccatcacaagttgatagcagggcccctcaatgctaaggagttccaccaggcatcttgtatagggacatgagatttcatgagtttgtttctagtagataacaggggcattcagatactctggttactatattctccatctgccatctctagatcacattgctgttttaaaccagagtatttatatctaacagataaggccttaaatccacaataatattctgaacaaataaatagaacttaatttgcattctcatgtggttcatattaaatttaatgattggttatttgattgcaccttttgtatcttaagctttcaaaaatctgctggacttctaatgacttctactntctttattattttnccttcctacctcgtgtagataatggcaaagcatatactattgtacattcatggtcaaagaacaagccccttgt

SEQ ID NO: 5182 - DNA, 548 bp, Mus musculus
  misc_feature (367)..(367): n is a, c, g, or t
  misc_feature (466)..(466): n is a, c, g, or t
  misc_feature (472)..(472): n is a, c, g, or t
  misc_feature (474)..(474): n is a, c, g, or t
  misc_feature (496)..(496): n is a, c, g, or t
  misc_feature (498)..(498): n is a, c, g, or t
  misc_feature (506)..(506): n is a, c, g, or t
  misc_feature (508)..(508): n is a, c, g, or t
  misc_feature (517)..(517): n is a, c, g, or t
  misc_feature (521)..(521): n is a, c, g, or t
gagagggtcagcagcaagtcccagatgttaatcatggtgaagaggattaagaacatgagtgaactgaaagaattgttcagcgatgctggaaacaagcttgtggtggtagagttttcagcaaagtggtgtggcccctgcaaaacaattgctcctgttttccaggcaatgtctttaaaataccaaaatgtcacgtttgctcaggtggatgtggactcatctaaggaattagctgaacattgtgacatcacaatgctacccacattccagatgttcaagtacacccaaaaggtcactccattctcaagactcaaaagagtactgtgctgcctcagaagtggaccgaagagcaagatgatttttgaatgtnatggagctgatgctaaacaactggaaaagaagattcaagagctaatgtaaacggccacccaaatatacctgtgacatttcctaaagcaggagctaatgntctgtntnttgcatgccctgcgagctgttntntattggtntntcctgacgntctntcggaagaacgcggcattacaggacca

SEQ ID NO: 5183 - DNA, 429 bp, Mus musculus
  misc_feature (339)..(339): n is a, c, g, or t
  misc_feature (360)..(360): n is a, c, g, or t
  misc_feature (362)..(362): n is a, c, g, or t
  misc_feature (370)..(370): n is a, c, g, or t
gtttgtgtctcagctctgtgaagatcaagctctctgcataaagaagtaccaggaagctttgaagaggatagaagaagaactagaaactggataccttgagagagaagtatcaaaagtcttaagcatggattctgagagagaaaggagtacgagcctaaataagatggatggcttcatcagtaaaggggcactgaggttcagtaaaagtatttttcgttccctcttgttctccacgctgtttttcatcagattgctgggatacctgatcttccatttaagttttataaatcccgacctcctggtcaacgcgctgcctaagatactgagcagggacgtctntgtggaagctgagatgtttcntnttcccatntctcacgcttgagacagaagacatgttacctcactgatccccaagccatacctgagggc

SEQ ID NO: 5184 - DNA, 303 bp, Mus musculus
agatgagtgaccacctgtgccaggtgcctgaggttctttttacacctgaccatctaggtattcatgatttaggaatctcaaaaatggtctgcaacagcatcatgaactgtgacactgacatccaggagaatctgtttgctgagattgtgctttctggaggtaccacaatgtttcccgggcttcaggatagactcctgaaagaactagaagatctggcttttgagggaacccctatcaagatcacagcttcctcagacagatgttattcggcttggattggtggatctgtcatgacatccatga

SEQ ID NO: 5185 - DNA, 510 bp, Mus musculus
  misc_feature (299)..(299): n is a, c, g, or t
  misc_feature (360)..(360): n is a, c, g, or t
  misc_feature (445)..(445): n is a, c, g, or t
  misc_feature (465)..(465): n is a, c, g, or t
agtccatctgcagcatgttactcatcaaagatccaagtaagagactgggctgccagagggatggagtctctgctgtaaagcagcacccaatattcaaggatataaacttcagcaggctggaagcaaatatgttagatccacctttcattcctgatcctcaggccatttattgtaggaacatcttggatattgggcagttctctgtggtgaaaggagtcaacctggataccaatgatgaaatcttctacgctgaatttgcgacagggtctgtcaccatcccctggcagaatgagatgatngaatctggatgtttcaaggatctcaatgaaaatgaagacgatttgtcatcacttgaaaaantacaagatgtgttcctccattctcagaccaaagagaaacttcttccgtagactcttcagaagaacgggctgcctgaacattgccntcagtgaggagagggagccnacagaacactgaccattcactgtgcagaccacagagcaagacctt

SEQ ID NO: 5186 - DNA, 553 bp, Mus musculus
  misc_feature (75)..(75): n is a, c, g, or t
  misc_feature (279)..(279): n is a, c, g, or t
  misc_feature (293)..(293): n is a, c, g, or t
  misc_feature (338)..(339): n is a, c, g, or t
  misc_feature (341)..(341): n is a, c, g, or t
  misc_feature (350)..(350): n is a, c, g, or t
  misc_feature (353)..(353): n is a, c, g, or t
  misc_feature (407)..(407): n is a, c, g, or t
  misc_feature (432)..(432): n is a, c, g, or t
  misc_feature (492)..(492): n is a, c, g, or t
tcacagtccggatggaaaacacctaccagttaggtcccaccaaacctttccccgtggccactgtcaatcatattntggaagatgtactaactacctacctacaagaagcacaatatgacccagagttctgcagacaaatgactaaaacaatttctgaggttattaagacccaggtcaaggaattagtgattccgagatataaactaattgtcatcgtttacatcggacagcgggatgaccagagcatagttattggcagcagatgcctctggaatcctnaaagtgatactgtntcgtcctatactttcaaaaattctacattctttgcacttgcaaanntntatgcagtntanttcgagtgattgaaagtggtccttgtgtgttaaaatcatgaaccaggctgtgtntctctattcacaaaagttctactgncaaaacctgtgggaaagagacaagatgaagatttcaaacaactggaagctttggtcgctntcgtgaggactggtggagggggacgggagcctaagaaacaggtcctgtttgttcaaagcag

SEQ ID NO: 5187 - DNA, 327 bp, Mus musculus
  misc_feature (292)..(292): n is a, c, g, or t
tttattttgctagcctctggtccagcaagactgcctgttgaaggcttcagagtagtgctaagatacatcaagatctgctcggcatccaggagggctatgagaatgccaattttggctggtcctgttaggtcatctagaattatatcatggtgatcagtcaagtgaatttgaaaaactttgaggtatcatctgtaacatctctcatgctcagacttgaacatctctcatgcttcagcagaacacccaccccaatgaggcatgcctatattcatcctgaacagattattaccancagtgactgcctttgcactatttcaccaaggccag

SEQ ID NO: 5188 - DNA, 597 bp, Mus musculus
  misc_feature (352)..(354): n is a, c, g, or t
  misc_feature (367)..(367): n is a, c, g, or t
  misc_feature (388)..(388): n is a, c, g, or t
  misc_feature (400)..(400): n is a, c, g, or t
  misc_feature (414)..(414): n is a, c, g, or t
  misc_feature (416)..(416): n is a, c, g, or t
  misc_feature (431)..(431): n is a, c, g, or t
  misc_feature (505)..(505): n is a, c, g, or t
  misc_feature (552)..(552): n is a, c, g, or t
tgtatcagacaccaaccagtgtgtttaaatgtaacactctggctacagttttaggggcagactgaggtggacaggagctgtgctggagccagatctgccttggattacatgggaggaagtgacaaaagccagaacaaacagaaccagtgactgggggagtaacggtgaccagactgtggtataaagtgatacagaggtttgctttcacaaaaccactgtacaccgtgctttttttaaaaaaataacttactatgaaaaacttcaagcattgcaaaagtgagccgtaacatggtaacagtacagagtcattacccagtgtgaacagtcgtgttctaatgggcagtagtctctnnntgtctagccctangctaccccacttcctgtatgntcaactggatcntcaagaccatttcntntctagctgcaccacntgaggctctctcagcttttgaagaacatttgcaaatgtttcataacaataccatcacgtgcagttaatggtatntagtcaatgtttataaagtgattagacaatgggaaatttggagtttntttgtatgaatcaagatcaaataaagttcacgcattgctactgcc

SEQ ID NO: 5189 - DNA, 493 bp, Mus musculus
  misc_feature (259)..(259): n is a, c, g, or t
  misc_feature (261)..(261): n is a, c, g, or t
  misc_feature (264)..(264): n is a, c, g, or t
  misc_feature (269)..(269): n is a, c, g, or t
  misc_feature (275)..(275): n is a, c, g, or t
  misc_feature (292)..(292): n is a, c, g, or t
  misc_feature (316)..(316): n is a, c, g, or t
  misc_feature (351)..(351): n is a, c, g, or t
  misc_feature (363)..(363): n is a, c, g, or t
  misc_feature (383)..(383): n is a, c, g, or t
  misc_feature (412)..(412): n is a, c, g, or t
  misc_feature (453)..(453): n is a, c, g, or t
ggtggcaataatagtcccgagttcaaggagttcatcaaggcctccagggagcacctgaaacggagcctggccctggccgcagccgccgagcacaagttggaacagatgtacggatctaacgtcttcccagagggacgtaccagcgacccagacaatgacatggaaatgattatcaatatgctgtacaactccaggtccaagttgtcagattatttcaatattaagcgtgtaccatcagagctgagagaaaaggcttccntncgngaatngctganttgagaaaaatattatntgtggatcaggtagaaatgcaaancctcattaagaagctgttaagcaataatatgaaantcctaaatattnttaatgtcccatgaccaaantcatgtaagcaaaggacttgttcacaggnaaataagcatagtgatttttaaagttgcctaaaatattttntacaatattttccatgtgctaacatccttgtatgtcatat

SEQ ID NO: 5190 - DNA, 422 bp, Mus musculus
  misc_feature (385)..(385): n is a, c, g, or t
ggtcacgatagccaaaattcccagagcaaagaagaaatacgtgacgagagtgtgtggccttgcaacttttgaaattgatctcaaagaagcacaaagattttttgctcaaaaattctcgtgcggtgcctcagtgacaggggaggacgagatcatcattcagggagacttcacagatgacatcattgacgtcattcaggaaaagtggccagaggtggatgacgacagcattgaagaccttggagaagtgaagaagtgatcctgaagtcatgtgtttctaactgtgacctgagagctgacacggccagcagaggagaggcctttcagaatatatacatatgtacatttgtgtgtatatataccctacagtaaagctgtcgactcctcntcctcggcgtcctcactgttccgtacaaggctgcttg

SEQ ID NO: 5191 - DNA, 525 bp, Mus musculus
  misc_feature (324)..(324): n is a, c, g, or t
  misc_feature (355)..(355): n is a, c, g, or t
  misc_feature (368)..(368): n is a, c, g, or t
  misc_feature (416)..(416): n is a, c, g, or t
  misc_feature (459)..(461): n is a, c, g, or t
  misc_feature (493)..(493): n is a, c, g, or t
  misc_feature (499)..(499): n is a, c, g, or t
atgcctgggcatcaccgtgtcatagctaccctcttgttgccacaaggttggttcattcaggttctggatgtcggtcaccctcccttggatctgacctgacctttgctaccaggacaggctctcggcagggcattgagatgcatctcttcagggttgaaactcatcgggatttgtcgacctggaccagaatacttgttcagggctgccatgctgctgctgagctgatcaaggaagtctccctaggctgcaccttaagtggccaagaggtaaggttcactgtccactatgaacacgggttcactatcaccagagacaatggaggcnccagcagcatattgtaccgctatccctttgnacggctgaagatntctgctgatgatggaatcagaaatctctatttggattttggtggcccntgagggagaactgactatggacctgcattcttgtccaaagccnnngattgtatttgtattgcacacgttcttatccnccaaantcactcgcatgggactgcttgtgtga

SEQ ID NO: 5192 - DNA, 377 bp, Mus musculus
  misc_feature (39)..(39): n is a, c, g, or t
  misc_feature (46)..(46): n is a, c, g, or t
  misc_feature (84)..(84): n is a, c, g, or t
  misc_feature (136)..(136): n is a, c, g, or t
  misc_feature (150)..(150): n is a, c, g, or t
  misc_feature (310)..(310): n is a, c, g, or t
  misc_feature (315)..(315): n is a, c, g, or t
ctgtaagtgggtaagctgtgctcttcttctggctgaggncctgtgngcccacagggtttttaatactgtcatttgaggcttatnaaatgaaggcttatgggtgattttgttgtcattaggagcaccaagagcaagntcctaagctgcttnttccagaagctgtagcagccccaacccccgcaggtggtcagttaggaattttaaaccacaagtggaatgctttttgtgagtgtgggacaccttgatacaaacctatattatcaattttgtactcaaaagccaaaatatagcaaactattttcaaatgatnaactnaaaaatgggcatctttgataattcacctctttttatagaatcagctatattgtctttaattt

SEQ ID NO: 5193 - DNA, 525 bp, Mus musculus
  misc_feature (371)..(371): n is a, c, g, or t
gcaagaacgcttggacatcgaggaaaaatataccagtctgcaagaggaggcacaaggaaagaccaagaaattaaagaaagtctggaccatgctgatggctgcaaagtcagagatggctgatctccagcaggagcatcagagggagatcgaaggcctcctggagaacatccggcagctcagccgggagctccgtcttcagatgctcatcattgataacttcatacctcaggattaccaggaaatgattgaaaactacgtccactggaatgaagacataggagaatggcagctaaaatgtgtggcctacacaggaaataacatgaggaaacaaactccagtccctgacaagaaggagagagacccatttgaantcgacctttcccacgtgtacctcgcctatacagaggagagtctgcgtcagtctctgatgaagttagaaaggccacggacctccaaggggaaagcaaggccaaagatggggcgaagaaagcgttctgcaaagcctgagaccgtaattgattcttt

SEQ ID NO: 5194 - DNA, 364 bp, Mus musculus
  misc_feature (168)..(168): n is a, c, g, or t
  misc_feature (265)..(266): n is a, c, g, or t
aaaccgttctgtcggtgcgactaatatgaacgagcacagctcccgatcccacgccatctttacaattactatagagtgcagtgagaaaggcgtggacgggaacatgcacgtcaggatgggcaagctccaccttgtggatctggctgggtcagaaagacaagcaaaaanctggagccacaggacagcgcctcaaggaagctaccaaaatcaacctttcattgtctaccctgggcaacgttatttctgccttggtggatggaaaaannactcacgtgccgtatcggaactccaaactgacccgtctcctgcaggactccttaggagggaactcaaaaaccatgatgtgtgcaaatattgggccagc

SEQ ID NO: 5195 - DNA, 575 bp, Mus musculus
  misc_feature (36)..(36): n is a, c, g, or t
  misc_feature (322)..(322): n is a, c, g, or t
  misc_feature (484)..(484): n is a, c, g, or t
gtagctaatgtgaacccaggaggatgggcgccagcntcggtcttaagagcagtggcaaagcgagaataccctaagtttctaaaacgttttacttcttatgtccaagaaaaaactgcaggaaaaccaattttgttttagtattaacagtgactgaagcaaggctgcgtgacgttccatgttggagaaaggagggaaaaaataaaaagaatcctctaagctggaacgtaggatctacagccttgtctgtggcccaagaagaaacattgcaatcgtaaagctgggtatccagcactagccatctcctgctaggcctcctcgctcnagcgtgtaactataaatacatgtagaatcacatggatatggctatatttttatttgcttgctccttggagtgaaaacaaataactttgaattacaactaggaattaaccgatgctttaattttgaggaacttttttcagaattttttatttaccatggtccngcctaagatcctcagttgtatcaggttttgtgcacaaaagaaaagcacaaaagttgaacgcacctgaggcatgtgctctctgtgcaccaaa

SEQ ID NO: 5196 - DNA, 361 bp, Mus musculus
gcaactactgctggaatccttgctacactttctcattgtattgaattaatggtaaaacgggaagagagctggcaaaaaagacacgatagggaagtggaaaagaggagacgagtggaggaagcgtacaagaatgtgatggaagaacttaagaagaaaccccgtttcggagggccggattatgaagaaggtccaaacagtctgattaatgaggaagagttctttgatgctgttgaagctgctcttgacagacaagataaaatagaggaacagtcacagagtgaaaaggtcaggttacactggcccacatcattgccatctggagacaccttttcttctgtcgggacgcatagatttgtacaaa

SEQ ID NO: 5197 - DNA, 353 bp, Mus musculus
catttgtccttcttgctaaaccgttaagtagctggaagatatctggatccttctatgccctctcacccgtaggcccccttctgaagtgcagaatgattctagcaccatctctctgctacaagtgatttaaatggcccatggtatgctatagggacagtcagagttcaccctggctctgagtggagcagctttgccaaagcatgcctcagagaaagtctccatggcttgagacagagccacttctccttcagaacagacagtgtgagcccattgtccctcctcttagaacccagatcccctgtagtatagagaggaggaagcgctgccagctgcccttgaactcgtggtgaagc

SEQ ID NO: 5198 - DNA, 284 bp, Mus musculus
gtcaagctgctcttgggccgaagatgcagcctgaaggtatctggaaaagaaagtgtggccacattgaagaaactggtttctcagcacctacaggtgcccgaggagcagcagcacctgctgttccgaggccagctcctggctgatgacaaatacctctcagattacagcattgggcccaacgcttccatcaatgtcatcatgcggcctccagaggatgcagcgctggataagacccatcaaacccagcccctgtggctccagctgggccaggttctagacaaaca

SEQ ID NO: 5199 - DNA, 248 bp, Mus musculus
gagatccaatactgccagcgcctggtggatcagtgtcgccatcgcctgctcatggaatttgacatctggtacaatgagtcttttatgatcccagaggacgttcaggtagcactgaagctaggcagcagcatccggccaggaatggtgcctatcagcaggattgtgtgtctgggagaagatgaccaggacaggttcagccatctgcagcagactgtcctgcctgaaggtcttgattccatcaccttcta

SEQ ID NO: 5200 - DNA, 275 bp, Mus musculus
acaaaccatcagcaatgcctgtggaacgattggactaatccatgccattgcgaacaacaaagacaagatgcacttcgaatcagggtcaacattgaaaaagttcctggaggagtctgtatcaatgagccctgaagagagagccaaattcctggagaactatgacgctattcgagttactcatgaaaccagtgcacatgaaggtcagactgaggcaccaagtatagatgaaaaagtagatcttcattttattgcgttagtacatgtagatgggcatc

SEQ ID NO: 5201 - DNA, 546 bp, Mus musculus
caacgattctcttctgactgcagcatcactcagatgaatcacacactcccgagggaaaaggagaagaggctgatgcatggcctgtctgaggatgagttaagctcttctacaagctcaactgataagtcagatggggattccagggaggggaagagtcatacaaatgaaatgaaagacttggtacagctgatgactcagactctgaggctggaagctaaggagagctgtgaagatctccaggtcctaaacccagggtcagaattcagacttcatcgaaagtatcgagacacgctggtgcttcatggcaaggttgcagaagaggtggaaccccactgtacggagctgcctacgggtatcataccaggttctgaaaagatcaggagaatcgttgaagtcttaagagctgatgtaatccagggcctggggattcaactcttagagcaggtgtttgatcttttgggagaggaagatgagttggagagagaggcacgattacaggagcacatgggagacaagtatacaacttactgtgtgaaagctcgccaa

SEQ ID NO: 5202 - DNA, 364 bp, Mus musculus
  misc_feature (115)..(115): n is a, c, g, or t
  misc_feature (141)..(141): n is a, c, g, or t
  misc_feature (249)..(249): n is a, c, g, or t
  misc_feature (335)..(336): n is a, c, g, or t
  misc_feature (339)..(339): n is a, c, g, or t
ggaacgatgtctcatgctgatgcttgctgccattagtaaccttagcaagtagttggtgttcattctctaatatcaattcactcttctgggaatagatttaaagaacatgaggttntatgttgcattcaaacaactgttatngttttctttttacacatcagtggacttttaatattttgatttattctgaaccttagtgaggctgtctttagacccttagaactcttgttcaacctaacgtatagcttngtaagtcactgtgacttgacatgtttgacttctttttcccatcagcaaaaacattcttttaaacatgagttcctttttcaattaannagngtctaagtccaggttcttagtccta

SEQ ID NO: 5203 - DNA, 455 bp, Mus musculus
  misc_feature (28)..(28): n is a, c, g, or t
  misc_feature (198)..(198): n is a, c, g, or t
  misc_feature (269)..(269): n is a, c, g, or t
  misc_feature (276)..(276): n is a, c, g, or t
  misc_feature (283)..(283): n is a, c, g, or t
  misc_feature (298)..(298): n is a, c, g, or t
  misc_feature (397)..(398): n is a, c, g, or t
  misc_feature (406)..(406): n is a, c, g, or t
tgggctagcatttccctttaagcatccngatgaatggcgagcatatccatttcactgggcttggcttcctcaagcaaaggttcctttttctgaagagactcgaaacttgattctaccctatatttctgacatgaactttgtacaagacttgtgtgaagatctttatgaactttttaagactgacaaaggatttgacanagctgcttttgaaaatcagatgtctgtgatgagaggccagatcttaaacctcactcaggcactgagagacnggaagantcctatncagctggcacagatnccatgtgtgatcgtggagtgcagcaaaagtggcagccagggccgtgtggtacacctgggcagctccttcacccagacggtccactgcaggaaaccgttnnttctcctnctggtagcagatgtaaggggaacaactgtgtggtgttactgtgctgata

SEQ ID NO: 5204 - DNA, 499 bp, Mus musculus
  misc_feature (209)..(209): n is a, c, g, or t
  misc_feature (229)..(229): n is a, c, g, or t
  misc_feature (238)..(238): n is a, c, g, or t
  misc_feature (245)..(245): n is a, c, g, or t
  misc_feature (248)..(248): n is a, c, g, or t
  misc_feature (286)..(286): n is a, c, g, or t
  misc_feature (330)..(330): n is a, c, g, or t
  misc_feature (357)..(357): n is a, c, g, or t
  misc_feature (438)..(438): n is a, c, g, or t
tgaaccaggcagagcttaccggagcccaatccatcaaaccatcatgtcggagaagaagagccaagaaaagccttgcagcgacaacaaccagatagaagatccttcttctaggcctgaggtacaggttcctgtgaattatgtgtaccgtatactgcaggaggagcaatataccccctgcatagggtccacaacttcagatttccttcttnccatgcttgattacctcacngactacatnctggagntgntgggctccgaagccaacatcaacaaccagcaaaatatntcacaagatagagagagacagagagacaacgaccgcgaaccctntcgaggcttcaagaatgcgcctttctntctgtttgacgagatgcctggacccagaaggaatggctaaagaatggggtacacaacccaagggtggaaagcctcacagantcagctagaaccatgaaggctaatagcagaggaggctcccctggtgtccatgactactaat

SEQ ID NO: 5205 - DNA, 354 bp, Mus musculus
  misc_feature (121)..(121): n is a, c, g, or t
cctgcagctgttggcccgggagatccgggacagcaagaagttcctgtgggaggaactggagctggtgcgggaagaggtgactttcatctatcagaaactccaggaccaggaggatgagatntcagagaatctcctgaatatccagaagatgcagaaaactcaggtgaagtgccgcaaggttcttaccaagatgaagcagcaggcatacgattcatggccagaagccgagggggtgcccacagaaggcaacggttgctgtaaggatgacctccagaaggagctgggtgacatatggtctgccgttcacagtctgcagagctccattgactgtcttgctttgtcaatgggcaccag

SEQ ID NO: 5206 - DNA, 407 bp, Mus musculus
  misc_feature (362)..(362): n is a, c, g, or t
  misc_feature (364)..(364): n is a, c, g, or t
  misc_feature (366)..(366): n is a, c, g, or t
  misc_feature (369)..(369): n is a, c, g, or t
  misc_feature (380)..(380): n is a, c, g, or t
cacgtggcttgcaatgtggaccccacggcccaccagggagtaccagcgcttcccccatctggtgattcttgagtgcacagaggtcaactctgtgggcttcctggtggctttcgcacacaacatcctcctctccatcagcacctttgtctgcagctacctgggtaaggaactgccggagaactataacgaagccaaatgtgtcaccttcagcctgctcctccacttcgtatcctggatcgctttcttcaccatgtccagcatttaccagggcagctacctacccgcggtcaatgtgctggcagggctggccactctgagtggcggcttcagcggctatttcctccctaaatgctacgtgattntntnccntccagaactcnacaacacagaacactttcaggcctcca

SEQ ID NO: 5207 - DNA, 391 bp, Mus musculus
  misc_feature (266)..(266): n is a, c, g, or t
  misc_feature (272)..(272): n is a, c, g, or t
  misc_feature (337)..(337): n is a, c, g, or t
gaacagatttatcacctccaggaacaactgaaatgtttcctgaaggagtaaggaaagcctcagcctggcacaccaagtggattcaccctccagatgaagactgggtggaaccacatacttctgtccctctactttatcttaaacaacttttatttgttgagcatttttcactaaagtaaatttaaggatcacatttatataggagacatatatagagggagttatataaatgcataggtttagagacccacatgggatgttgtttntctttntcaatttgagattaaatgtgtgtatttctttatctcttactctatggtaccatgagatcattcanccgtccttgtcaaaggtttaggctagaaagatacacagctgttttacataagtt

SEQ ID NO: 5208 - DNA, 534 bp, Mus musculus
ccctattcttgctctgtgtgtggaaagaggttttcactcaagcatcagatggagacacattaccgagtccacacaggagagaagcccttctcctgtagcctctgtcctcagcgctcccgggatttctctgccatgaccaagcacctgaggacacatggggctgctccctatcgatgccctctgtgcagggctggctgccctagcctggcctccatgcaggcgcacatgcgtggccactcgcccagccggctgccgcctggatggaccatacgctccaccttcctctactcttcctcgaggccgacccgggcctccagctctcccggtagtcctacctcctctgctgccacctgaccgggtgttggtagcttctctggcttgacaaagagtccaaagaatgaaaggcagaagggctcagctagggcggcctggcaaatttaaccacagaagaactgcgagacaggagctacgaacccttccgggacaagcgagttgcagaagcctcggcctggcgagcccgagttaaaggacaat

SEQ ID NO: 5209 - DNA, 333 bp, Mus musculus
caagcaggacatggctcggcagctacgtgagtaccaggagctcatgatcgtcaaactgggcctggactttgagatcgctacctaccgcaggctgctggagggtgaggagcagaggcttggtctgggacttggggcagggagtgtggctcccggcggtgacgtcactggagacaggtcctccctaagggcacccggagtcagttcctgtggcctgaacatgagcgccccaagtggtggctgcgctctctgcagctctgcgggctgtgttggaggctttggctgccttggctcccgtgaatgttgaacccctccctccggagaagactagaaact

SEQ ID NO: 5210 - DNA, 413 bp, Mus musculus
  misc_feature (120)..(120): n is a, c, g, or t
  misc_feature (122)..(129): n is a, c, g, or t
  misc_feature (131)..(132): n is a, c, g, or t
  misc_feature (169)..(169): n is a, c, g, or t
  misc_feature (367)..(367): n is a, c, g, or t
  misc_feature (373)..(373): n is a, c, g, or t
  misc_feature (388)..(388): n is a, c, g, or t
gacccctggaaggaaaggttgctgtcagctgctctctgaggaacttagatgtgggcaggaagaaagaaaactccaggacccggactgcccacatagataaacacagcaagttcaaaaagntnnnnnnnntnntggatattgagcagaattccaagatggctgcagcccnaaggatggaggagaaaatccagagacttcagaagcagcttagtgatttgaaattgtcaaacaaaaacatgaagactcaactaacgagaataaatgtccttaaagacaaaacaattgagaggctcaggcaatctgtaacaaaagttgaaaccttgaaagagaagacagcagccaaaacagacaacttgaaaaccccatncagatnctgcggagcagggancaagaccagaaaaggagagggccca

SEQ ID NO: 5211 - DNA, 437 bp, Mus musculus
  misc_feature (283)..(283): n is a, c, g, or t
  misc_feature (295)..(295): n is a, c, g, or t
  misc_feature (297)..(298): n is a, c, g, or t
  misc_feature (374)..(374): n is a, c, g, or t
  misc_feature (380)..(380): n is a, c, g, or t
gagaggctcaggcaatctgtaacaaaagttgaaaccttgaaagagaagacagcagccaaaacagacaacttgaaaaccccatcagatcctgcggagcagggagcaagaccagaaaaggagagggcccaccagacgccagcccagagccttccagacccttccacagtcagggctgtgctgaaagggctctcaggacgagagcaagagcttgctgacttccgggaagccatcatgaagatgctgggatttaacatgaaaacagcagacaaggatgtcattaatnggctgaagcttntnntccaaatttatgaaatttctaaaagatcaaagatggcttctcactgtgagcctggtcaggccaagtgagcaagatntacctntatatgcggttaagaagttatacacagctgtttcctacagcacccagaaaatagcta

SEQ ID NO: 5212 - DNA, 481 bp, Mus musculus
  misc_feature (322)..(322): n is a, c, g, or t
  misc_feature (412)..(412): n is a, c, g, or t
  misc_feature (429)..(429): n is a, c, g, or t
  misc_feature (455)..(455): n is a, c, g, or t
gatgacaccgacgatcaggcagatgagccactgagcgctgccgaatttcttcacctgcaagatattcttcaggaggacagagtcagcagtaccgatgatgaggacacttgccaagctggatgtactgaagatgatgaaaccagtcacagtgacagagacatagacaataatgtgaaagtcatcactggcaacattaaagcaagcccctccatgtatatggagatgttcactgatcagaacccacaagctgaccaagacctggaagaaactgaatcagatggtgccatgaacccaactgattaagcaggcaggcagaaacgtntcaccatcagctaccattgtgccctcatgcataaatgaagtcctgatggaaaacagacaaacaaacaaacaaacaaacatctctacacantaagccgaaaacaaatntataccaaactgctaaaataaatggnaaatacttaatttgagcctggctgtt

SEQ ID NO: 5213 - DNA, 322 bp, Mus musculus
  misc_feature (229)..(229): n is a, c, g, or t
  misc_feature (283)..(283): n is a, c, g, or t
  misc_feature (288)..(288): n is a, c, g, or t
atcaagggccgcagcaagttgggcagcttcagcgacgacctgcacaagactccaggtcctgcggcataccgtcagactgaggttcaagtgaccaagttcaaggctccacagtacaccatggctgcccgggtggagcccccaggggataaaaccctgaagccaggaccaggagcccacagccctgagaaggtgaccttgaacaagccctgtgctcctactgtcacctttngcatcaagcattctgactacatgacacccttggttgtcgatgtggaatagcctntgctntctgtgactacgatcctcccacagaaatgtgctg

SEQ ID NO: 5214 - DNA, 577 bp, Mus musculus
  misc_feature (307)..(307): n is a, c, g, or t
  misc_feature (341)..(341): n is a, c, g, or t
  misc_feature (374)..(374): n is a, c, g, or t
  misc_feature (408)..(408): n is a, c, g, or t
  misc_feature (458)..(458): n is a, c, g, or t
aaggtgcattcgtatttgccctggcacaatagcaccccagagtcctggagcagggagccaggggagaggctccttgtggtagaagttgtatctctgagggagttgccctgcttccgttccccctcccctgatccacacaattgagggactggtgcttgtaccacccccaggtccccctccccccgggactgaagagccagaggttgcctctcagccacaggtcctgaaggatgtccatcatattaaggggaggttgtggatcagcctggggttggggcctcagggaagctgggttcatcgtccctanttgacagttcagtgttcggaaggttagactcagncttcatgtgcagggcaaagacttgtgtatcaantcttatgggggatgggtcactggtccttccccanttctgccctagttgtaggtggcgacactagaagtatgacaccaagtcacnttggttgaccccgtgttctgcacttggctttttctgaggggctgtgagtcctggattcagagttgactgctttgtgctacttgctcagttcgtgccctgtgcatgcttctgtgttaata

SEQ ID NO: 5215 - DNA, 236 bp, Mus musculus
aaaacctgctagaaggtgaaatacaaaggctgagagatcccgagagagtaaagtctgcaaccaaattagagcgaactaagaaacctggaaaatcagaaaagaaaaaggataaagatttagaaaggaatatatctccaaacagagaatttaaatcatttaaagaactgcatcaaatccaagaaactgaaagaaataagactcaactcgataatgtcctacctcaaaagtcagagatg

SEQ ID NO: 5216 - DNA, 459 bp, Mus musculus
  misc_feature (367)..(367): n is a, c, g, or t
  misc_feature (388)..(388): n is a, c, g, or t
  misc_feature (395)..(395): n is a, c, g, or t
  misc_feature (397)..(398): n is a, c, g, or t
  misc_feature (434)..(434): n is a, c, g, or t
gaggtaatctcatgctttgtccagagagagaaccttcacacctgtgtactgccccagccccctgagtggcatcacacctctactctacgtggctcagacaagacagtcaaatatcttaaaaattctcctgcagtatggaatcctagaaagagaaaaaaaccctatcaacattgttctgacaatactactttacccttcgagagtgagaataatggttgaccacgagttgattgacattcaagaagatgccaagacatgtttaatgctatgttccagagtgctttctacgatctcagtcagggagatagagacacagctgagcttaggacgacgcccaattattcaaaattggttggactacatcccnccaacaagatacaaggatccntgtgaantnntccacctttgcagaataaccatcaggacccaactgntggccaacaatatgctcccaaatgg

SEQ ID NO: 5217 - DNA, 288 bp, Mus musculus
tttctttttccctaatgctattgtttttaatgtggttcgtttgtgatgtggtgttcagagtaaaaattgaacattgtcacttcatctctttagaacacctggaagtctgaattctagtgctcagtattcattatgatgattttggtgatcaaacctcagctcctttagaatacgcaccgcgaggctgcccttcttgggacaagtgtgatgatttccaatgccatcccatcagccaaggattccagcatgtggctaacttcaaacctcgcttgtgatttttcagggcaa

SEQ ID NO: 5218 - DNA, 476 bp, Mus musculus
  misc_feature (268)..(268): n is a, c, g, or t
  misc_feature (280)..(281): n is a, c, g, or t
  misc_feature (341)..(341): n is a, c, g, or t
gattgcactccaaggaaagttcctattgttaataaaatttacgtagaggagaaacgtttgtttgaggtggtagttctttctgtgaggttttagtattcgaactcttagaatgtgaacacattcgagagctgacttcttcctgagagttttaactactggaaatccttaaccaattatattttctttattttgagaatgatttggttgctttttcttagatggtttctgctattttctgtaatcatagttcatctaaacacagcctatntttcgtgaacanntgaagtttgtaacggaaagataggatctcattttcagtgaacttccagactagcgcactnttcccttccctctgtaggaagtagctgttgccaaagcgaagaggtagctggctcttgtataatgggaaagtgccgtgtggagcttcaggggtcagtgtttattatgacatctgtcagtccccaaatggttctatt

SEQ ID NO: 5219 - DNA, 452 bp, Mus musculus
aaggctgcagtcagctgagcacagacacacaactgaggcgtatggggcaggaggaagcctgtgtgggggccactctcactcagggcttgttggtttctgtaccagtgttccttgatacacctcagtacaggtttgtcagttaactttactttctaggaagctcaacagcccaacttatgtttccttaaacctattttttactatgatggcactttgataaaatggccagcaaccagccctggccaaaggttcacataccacgtcctggagcagctattgtcaatgtgggtttctaaggacggccatgttctccttcatgtaagtgcctgttcagagtctcaaagtttcaaaatgccaaatattttcatggtcacttgcatgtataatctaggaaatattcaaggagattttgaaaaacaattgtatttaaccagcctcaagttgtgcaacca

SEQ ID NO: 5220 - DNA, 553 bp, Mus musculus
  misc_feature (257)..(257): n is a, c, g, or t
  misc_feature (377)..(377): n is a, c, g, or t
  misc_feature (423)..(423): n is a, c, g, or t
  misc_feature (448)..(448): n is a, c, g, or t
  misc_feature (467)..(467): n is a, c, g, or t
  misc_feature (509)..(509): n is a, c, g, or t
  misc_feature (524)..(524): n is a, c, g, or t
agcacatcattcttttggtggcttaggccggtgctgtccctcggtaagtcaattagcacgtggctttactgcagtcacaggaatgatctacttagcagctctgagtcgtgtccgccttccagtggcacagctgcctcggcaggagtgatttgctcttgatactgaatagctttatgtactctgtaatgtataaagatagtgagggtcttcactgttgttttttaaatctctagactttctaaaataacattgagganaaaattgctttactgatcttaagtagtaagtttttaaatgaatgggatctacaggaagataataatgaaagtatttataacagtgccgttgttttatgaaatgcatgtttctggcacttncctcccatgtttttataacaattaaaacatccccttttttaaacantcatttaggttactaggaagtctgncagagagattctatgctantcaagattattagggtagatcctgggttgatttacaaatgtnccatattggcatgtncttaggtgatacctcaaacacagagcttt

SEQ ID NO: 5221 - DNA, 306 bp, Mus musculus
  misc_feature (281)..(281): n is a, c, g, or t
ggtcattaggatgctgcccgactgaaggagagctgcatgatttcattgcagagatagaggaagaagaacccactggctacattcgatttgaaaaatttattccagtgatgaccagagcccttgtagaaagaagatacagaccagctgctgaagatatccttttgcgagctttcgaggttttggatccagctaaacgcgggtttctcactaaggatgaacttgtcaagtacatgactgaggaaggtgagcctttttcccaagaggaaatggaagaaatgttntctgctgcaattgatcccgaatcaa

SEQ ID NO: 5222 - DNA, 542 bp, Mus musculus
gagcagtttacttcagagcatgtcagcagcaggacagcagatcaaacccccagaggtgtcctgaaacgcaagaatctgggattgaaagtatggttgatagatatttggaacctgatgagagatgagaggttgaaataagaaccatatcctaagagataatgagctaattggggttaaggtttcagtgtttgaacgtgaactttctctgagaatcagagagaaaggagctggagttgtaaatagcctgagaaatactttgaagggtcaaggccagagggaaggagaccagctggtaggctgcttcgttggcagtgagagatgggctagggaaagtcaagcacaaatcctaagtgtctggcttgaacacttggtaaataataatatcagccattcagataagatgcccaaggcttaggctaataggcttgactgtggtcatctccagcttgaagagctggtagaagataaaaagatcaagtggataaataaggggacatctgctagagacacaggctttgaagttgttagcacacggtgttctg

SEQ ID NO: 5223 - DNA, 246 bp, Mus musculus
  misc_feature (93)..(93): n is a, c, g, or t
caccttccccaatggaaccaggaaggagatcagtgctgacaagaagaccaccctcatcaggttttttaacggtgacatgaagaagatcaagtncgatcagaaagtgatttattattatgcggacacacaaacaatgcacacaacctacccagatggtgttgaagtggtgcagtttcctaacaagtggactgaaaaattctacccggatggctccaaggaaaccgtgtttcctgatgggacagtgaa

SEQ ID NO: 5224 - DNA, 360 bp, Mus musculus
  misc_feature (276)..(276): n is a, c, g, or t
  misc_feature (280)..(280): n is a, c, g, or t
  misc_feature (294)..(294): n is a, c, g, or t
ggatttgcccttggaaactggctctgcatggcatactatgagagccactacaacactacagccgagaatgtcctggaggatggaagcactgactatggcattttccagataaacagtttcacatggtgcagaaatgcaagaaagcatcagaagaatcactgccatgttgcctgctcagccttgatcactgatgacctcacagatgccattctctgtgccaagaaaattgttaaagagacacaagggatgaactattggcagggctggaagaagaantgtnagaacaaagacatntcagagtggaagagaggatgtgaggtttcctgatctgcagcaggtgcaagggtgctttccgtgacc

SEQ ID NO: 5225 - DNA, 495 bp, Mus musculus
atggagactctcatttgctcctgaacctcatctgtctccagactggaagggatttgccttctctctgggaactggttcaagtaacacttctgggggtgggggtctctttttcacgttagagaagaaaagaaacactgcaaaggcagggaggactcctgagctccttgtgtgacttgttacctacagcacaaaccacgcctacttcactaatgacatcatccctaatgacatcatcccgttatatctcctggaatctctcacagcagcccttgaagttagatcattattaactctagtcatttacttgaaagatggttcccgatgctgtgaaagattcgaaatgcagttctgctcttgccctagacaacagctgctggttggtgatgaaccaaggcgcaagtggaacagatttctcaagactggagcagtgatcgcctgttatagaagtcaattccactcaaccacagagaaggaaccactaagccacgttgatgt

SEQ ID NO: 5226 - DNA, 583 bp, Mus musculus
  misc_feature (141)..(141): n is a, c, g, or t
  misc_feature (183)..(183): n is a, c, g, or t
  misc_feature (256)..(256): n is a, c, g, or t
  misc_feature (261)..(261): n is a, c, g, or t
  misc_feature (378)..(378): n is a, c, g, or t
  misc_feature (396)..(396): n is a, c, g, or t
tccaatttggtttcacccaactcaacagccaaggatgcccaggaagaatggaggttacgctcaccatccaccttctagagtagcttatggcaaaatacatgaagaccaatcagctaacagaaataaacgactctgaagagnaagagtcccaaattagaagacagagtggcacagggaacattntggaagacaggctctccggtgctgcccaagccactgaattgctttatgatttttactttgtttaccttgtttntatgntacctgtttgtgcaaatgtccttgaaagatatttcatgtggttttctagatgttgtaaagaaaacatgtaagaaggttataggtatacattgatagacaattaaagacttaagagtntacagtaagactgaaaantctttcattctctacatgccactcaaaatgatacaatatcaccaccagtaacttatgaaaattacatgtatataattacagacatcaaggagccaagacacataaaaacacacatctagagaaatacatgcacactatgaacaaattgaagtggaattttaaccattcccttagttgtacacagaaa

SEQ ID NO: 5227 - DNA, 451 bp, Mus musculus
  misc_feature (109)..(109): n is a, c, g, or t
  misc_feature (155)..(155): n is a, c, g, or t
  misc_feature (157)..(157): n is a, c, g, or t
cgtgctaagcgtcccggagtctacacagccacctgggactacctggactggattgcttccaagatcggccctaacgccttgcacttgattccagccagccacccctcanccgccgactacccgccatccgatggtctcttttcaccctccttctntncgccctccttggtatttccaacacctgccttctcgaccgctttacctgcgaccactacggcctctgctccatcggccgtcttcgacccaaacctcctcatcactcatgcccctcctctcgcccccaaccccagcccagcctgcatcctttaccattgctacacaacacatgaggcaccgcacaacgctgtcttttgctcggcgtctccagcgcctcatagaggccctgaagatgagaacttaccctatgaaacatccctcccagtacagtggaccaaggaactaccactaccgc

SEQ ID NO: 5228 - DNA, 422 bp, Mus musculus
aacacccagagtcaaggcaggctttctaaactggctaaatctgtggaaatctattaaaatatgactgttttgttattcacgatcattttccactctggtcagttttgagttgctctgacgtcagacgcagaacctaagattgactgtcgtgccccaggggcctgagaagtgtgtgcctttgtagttttcacagaactaatcacaccccggtggtagatgagaaacttgggtgagttctgctgtaatgatgtagtaagaggcagaccctgcccctgaaggagcaggctccggcgccagacttcaggtatcggcctctaggactgaagcacagacccgaggcccacatagggccttccagaaacctcagagctctctgagacactagcaacttataggtaggtagtcgctgtttgacttttcta

SEQ ID NO: 5229 - DNA, 426 bp, Mus musculus
  misc_feature (323)..(323): n is a, c, g, or t
  misc_feature (332)..(332): n is a, c, g, or t
  misc_feature (401)..(401): n is a, c, g, or t
aacgacctattacctgggctgcagacgcttccagcacaatcagtgttataggcgatcaccactggaccaacatgactgtgcagtgcgatgtttatatagagacccctcggagcggcggcgtattcattgctggaagagtgaataaaggtggaatcttgattagaagtgctacaggagtctttttctggatttttgcaaatggctcttacagagtcacagctgacctgggtggatggataacgtatgcttcaggacatgcggacgttacagctaaacgatggtacacactcaccttaggcattaagggttatttcgcctttggnatgttgaanggcacgatcctatggaaaaacgtccgtgtgaaatacccagggcatggctgggctgcgatcggaacacanaccttcgagtttgcgcagtttgaca

SEQ ID NO: 5230 - DNA, 459 bp, Mus musculus
  misc_feature (109)..(109): n is a, c, g, or t
  misc_feature (184)..(184): n is a, c, g, or t
aggcaacatggatgagacctgcatagaccaggtgagacggaaggccttgcaagaagagattgatcgtgagtcgggcaagacagaggcttcagaacccaaaaagtggacngtgggtttgtcggtcaagacagaggcttcagaacccaaaaagtggacgggaacccagtttggccagtgggatacngccggctttgaaaatgaagaacagaagctaaaattcctgaagcttatgggtggctttaagcatctgtccccgtcattcagccgccctcccagcatgactatcaggtccaacatggccctggacaaaaagtcttcagaaatgctccagcagagtctgcagcaggactatgaccgggccatgagttggaagtacagccacggggctggcctgggctttaactctgaggcccgaaaggtcttctacattgaccggaatgcctccaagtctatcaagtt

SEQ ID NO: 5231 - DNA, 375 bp, Mus musculus
  misc_feature (29)..(29): n is a, c, g, or t
tcacctgagtcatcagcggcagcagccgncacctgaggcagcagcctcacttgagtcatcagcggcagcagccgcacctgaggcagcagccgcacctgctacacctgctgcacctgaggcagcagccgcacctgaggtagcagccgcacctgctacacctgccgcacctgaggcaacagctgcacctgccgcacctgaggcagcaactacacctgctgcacctgaggcaccagcagctgctccagctgtagaggaggaagaaatggtctgggaggcggcagcagtcgttggggaggcagctgtgaagccccccgaggaggaaccgaccagcggagaagcagtcgctactacaaccatgacctaggcagatagcca

SEQ ID NO: 5232 - DNA, 467 bp, Mus musculus
  misc_feature (336)..(336): n is a, c, g, or t
  misc_feature (360)..(360): n is a, c, g, or t
  misc_feature (424)..(424): n is a, c, g, or t
  misc_feature (427)..(427): n is a, c, g, or t
  misc_feature (429)..(429): n is a, c, g, or t
ttgaggacgccaacgactcatgctacatcccctcggctgcgccagattttattagagctgctgccgcgtctcctgggctcgagcccacccccagaggatccccgaactgcctcaccagcgaggcgtgcctcgtctgtgggcattctgctcagagcggaggagctcatcttgaaaaagccgcggagcgaactcgtgtttgagggtcagaggcatcggcacggaacttggaccgcagccctctgccagaacctgggtgctgcagccccagaaatccgctgctgtgtggatgctgtgaactttgtggctgagagcacaagagaccaggaagccactggnagaggaactgtccgactgggtgcngtatggggaaggccctggacaatgtctgtttttgggcagctttggtgctcttcagcgttggttntantntcatcttccttgggggttacttcaaccaagttcctgat

SEQ ID NO: 5233 - DNA, 330 bp, Mus musculus
gggaaagctgactcaatggcagaaaagtgcctacgtgtacatgaaaagaaactacatcagaatgactgacctaggggtcaccgtgaaccaaccagttttcatgcgcggcaaggagcaggccaagcaatccctggtcgaaggcattgaagttcatgacagtgaagatgaatgctttgaaggatcttttggtgtgacaccgataaaacgaatgaagctgacatcagtgacaataagttttcataatgtagaaggaagccttgcatctggagagaatgattgcaacttggcagaaactggtggcattcaggtcaatgtttggagccaccggct

SEQ ID NO: 5234 - DNA, 229 bp, Mus musculus
  misc_feature (135)..(135): n is a, c, g, or t
gacgacgacaaccagacagcagagaacacatgcaaacctgcagaagagcagcctcaacagctcaggtgggacgatattcacttgccccggttctcactaaagcaagggatgatcccgacccgttacgtcatgccntggaaagaaaacatgaaattcaggaacgtgaatctacagcaagcagaagcctgtgggatctatgctggccctttggaagattctctgttctggg

SEQ ID NO: 5235 - DNA, 451 bp, Mus musculus
aaaatgctgatgagcacaccccactacatggagcctggggactttgagagcagccattatttgtccccagccaagttctcaggacctccaaaactgagaaaaaataggcaggccttctcctgtatctcctgggaagtagtggaggccacatgtgcctgcctgctggcccagggtgaggaagcagagcaggagcactgttccccaagcttggctgagcagatgatcctggaggagtttggaaggtgcctgtcgcagattctccacatcgagttcaagtccaaggggctgaaaattgagtagcgtgcaagctggtaaaggggaatgcctgtggcaagcctcagccctgggaatctgcaccgaggaagctggtgcccagggaggagcagaggccgcgcatcatggccaggtcagctgtgaggtctgagtgatctgcatggtactggccagccta

SEQ ID NO: 5236 - DNA, 361 bp, Mus musculus
  misc_feature (282)..(282): n is a, c, g, or t
  misc_feature (307)..(307): n is a, c, g, or t
ttcagtgtgctctgcgagatcaaggggaagactggtctctaactggtttggcaacaaaagaatccggtacaaaaagaatacagggaagtttcaggaagaagccaccatgtacacagggaaagcatccacagtcaccaaggcccggcgtcccaggggtcagagcagctgccagtccacacccagcccaggtccctgtggccccttgccactgaccaatggaagtgacgtggttctcactctgcggaccctggccttcctccagccccccactgggggagtctncctacagcccctggtccatagtaantggcagagggccgccccacagccagcctcatcacctgcgggagagtctggcagc

SEQ ID NO: 5237 - DNA, 501 bp, Mus musculus
  misc_feature (369)..(369): n is a, c, g, or t
  misc_feature (407)..(407): n is a, c, g, or t
  misc_feature (448)..(448): n is a, c, g, or t
gccctgctccatcagtcaggaaaaggatggtgctccaatatacttccccccggagtttcagttaaaggaaactctccatcggtgcaaacccaacaagaatgacttctttcccacaatgtctcagaaaaagaagttaaaaccagagctgaagccagtcttccctatgaaacggctagatgatcctaccttcaagggacaacaatggtttaggttttctaccgacaatgatttcaacatcgaagggaagtattctgaaatctatgctttaaggaaacagaaaaaaatgtatcctaacctcatctttgctccagcctcccagagagagacaaagaaacatgtttccatgaagtcagagagtgaaacaccaanttcgcaagtattttgggaacccctgacattttcaaagntcctagaagagaagcctacaagaagtgtgccaggggagagnttctttcgccatggaagggcccagcagtggattgtcaaagatgcggctgtcat

SEQ ID NO: 5238 - DNA, 316 bp, Mus musculus
gctgtttgatggatgctacttctttttggggggaaacttcaagcatcatccaagggatgacctccttaagctcattgctgcagcaggaggcaaagtcctgagtcgcaagcccaagccagacagtgatgtgactcagaccatcaacacggttgcataccatgccaagcctgagtcggatcagcgcttctgtacgcagtacatcgtctacgaagacctgtttaactgtcacccagagagggttcggcagggcaaagtctggatggctccgtccacctggcttatcagctgtataatggcctttgaattgcttcctctt

SEQ ID NO: 5239 - DNA, 441 bp, Mus musculus
  misc_feature (320)..(320): n is a, c, g, or t
  misc_feature (331)..(331): n is a, c, g, or t
  misc_feature (367)..(367): n is a, c, g, or t
  misc_feature (375)..(375): n is a, c, g, or t
  misc_feature (416)..(416): n is a, c, g, or t
cggccatcggatgagtttgatcacgacgacaaacaaatcgccatccctcacagcctttgaggaagaaacagatgggccattgggagtaattgcagtgcctggcctagaaggaagaatcttccatatttctccagacatgaaagaacatttgcaccaacttagagctgcgagacagcaaggcctgagaactttccccaccattagtgacagtgcacgtgagacctctgattctgactaactgtaatggagttggtatgttttgttagtgctcaaatggatcggaccaagtttagcagtgttagacatggtaacagaatctngattgcatgtntcattctagaattgatgataattctagggatattgntctaaatnttcttttcatttaaattttatcaagtcttgtaacttttgantcttcattgtgttgggccagaaaca

SEQ ID NO: 5240 - DNA, 422 bp, Mus musculus
  misc_feature (293)..(293): n is a, c, g, or t
  misc_feature (353)..(353): n is a, c, g, or t
  misc_feature (365)..(365): n is a, c, g, or t
atgccttctgcagaattcgataaagaatccagggagctgctctctaggctggaggagcaggaggccaaaaagctaaagcttgagaaagactatgcagcaactgcagagcaggatgcctccagaatgcaagagaatctggctctgaggctagcttctgtggcagagccacagggagacctgcaaccccaagtggacacggagctcctggaacaatcagttgtggaaccctttgtgccagaacctggaccagtgcagcttcccacttttgatcaagctctgcccacatcaacttntacacagtcacctgaagatgtggctgtagatgaggctgcagacatggttgcagatgaggntgcagacgaggntgcagatgaggctggagatgtttcacctgccaggcagttatttctatcttacacagt

SEQ ID NO: 5241 - DNA, 499 bp, Mus musculus
ttcggcgggcacaggcattcagaaacatggttccagtcgccatgagtccccctgtgggtgtctatcttgatgatcattatggccccatccctattgtggaggttatttggaagtgctacccaatggtgcctcgtcccatgcatcctcaaatgatgcctcttccacccaggccccctccaggattcagaatgcctccaccatttaggccacctcctctgccaccttttccctggccacctgtaccacctgatgcgcacatacccaatgcagcaagggaatataaccccttccccttccccttcccctttccctttcccttccccaacccattccccaaccccaaccctaaccccaaccccaaccccaaccccaaccccaaccccaaccaaaattttgcaggtcccagatacagatactgaagtctacatcagttttccaaaagtgtttttcaatcagatttatatcgtttgtaaacactatcacgcattacctgtcaaga

SEQ ID NO: 5242 - DNA, 510 bp, Mus musculus
  misc_feature (470)..(470): n is a, c, g, or t
aagttccaccagtccattggcaagcactattcgtctggctacggacaaggggacgtcctagggttctatatcaaccttcccgaagacacagagacagccaagtcactgccggacacctacaaagataaggctttgataaagttcaagagttatttgtattttgaagaaaaagactttgtggacaaagcagagaagagcctaaaacagaccccccatagtgagataatattttataaaaatggtgtcaatcagggtgtggcttacagagatatttttgaaggagtttacttcccagccatctcactgtacaagagctgcacggtttccattaactttggaccatccttcaaataccctccaaaggatctcacgtaccaccctatgagtgacatgggctggggcgctgtggtagaacacacactggctgatgttttgtatcacgtggagacagaagtggacggaagacgtantccaccctgggaaccctaaccagtccttgcttctggtgac

SEQ ID NO: 5243 - DNA, 539 bp, Mus musculus
gagcgacacaagctgtctatcagtttgaactctcaggtgaagatggtggtacgtggtttcttgatctaaagagcaaaggcgggaaggttggacacggagagccctctgaccgggcagacgtggtgatgagtatggccactgatgattttgtcaaaatgttttcagggaaattaaagccaaccatggcatttatgtcaggaaagttgaagattaaaggaaacatagccctagcaatcaaattggagaagctaatgacccagatgaattctagactatgaaggacaagaagtaacaatgttgactctcctcagaagtaaaaagctcagcagttagaaatctgttgtctcccccactgtcatgtaaggacatataagtttgttctagaaagaagtagaatttctgtatctataagatttgaaactgtaactaaaacaactaaccaatcacatacaagtttaattaagtgacatcctaatatattgtggtttttccaagttttcctctctatgcctttatttcattcattgctttcttgcaga

SEQ ID NO: 5244 - DNA, 458 bp, Mus musculus
  misc_feature (399)..(399): n is a, c, g, or t
  misc_feature (402)..(402): n is a, c, g, or t
gagaaagatcgaatgccatcccttctaatagtattatactaatttattaaggctgtcttgtctgtgagttcacttttgacgctgttgcctaagcgtcctccacactggagagagagggtgcttgtttaaagagaaagcaagagtcacagtctgggagaaccccatctcggaccctctttccagagaacacccacattccacccaggttgccaccctgtgggacccaggtgagttttatactgtccattcccctggagcagtcaccttctagcagtaactgaagcaaaggacttggagtacatggggcagctggaggctcctcactcaagctaagtgacctctttaaccacaagtttaccctcctcccgagacaaggccactcatcacagcccagccggnagncagccgcagcgtcaggatcaaaggagactggcagcaggtgtgaggccagagaaaac

SEQ ID NO: 5245 - DNA, 416 bp, Mus musculus
acttcactgggctcaggtacctgctgtacaacttccccatgacctgcgccttcgtgggtgtggccagcaacttcacgttcctcagcgtcatcgtgctcttcagctatatgcagtgggtgtggggtgctgtctggccccgccaccgcttctctctgcaggttaatatccgacaaagggataactcacaccacggggccccgcgtcggatctcgcgccatcagccaggtcaggaatctacccagcagtcggatgtgacggaggatggtgagagccctgaagatccctcaggaacagagggccagctgtctgaggaagagaaaccagagaagcggcccctgaatggagaggaggagcaagagccagaggtctagtgatggctcctgggaagatgcagctttgctgacagaggccaaccc

SEQ ID NO: 5246 - DNA, 484 bp, Mus musculus
tcaaagaagcgtccccagagtcagaggatgaggaagaggctttgccgtgcacagactgggagaactagcaggtgacttaagagagaagaaaaatacccatggatgaagactggctctggttcctttggggaaaaaatctaagctcttggtcccacaattggattccattatgtcctgagtatattgacaaagtggtttgaaaaaggaagcacaaacgggaggttactactgtccagtccctctcattgatagtgcaatgttcccgactgcagagagaacaagcctcctggagacggctgttccttccccacccctcctccccatctgcccaatcataatctcatagtggccagtcccattgctatgaattggaagaacactgggttggcagaggtctgctgtacgagctactttgggattcatctttcagtgaactgagaagatctgtgctgaagcacagccgcttccatgtcagcttgtagag

SEQ ID NO: 5247 - DNA, 435 bp, Mus musculus
gacacgtgtggctggaagatcctttctcaggttcttttcaccgagacggatgatccggaggagtattacgaaagcctcagcgagctgcggcagaagggctatgaagaggtgcttcagcgggccaggaagcgcatccaggagctcttggacaagcacaagactatagaaagcatggtagagcttttggacttgtatcagatggaggacgaagcctacagcagcctcgcagaggccacaactgaactctaccagtatttacttcagccattccgagacatgcgagaactggccatgctacgaagacagcagatcaagatttccatggagaatgattatttgggccctcgaagaattgaaagtctacagaaagaagatgctgactggcagcggaaagctcacatggctgttttgtctattcaggatctcaccgtcaaa

SEQ ID NO: 5248 - DNA, 476 bp, Mus musculus
ctgcccagtctggaatccttgatagaacaatgtgtctgattatgaagaaccaaagacccataaaaaagtatgatggttatacctcgtgcccactggtaactggctacaaccgagtgattcttgctgagtttgactacacagctcagcccctggaaaccttcccttttgatcagagtaaagagcgaattactatgtacctaatgaaggctgacatgatgccattcctgtactggaatatgatgctcagaggctactggggaggtccagccttcttgcgaaagctgtttcatctgggcatgaattaaagatggctcacagcttgcttttcttggatggcttctggatcaaaatcgcagttactgattgacatgacagatacaaaggactcagaacctcaccctttaaggaggttggacatggtgacctttctaggcctctgaatagctatcatgtggacaacccagaacgagtctttg

SEQ ID NO: 5249 - DNA, 419 bp, Mus musculus
ttggcggcctttgttactatctgtctcctcctgagtctatgggagccatatttgaggatcctgttcatgtagttgtatatattatcttcatgttggggtcatgtgcattcttttctaagacgtggatagaagtttctggttcttcagccaaagatgtggccaagcaacttaaagaacagcagatggtgatgaggggtcacagagatacctccatggtccatgagctgaacaggtacatccccacagcagctgcctttgggggtctgtgcatcggtgccctgtcagtactagcagacttccttggggccattggctctggtactggaattctgcttgcagtcactattatttatcagtattttgaaatatttgttaaggaacaggctgaagttggtggaatgggtgctttgtttttctaa

SEQ ID NO: 5250 - DNA, 251 bp, Mus musculus
agctaagcctgtgtgcagcatcagtaccagctgccttaaaactgaagtttacattatttgttgacactgtccatctagtgttagccatgacgctgggaagcagtgtatctgcctcgctgttggtcagacagcaagacagtgatgtggattagcttcgcacacaacattcagaacactgaatattcccttgtttaaaaataagtgcagtgcagattgccactttccagtattttgagcttccctaatgagtt

SEQ ID NO: 5251 - DNA, 561 bp, Mus musculus
  misc_feature (258)..(258): n is a, c, g, or t
  misc_feature (318)..(320): n is a, c, g, or t
gggtgtttcacagacgatctgccatgccttacggtgtttataagaatcaccaagaagacccaagtgaggaggctggtgtgctggagtatgcaaacctcgtaggacagaagtgctcggagaggatgctgctgttcagacactgaaggcctgcacctcagcccagcgccagcctggcatctcttgccacagtcccacctgcttctcggctcctgcagccattcaccaagtacattcgtagagctttttaaaaatattttngtggaattgtatttatgagaatcttgtggttaatataaagattttaaaatattctatgannnagccctttaattgggacttgtcctttgcagcttgcttctggagcaaggtgtgcttcatgtctccagtgaatatttagggaaggaaaatgaagaagtcaatataagtcattttgtcacagttactgttctgtgctggagaaattctgacacagagactgttcttttagaccaatggttcttaacctgtgggctcaccacactcacaggccgaatgttagatagcctgtgtgagatcaactca

SEQ ID NO: 5252 - DNA, 495 bp, Mus musculus
ctgtgtgtgtgactaagcctcttcccaagctccatcacgattcctttgtcctcactgccattcagagcaaagccggccagctcgcctgaccgccagtgagcagccagtgcatccgtgcagtgcagctggagaggctagcctcagagcctcgctccggttactttacagcaagtagatttctgggtgtgtcctaaaggtcagaggtcaggtctgcatgcttgagcaggtggaggatttgcccctccccaactgggacccacagtggcctcaggggctctgggccgcagctctgggtctgggtcgagtcaggctgggctgtgtgtctgcctggttggttagtctctaaccacctgtctggcctctgcgccagggtggggagtgaggacattggtgtcccgccctatgtgggggctcacagacgatgataaggtaacagctctcagcagttaggcacgtgagggcacggttctcggtagtcaccacaatgttcacaat

SEQ ID NO: 5253 - DNA, 555 bp, Mus musculus
  misc_feature (262)..(262): n is a, c, g, or t
gataaactcatcacccaacgttaatactactgcatcaggtgtggaagacctgaacatcatccaggtgacaattccagatgacgataatgaacgactgtccaaagttgaaaaggccaggcagctgcgggagcaggtcaacgacctcttcagtcggaagtttggtgaagctattgggatgggcttcccggtgaaggtcccctacaggaagatcaccatcaaccctggctgcgtggtggtcgatggcatgccccccggggtgtcnttcaaagcccccagttacctggagatcagctccatgaggaggatcttagactctgcggagtttatcaagttcactgtcattagaccatttccaggacttgtgattaataaccagctggttgatcagaacgagtctgaaggccctgtgatacaagaatcagccgaggcaagccagttggaagtcccagtaacagaagaaattaaagagacagatgggagttcacagatcaagcaggagccagaccccacgtggtagaccgtggctctccaggttcgtccagtgtccagcgtgcg

SEQ ID NO: 5254 - DNA, 568 bp, Mus musculus
  misc_feature (170)..(170): n is a, c, g, or t
ggctcaagaggctcaacgggacaaagggccagagcctcccagggctgggcccagggcagaacacccacgaggggcagagaggggcagcctctggcgctttggcgatgtgccctggccctgccctggtggaggggacccagaggccatggctgcagccttggtggccaggngcccccctctggaggaacagggggctctgaagaggtacttgagagtccaacaggtccggtggcatcctgaccgcttcctgcagcgattccgaagccagattgagacctgggagctgggccgagtgatgggagctgtgacagccctttctcaggccctgaaccgccacgcagaagccctcaagtgaccctagggaataagcaagaacctgtggggatgtagcctcaagaatagacggaaggaagcaaggtcgtggatggggatggacaagaaggggcagctgcggcacagagaggagaggatatgggacggctaacgtaatggttgtgggggtggggtgggggaggctctaccactgctctggactgccatttcctaataagacttggttccacacctc

SEQ ID NO: 5255 - DNA, 381 bp, Mus musculus
  misc_feature (26)..(26): n is a, c, g, or t
  misc_feature (57)..(57): n is a, c, g, or t
  misc_feature (285)..(285): n is a, c, g, or t
  misc_feature (288)..(288): n is a, c, g, or t
gactttgaggataacccagaagtgcntccactaatttgaaataggagggctgtgttntcattgaccctgacccacagactcatgttgcttggtgttgacagtggctatgtgtcattcatggagtaaacatagtttcattatcatttttacctgatgctataatgctttccatgcattgtaatatatttgagtttacaattaaattgcataccttaaatatgctataacttatcactcatctataattgaacttcgagcttgaaaatgtgaagtaatttaataganctncgacattcaacattaagaataagtcatttagtcttcacttatgcaatagattgtgttatatggaaaaggtctttagcaaattgttcaaactca

SEQ ID NO: 5256 - DNA, 128 bp, Mus musculus
tgttcctgaacacagtgcacccatctatgagttccggtgacagaggttcagaacagtggccaaataaaactgaacttggcaacaaagagctttgcgaggaaattatgtacctgccagaaccaggagag

SEQ ID NO: 5257 - DNA, 441 bp, Mus musculus
  misc_feature (84)..(84): n is a, c, g, or t
  misc_feature (107)..(107): n is a, c, g, or t
  misc_feature (124)..(124): n is a, c, g, or t
  misc_feature (166)..(166): n is a, c, g, or t
  misc_feature (283)..(283): n is a, c, g, or t
  misc_feature (331)..(331): n is a, c, g, or t
gcaaatgggagcttatcaacgtctaaagcaaggaccaaattacatagcaaataacatttaaatcactccttaagtgatgtatgngatgtatgttaatttggaaattngtgatgatgtaataacnctctatcccaaaggcacttagaagaaatgcgctcactatgancagtgcctgcatctgcctgatcatatttaaaggcacagaagaacgtgtgtaattaatctgcccagtaaataccaacttcgagcactaggcaggtgcaagtctagataaaatttcttncagctaatttaaactttcggcacacaccagtagctaatctcaatgtanataatacatttctccttcactctctaatgtaagccttgcagtacaggagtcttgacttatatactctgtaccacatatgtttctatatacttttaacatttctggctaga

SEQ ID NO: 5258 - DNA, 340 bp, Mus musculus
  misc_feature (127)..(127): n is a, c, g, or t
atgtttgagctcgagttcttctatgaggagcaggcccagcgcatggccgcccggggtgtggagcccctccccttccacgaccttgcacgccaggccggatcacgctgcgcgacctgaagcagtgcgncctggcgggtgagttcttcgacgccttcttcaacgtggacaagtacctggcacgggagcagcgcgagcaggcggggactccgcaggacactgactccgaccccgcggcatctgcctgggacaggtatgccgccgaggagtacgacttcctcgtggccgaggaggccatggcagaggacgacgacgaccatgacgaagggtccgaccccataga

SEQ ID NO: 5259 - DNA, 525 bp, Mus musculus
  misc_feature (55)..(55): n is a, c, g, or t
  misc_feature (319)..(319): n is a, c, g, or t
  misc_feature (378)..(378): n is a, c, g, or t
  misc_feature (381)..(381): n is a, c, g, or t
  misc_feature (465)..(465): n is a, c, g, or t
agaaccaagaaatcgacccttccaggacccggagcttttccaaggcacttcctgntaggcctaacttccaccaggcagcctcgcctagttcagtgcctggctagtaatctccagctggctttgaggcttggcccatcatttcccaatccacagcaaggacctgtgctcaagccaggatatcgtcccaggcttgctggagttagtaatgtaccaacgtttcagcacagcctggagcttttaaagacattgaagctgttttccctcttgctatggagacacgggaattggtatcctaaatctttgggtttgaattccgttntcatcactagctcagcaagtccagacaagtcacataaccgtttcaagcctctgttttgntcntgttaaatggcaacaataaaagcaactcatacagtgagaagttacctccagcacaccaagagctagctacgattccatttcttntctgtttcccccctgcctctttcttacaaatatgttacttttggctcattttcttcactg

SEQ ID NO: 5260 - DNA, 384 bp, Mus musculus
tcgcaaagctccgaggaagccatgaagctgtgcctagccaggttgttcctggcgtactgcagcagcagcatgcagttactgctcacgctgcactccctggaagccctgctctgcagtcgcccctctctctgccttctcattgtggacagcctgtcgtctttttactggatagaccgagtcagtggaggagagagtgtggccctgcaggagtcaacgctgcagaagtgctctcagctcctagagcggcttgtcactgagtaccgcttgctgctttttgcgacaacgcagagtctaatgcagaaaggctcagactctgcagacgggccttcttcctccaagcacccatgcgatggagacatgggctacagagcctatctctgcaag

SEQ ID NO: 5261 - DNA, 449 bp, Mus musculus
  misc_feature (26)..(26): n is a, c, g, or t
  misc_feature (190)..(190): n is a, c, g, or t
  misc_feature (226)..(226): n is a, c, g, or t
  misc_feature (328)..(328): n is a, c, g, or t
  misc_feature (350)..(350): n is a, c, g, or t
  misc_feature (370)..(371): n is a, c, g, or t
  misc_feature (418)..(418): n is a, c, g, or t
ctctgtacaggcgaaggctgcgtagntgctaatgcagagatggacaaacccgaagatcaagacaaggtcctaatgcactttttaaacatgggcttgccgatgaagcctagcattcttgtgcaaaagcagagtaaggaagagatggccacatccttaggagacaacatcaaggcagaagactaccaaaagnaacagacatatgagcctgtgaatgctagagaaaccnaccatgagggtgagcttgctgagaaaatgcccatacatgtccacagatcttcagatacaggaagccaaaaaagacctttaaaaggagtgacattttctaagnaggtgattgttgtggaccttgnaaacgaataccctacacctnnaagctatgctcgagaacataaggagaggaaatgaagtgtagaaaaanctgtgcggaaagtgtaacctttgaccagctt

SEQ ID NO: 5262 - DNA, 520 bp, Mus musculus
  misc_feature (206)..(206): n is a, c, g, or t
  misc_feature (261)..(261): n is a, c, g, or t
  misc_feature (263)..(263): n is a, c, g, or t
  misc_feature (292)..(292): n is a, c, g, or t
  misc_feature (294)..(294): n is a, c, g, or t
  misc_feature (339)..(339): n is a, c, g, or t
gactgccagggtggacatcatgcataataaaagataatccgttctgtgagtttattacagttccgtggatgaagcacctggtgggcggcattgtccgcatactgatagattacatggattacgtccctctgtgtgcaaaactgaagtctgtgctagaagtacagagagaatggccagaaatacgccaaataatagagaatccttgntccctaaagcatctgtgccgattaaaaattcgccgagttatgggactgcagcgantntgccagccagcctccatacagatgcttcntntcccggcggcgatgcgaagatacttattatttaaagagtttgacntctacggacagtagctaaagttaatataactttaaaattatattttaaaatgtgattcttaaagcatttttttttaactgtgattcccctagagaagtcactggaatcattttgtattcttattttgtattcttaagtgtattttaacaccactgagaatctcgtagctatgtcgtgtccc

SEQ ID NO: 5263 - DNA, 401 bp, Mus musculus
  misc_feature (141)..(141): n is a, c, g, or t
  misc_feature (219)..(219): n is a, c, g, or t
  misc_feature (223)..(224): n is a, c, g, or t
  misc_feature (262)..(262): n is a, c, g, or t
  misc_feature (303)..(303): n is a, c, g, or t
gagatggcaacttcggccctggtccccggctccacgaccccctggctcgcatccgcctcccaccctgaggagctgtgcgagctagagatccggattaaggagctggagctgctcacaatcactggggacggcttcgactcncagcgctataaattcctgaaggcgctgaaagatgaaaaattacaaggactgaagatgagcaggcaacctggaaagtcngccnncctgctcctgaggagctgccccccacgccccccggagntgggcagctgcctccttaggtgttagtgcttagataatgtntcctagttgttgtcatttcaaagatggttattttctgttctgtatttactactgttatcattgctctcagcacatacttcacatacagtgcccacttg

SEQ ID NO: 5264 - DNA, 388 bp, Mus musculus
  misc_feature (52)..(52): n is a, c, g, or t
  misc_feature (77)..(77): n is a, c, g, or t
  misc_feature (339)..(339): n is a, c, g, or t
atactactcttggtgtttctatcagtacagcagcagcaatggcactgctgtnactcacacataccaagggatgacancatatgagatacaacagcctcctcctccagtgttgactacagttgcaagtactgttcagagcacacatttcaatcgttcatactctgaacattttagttactttcctggacagccacaagcaaattcctttaacccaggaaacgggtattttccatctcacacgcctgtttcttacaattaccaacaaccagtttattcacagtttgcttctcatcaaccagtcccacaggctacatatccttatccgcctaacccaggtgngcctcctcaagttccttggacttatgctccatggcaacagaatccgttt

SEQ ID NO: 5265 - DNA, 557 bp, Mus musculus
  misc_feature (104)..(104): n is a, c, g, or t
  misc_feature (163)..(163): n is a, c, g, or t
  misc_feature (409)..(409): n is a, c, g, or t
gtgtatacatttagtttgttcctgtatatgtctacatcactgcattttaatgacatataagtttaatgaaaaaaatcctttatggggtctttttataaataaanctaactgcatttaaaaatctaataagaaaaccagaagcaacagtgtgtctatattgctntaagtttgaaattatactggatttcagatcaactaaataaaactggggttaaaagctacagaattttgttaacagttctcacatgtcaagatgatactgaactatactgtagagatacagagcactaaaatttatctggaaaattaacatttgtgttgattacatttatttgttaatagattttcaaattcaagtagcaacttaaacaaaagccatgtgcaaaattctggtgtatgatttgttaanaaagcatttgaaagactcaaaagcaagaatggagaattaatgacattcatctttttcatattgcttatatattaaaatgcagaatttaatattccaatgtcaatgtaaccagcaaatgttttataatgctttcttgttaacatcacat

SEQ ID NO: 5266 - DNA, 537 bp, Mus musculus
  misc_feature (31)..(31): n is a, c, g, or t
  misc_feature (41)..(41): n is a, c, g, or t
  misc_feature (308)..(308): n is a, c, g, or t
  misc_feature (357)..(357): n is a, c, g, or t
  misc_feature (359)..(359): n is a, c, g, or t
  misc_feature (390)..(390): n is a, c, g, or t
  misc_feature (392)..(392): n is a, c, g, or t
  misc_feature (395)..(395): n is a, c, g, or t
caagcttcaaaggtctgcctgtgtggctgcngcttgcgganaaaagcggtcctccaccccaggccggatccagtccctcttctagtctctcgggggccgtccagcttgccatcagagaggaagacactggtttccaaggagacagtctttccagctcagctctcccaccactctccgaaggaaaaagctgagggcaagtcccagctgttatcttggcgggatccggtacctctgcgccagctggtgcctatgagcgtgtggcccaagggctttattcatccactccccaaacctttgccagggcaagntctgagcacctttatccatgttgaaggggttcacatccctagggcagtntntccggtgacatcactggtggaagataacaantnttntatgccacctttactaaaatgaacgtgcctgctcaattaattgctatttatctgtgtctactgtaaacacgcaaaactgtccatttttaactgagaatatatttttatcctcaatgtgaacccagttgggacttccagaata

SEQ ID NO: 5267 - DNA, 493 bp, Mus musculus
ggatttcaactccaggcccgaggaagtgatgcagtcagtgagtgagcaggtggtggaggaagtccaccagggtctcgagagcatggggttggccgctctgagcagcgagaatacggcgtccctggtgggccagctccagaacattgccaagaaggaaaactgcgtccgcagcgtcattgaccagcgtatacacttgttcctcaagtgctgctttgtcctgggtgtgcagcgatccctcttggaccttcccgggggcctcactctgatcgaagctgagctggcggaactgggccagaagtttgtcagcctgacccatcacaaccagcaggtgtttgccccgtattacaccgagatcttaaaaaccctcatctccccagcccagaccctggccaccaaaggtgggtctctctgatgacatcggctcggagcactggcaccttggacccaggagaaagcgcatctccctgggatgacatcaccactgagcagcagg

SEQ ID NO: 5268 - DNA, 311 bp, Mus musculus
tgtccacctttgatatcgcttcagatgccttcgctacttttaaggatttgttaaccagacataaagtattggtagcagacttcttagaacaaaattatgacactatttttgaagactatgagaaactgctgcaatctgagaactatgtgacaaagagacaatctttaaagttgctaggtgagctgatcctggaccgccacaatttcaccattatgaccaagtatatcagcaagccagagaacctgaaactgatgatgaacctgcttcgagacaaaagtcccaacatccaattcgaagccttccatgtcttt

SEQ ID NO: 5269 - DNA, 442 bp, Mus musculus
  misc_feature (340)..(340): n is a, c, g, or t
gaaaaggaccacctccacaatgtaatggtccacctgcagcaggagaacaaaaagctgaagaacgagatagaagagaagaagctaaaggccgggaacccgaggatctgtgtcaaggcctttcccccaaacaaactggagccttcccaaaagggaaagctatgctgtgccctgggctggagagggataccccaggacctgacaccgaaaacggaccacaagtacatggggttacctcactcctcaggctcctcctactgctagaatcggctcttcacccaaagcgtcactgctacacgttttcagaggacattgagtccccacccctctttcttgaccgganccagctcctacagtggtccatcaaggcccctgtttagtttgcaagaagttatgctttgctgagttttgtctacctcctgaagtagagttgtaagaccccact

SEQ ID NO: 5270 - DNA, 474 bp, Mus musculus
tatctcagagaggacgtgcgaattcctttgcctaatgaactgtatgaagccgagctcatcatcatgagtaatgaccagtgtaaaggatttttcccaccaccagttccgggatccggtagaagctactacatatatgatgatatggtgtgtgctgctgactatgacatgtcaaaatccatctgcgcaggtctcctactttgacaagtggattaaagataacaagaaatcatcatccaactcaaagccaggggagtcccctcaccatccaggatcccctgagaatgaaaatcccgagggcgacaataaaaaccaaggtgctgttatcaagccgacggtgtgcacagccctgctgctctcccagatcctcctgcaacagttgatttagttcagggatctgtgatggagccacggggccttagacagccagaatgtcctgcaagccacctcactgagcactgtcattcatgcctccat

SEQ ID NO: 5271 - DNA, 247 bp, Mus musculus
aagaaggagctactacaggtcgaaaagaagtcatcaagaataaaatccgagccattgggaaaatggcccgggtctttacggttcttcgggaagagagtgagaatgtgctgaccctcaagggcctcactcccacaggcacactcccactgggggtcctctctggaggaaagcagaccattgagactgccaaacaagaagccgcagaggagcgggaagccatcagaggttttacaattgcacacaggat

SEQ ID NO: 5272 - DNA, 435 bp, Mus musculus
  misc_feature (99)..(99): n is a, c, g, or t
  misc_feature (179)..(179): n is a, c, g, or t
tcagttttccggacgcagcgcggagccagccccacgtttttttccagttggagcggaagcccacctgcccgtccccgagagctgtcgctgccatcgccntcctccctgcaggtctgcagggattgccccatccctgtggttttttactttttccagacaagttctcaagtatcccaggntggcttcctgactctctcgagtagccgaggataaccatatacttctgatcccacctgtacctcctgagtcctgttttaatgtggtgctgagactcgaacccatggcttcgcagatgctaggcagacgcttttcgagctgagctccacccccagcctctttgtccctgcttcttcttgccctccagtgctttccagccaagcacctgttggggatactgcccactcctaatctttccccgtaagaagcagtgctagt

SEQ ID NO: 5273 - DNA, 465 bp, Mus musculus
  misc_feature (373)..(373): n is a, c, g, or t
  misc_feature (379)..(379): n is a, c, g, or t
  misc_feature (387)..(387): n is a, c, g, or t
  misc_feature (390)..(390): n is a, c, g, or t
  misc_feature (396)..(396): n is a, c, g, or t
  misc_feature (404)..(405): n is a, c, g, or t
ggctaatgaccacagtccattcctacacagccactcagaagacagtggatgggccatcaaagaaggactggcgaggtggccgcggcgctcaccaaaacatcatcccatcgtccactggggctgccaaggctgtaggcaaagtcatcccagagctcaaagggaagctaacaggaatggcattccgggtgccaaccccaaacgtgtcagttgtggacctgacctgccgcctggccaagcctgcttcttactcggctatcacggaggctgtgaaagctgcagccaagggacctttggctggcatccttgcttacacagaggaccaggtggtctccacggactttaacggcaatccccattcttccatctttgatgntaaggntggaattnccntcaatnacaacttnntgaagcttgttgcctggtacgacaacgaatatggctacagtaaccgagtggtcgacctcc

SEQ ID NO: 5274 - DNA, 297 bp, Mus musculus
taccaaacttgaggcctagagctaaaaatcatatagaaatgatgttatcttgtggtgtgaggaaaggccagctggcctaagttcacacttttgtcccagtggccctagactccacccagccagctcccaaaatgaaaagaccacctgtcaagcagcagtcaggagtctgatgtcacccatcactattttttttccatcattgtgcttgcctctgcctccttccacacccgtgtgacgtaatcgcattgggaagccaggacaatgtttgctgttctgctttgggtaaagggactccct

SEQ ID NO: 5275 - DNA, 380 bp, Mus musculus
  misc_feature (198)..(198): n is a, c, g, or t
  misc_feature (201)..(201): n is a, c, g, or t
  misc_feature (319)..(320): n is a, c, g, or t
  misc_feature (340)..(340): n is a, c, g, or t
agtccagatccatttctgcttagtcaccatattctctcagctcacacaaagaatgttccattcaagtgtaagagatgtaaaaaggaatttcaacaacagtgtgagcttcaaacgcatatgaagacccacagtagccgaaaagtctatcagtgtgagtactgtgaatatagcaccaaagatgcctcaggttttaagcgncangttatctccattcatacgaaagactatcctcaccgctgtgacttctgcaagaaaggattccggagaccctcggaaaagaatcaacacataatgcgacatcataaagaagttggcctgnnctaagtgtgtaatcctaacntatggggacattggcattcaggcaggaaattcattttaaa

SEQ ID NO: 5276 - DNA, 342 bp, Mus musculus
  misc_feature (142)..(142): n is a, c, g, or t
  misc_feature (149)..(149): n is a, c, g, or t
agcgacacataatttccgttcacacaaaggcgtatcctcataaatgtgacatgtgcagcaaaggatttcataggccttcagaactcaagaagcatgtggctacccataaaagtaaaaaaatgcaccaatgtagacactgtgnctttaanagtccagatccatttctgcttagtcaccatattctctcagctcacacaaagaatgttccattcaagtgtaagagatgtaaaaaggaatttcaacaacagtgtgagcttcaaacgcatatgaagacccacagtagccgaaaagtctatcagtgtgagtactgtgaatatagcaccaaagatgcctcaggtttta

SEQ ID NO: 5277 - DNA, 252 bp, Mus musculus
  misc_feature (215)..(215): n is a, c, g, or t
gacctccgcgcctatcaacagtggggacccccccaccaccatactggagtgattccaactcagaggacacccagagctaccatctggtatctgccagtttccaactgactctacccagcatccccctccccactttcccataattcatgacatcaaaacatcggcttttcccttgagactcaggagggccaaagcaccagcctttggcttttttntcttttttttccctctcccctagcatgggttgaagga

SEQ ID NO: 5278 - DNA, 504 bp, Mus musculus
gtttccactatactggttcagcgttccagcaatcctaaaaggttggatggatagggtgctgtgccgagggtttgcctttgatatcccaggcttttatgactctggttttctcaagggtaaattagctctcctttccttaaccacgggaggtacagcggagatgtacacaaaagatggggtcagtggagatttccggtacttcctgtggccacttcagcatggtacactgcacttctgtggatttaaagtccttgccccccagatcagttttggtcttgatgtttcatcagaagaagaaaggaaagtgatgctggcatcatgggcccagcggctgaagagcatctggaaggaagaacccatccactgcacacccccttggtacttccaagagtaacatttttgtgctctgagtacagctgacaagcaacacagtgagagacctacagcatgtgcaaagagaaggtggtgttgtatcctgagatgtatttaacagtgcccaccaat

SEQ ID NO: 5279 - DNA, 477 bp, Mus musculus
  misc_feature (149)..(149): n is a, c, g, or t
  misc_feature (416)..(416): n is a, c, g, or t
  misc_feature (418)..(418): n is a, c, g, or t
agctgctctatccagtgtccagattcagcaatgtcaagtccctccagcatctttgcagattccggatccggcagcttgtccgaatagaccatattccggatctgccactgcctaaacctctgatctcttacattcgaaagttctactantatgatcctcaggaagaggtgtacctgtccctaaaggaagcgcagctcatttccaaacagaaacaagaggtggagccttccacgtagcagcaaggacccctgctgttgaacatgaaggcatttgatcgccaggctccagcttgaagaaccaaatgaggctaccacaaaagaagaatctggcagaaagagaagagcgggttgtgattcctggcacagactttggttcccctgtagccctggggcttggaagaagcacacaaccatccncnaagtggggctccccactccccaacccatgaaccccagggccagatgagctccttggaaa

SEQ ID NO: 5280 - DNA, 431 bp, Mus musculus
  misc_feature (229)..(229): n is a, c, g, or t
  misc_feature (232)..(232): n is a, c, g, or t
  misc_feature (279)..(279): n is a, c, g, or t
  misc_feature (293)..(293): n is a, c, g, or t
  misc_feature (295)..(295): n is a, c, g, or t
  misc_feature (300)..(300): n is a, c, g, or t
  misc_feature (318)..(318): n is a, c, g, or t
  misc_feature (341)..(341): n is a, c, g, or t
  misc_feature (360)..(360): n is a, c, g, or t
ggactatttcacctgaattccactatgcacagacattgatagtatgggcgattttgttgaaacctgtagtcctactttttaatgcaatggccgttaagatagactacacgaatgactcgtttgttaagggacagatgcttttgtacaagatctctgcctcacttttgtgtattagcagcctttgcacatttgtttccgtgagctggaaccatgttgtagacctttacgnccnaaccacacttgattttccacccagctttcctgttaagaaaaaggatnttaaaatgaaacantntactnctgcattcccaatagggntcctgacagctaccatgtcactntttggtgtgattatattcntctttgagatgagctctttggatccacagagtgaagtggaggcccagtgtgcttccagactgatcaatcaa

SEQ ID NO: 5281 - DNA, 179 bp, Mus musculus
  misc_feature (86)..(86): n is a, c, g, or t
  misc_feature (89)..(89): n is a, c, g, or t
  misc_feature (97)..(97): n is a, c, g, or t
  misc_feature (105)..(105): n is a, c, g, or t
  misc_feature (108)..(108): n is a, c, g, or t
  misc_feature (123)..(123): n is a, c, g, or t
  misc_feature (136)..(136): n is a, c, g, or t
  misc_feature (144)..(144): n is a, c, g, or t
  misc_feature (149)..(149): n is a, c, g, or t
  misc_feature (154)..(154): n is a, c, g, or t
acgacctgctcatctgtacggcagagttgttacagttggcactcaacagctctgaggaggatgaacacgtagagctcagagaattntcnctgattgnggtggacnagngtcaccacacccacnaaggacaccggtntacaacanccatnttganccggtacctagaacagaagctgaag

SEQ ID NO: 5282 - DNA, 569 bp, Mus musculus
gatactagccaggagggcgctgataccagccaggagggggctgataccagccaggagggcgctgataccaccaaggaggaggctgataacagcaaggaggctgaaggtaccactactgaggacccgcgctcgatctccgaggagagtgccgaactagaagaaagccctcccttaggctcagaaccccctgcccagcctgagtcacaagaagaagaaacccaggtcacagaggaaacagcatcaccccaaggttgatctgcaaaattctatagttgcttttgtatttttagtgaccttagcccttcttcctagaatattttaatataccttaaagaatttaactttactaatagatatttgattgggagttggtattttacaagtcttaatagtttttccaccctctaaaatcaggctgtgttaagaccttaaatagtgttaagtttggatttaagttttacgttttagaaactgagttatctatgcaaccggtgtcactttgattttcctttgcctttctcttactttgttctatgtaagaccagattactgggtttgctgtgaactca

SEQ ID NO: 5283 - DNA, 487 bp, Mus musculus
  misc_feature (276)..(276): n is a, c, g, or t
  misc_feature (326)..(326): n is a, c, g, or t
  misc_feature (382)..(382): n is a, c, g, or t
  misc_feature (454)..(454): n is a, c, g, or t
  misc_feature (456)..(456): n is a, c, g, or t
  misc_feature (461)..(461): n is a, c, g, or t
gtctatttcaccacatcgttctgggggatgatcctgaagtaaagaatggcaagccaggcatggacatatttctaacctgtgccaagaggttctctcctccccctgatccaaaagactgcctcgtctttgaagattctccaaatggagtggaggcagccatccactgtgggatgcaggtcgtcatggtacctcatgaaaacctgagcgcagacctaacacgaaaagccaccctggtgctgagttccctccacgacttcaagcctgaactgtttggtntacctgcctttacggaataagggtgaagggtgacggtgctgctgtgggcntcatgtaacccaaagttggctcaggacccatgttgctgagtggaaacattaggaantcaacatcatccaaattgtaacctttcttgtcactgtaggttataaagtcatgggttccattatgtattcantntcctntgtgatttgctctacatttgacagta

SEQ ID NO: 5284 - DNA, 516 bp, Mus musculus
  misc_feature (284)..(284): n is a, c, g, or t
  misc_feature (293)..(293): n is a, c, g, or t
  misc_feature (308)..(309): n is a, c, g, or t
  misc_feature (314)..(314): n is a, c, g, or t
  misc_feature (316)..(316): n is a, c, g, or t
  misc_feature (321)..(321): n is a, c, g, or t
  misc_feature (327)..(327): n is a, c, g, or t
  misc_feature (335)..(335): n is a, c, g, or t
  misc_feature (359)..(359): n is a, c, g, or t
  misc_feature (363)..(363): n is a, c, g, or t
  misc_feature (431)..(431): n is a, c, g, or t
  misc_feature (457)..(457): n is a, c, g, or t
  misc_feature (479)..(479): n is a, c, g, or t
  misc_feature (481)..(481): n is a, c, g, or t
attctactggctttagtactgtttatggtaaaacaatacaggggaaaaaaaccattattgcatgtattgaaagccaccagtttcagccccaaacattctggaatggatcctggagatcacagtggaaattaaccatcacaccacccacagcacaggtcattggaatgctcaagtctcacgttcattattatgaaaatggaaatatccagctagttgtccataaagatgtacatgagtcattaactgttatcaatgaagatcaaactgcgaaggtgtttattaanatcataganatggtagaaaatggnnatcangnagcanttaatnaaaactancacacaatttcatgtacaacattnaaanccttgcgcagacagcttccaattacctaccacaaaatcgactggaacaagatacttagctacaaagtntgcaaagaactcaagttgaaacatgnttaatggcccactgtagcagtntntaggaagtgtgggcataaaagatccaacagggttt

SEQ ID NO: 5285 - DNA, 477 bp, Mus musculus
  misc_feature (376)..(376): n is a, c, g, or t
  misc_feature (378)..(378): n is a, c, g, or t
  misc_feature (385)..(385): n is a, c, g, or t
cccacctccatcttaaacattttagtcccctgtaatgctggctgctatgactctgaagaggccttactaaatatacatcactcttctggttgactctaaacctgcccgtttttaacttcaacccggaaggaagaaggactcccaagatcaatagggacctgtaggaacttggtttgagtttgttcaagctttctaatatctcattttcacaggcactgtggtttgtgttatgtttgtgttttgttcgttattttcccttttcagaacccctatcccagcagcgtcctccttgtctcccacactgtctggagtaggagctgctgtaaccttgaagcccagcagtccactgtctgctggagtatatttcaataacctntngttgccnacaatttggcccttgagttcgagcacctaaccctattttgctatttcttgaatgtttctcttacacccccttttgttctctacagtgaaact

SEQ ID NO: 5286 - DNA, 448 bp, Mus musculus
  misc_feature (299)..(299): n is a, c, g, or t
  misc_feature (339)..(339): n is a, c, g, or t
  misc_feature (370)..(370): n is a, c, g, or t
gagaaccatacataagcaaccgaagtaacatatactcaagtgactatgaacgtagtggtagacaagaagtgcttccaccacctattgatagggaatactttgaccgtgagggcagacaggaaagagggcattcacctaaggatgggctgtatagtgcatctcgtgaatcatacagtagtaataccaagatttgggggatcccatggaggtcgtggagaaagcagatataaagtggaggcaggtactaaagtcttaagttgtgtaccaaacagcatttctaagaagaaaaataagatgtnattcctatgttctccaaatgttaaaagaaatatgttgatntaggagataaggcaaatagtaagttttactnccttacccgaatacggaaatacattgttttggggggaagtgaaataatgactaacattccacccatgaattcttctag

SEQ ID NO: 5287 - DNA, 528 bp, Mus musculus
  misc_feature (396)..(396): n is a, c, g, or t
  misc_feature (398)..(398): n is a, c, g, or t
  misc_feature (400)..(400): n is a, c, g, or t
gagaggatcacacattttgaccaaaataaggaagtagagaggaacacacaattttatcaaggcaaacaagagaaagaaaagacgatcaggcactactatcaagacaggcatgcaaaagaacataagatcacactattcatttatgaccaacaagggcaagaggatgtgatcacacacttagaccaaaataatcaagaggagaggaacacactatttgatcatggcaatcaagtgaaagaggagaggatcaaattttgctttccaaacaagaaggtagatgaagagagaaccacattctgctctccagaaaagcaggagaatggggagataccggtccccttctatcaacacacacccctgcatggagggatgaccattctgcaactacacgaacangnancaggagattatgcacaggaggcaagcacagatgcaaggatgcatagctgggacaattaccttcattgcttgtattatacagacatcagccagctatgactagacatcatgttgtttcgaaaggcctaa

SEQ ID NO: 5288 - DNA, 468 bp, Mus musculus
  misc_feature (299)..(299): n is a, c, g, or t
agatcccccagaacaggatgtctctgggaggcaggacactctggccctcaggccagcttctatggcagagccacagggagataagcaatcccgagaggacactgtgcttgtgaaaagagcagttctggatccctttgaaccaaaagctgcaatagagctgcttccgactttagatcaagctctgcccacatcagctgatacacactcacctgtagatgtggctgcagatgaggctgcagatgtggcagcagatgaggctgcagatgtttcacctgccaggcagttatttgtgccttacnctgtgcccacagatacaccaggttttgttttccctctgcctgaggttgacatatagttaggagaatgatctgcagagttccacccagatgaggttccccacctaagcttatattatttctttatagaaaatatcttattgttttgttgggttctatttttcatattgtt

SEQ ID NO: 5289 - DNA, 227 bp, Mus musculus
ctgctgaggagttgtcaccccaggaggcccctgctgaggagttgccaccccaggaggcccctactgaggagttgccaccccagtaggcccctgctgagcagttgccaccccaggaggcccctgctgaggagttgccaccccaggaggcccctgctgagcaccatctccagcacccacaatcttcctcagatgaatcttcttatatcacttgtcctgagtgggaatag

SEQ ID NO: 5290 - DNA, 536 bp, Mus musculus
  misc_feature (394)..(394): n is a, c, g, or t
tgagcttcaggtttgtcagccatctctccacatacacattaagcatttgaaaataaacactgctgatattggatgatagcaaggttcagaagaccttccagaggatttcgaggatcttctgtcctcaaggaatcgattacagatttctacttgcagaaaaggtctcattgttggaagagtgtcctgctgattggtagggaagtggcaccggagacagaggtggcaacagcagccaggtggactgggagcaagaagagaaggaaaacatgttctcatctcaggaacacccagaaccctttgatgtgcaaaaagattataagcggcaacttggggaacttcctcactggggtaaagttcctctctctccagcagacatcaagtgatcagggcattntccgaatgaatatcaaccatcgaggatatccacagagatctgggtttaagatctgcttaggcagaagtgacaccaagagtatcatatgctgaaacctggacacaaattgtatggtttaaacaactcggaatacacagactat

SEQ ID NO: 5291 - DNA, 444 bp, Mus musculus
  misc_feature (38)..(38): n is a, c, g, or t
tttctttttctgttctatcttggaataagaaactgccntggggagggagtagtacctgtttattaatagtcaactcaactatcctatgttatgttcctagaataaaaaattgttacatctatttcattaccatggtttaaggtaagctcaccttcctaagggtagttcctctgtcaggagaatgatctatctgctttggaatcattgccctttgatgtgcaaaggagtttgcctccttttaagtgaagtatccagggtgtggggctccagaaagtattacagtgttttaaatgtagcatttgcttgtaatatttgtaacatacatttaggcacttgtgaatcttctttgataattgggacacattcgtcaattctgagaacttgttattttttttctattttcatagtgtttactgtgaattaaaatttgttatgccactgcca

SEQ ID NO: 5292 - DNA, 363 bp, Mus musculus
tcatggaccagaaccgcgatggcttcattgacaaggaggacctgagggacacctttgctgcactgggtcgcataaatgtcaagaacgaggaattggaagccatggtgaaggaggctccggggcccatcaacttcacagtcttcctgaccatgtttggggagaaactcaagggcacggacccagaagagactatactgcacgccttcaaagtgtttgacactgaaggaaaaggctttgtcaaggctgacttcattaaggaaaagcttatgacgcaggctgaccggttcagtgaggaggaggtcaagcagatgtttgcagctttcccgccagatgtctgtggcaacttagactacaggaatctgt

SEQ ID NO: 5293 - DNA, 506 bp, Mus musculus
  misc_feature (416)..(416): n is a, c, g, or t
  misc_feature (422)..(422): n is a, c, g, or t
ccaatgcaactaatccagagagtaaggtcttctatctgaaaatgaagggagattatttccggtatcttgctgaagtagcttgtggcgatgatcgaaaacaaacaatagaaaattcccaaggagcctaccaagaggcgtttgatataagcaagaaggagatgcagcctacgcatccaatccgcctggggctggctcttaacttttctgtattttactatgagatccttaataatccagagcttgcctgcacactggctaaaacggcttttgatgaggccatcgcagagcttgatacactgaacgaagactcctacaaagacagcaccctcatcatgcagttgcttagagacaacttaacattatggacatcagacagtgcaggagaagaatgtgatgcagcagagggggccgaaaanctaaanggcatccagggcaccaacctccttcccctcaagaaaacctttttacatctccattccttattccacttggatttcctctagcaa

SEQ ID NO: 5294 - DNA, 422 bp, Mus musculus
gacagtttgggcagcgacagctccacggccatcatcccccacgagctgatccgcacacggcagctcgagagcgtgcatctaaaatttaaccaagagtcgggagccctcatccctctctgcctaaggggcagactcctacatggccggcacttcacctacaagagtatcacaggcgacatggccatcacgtttgtgtccacgggagtggaaggcgcctttgccactgaggaacacccgtatgcagctcacggaccctggttacaaattctgttgacagaagagtttgtagagaagatgttggaggacttagaagatctaacctctccagaggaatttaaacttcccaaagagtacagctggcctgagaagaaactcaaagtgtccattctccccgacgtggtgttcgacagtccactgcacta

SEQ ID NO: 5295 - DNA, 516 bp, Mus musculus
gaagccaaggatcccgagagaacaagacaggtatatcaagcgtctttggaactaattcctcacaaaaagttcacatttgccaaaatgtggttatattatgcacagtttgaaataagacagaaaaatctgccatttgccagaagagctttgggaacttccataggcaaatgtccgaagaacaagttattcaaaggatacatagaactggaactgcagcttcgagaatttgacagatgcaggaagctttatgaaaagtttttggaatttggacctgaaaattgtacctcatggattaagtttgcagaattagagacaatccttggtgatattgagagagctcgggcaatctatgaattagccatcagccagccacgcttggatatgccagaggtactttggaaatcatatattgattttgagattgagcaggaagaaactgaaagaacacgaaacctttaccgacaattgcttcagcgaacacagcatgtcaaggtatggatcagttttgctcagttt

SEQ ID NO: 5296 - DNA, 73 bp, Mus musculus
caaagacccccaattagagcatgagcgatagaaatcatgtcatcagcattctgtgacagcgtgtcccttaaag

SEQ ID NO: 5297 - DNA, 474 bp, Mus musculus
aatctgaatccttcatctctaggctccttctagtgtgcatgtttcttggtgcttgtcttataggtgtaaattgaataactagaaaagccacactcattacatgaactcttagctgagcacatgtgagtgttaaaggtgacaggcacacatttttgtatatagtatctaaactagggtatcatctctatcaacacagaaacagttgtgtgatgtctgtcttgaccatcagctagcagatctagatatcctgtgagaatacatgttagcattttccatgggcatgcgtgagaggcagcctcccaaacccgaatgaagggcaggtcagtgtgcactgcagagctcaggaaggcacaattgacacctcctccctctgtgtgtcttgtggtcaatgtaattaatggctaagcattaggaattctgagacatttactcagatacatattattaaaacagatacctccttactgttttcag

SEQ ID NO: 5298 - DNA, 327 bp, Mus musculus
  misc_feature (98)..(98): n is a, c, g, or t
  misc_feature (100)..(100): n is a, c, g, or t
  misc_feature (115)..(115): n is a, c, g, or t
  misc_feature (145)..(145): n is a, c, g, or t
  misc_feature (155)..(155): n is a, c, g, or t
  misc_feature (175)..(175): n is a, c, g, or t
  misc_feature (199)..(199): n is a, c, g, or t
  misc_feature (228)..(228): n is a, c, g, or t
  misc_feature (296)..(296): n is a, c, g, or t
aggtatcaacacatgtgcatttcagtgacgccattgacttccttcgttatatccactacatgtgctgctgtgcatcccatgaggctgcagccccaatncnccatgaggtaaaggnagaaatggcacgtgaaccaggatttagggntcacttatgnccatttcagagttataaatntttaaaattaaatttaagaacatntcacttttgtttcttaggcttgtactatntcaacaactgtactctaaatgtgttggaaagcttaaaatatgtacacacaaaataacattttgaaatnttaagggaaaacgtcagtgttcacaaaaagt

SEQ ID NO: 5299 - DNA, 419 bp, Mus musculus
gtgagaatcatgtcaatccccaaccttcgctacatgaaggagagccaggtcctcttgactcttacaaatccagtggagaacctcacccatgtgactctgttggagtgtgacgagggggaccctgataatatcaacagcactgctaaggtggtggtgcctcccaaagagctcatcttagccggcaaggatgcagcagcagaatatgatgagctggcagagccccaggacttccaggatgaccctgacatcgtagctttcagaaaagccaacaaagtgggcatcttcatcaaagtcaccccacagcgtgaggaaggggaagtgaccgtgtgcttcaagatgaaacacgattttaaaaacctggctgcccccatccgcccagtggaagaaggtgaccaaggcacagaggtcatctggctcac

SEQ ID NO: 5300 - DNA, 335 bp, Mus musculus
  misc_feature (249)..(250): n is a, c, g, or t
  misc_feature (285)..(285): n is a, c, g, or t
  misc_feature (304)..(304): n is a, c, g, or t
gatttactccctaagacatgtgctgtgtgcctgtcacagtctgacagagaaccttaggacggtaatccagagcacacctggtcttcatgccgcagcattggcctcggtgttgaaaggcttcctgcattccactaaggataaccctgtaatgataacccttcatagccttggctctcactttgccactgctttccatttgacagagcagtaggactgtcagtgtgtctttaactttgtgatgacagggcnnacctgtcactttcctaaggcactttgtttcttccnaaagaacacagtatacctntcacttgcttgtcattttcctcactagtata

SEQ ID NO: 5301 - DNA, 531 bp, Mus musculus
  misc_feature (158)..(158): n is a, c, g, or t
  misc_feature (161)..(161): n is a, c, g, or t
  misc_feature (164)..(164): n is a, c, g, or t
  misc_feature (166)..(166): n is a, c, g, or t
cagtgtaccacctaatgcagcgcatccaatgccggccgccgcactgaccaacagtgcctcgggactagggctgctgtcggaccagcagagacagatgtttatccagcagcagcagttccagcagctgttaaactcccagcagctcacacccgaacagnatnagncnttcctataccagctgatgcagcagcagcaccacccgcctgagctccagcagctgcagctcccgggacccacgcagatccccatcaacaatctccttgcaggtgctcaggcgcctccactccacacagctaccaccaaccccttcctcaccatccacggggacagcacgagccagaaggtcacaagacttagtgataaaactgggcctgtagctcaagagaaaagttgacacttgaaaatggccagaactcgcctttcctgctgttctgtgcttcactggctgctgcagtgtctgccacagctatgaagaatggaggcgggaacacacaggggaggatgccacacactcccttgtaaggctctgat

SEQ ID NO: 5302 - DNA, 456 bp, Mus musculus
ttccgacttagccatgccccgagtagccatgctcttgattgtgacaatatggcagcctagtaggttagacagttggggatataatcattggtctgtttctgaaacacatgaattactggtgggaaaggcccaactgcagttcgacctccactgtgtgcttagctggaagaccatgtgcacggcttagcagtctgtcttctgtgacactgcacacctcttacctcacttctgtaaataaggttgtgaatctgttttgtaatgtgaaaaattcataagataacattgatattttgatttgtaatatttctaattggtagatttaattgaaaagtaaaattaatttatttttatatgttcaggggaattttaaagaaagtcaaaccttttgtagataatttaaaagaatcagtgtggtttattttatatatgtaacccactggttgttattctgtaaca

SEQ ID NO: 5303 - DNA, 452 bp, Mus musculus
ttgaatccttcaaacgcgctgacatctatgcaatgggcttagtgttctgggaaattgctcgacgctgttctattggtggaatccatgaagactatcagttgccttattatgatcttgtaccttctgatccatcggttgaagaaatgagaaaagtagtttgcgaacagaagttaaggccaaatattccaaacagatggcagagctgtgaggccttgagagtgatggctaaaattatgagagaatgctggtatgccaatggagcagcaaggctgacagctttgcgaattaaaaaaacattgtcacaactcagccaacaggaaggcatcaaaatgtaactgaaacaccgtgggaactctgctctcttcatatctgctcctgggtgtttaggaggctggttgttctacctcactgagagaacagagggctctgcttcctcttgcagcagtggaata

SEQ ID NO: 5304 - DNA, 519 bp, Mus musculus
  misc_feature (189)..(189): n is a, c, g, or t
atgtacctgggtgagatcgtccgtaacatcctgattgacttcaccaagaaaggcttcctcttccggggacagatctctgagccactcaagacccgaggcatcttcgagaccaagtttctctctcagatcgagagtgaccgattagcgctgctccaggtgcgggccatccttcagcagctgggtctaaancagcacgtgcgacgacagtatcctggtcaagaccgtgtgtggggtggtgtccaagcgggcggcccagctgtgtggtgccggcatggccgccgtggtggaaaagatccgagagaacagaggcctagaccacctgaatgtaaccgtgggcgtggacgggacgctctacaaactccatccacacttctccagaatcatgcaccaaacagtgaaggaactgtcaccaaagtgtaccgtgtccttcctcctgtctgaagacggcagcggcaagggggccgcccttatcacagctgtgggcgtgcggctcagaggagaccctacgaacgcctaaga

SEQ ID NO: 5305 - DNA, 385 bp, Mus musculus
  misc_feature (285)..(285): n is a, c, g, or t
ccccgtgtgaagtgtgttatcaccagcagacactgccggactcctgcccacaggggcgtggcctgaagggcgagtgtgaacatggcactgctgttcccttccccctccctgcacccgccgcagcctgccatcccatttggatgtatcaatgccactgagttgtctgtccgtccgtggagccagtcctagccacattattgacagtcttgcattttgttttgtctcgtgatggtggtggtggtaggggtacgcttaggtgggcagtcctgtggggaaaacatcttngtctccatcttgctaggaagaaccaacccacaaaacaacgccatcactggaatctcccatcgctttagtgagccattgtcgtatgtctagtaaactttgt

SEQ ID NO: 5306 - DNA, 165 bp, Mus musculus
  misc_feature (76)..(76): n is a, c, g, or t
tcctgaacctgaggttacttccattgttgctactgctgtagataatgaaaatacagtaactgtatcaactgaagancaagcacagcttgctaataccacagctattcaagatctcagtggtgatatatccagtaacactggagaggaaccagctaaacaagaaac

SEQ ID NO: 5307 - DNA, 297 bp, Mus musculus
gatgatcttaaaacacctgctgagcaactattgtctaaatgcccatggaaagagtacaaatctgattccgggaagccttattactataattctcaaacaaaggagtcccgctgggccaaacctaaggaacttgaagatcttgaaggataccagaataccattgttgctggaggtcttattacaaaatcaaacctgcatgccatgatcaaagctgaagaaagcagcaagcaagaagaatgtactacagcatcaacagccccagttcctacaacagaaattcctaccactatgagcacc

SEQ ID NO: 5308 - DNA, 594 bp, Mus musculus
  misc_feature (428)..(450): n is a, c, g, or t
gagccaaagaactgccgtgttgcccagtctgggtctctgccacccacctgcttcagggccaggcctggtcacaactaaaggctcagaaagaggcacttagtgaatttagccagtgtcttgagctgctctttcggaccctgcctgaggacaaagaacaaggctccgactgtgagcagaagtgtaggtctgacgtggcactgaaacagctgcgagtggctgctctgatcagtcgtggactggagtgggtagccagtggccaggataccaaagccttaagtgacttcctcctcagtgtgcagatatgcccaggcaatagagatggctccttttacctgcttcagactctgaaaagattggatcggaagaatgaggccagtgctttttggcgggaggcccacagccagctgccactggaggacgctgccggnnnnnnnnnnnnnnnnnnnnnnngtctcttccactgtatttagaaacctgtttgagctggatccatccccctaaccgcgaagccttccttgaggagtttgggacttcggtgttggagtcttgtgtcctttagcttccttgtttccaggatcttgaactttggcctct

SEQ ID NO: 5309 - DNA, 105 bp, Mus musculus
tttcttctgccttatcctctttggagagtggctggaactgattgtttctaagtaactcttttgctcctgaggctggtcctgtgaaccttgatctacttgctacca

SEQ ID NO: 5310 - DNA, 470 bp, Mus musculus
  misc_feature (205)..(205): n is a, c, g, or t
  misc_feature (215)..(215): n is a, c, g, or t
  misc_feature (217)..(217): n is a, c, g, or t
  misc_feature (251)..(251): n is a, c, g, or t
  misc_feature (286)..(286): n is a, c, g, or t
  misc_feature (301)..(301): n is a, c, g, or t
  misc_feature (327)..(327): n is a, c, g, or t
  misc_feature (399)..(399): n is a, c, g, or t
  misc_feature (405)..(405): n is a, c, g, or t
gggacctactgctatgccgagaagtaggagtgcgacagagtggcgggtcccctctggacagactaaggcccagccctcacttctgccttccccaggccagcgcggtgcttcgggctgctgggcaaaggggcgtcccgggcattaactgaccaataaaataacatggcaccttctttgttccataagaacaaacatatattgcatntatggctcancnatatactgggtttgtgattagagagcacccacancacgaaggacagaggagaggaaggaggagaggaantctcagcagacctgnccatctacacgggagaatacaggctnccctttatgtctaaccagtcactcaaaggtttcttattcaaaatttccaggaactccaaacttccagagctntctggnccctacaaaacaaatattcaaactaaactcatttctaaatgtacttatcacttccaaggtctgtt

SEQ ID NO: 5311 - DNA, 555 bp, Mus musculus
gtgaaaaccattatctgatcctcagattgagccagtactccaaaaacttgccacctcaaacttgttcagtattgataaaagacaacatggagagagtgagctctagcacatgtcaaaactgtatcttttcctacttgaaatttttaaactgtaaatgagaatggtagatggctattactttagaaaaaaagatgaggttttggttctcagagaaaaagaaagtgagccttcctcatacagcacaagcccactcccaagtcaaaggaaagtgaggagctgaaggtgccaaagaccagtgcagcaagcaggggaacctctgttacactcatgcagtaaaggcgccatcttggttccctgggaatgctccaaggagacaagagtccccccacctacccagtgctctgcattgtccacgtgatcctagagcagtagagagaaggcccaggtgtgagcaggacatgttcacacaaagatcttaagactgtcacttgactgtcctcaccctcctgataagaactagagcttgtaacaatgctttttcctctttgaatacca

SEQ ID NO: 5312 - DNA, 487 bp, Mus musculus
aaggcatcagcagggcacttgtgaattgcccacaagggtccatactgtcctgggagcagaagagtgaggaggcagatgcagactagcagcaagagactcagagcaggaggaagggcagatagcagtggaagcaaaggaatcctgtctgcctggagcagaagccactgacttctgcgagtgtggctcccctgggtggagaggagccgtaggtgctggcaagaagaggctctgagtaggctcagaggggagtccacacctcctgtttacatagactagtttggtttataagttttagttcttcatgttacggcacctcaagctttgctttatgttggtcattaggtgacagttactcattttccccaagagaaataaatgcatgagtgtgtggggctgcctgtgcacagtagtgcctgtgctctgggtgtgtctctaagagagactgaaaacttgcccggttttagaaatactccagcgtccagtgttt

SEQ ID NO: 5313 - DNA, 74 bp, Mus musculus
tgctgcctgaattgttccacctacatctccatgaccatggtgccagagtgcagtacagctcaggcacaggccac

SEQ ID NO: 5314 - DNA, 583 bp, Mus musculus
  misc_feature (219)..(219): n is a, c, g, or t
  misc_feature (312)..(312): n is a, c, g, or t
  misc_feature (339)..(339): n is a, c, g, or t
  misc_feature (360)..(360): n is a, c, g, or t
  misc_feature (365)..(365): n is a, c, g, or t
  misc_feature (377)..(377): n is a, c, g, or t
  misc_feature (396)..(396): n is a, c, g, or t
  misc_feature (399)..(399): n is a, c, g, or t
  misc_feature (411)..(411): n is a, c, g, or t
atgtggcactcagttcctctgggaagtgtcctttaattagcatctcagaatgcatgggtaaggtaaactgcaaagtccaagtggacagcaagagaatgaccatgaccttgctttccttctttctcccttccctcctcaccctcccttcctctcctcttctctagcctcttcttcacaccagcctcccttcttgttaaacaatatggagacgaggcctcnttaggactgtgtgtggagccttggccttaagtggcagtggggctgagaaatgaaagccctagaacttgaataggtgcctgcctctgtcaggtnaaatgagatatctcacttggaaccaanccccaggacggcacgatgagngagcnatccagcttccnggcccctcagtaggagtanatntacctggaatcngttgaatggggcagtggcttccagttcctgttccagaaggacttggtgttggaagcaatagaaaagacattccctttgccccctgggagagtttggggaaatagcttttttaaaatctcaaaaccatgaccatcctgttaaagacctaagtctataaaccagtgccatgtcc

SEQ ID NO: 5315 - DNA, 423 bp, Mus musculus
aattcccggaagatcgatcggccatccccctaagttgtatcatagtgctctcaacagacagagggaacaacaaaggatcgaaagagaaaatatggctttattgaaacgacttgaagctgtgaagccaacagttggcatgaaacgctctgaacagctgatggactaccatcggaatatgagttacctcaatccttcaccgtccgtccgacgagtgagatctactcttggccattatagcccactgagaggagcttccaggacatccagtgcaaccagtggtctcagctgtaagactgaccgatcagtgttggacacatccaatggctttttgctaagaccgaaacccccgaatgttcgtactgcttggttgtaaaaccttttttttttatgatatacattgttcatctgtttgtcctattttaa

SEQ ID NO: 5316 - DNA, 484 bp, Mus musculus
  misc_feature (118)..(118): n is a, c, g, or t
  misc_feature (197)..(197): n is a, c, g, or t
  misc_feature (200)..(200): n is a, c, g, or t
  misc_feature (228)..(228): n is a, c, g, or t
  misc_feature (233)..(233): n is a, c, g, or t
  misc_feature (258)..(258): n is a, c, g, or t
  misc_feature (298)..(298): n is a, c, g, or t
  misc_feature (323)..(323): n is a, c, g, or t
  misc_feature (368)..(368): n is a, c, g, or t
  misc_feature (375)..(375): n is a, c, g, or t
  misc_feature (390)..(390): n is a, c, g, or t
  misc_feature (414)..(414): n is a, c, g, or t
  misc_feature (453)..(453): n is a, c, g, or t
gatcctacacaagcacgaagttcctcagtgttgacttcttcacgatcaaaaaaatcgtgtgatgccacaaaaggacataaattaaacttgcccgttccagatagaattcctaagattngtgaaaggtgaggacgattactacacggatggggaggaaagcagcgacgatgggaagaagtacgtgaggtctaagtcanccnaagccctctagcaacttaaaaaaaaacntgagntaagaagtattcctcctcctccttntcttcctcatcttcaagatcaaactcagactgctcagatntggggtctgacaggcaaaggagatntgagtcacactcatcagggaagtgtgtttctagtgtaaccccctnatcaccnaaacagaggtgtaantcaggaagaaaatcaagtgcacanccttccagcactaaacaaaagactggtgactatcatgantccgaaggcaatgtaccagacataactcctt

SEQ ID NO: 5317 - DNA, 343 bp, Mus musculus
  misc_feature (56)..(56): n is a, c, g, or t
  misc_feature (141)..(141): n is a, c, g, or t
  misc_feature (159)..(159): n is a, c, g, or t
  misc_feature (176)..(176): n is a, c, g, or t
caagatctttgttcagggcatcatgtgggacatcaacagcttcgaccagtggggangtggagctggggaagcagctggccaagaaaattgagccggagctggagggcagctctgctgtgacctcccatgattcctccactnaacggactgatcagcttncatcaagcaacagcggngacaccaaactagaataactccagccgcggccctactgactggtcctccgtgtcccttctcaccatatgcactgcatggtcctgcccctccctgcccagagcgcaccaccggtagttggcctggactacaaggctgttgggagaagctggtctggaactgccatcca

SEQ ID NO: 5318 - DNA, 579 bp, Mus musculus
  misc_feature (55)..(55): n is a, c, g, or t
  misc_feature (67)..(67): n is a, c, g, or t
  misc_feature (92)..(96): n is a, c, g, or t
  misc_feature (98)..(102): n is a, c, g, or t
  misc_feature (104)..(105): n is a, c, g, or t
  misc_feature (107)..(108): n is a, c, g, or t
  misc_feature (110)..(110): n is a, c, g, or t
  misc_feature (112)..(116): n is a, c, g, or t
  misc_feature (121)..(122): n is a, c, g, or t
  misc_feature (124)..(128): n is a, c, g, or t
  misc_feature (130)..(133): n is a, c, g, or t
  misc_feature (136)..(138): n is a, c, g, or t
  misc_feature (204)..(204): n is a, c, g, or t
  misc_feature (289)..(289): n is a, c, g, or t
  misc_feature (307)..(307): n is a, c, g, or t
  misc_feature (324)..(324): n is a, c, g, or t
gctgccggaaagagcccagaagacttggagaaactcttgccacacaaggtctttngaaggaaaccgnccgaccaactctattgtgtttaccnnnnngnnnnncnncnntntnnnnnctggnngnnnnntnnnngcnnntgtatgagcacaagatctttgttcagggcatcatgtgggacatcaacagcttcgaccagtggggangtggagctggggaagcagctggccaagaaaattgagccggagctggagggcagctctgctgtgacctcccatgattcctccactnaacggactgatcagcttncatcaagcaacagcggngacaccaaactagaataactccagccgcggccctactgactggtcctccgtgtcccttctcaccatatgcactgcatggtcctgcccctccctgcccagagcgcaccaccggtagttggcctggactacaaggctgttgggagaagctggtctggaactgccatccacccactacgcaccctccctgttgaagctgatggaagggctttgacgtgtcatgttgttctgacctgtatttcacaccccagctagaat

SEQ ID NO: 5319 - DNA, 464 bp, Mus musculus
  misc_feature (273)..(273): n is a, c, g, or t
  misc_feature (281)..(281): n is a, c, g, or t
  misc_feature (420)..(420): n is a, c, g, or t
ggaacccaccgaaagctgagagtctctctctcagccgtaaaggtcggactcactgaagcagtcaggcccggttctgaagagttttttcgccgactctcgttcattggtctcctgtgaggactcggcaacgcgtggagtcggctaagagaaaagcgaggcaaggcaggcgggtcttcagagttctatattttagctctcagtgctgaattaccttctcccttaaattattataaacttttgctgctgtcatataaacgtgaagatgtctcgcantcctgatncaaaggaagaccctgtggaatgccctctttgcatggagcccttggaaatagatgatattaactttttcccttgcacctgtggctaccagatatgccgattttgttggcatcgaattcgcactgatgagaatgggctttntcctgcatgtagaaaaccatatccagaagatccagcagtttaca

SEQ ID NO: 5320 - DNA, 276 bp, Mus musculus
gagaggcccgaggacctaaatctgcccaacgccgtcatcaccaggatcatcaaggaggcgctcccggacggtgtcaacatctccaaggaggcccgaagcgccatctcccgcgccgccagtgtcttcgttttgtatgccacatcctgtgccaataacttcgcaatgaaaggaaagcgcaagactctcaatgccagtgacgtgctgtcagccatggaagagatggaattccagcgattcataacaccattgaaagaagctctagaagcgtacaggcgg

SEQ ID NO: 5321 - DNA, 318 bp, Mus musculus
taaagtccaacctgctctcgggaagccttcagagcctgtggcgggcagtcactggcccactttttgatttccaaggagacccagctcagcaaggaggaaccctcattttaggtccaggtaacaacatccactttgtgcaccgagacaggaataggttggatcacaaacccataaactctgttttacagcttgtgggggttcagcctgtgaacttcatgagcagacctacagtcatccacgtgtgactttacgtggcatcttccacttgtgaatgggcccttaaaacgtgaaccaaaatgccaggcaccatggcttcat

SEQ ID NO: 5322 - DNA, 434 bp, Mus musculus
aacaatgtttgctttccactggcataaatctaaagtggttcagtctagaagaattagctctgcaattgctgcctgcagagagatgtgtttaggactctggaagcctagttagaagttctaggtgcacaagctccatttaacttgaaggaaagctgagggtggcaagttgtatctggaagcagctctgccttctgaccacccagcagagttcagctgccaccttctgccctccgccctccctccgccttccacacgcttaaccactgttggatgtgacttcatccaaacataggaaatgaaggcctttacagcttgtgacccatcaaacctaagctattaatttggaattgccactgtcaggcgggtttcctatctcactgcactgactttggcgttcaggcttacaataaacactgcggccataatgtctgatc

SEQ ID NO: 5323 - DNA, 482 bp, Mus musculus
  misc_feature (345)..(345): n is a, c, g, or t
gcaggctggtcagagactgttacattttatgcaacaaaacccagatgttctgcagcagatgatgtctgtcctcatgaacaccattgtctttgaggattgtcggaaccagtggtcagtatccaggcctctcctggggctcatcctgctcaacgagaagtatttcagtgaactgagggccagtctgataaacagccagcctctccccaagcaggaagtccttggccagtgcttcaggaacttgatggaaggagtggaacagaacctgtctgtcaagaacagagacaggtttacccagaacctctccgtcttcagaagagatgtggcagaggccctgcgtagcgatgnccacactgacctaagcagcctggacatgatgagctgacccagctcctgagcgtgggctgtgcagcctttgtcaagagaatctggaaggtctgggttccagactacgatgctggccagcccagaagagtgtatttttc

SEQ ID NO: 5324 - DNA, 279 bp, Mus musculus
accttggtctcagtggattacgaaatttttggaaaggttcaaggggtgtttttccgcaagtacactcaggctgagggtaaaaagctaggtttggtgggctgggttcagaacaccgaccggggcaccgtgcaagggcaactgcagggccccgtctccaaggtgcgcttcatgcagcagtggctggagaccagaggaagtcccaagtcgcacattgacagagcaaacttcaacaatgagaaagtcatcgcaaacttggattattcagacttccaaattgta

SEQ ID NO: 5325 - DNA, 513 bp, Mus musculus
gggaagccccagaaactcgagcttccgccgctcggatcatccaagtgtttgagcatggcagaaggggacaccttggtctcagtggattacgaaatttttggaaaggttcaaggggtgtttttccgcaagtacactcaggctgagggtaaaaagctaggtttggtgggctgggttcagaacaccgaccggggcaccgtgcaagggcaactgcagggccccgtctccaaggtgcgcttcatgcagcagtggctggagaccagaggaagtcccaagtcgcacattgacagagcaaacttcaacaatgagaaagtcatcgcaaacttggattattcagacttccaaattgtaaaataatgaaacgaatcttaatattttttcaaaataatctcactcctttttttaaatcgctagattaaaaaaaaaatagaactattctgtgctcagtattagaatttgttagtaagttattttggttgcatgttggaaaagttaccacgtattacaagtatgatg

SEQ ID NO: 5326 - DNA, 240 bp, Mus musculus
  misc_feature (57)..(57): n is a, c, g, or t
  misc_feature (122)..(122): n is a, c, g, or t
  misc_feature (136)..(136): n is a, c, g, or t
  misc_feature (166)..(166): n is a, c, g, or t
tccgaagagtacacgggctccagcctcaaaacagtggaacggaatgtagaggatgantacatcgccaacctgcgcaacaactgctggaaggagaagcagcagaaggaaggcttgctgtaccngagcccgctacttnggtgacacagacatgtaccacagagcacangaagatgggcaccccgagttgcaatcggctgtcagaggtgcaggcctccctgcatggatagttctgggccagcc

SEQ ID NO: 5327 - DNA, 545 bp, Mus musculus
agatcctcggtgcattaagttctcctccagtgacaggaaaaaacaaagggagtttgaagaatacatcagagacaaatacatcactgccaaagctgacttcaggacacttttgaaagagaccaaattcattacatacagttaatttagtgaaagatgtgaaagtgaaagcttgtgaaagatgctgggattggcagccccgcagactgaagtcctctgttcatccacagaacagatccaaaaagttaatccaagaatctgatcagcacctgaaagatgtagaaaagattttgcagaatgacaaacggtatctagtactggactgtgtccccgaggagaggaggaaactaattgtggcctatgttgatgacctggatcgccgaggtccacccccacctcccacagcatcagagcccactagacgatcaacaaaataattctaaatacccttccacgggctcgctgttaattgaaaatgcttgcatgagccagattttcaggtttttacatatatgcattagtcaacctattgcaaaatcacctgacga

SEQ ID NO: 5328 - DNA, 568 bp, Mus musculus
  misc_feature (170)..(170): n is a, c, g, or t
aggatcttctcaggaacctctacgacagcatccggaacgagcccttcaaaatcccggaggatgatgggaatgatctcacccacaccttcttcaacccagaccgagagggctggctcctaaagctgggagggggccgggtgaagacttggaagcggcgctggttcatcctnacagacaactgcctctactactttgaatacactacggacaaggagccccgagggattatccccctagagaacctgagcatccgggaggtggacgatcctcggaagccgaactgctttgagctttacattcccaacaataagggacagctcatcaaagcctgcaaaacagaggctgacggccgggtagtggaggggaaccacatggtgtaccgaatctcagcacccacccaggaggagaaagatgagtggatcaaatccatccaggctgctgtaagtgtggaccccttctatgagatgttggcagcaagaaagaagcgaatttctgtgaagaagaagcaagaacaaccctgacccctgtccccaactccattatttattttggagctgccccgcctggg

SEQ ID NO: 5329 - DNA, 481 bp, Mus musculus
  misc_feature (104)..(104): n is a, c, g, or t
  misc_feature (124)..(124): n is a, c, g, or t
acacaccctgttgcaggaagagctgcggcgctgccagcggctcggggaagagcgggcaactgaagctggcagcctggaggccaggctccgagagagcgagcaangcccgggccctgctggagcnggaggctgaagagatccgccggcagcttgcagccttgggccaaaacgagccactcccggcagaagcgccctgggctcgcaggcctctggacccacggcgccgcagccttccagcgggcgacgctttatacttgagcttcaatcccccccagcccagtcgaggccatgaccgcctggatttgcctgtgactgttcgttccctccaccgaccctttgatgaccgagaggcgcaagaacttggtagccccgaggatcgactacaggacagcagtgaccctgatactggtagtgaggaggaagtcagtagccgcctgtctccacctcacagtcctcgagacttcacccgaatgcaggacat

SEQ ID NO: 5330 - DNA, 547 bp, Mus musculus
tttggtgccatttctttgcccaagattggaggctggtaatacaggaaatgcctgcgcaatgctggtcctagcccaagctgctttttccccagctacttccagtagtttccctctagactaaggctggcaaagcaaagtgactctaccagtaaggtaagtgctgaaactcagcacaagcagccgtgtgaccttggcaaggctcagggccatccttatctaggaatgaacactggtcaacagtctgctcaaactggacatgcccgcctggctagtttttaatacttttcagagtgggaacttggtggctgaggcatgggcggctttccccagtgggaaggcggcaagggagacagacccgagtacgtccttatagatgcctcagtaaagctgaagagtcttggagaagtcttctgtatatactaagattatatttagactttatgctctgggcatgctatctgcccctcaactgagcactctgtattatcttttgtgagagctctgactggaacgtttttgctagtactctatatgacttacctgtatt

SEQ ID NO: 5331 - DNA, 583 bp, Mus musculus
  misc_feature (32)..(32): n is a, c, g, or t
atggagtaaacctaattctgcccttaatgtcnacaagatcttttgaagtttccaaccctttgtaatcaatattacaaactgatcacatttatttgtgagatttttcctgaaaagataccgcagcttcctgaggatctgtttaagagtctgatgtactccctagaactagggatgacatcaatgagttcagaagtatgccagctttgtctcgaggccttgacaccattagctgaacaatgtgctaaagcacaagaaacggattcaccactttttctagcaacacgacacttccttaagctggtttttgatatgctggtcttgcaaaagcacaacacggagatgaccactgcagcaggcgaagcattctacacattggtgtgtttgcaccaggctgaatattctgaactggttgagacattactgtcaagtcaacaagacccagtcatttaccagagattagcagatgccttcaacaagctcacagcgagcagcactcctcctgccctggaccggaagcagaagatggccttcctaaagagtttagaagaatttatggcaaatgttggtggtctcctttgtgtaa

SEQ ID NO: 5332 - DNA, 361 bp, Mus musculus
  misc_feature (33)..(33): n is a, c, g, or t
  misc_feature (74)..(74): n is a, c, g, or t
  misc_feature (94)..(94): n is a, c, g, or t
gagtccaggctaagcttcagtgacagcgagagntgacaacagcgcagactcctgcctgcctggccgtgagcccnctgcctccccagaagccgcnccctcccagcagcaaggtgtctggtcggaggagccccgagccctgcagcaagcccgaaaagatgctgaagaaggctacctatgacaaggcttacacggatgagctggtggagctgcaccggagactgatggctctgcgcgagcgcaatgtgctgcagcagattgtcaatctgatcgaggagactggccacttcaatgtcaccaacaccaccttcgactttgaccttttctccttggatgaaagcactgttcgcaagctgcagagctg

SEQ ID NO: 5333 - DNA, 524 bp, Mus musculus
agcaccgagtgccatcagtggtataagaaatttatgacggagtgcccatctggccagctcaccctctacgaattccgccagttctttggtctcaagaacctgagcccctcagccagccagtatgtggaacagatgttcgagacctttgacttcaacaaggatggctacattgacttcatggagtacgtggcagccctcagcctggtcctcaagggcaaagtggaacagaagttgcgctggtatttcaagctctacgacgtcgacggcaacgggtgcatagacagggacgagctgctcaccatcatccgggccatccgaaccattaatccctggagcgactcatccatgagtgccgaggaattcacagataccgtgtttgccaagatcgacatcaacggggatggggaactgtccctggaggagttcatggaaggtgtgcagaaggaccagatgctcctggacacgctgacccgaagcctggacttgaccggcatcgtgcgcagactccagaacggcgaacacga

SEQ ID NO: 5334 - DNA, 435 bp, Mus musculus
atgcccagtgaagatgtcacacagcagtagtggttcagccgctctcagtccaggggaggaggcagaacaggcggagacctcgtccattcagtcttcagttttgggaaagggagtaaaacaccgacccccacccatcaaacttccctcaggctcaggaaatagttcctcaggtaactatttcacagcacagcaggccagcagcttccttaaatctccaactcctcctccatcgtgtaagccaagcctttctcggaagtcttctgtggacctcagtcaagttagcatgctttctcctgccgccctgtcccctgccagctcatcccagagacatgaaagctaaaaaggaaacacctcaagagctttgctttacttttttggtttcatttttaaaaatttttttaagttgataaaactgtgcatacttcattcacgaca

SEQ ID NO: 5335 - DNA, 402 bp, Mus musculus
aagtcattctcagctttgtaggcaaaagacagcatgtaggagactaactttttattgggtgttgtggtagagtgtaagtgtatttccactgttaactgtgatctgagtggggtttctaggtgatatactgcatccttaattgtaattgagtgtagcaacactcttggatcgtgtagagagttaacacttgcagttaactgcttttaaacaaattggaacaaatttgtcagtgctaagtaagattccattaaccgtattttaaaaggaccagccatttataacaaactagcaatttttatttttctcaacgagcaggatctggaactcctaagccatctcctcctacaccaaccccttcatcggtcccacaccctcctgacgctcagaactcagctcctagta

SEQ ID NO: 5336 - DNA, 197 bp, Mus musculus
gggaccctctgaaccgagtcctggccaacctgttcctgctcatttcctccatcttgggttcacgcaccgctggcccccacacccagtttgtgcagtggttcatggaggagtgtgtgggctgcctggagcaggacagcaggggcagcattctgcagttcatgcccttcactaccgtatcagaactggtgaaagtgtct

SEQ ID NO: 5337 - DNA, 506 bp, Mus musculus
  misc_feature (281)..(281): n is a, c, g, or t
  misc_feature (371)..(371): n is a, c, g, or t
  misc_feature (452)..(452): n is a, c, g, or t
  misc_feature (478)..(478): n is a, c, g, or t
agtctcactcaggtggttccgatggctccactgctcagtctagtgtgaaaaaagccagtattaaaattctgaaaaattttgatgaagcaataattgtggatgctgcaagtctggacccagaatctttatatcaacggacatatgcagggaagatgtcctttgggagagttagtgatttggggcagttcatccgagagtctgagcctgaacctgatgtgaagaaatcaaaaggattcatgttctcacaagctatgaagaagtgggtgcaaggaaatactgangaggcccaagaagagctagcttggaagattgcaaaaatgatagtgagtgatgttatgcagcaggcacaccatgatcaaccactagagaantctacaaagctatgactcgaaaccagagataaggaaatctgattttgaaaaaaataagaactttcccctttggttggattnttcaacacagccgatgaaaacggagnactgcatttcttttcactgctagatcac

SEQ ID NO: 5338 - DNA, 504 bp, Mus musculus
caccattacaatcctaactctttaccccagtttactgaagaccaaggaactctgagccctccatttacacaaccaggaggaatgagtcctggtatatggcctgcaccaagagggccacctcctcctccacgaatgcagggcccgccttctcaaaccccactacctggaccgcatcatccagatcaaacaagatacagaccgtattaccagtgatcatagtgttttgaactgaagatatgacaaggaaaaaaaagattagtcaatcttaattgacctttgactgtggaaggaaaactacctcttttgaggtagctattaacacaagtcttgtctctcaaaatggttttaatctgactaggattgctttcaagtactattctgtagtgcagataagtggcttggttgagcacaattctatcttaactgttactttgatgtgataaattttcccaaaacgaccatttgtaaaaaattgaaaaaaaattcactgttccactttgagaa

SEQ ID NO: 5339 - DNA, 492 bp, Mus musculus
  misc_feature (42)..(42): n is a, c, g, or t
  misc_feature (296)..(296): n is a, c, g, or t
  misc_feature (334)..(334): n is a, c, g, or t
ctcattatttatagcccctgggacggtccgctcctcagacgnccttgaagaaaactccagcgaacacaaggtcccttccaggaatagtcacagtgactccagcatttacattcggcgacacactaataggtctttggaattggaccattttagctatgttcaattgaggaacgcagctgatctggatgacaggagaaacagagtgttaaacaggtacaattctcagaagctcactgagctgattttacagttctacggcatcagagcagacatgaagcgcgagtacaaacatgccnggctgtctatgactggcaccaactcctctggagaagcngtgcccctggggaaccagagcccgcccaacgactctctgacgcagtttgtacagcagcccgacgtgatatatttcattctcttcctctggctcctcgtttactgcttactgctcttcccacagcttgatgtcagccggctctgaaacatgtgtctgga

SEQ ID NO: 5340 - DNA, 111 bp, Mus musculus
atggcctgatggtttattggcgtcagataatactcttcattttgtccatccattgactgtcaattattctggcgtttatgtctgtaaagtatcaaattcccttggtcaaag

SEQ ID NO: 5341 - DNA, 339 bp, Mus musculus
gaccttcttggccagactgaacacttgcctttgcagactcagttcaaggagaaaggagctggtggtcttcagccctctaatggaccaattagcaggagatttgactatgaggatgagagcacaatgcaagaagatggaactcagcgcatgtgccccctttatagccagatgtgccaccaagaccgaagccctcgccaacatcacccacgcaaccccgagagactctacatcaacccacgagaacattatgtgtgattttccttgtcatgaagggtgttctaacaaatgtttattcttagacctggagagacactgaggcatctaagtgatttcagtctt

SEQ ID NO: 5342 - DNA, 488 bp, Mus musculus
  misc_feature (177)..(177): n is a, c, g, or t
  misc_feature (209)..(209): n is a, c, g, or t
  misc_feature (248)..(249): n is a, c, g, or t
  misc_feature (290)..(290): n is a, c, g, or t
  misc_feature (332)..(333): n is a, c, g, or t
  misc_feature (336)..(336): n is a, c, g, or t
  misc_feature (350)..(350): n is a, c, g, or t
  misc_feature (353)..(353): n is a, c, g, or t
  misc_feature (358)..(358): n is a, c, g, or t
  misc_feature (362)..(362): n is a, c, g, or t
  misc_feature (405)..(405): n is a, c, g, or t
  misc_feature (434)..(434): n is a, c, g, or t
gggtcatgatatactggaaaccacacaagattagtctgtggaggcagaaaccataaagcccctgaaaccaggttcggagaggaacgataaaggaaaaactccctttcggcttcatccttcacctgtcttagaaacaacagcacattttaaccacagatttcacctgggccactggcnaccatggataagcacgctgatgcccctggggntcaaaagaaaacaaaggagaccagcatgggaggcggcannagcccagaagcccagcaagattctgtgatgaggacagattnatcagagatgactgatgtggaatctgtgatcaccagctttgnntcntcagcaagggcagnccnccgcnaatnccttacccgacatccagagttcactggctacaagtggatcctntgatcttccactgaaactggaagcgttgnccgtgaaggaagatgcaaaaacgaagaatgaagagaaagaccaaggccaaccaa

SEQ ID NO: 5343 - DNA, 572 bp, Mus musculus
  misc_feature (73)..(74): n is a, c, g, or t
  misc_feature (85)..(85): n is a, c, g, or t
  misc_feature (158)..(158): n is a, c, g, or t
aaccatcagtgaacttgacttgacttcagaaactgcaaagaaatggtcataagagacaagtttacaaaaaaanncaaaacaaaanaaaaaaaaatcccagtttatttatcttttagttcttccaaaattcaaaatatcaagtcctactgctaaggggnagaaaacaaacaaacaaacataaaatctgagaagccccttctcataaagtcacagaacagaggcggcgaagtgggacaggtggatgcagagaacctgcaggggaggatggcaagatagagccccccagtatttcaaagctgatcatcggaagcaaccaacacaggacactgcagagaaagtaaagggaagagcagcagtgcccagccttgtgggtgtggccttcttcccgcttctcttcttgtcaagatattctaggccaagacacgacttactctttgagatccatgttgactcctttaagcctccctctagatttcacctgtagtatacgaagcatgaccattcttccttagatgtatcagaagagacaatggtaatttgtgtttgagcactgcaccacatatggacttgta

SEQ ID NO: 5344 - DNA, 549 bp, Mus musculus
  misc_feature (356)..(356): n is a, c, g, or t
  misc_feature (380)..(380): n is a, c, g, or t
  misc_feature (410)..(410): n is a, c, g, or t
aaaggctctgactgttgtttctctaggaacaggtgcaggatacagtcacccaaataccagtcacaaaaatgacggtttgccacgtgcttctgcatgtagaattgtaatctttaccagtggaaagacaggcctgtttcaggcccctcacactttattagacatttccccttctggtctcaccttcttcagccagaatttgatcaaattaaaagtcttttgtggggactgtatttctgagcatctagaacaaatcctttatattcatcgacacaaaagatcttggtggctatttttaaacccagctgtattaaaaggtgatgttgaattttacgacacccctaccatggcctgctttnaaattcggggcttctaaacctggntgtactttttaaattatatttcttagaaanttcaggatataaatacctactttattctctatctcaccccctttcttcataaattctctagagaagcctataaacatacagcgcttgactgtcttgaaaatggttggtttcatatctggtactcatcagcttgtcactg

SEQ ID NO: 5345 - DNA, 443 bp, Mus musculus
  misc_feature (64)..(64): n is a, c, g, or t
  misc_feature (200)..(200): n is a, c, g, or t
  misc_feature (203)..(203): n is a, c, g, or t
  misc_feature (208)..(210): n is a, c, g, or t
  misc_feature (212)..(213): n is a, c, g, or t
  misc_feature (219)..(219): n is a, c, g, or t
  misc_feature (229)..(229): n is a, c, g, or t
  misc_feature (233)..(233): n is a, c, g, or t
  misc_feature (239)..(240): n is a, c, g, or t
  misc_feature (333)..(333): n is a, c, g, or t
  misc_feature (336)..(336): n is a, c, g, or t
tgatcaagagttctgtttctcacacaatgggtatcatgagcctctgccactacttcggtgcccnagcacagctgggcatgctgctggacctgcaggcaggagagctggtcttctacgagcctgcctcagggacggtgcttcatatccaccgtgcgtccttccctcaggtgctcttcccagtctttgctgtggctgaccangcntcatnnncnncatcgnttcgcggacnctcntggccnnacagtgagactagattcacctccccatcacccttgcagcatacgaaggacaacctgccaggatactgttggccagaacgtcgtcgtgggagtngtnggtagcctcctcccgcctcctctgtctccaggaaacctgcttgcagcacacttgttggcatctgtcccaggccctgaggctgagctctagcatggacctacgtgtga

SEQ ID NO: 5346 - DNA, 506 bp, Mus musculus
  misc_feature (53)..(53): n is a, c, g, or t
  misc_feature (155)..(155): n is a, c, g, or t
  misc_feature (294)..(294): n is a, c, g, or t
  misc_feature (305)..(305): n is a, c, g, or t
  misc_feature (346)..(346): n is a, c, g, or t
  misc_feature (348)..(348): n is a, c, g, or t
aagtactggacgactcggacgacgacgacctcagcagtgatgcgggaagcctntacgaagccccactgagctatgcctttcccaaagacagcactatcgccagccagatctgagtctgcttccaggcccgttgatcctgacaggactctgcagtnatctagacagagtaggaggcactaaatagagcttgtgaatggagtcagacccacggttaccacctcacattcctcctggggcctctgcgtggttgagtgaccttggatcttagatagggagctattgaagtttcagatnacctaactggnacatttgggggtaagacaaagccccattgtgcactgctgtntnccatcactccttctcctgccccggagaaggttccagtgccagctgtaatgatatagggacacatagggatgaaatgatgtatagactgaaccagaccttctcaaggaccgctgttctccttaaggatgctccagagcctttcgagtatgacatctttg

SEQ ID NO: 5347 - DNA, 413 bp, Mus musculus
  misc_feature (115)..(115): n is a, c, g, or t
  misc_feature (127)..(127): n is a, c, g, or t
cgttccgcgcatgagcagtgaggcttggagcccgcctgcccgtgtctccggcgccagctacgccgctgtggctgtcactatggcccattacaaagccgccgactcgaagcgcgancagttccggagntacttggagaagtcgggggtgctggacacgctgacgaaagtgttggtagccttatatgaagaaccagagaagcccaccagtgctctggattttttaaagcatcacttaggagctgctaccccggaaaacccagaaatagagctgcttcgcctagaattggcagaaatgaaagagaaatatgaagctactgtagaagaaaataaaaaactgaaagcaaagcttgttcagtatgaaccacctcaggaggagaagcgtgctgaataggattcttctcagttgaaaagac

SEQ ID NO: 5348 - DNA, 447 bp, Mus musculus
  misc_feature (46)..(46): n is a, c, g, or t
  misc_feature (58)..(58): n is a, c, g, or t
ggctgtcactatggcccattacaaagccgccgactcgaagcgcgancagttccggagntacttggagaagtcgggggtgctggacacgctgacgaaagtgttggtagccttatatgaagaaccagagaagcccaccagtgctctggattttttaaagcatcacttaggagctgctaccccggaaaacccagaaatagagctgcttcgcctagaattggcagaaatgaaagagaaatatgaagctactgtagaagaaaataaaaaactgaaagcaaagcttgttcagtatgaaccacctcaggaggagaagcgtgctgaataggattcttctcagttgaaaagacactgaaaactggttttgtatcacttgaatagcttgtatagtatatgatctttcctgaaaagatgctataaacttttaatatgttaaatccactcatcacactt

SEQ ID NO: 5349 - DNA, 484 bp, Mus musculus
  misc_feature (414)..(414): n is a, c, g, or t
  misc_feature (450)..(450): n is a, c, g, or t
ggaagagacctgctgtacctctcggactggagccctggccagccaggcggactgagagcctcatggagtcctctgtggcccccactccagccaagtcctccacccacagcacaggctccacccttccccacctccccacggtgcccaggttcactctgaagacaccagcaccatgagatgttatttattcagctaggcggggctcgagccaggccctgcccctaggtgagcagccgccacctggacagggactgtcctgtcaccactcaccctccagccagcctgtctgtcaggaagatcttcctagcccttttttaaagcctcttttacattttttaaaaacataactttttcagagagagaggggagctgacaatcacttttcttctgttttggtttttggttttggttttngttttgaaagccgtttaaagctcagttctgatgatntatgcagctctaagtttcctcatggagcctcaca

SEQ ID NO: 5350 - DNA, 591 bp, Mus musculus
  misc_feature (100)..(100): n is a, c, g, or t
  misc_feature (107)..(108): n is a, c, g, or t
  misc_feature (112)..(112): n is a, c, g, or t
  misc_feature (183)..(183): n is a, c, g, or t
  misc_feature (222)..(222): n is a, c, g, or t
  misc_feature (259)..(259): n is a, c, g, or t
  misc_feature (274)..(275): n is a, c, g, or t
agatgtttgggaactggaccttcgggacgctggtgttcactgtgatggtgctcactgtcacactgaagctcgcactggacacgcactactggacttggantcaaccnntttngtcatctgggggtcgctgctcttctacattgccttctccctgctctggggaggggttatctggccgttccntcagttaccagaggatgtactatgtgttcatatccatgnctgtccagtgggcctgcctggctgggtatcatactgnttgtcacggtcggcnncctccctgacgtcctcaagaaggtcctgtgtaggcagctgtggcccacggcaacggagagaactcagaacatacaacatcaggacagcatttcagaattcacccctctggcctctttgccgagctggggtgctcagggcagcagactcttggctgcccagtgcagctccccctctgggagagttgtgtgctccaggtgggagagcgaagagtgtcctgtgctccctctccacccaggccttcctcacaaggcaaggtatgggtgctgtaggtccagcctggagatgcccacttgatggacagacagccccagtgcc

SEQ ID NO: 5351 - DNA, 587 bp, Mus musculus
  misc_feature (41)..(41): n is a, c, g, or t
  misc_feature (43)..(48): n is a, c, g, or t
  misc_feature (50)..(52): n is a, c, g, or t
  misc_feature (54)..(62): n is a, c, g, or t
  misc_feature (64)..(64): n is a, c, g, or t
  misc_feature (66)..(66): n is a, c, g, or t
  misc_feature (69)..(72): n is a, c, g, or t
  misc_feature (74)..(74): n is a, c, g, or t
  misc_feature (76)..(77): n is a, c, g, or t
  misc_feature (79)..(79): n is a, c, g, or t
  misc_feature (81)..(82): n is a, c, g, or t
  misc_feature (85)..(86): n is a, c, g, or t
  misc_feature (88)..(92): n is a, c, g, or t
  misc_feature (96)..(96): n is a, c, g, or t
  misc_feature (98)..(100): n is a, c, g, or t
  misc_feature (103)..(103): n is a, c, g, or t
  misc_feature (311)..(311): n is a, c, g, or t
  misc_feature (316)..(316): n is a, c, g, or t
tgtgagggtctctgtatgcatatatgtatacacatacacanannnnnncnnncnnnnnnnnncncncannnncncnnananncanncnnnnncacncnnncanacacacacacacccacttcgctgctgcccgcgcgctcgcaggctggcctgctctgccagaagggtgattcactgggtcctaaagccttggctcgagccagtcccaggcaactgagatcagaaccagggaggccctcaggagaccagggacgcaagtgctcagagagatctggctcctgatcccctctaggactaaaagctgccttgtnactgnttaagacctcataacccaccacagacctggatcagacatctctcctgacatctaaaaaagtggctatcagcttgtctatcatctcagcatgccaaagggctgtctcctctgcctgaccaatgtggagcctaccatgaacagcccattccagatacagtttttgtcttagtccagaaggcactttaaggaagtaagcgtcaaacatggctttggcagacaagagacttgagaacttacagatctacagagttcttcagtgtgttcgcaacaa

SEQ ID NO: 5352 - DNA, 499 bp, Mus musculus
  misc_feature (433)..(434): n is a, c, g, or t
  misc_feature (438)..(438): n is a, c, g, or t
  misc_feature (449)..(449): n is a, c, g, or t
  misc_feature (473)..(473): n is a, c, g, or t
gaggaaacactgtcatccatttacactgtgccagcaataacagaggagaagaaagtccacagggatagtgtggtttacctcaattccctgattaccagtggcttcaccaagaaagttgatatcacatttatccccaaaaggatttggagtcctgaagccacaacagcagagctgatcaggaagagggagctccggagggagaggttcacatacgaggtggactttgaagacttcatgatgcctttccaaaagaacatcacggagaaagctcaggcactggaggcaacactcaagaactaagtcactccagcagcctcccaggagaaatactctgtggcccagagtcaaagtttggagaaagtaagactttgaagaggaactgatacacaaatctgatcccccctagattatagtgatttacctgatgatttgnnaaantcccctgattntctaaaactaagagagtattatgntctttgttcctgaggcttcagtatca

SEQ ID NO: 5353 - DNA, 578 bp, Mus musculus
  misc_feature (339)..(339): n is a, c, g, or t
ttctggcgagaacctagcagcctggcaccccatcaagccacacggcatccttatcctgggccaagagcaggataccttgggaggccgatttgacgccacacaggccttcgttggtgacattgcacagttcaacctgtgggaccacgctctgacaccggcccaggtgctgggcatggccaactgcaccgggccactgatgggcaatgtcctcccctgggaagataagctggtagaggcctttggaggtgcgaagaaggccgcctttgatgtgtgcaaggggagggcaaaggcatgaggggccaccttgttcagggcccctccattgcctgtcagtttcangactttgaaggggcaatccctcctcagcctgtctacacgccggccttcccttctaccccactcctggctatacctcccacttctcctcatgggcacccactgctccagagtgccctgccctggatgggtgtcccctcagccacctggatagggaccagtatctcacatcaatgtaggggttgaggcagtcccgcctcctggcaatgtattggcttggtctctcccatcatatacactgt

SEQ ID NO: 5354 - DNA, 499 bp, Mus musculus
  misc_feature (31)..(31): n is a, c, g, or t
  misc_feature (188)..(188): n is a, c, g, or t
  misc_feature (468)..(468): n is a, c, g, or t
ctgaggcttctggactcttttataaagaggnagctctggagaaggatttgagcgatatgagcaaggaaattaatctgatgttgtctacatatgcaaagattttaagtgaaagagcagcagtagatgcatcttacatcgatgagatagatggactcttcaaagaagccaatattattgaaaactttctngtacaaaaaagagagttcctgaagcagaggtttacagtaattaccaacaccctacacaagtaatgtgcctatgccagctaaaagtttttcctgttactgctgtgttcttcttgctagagaaaacatatattaaactgtaactttttctaaatttaaaagaagttttaagatagatattaatatgaagtgtgtaatatttcttttgagggtcaaatatttggcacattatataaaaatataaattaaaaattatatgcatgttcttttctttattgtttantcctaaattgcttagcccttcttaaactatg

SEQ ID NO: 5355 - DNA, 250 bp, Mus musculus
gttggatcaggcctgaacccgtccattcagaaagcttcaaattatagaaacaacactgtcctatacgagtgaccgataatgctttctttggctacattctttattctgcggtgacattgaggcttataaatcaaaaggaactaacttgccgtccaccggtttatacagaactcacagtatctatgacttttttaaactacgacctgttaaatgaatctgtttgcacagatgcccgtgtacaatgccatgt

SEQ ID NO: 5356 - DNA, 506 bp, Mus musculus
gaatgcatagccaggtcgcagatattgtccaggaccctggggagttggaagccttattctttggaaatcctcactccaacctctaaacaggtctggcaagcgctggccaccacatggactttggtattgctatcctctctcagtttgttctctagtggctgtaagtagcacacgtggacatctttggggtgcctggtgtgggctcctacagacacagttctcactttcatttcctagcagatccctcccctggagcaggtggctgtggagccctgtgctcagccagcctttccacagcactggggtgggtccgggaatcttcccgctcgtcctgtaaaaagggcccaacatcctctgcaagcctcttcacacagcctctgtaatcaccctacactaggagcaggcagtgtttctgccgtgggtgggtgggtctccacataaaggacccccgtggagctgagctcacagcgccttactatgcaaggccccttacagtggacagctaa

SEQ ID NO: 5357 - DNA, 466 bp, Mus musculus
  misc_feature (326)..(326): n is a, c, g, or t
ctgggccccatgaaggatcgaatcaatgatgacttgatatctgaatttcctgataaatttggctcctgtgtgcctcatactacgaggccaaagcgtgactacgaagtcgacggcagagactatcactttgtcatttctagagaacaaatggagaaagatatccaagagcacaaatttatagaagctggccagtacaatgacaatttatacggaaccagtgtgcaatctgtgagatttgtagcagaaaggggcaagcactgtatacttgatgtatcaggaaatgctattaagcggttacaagtcgcccagctctatcccattgccancttcataaagcccaagtctctggaacctctgatggagatgaataagcgtctgacagaggaacaagccaagaaaacttatgaccgggcgattaaactagaacaagaatttggagaatattttacagctattgtccaaggag

SEQ ID NO: 5358 - DNA, 558 bp, Mus musculus
  misc_feature (271)..(271): n is a, c, g, or t
  misc_feature (284)..(284): n is a, c, g, or t
gaaatgagaaccacagaccccagaaaggaccagacgggacagtcattcctaataactactgtgacttctgcttggggggctccaacatgaacaagaagagtgggaggcctgaagagctggtgtcctgtgcagactgtggacgctctgctcatttgggaggagaaggcaggaaggagaaggaggcagcggccgcagcacgtaccacggaggacttattcggttccacgtcagaaagtgacacctcaactttctacggctttgatgaggacgnatttggaagagcntcgctcctgtcgaggacgccgcagtggccggggttcacccacagcagataaaaagggcagctgctgagcacatgggacagactgtgtggccaattagccacccctccccctgactctggtcattgttctagttctgatatatatttttaaatgaaagacaacttgggcatttcccttaatccttgccttttccttctgcctcccacgtgtccctccctctcctagcttccttctattttgggtacaacagaagcacacactactgagaaccagg

SEQ ID NO: 5359 - DNA, 422 bp, Mus musculus
  misc_feature (221)..(221): n is a, c, g, or t
  misc_feature (225)..(225): n is a, c, g, or t
  misc_feature (243)..(243): n is a, c, g, or t
  misc_feature (249)..(249): n is a, c, g, or t
  misc_feature (252)..(252): n is a, c, g, or t
  misc_feature (311)..(311): n is a, c, g, or t
ggaacagtttgtgtgtcctacatcttcattcctataaagaatgaaaagaaatattttaacctcaaaattatttaaagtccaaagtgaagctcacctaaacgtcgagccatagagtctttaattgcccgttggcagttgagctacagtatctgaaccttctgagacccggagtgcagcatagactgtgaagtcggcttcctttccgattgccttccgaaccngtgncactgtcaggttgcagtntttctnttnttgcagcagtgtgtgttggaaatggaggctgtgtcgctttgacatatagaacagatcantagttgcatagggacagatatgaagatacagccggtctttgctttcttatgcagatgcctgtatgacagtatcagtgcaccagcccagccagggagacatcagcttccatt

SEQ ID NO: 5360 - DNA, 443 bp, Mus musculus
  misc_feature (242)..(245): n is a, c, g, or t
  misc_feature (247)..(253): n is a, c, g, or t
  misc_feature (255)..(255): n is a, c, g, or t
  misc_feature (257)..(259): n is a, c, g, or t
  misc_feature (261)..(267): n is a, c, g, or t
  misc_feature (270)..(270): n is a, c, g, or t
  misc_feature (272)..(273): n is a, c, g, or t
  misc_feature (275)..(276): n is a, c, g, or t
agcatgctgatctggttggtgttcttcggtgtctattcaaccatctggccgaccatccccattgctcctgacatgaaagggcaggcaactatggtcctgagctctgcgtacttctggttgggattgttcctggttccgactgcgtgtttgattgaagacgtggcgtggagagcggccaagcacacctgcaaaaagactctgctggaggaggtgcaggagctggagaccaagtcccgagtgannnncnnnnnnntncnnngnnnnnnnaangnnannaggatgaacgagcgtgaccgtctgatcaagaggctcagcaggaagacacctccaaccctcttccgaacaggctccatccagcagtgtgtcagccatgggtatgccttttctcaagaagagcatggagctgttacacaggaggaaatagtccgcgcttatgataccac

SEQ ID NO: 5361 - DNA, 511 bp, Mus musculus
gatgagcttttcaaccagtttagaaaagctgcaatagaaaaggaggtaaaggcccggacacaggagcagatgcggaaacacctggagcataatgcgaaggacccaaaagtatctcaagaaaatcagagggagcctggaagtggattgactctagaatctttatcaagtaaagtgcaagataagtctcttgaagaagatcagagtgaacagcagccaccgtcggaagctcaagacgtaagcaagctctggcttctcaaagaccggaatctagcgagggagaaagagcaagagcgcaggagaagagaagcaatggcgggtaccattgatatgactcttcaaagtgacattatgacaatgtttgaaaataactttgattaaaactcagtttgtaaattaaccctcaactttaaatgaaaggtaaaagtgtttacagtgggcgtggttaaagtggttactttaaacaccagaatgtcaatcactgattgtgttctgactgccctaaataattttt

SEQ ID NO: 5362 - DNA, 491 bp, Mus musculus
  misc_feature (397)..(397): n is a, c, g, or t
tactcacattcaacttacagggcagagccaagcacttacgcctggtgctcacagagcgtggacagtgccgggtgcaacacctgcacttcccctcggtggtagatatgctccgccacttccagcgttctcctatcccactggaatgtggagcagcttgtgacgtccgactctctggctatgtggtagtcctctctcaggcaccaggttcctccaacaccgtcctcttccctttttcccttcctcactgggattcggagctgggtcatccccacctcagctctgttggctgtccccccagccatggtgcagaggctctccctggccaagtgacaccacctgagcagatcttccacctggtgccttctcctgaggaactggccaacagtctgcggcagcntggagctcgagtctgtgagcagtgcccgggactcggactatgacatggactcctcttcacggggccaccttcgggccattgacaaccagtacac

SEQ ID NO: 5363 - DNA, 458 bp, Mus musculus
atgtagctgtcatccacaaagatgcagagatggtccggctgctcagggatgccggagccgacctcaataaaccggagcctacgtgtggccggacccctctgcacctggcagtagaagcccaggcagccagcgtgctggaacttctcctgaaagccggtgctgaccccaccgcccgcatgtatgggggccgcaccccgcttggcagtgccctgctccggcccaaccccatccttgcccgcctcctccgtgcacatggggcccctgaacctgaggacgaggacgataagcttagcccttgcagcagcagcggcagcgacagtgacagtgacaacagagatgagggcgatgaatatgatgacatcgtggttcacagtggcaggagccaaaaccgacaaccgccttccccggcatccaaacctcttcctgatgaccccaaccctgcctgacttaagtgctaa

SEQ ID NO: 5364 - DNA, 512 bp, Mus musculus
  misc_feature (157)..(160): n is a, c, g, or t
  misc_feature (163)..(163): n is a, c, g, or t
  misc_feature (166)..(171): n is a, c, g, or t
  misc_feature (174)..(175): n is a, c, g, or t
  misc_feature (179)..(179): n is a, c, g, or t
gatggtccttagcaagtcccaggaaggccgtggcaagagaggacccttggaacggctggctgaggccccttcacctgcccccaccccatcacccacaccattggaagacttcggcctccagaccagtgcctcccctggacgcttgtcaccagatttnnnnggnggnnnnnnggnntttnggaagcatctcccagtcctggctcccaggaagaagatggagaagtggccttggtgctccttggcaggccctcacctggcgctgtgggccctgaagacatgacgctgtgcagcagccgtcggtctgtgcggccgggacgccggggcctgggccctgtgccctcctagggccaggtgcctccccagacttagggtgggagcctgccagcttcatcacctcccttatcccaagtctgttagccttggtgttagcattttaaagagacccctcaggagttctggcttctgattaactgccccgtagccgggatctcgtggcgagactgtaactagtg

SEQ ID NO: 5365 - DNA, 576 bp, Mus musculus
aagttcatcctagcagacggtgccagccagggtatggccgccttccgaccgcgaggccgccgatctcgcccttcatccagaggagcttcccccaacagatccacttccgggtcgagtcatgcctgccaggcagcctccccaccggtgcctgctgccgccagcacacccaagggcacaccaatccagggaagcaagctgcgactacccgggtacctgtcagggaaaggcttccactctggggaggacagcgccttgataacgacggcagccgccagagtccgaacacagttcgctgagtccaggaagactcccagccgcccagggagcagagccggaagcaaagccggaagcagagccagcagccgccgaggcagcgacgcgtccgactttgacatttcagaaatccagtctgtgtgctcagacgtggagaccgtcccacagacacacagacctgtgccccgagcaggttctcggccatccacagccaagccttctaaaatccccacaccccagaggaggtcacctgccagcaaattagacaagtcttcgaagagatagtgcaattggctccaacca

SEQ ID NO: 5366 - DNA, 524 bp, Mus musculus
  misc_feature (121)..(121): n is a, c, g, or t
  misc_feature (442)..(442): n is a, c, g, or t
tgcacagtacattctcatctagagaatgttgcatctggcattctggatttaaaggtgttctgaaataatagtttttcttttgtctgacagcttttcccagtaatgtttgagagcacctgcngccctttgctcctcactgtcaacttcatgtacctgtgggggtggtactgacactctacaaagtcattcccaagtggtgactgaatggaaccacaggttacaacataaacccagcattgacttgcttttgtggtagctctgacttctagaagggctgcaatctgggatttactgagcctctgagcaaagctgtctgccaggctttgccatttctgctcctgcagtacgttggcttgtgcctctctgtgccacttccgggattctcatagtcagccaattagcaaagctttcacctttacattttgtcaacttctggatcatnttcaaattttgggagactctgtggctttgttgattattgtttcagtgtcagtccccaaatcagtggctgtagtttcctaaca

SEQ ID NO: 5367 - DNA, 486 bp, Mus musculus
cagaaaaggcggtccagggcctgattgttggagaaatagaaggcctgtagtcacggtgtttgtagaagagccccttttacccgttcctgctgccacctggctgtggcttgggaaacccactagggcccagtcttcaacccagtccacctctccttcattcattcgccttctacaagcctaaattcctggcatgaggggacaggccagttgacatcaactttgtggcttaagtagtgaccacccttcccaccctaaactcttaggggcattttggacctctgcctaggaaccaggagtgaagagggatggaagatgaagagcagggacaacattcaaaggtctggaaggaacagtctgtaaactatggcgatgctagtctactccacacccaccctgagtgccgcccataattcctttcagagtactgtaggttcggggaaagtgagacagcagtgtccagtaaagatttttgttgtcccagtcact

SEQ ID NO: 5368 - DNA, 401 bp, Mus musculus
  misc_feature (30)..(30): n is a, c, g, or t
  misc_feature (39)..(39): n is a, c, g, or t
  misc_feature (89)..(89): n is a, c, g, or t
  misc_feature (166)..(166): n is a, c, g, or t
  misc_feature (168)..(168): n is a, c, g, or t
  misc_feature (183)..(183): n is a, c, g, or t
  misc_feature (189)..(189): n is a, c, g, or t
  misc_feature (217)..(217): n is a, c, g, or t
  misc_feature (245)..(245): n is a, c, g, or t
  misc_feature (267)..(267): n is a, c, g, or t
  misc_feature (277)..(277): n is a, c, g, or t
  misc_feature (321)..(321): n is a, c, g, or t
  misc_feature (325)..(325): n is a, c, g, or t
ataagatctgaaagactttgcccttttggnttgaagagntgagacatcctctccacatctcttgggccactgaaggaaacttcagctgntcctttgaatccaccctggagccccaagcctttagtcatacatatataacttaaacataagaatactttagaaactntntttatttttaaaggnattttnctatatttataaagatcaaactttggtngcaactcctagttttcctgtggccaatntcatatcccttattgcttgggntttgatgacntgcttgttgttaaggctttgctttccttaaggtgctgcaatttntatntgcatgtcagcacctgggcccctcagtgttgtcacctactgcaaaatgtactcagaagttaagtgtcccttcccag

SEQ ID NO: 5369 - DNA, 538 bp, Mus musculus
  misc_feature (56)..(56): n is a, c, g, or t
  misc_feature (60)..(60): n is a, c, g, or t
  misc_feature (62)..(62): n is a, c, g, or t
  misc_feature (68)..(68): n is a, c, g, or t
  misc_feature (72)..(72): n is a, c, g, or t
  misc_feature (74)..(74): n is a, c, g, or t
  misc_feature (84)..(84): n is a, c, g, or t
  misc_feature (139)..(139): n is a, c, g, or t
  misc_feature (162)..(162): n is a, c, g, or t
  misc_feature (233)..(233): n is a, c, g, or t
  misc_feature (249)..(249): n is a, c, g, or t
  misc_feature (252)..(252): n is a, c, g, or t
  misc_feature (277)..(277): n is a, c, g, or t
  misc_feature (281)..(281): n is a, c, g, or t
  misc_feature (327)..(327): n is a, c, g, or t
  misc_feature (378)..(378): n is a, c, g, or t
  misc_feature (422)..(422): n is a, c, g, or t
gctggaaggtggtagcaccctgataaatggtttccctgagcgcatgagacaggagntggntnctggtnccantntgctgggttntccccaccgtgcagttgctgcctggcttgggggttccatcatggcatgccgggantccttccaaagcctgtggctcantcgcagggaatatgaagaggaaggcccgtgggctgtctacaaatatcagctgtgagcacataaactggttntgcttgctttacgtantgntgcatggtttaggtggaaggaggtntggngaatgtaagactccagacacagggtcaatgagggggatttgggtgntcccaaggcatacctaacctcaatactcaagaacctcatgagccctggcantctgccctttccagagaccccccagaaccccttggttgtcattntctccagtctggtttgacctttaccgcaccccaagggcaaccacagaaaatggctgctgtggggttttgccctgttgccctgacgacaagtgcaattacccttgattgccagcttg

SEQ ID NO: 5370 - DNA, 405 bp, Mus musculus
  misc_feature (345)..(345): n is a, c, g, or t
atcaatgaggtctggcccaaccttttcttgggagatgcgtatgctgccagagacaagggtcgtctaatccagctgggcattacccatgttgtgaatgtggctgcgggcaagttccaggtggacacaggtgccaagttctaccgtggaacacctctggagtactatggcattgaggctgatgacaaccccttctttgacctcagcgtccactttctgcctgttgctcgttacatcagagatgccctcaatattccccgaagccgagtgctggtccactgcgctatgggggtgagtcgctctgccacaattgtcttggccttcctcatgatcttcgagaacatgacnctggtagatgccatccagacggtgcaggcccaccgagatatctgtcccaactcaggcttc

SEQ ID NO: 5371 - DNA, 455 bp, Mus musculus
  misc_feature (84)..(90): n is a, c, g, or t
  misc_feature (92)..(95): n is a, c, g, or t
gtgacatccaaatgtggctctctaaagaacatccgtcacaggccaggtggtggacgtgtgaaaattgagagtgtaaaactggannnnnnngnnnnggcccaagctaaagttggctcacttgacaatgctcaccacgtacctggaggtggtaatgtgaagattgacagccaaaagttgaacttcagagagcatgcaaaggcccgcgtagatcacggggctgagatcatcacacagtccccaagcaggtccagcgtggcatcaccccgacgactcagcaacgtctcatcttctggaagcatcaacctgctcgaatcccctcagcttgccactttggctgaggatgtcactgcagcgcttgctaagcagggcttgtgaatacttctcctttagcactggagtaacatttaggcatgagctcttggcaggagtgggctctgagcaggtgtcatattcat

SEQ ID NO: 5372 - DNA, 576 bp, Mus musculus
  misc_feature (50)..(50): n is a, c, g, or t
  misc_feature (105)..(106): n is a, c, g, or t
  misc_feature (126)..(126): n is a, c, g, or t
  misc_feature (274)..(274): n is a, c, g, or t
  misc_feature (290)..(290): n is a, c, g, or t
  misc_feature (317)..(317): n is a, c, g, or t
  misc_feature (320)..(320): n is a, c, g, or t
  misc_feature (345)..(345): n is a, c, g, or t
  misc_feature (367)..(367): n is a, c, g, or t
  misc_feature (434)..(434): n is a, c, g, or t
cagtattggccagaaccctcagaaagctcatcctatggatgctatcaagncacctgccactctgaagaaggaaaccctgcctatatcttcaggaagatgacactnnttaaccaagagaaaaatganagccgtcaacttactcagattcagtacacagcctggcctgaccatggagtacctgatgattcgagtgactttctggattttgtttgtcatgtacgagaccagagggctggaaaagaagagcccattattgttcattgcagtgctgganattggaaggactgggnttcttattactatggaaactgccatgngtntcattgaatgcaatcagccagtttntccactagacattgtaagaacnatgagagatcaaagagcaatgatgatccaaacacctagtcaatacagatttgtatgtgaagctattntgaaagtttatgaagaaggatttgttaaaccattaacaacatcatcaaataaataaaacaaaaaggttggaacaagtactgggaaactgattttgttatgttcactgtgccataatactgcttgcaagaaatggcctctcac

SEQ ID NO: 5373 - DNA, 485 bp, Mus musculus
  misc_feature (108)..(108): n is a, c, g, or t
  misc_feature (110)..(110): n is a, c, g, or t
cagcaatttccgtgagttttactatatccagatggagaagtatgcgcgtcaagccatcaatgatggagtcaccagtacagaagagctctccatcaccagggattgtgnanctataccgagccctcaacatgcactacaacaaagcaaatgactttgaggttccagagagattcctggaagttgcgcagatcacgttacgggagtttttcaatgccatcatcgcgggcaaagatgttgatccttcctggaagaaggccatttacaaggtcatctgcaagctggatagtgaagttcctgagattttcaaatcccctaactgcctacaagaactccttcacgagtagagattgcaacgctcttttgaatgtatggatagaagaattcccccttggatgtccaacttctctgtgtctagattttggttttatatatttgtgtgggggaggcatggatatgttgtgatgtcagctgttggttcctgctca

SEQ ID NO: 5374 - DNA, 388 bp, Mus musculus
  misc_feature (87)..(87): n is a, c, g, or t
  misc_feature (207)..(207): n is a, c, g, or t
gatgtttcgtcttctcgcttgtcaagtatgtacccctgacctacaacaaagtgtaccggtacccggattgggcaattgggctgggcntggggcctggccctttcctccatgctgtgtatccccttggtcattgtcatcctcctctgccggacggagggaccgctccgcgtgagaatcaaatacctgataacccccagggagcccaancgctgggctgtggagcgtgaaggggccacaccctttcactcccgagtaaccctcatgaacggcgcactcatgaaacccagtcacgtcattgtggagaccatgatgtgaggtccgggccatgtgacaggcgccgctttcctgctgtttactaacgttagattctcataggaccaggtttaca

SEQ ID NO: 5375 - DNA, 471 bp, Mus musculus
  misc_feature (330)..(330): n is a, c, g, or t
  misc_feature (337)..(337): n is a, c, g, or t
gaccacgtgcacaacttagtcaccatgggggctccagccgcgggcttagcggaatatcttttcgacaagcacacgcttggaagcgagagcaagcactaagacaagaggctgcctatctgataccccagtgggtcccaagacctggatggagttaacgatctcctgtttcttgcccttaaaacttgacaccgtctttccattctcctccttctttgaactgttttgctagtgttttgtagagaaaatatgctaagccctgtgctcactacggctttctaccaacaccaaaataccaattatttccccagcctgaaagatagcccagaatantatggtntgacagggatgggagacaaaacacttaaattagatacaagagtatgttctttgaatattattaagtgctgttcctatccataaacctgaactgaaattccatgacttccaattcaaccatctgtactgccttaa

SEQ ID NO: 5376 - DNA, 513 bp, Mus musculus
  misc_feature (297)..(297): n is a, c, g, or t
  misc_feature (317)..(317): n is a, c, g, or t
  misc_feature (320)..(320): n is a, c, g, or t
  misc_feature (374)..(374): n is a, c, g, or t
  misc_feature (411)..(411): n is a, c, g, or t
agttcacggccacactatagccaaacaactcgcagcaacaccctgccctcagacgtgggcagaaagtctgtaaccctgcggaaaatgaagcaagaaataaaggagatcatgtccccaactccggtggagctacacaaggtgaccttatacaaggactctggcatggaggacttcgggttcagtgtggcagatggcctgctggagaaaggcgtgtatgtcaaaaatatccgcccagctgggccaggtgatgttgggggcttgaagccctacgacaggctcttacaggtaaatcacgtncggacgagagactttgactnctncctggtggtgcctctcatagctgaatctggcaacaagctggacctggttattancagaaatccactggcctcccagaagtcgatagaacanccggctctgcccagcgactggagcgaacagaacagcgctttcttccagcaacccagccacggtggtaatctagagacacgagaacccactaacacactatag

SEQ ID NO: 5377 - DNA, 396 bp, Mus musculus
  misc_feature (87)..(88): n is a, c, g, or t
  misc_feature (93)..(94): n is a, c, g, or t
  misc_feature (96)..(96): n is a, c, g, or t
  misc_feature (102)..(102): n is a, c, g, or t
  misc_feature (105)..(105): n is a, c, g, or t
  misc_feature (112)..(112): n is a, c, g, or t
  misc_feature (114)..(114): n is a, c, g, or t
  misc_feature (126)..(126): n is a, c, g, or t
  misc_feature (132)..(132): n is a, c, g, or t
  misc_feature (138)..(138): n is a, c, g, or t
  misc_feature (143)..(143): n is a, c, g, or t
  misc_feature (174)..(174): n is a, c, g, or t
  misc_feature (248)..(248): n is a, c, g, or t
agaagactgtgtgcgacaacagcgaacagttacatcccagcaatcccaaatagaaaaatataagaatctttttgaagaagcaaatannaaatnngntgaatnacngcagcancngtcatcagtagnacgggnattagnaagtnaaagaagattacaaaaacaggctgcctcaantcagagtgccacagaggtccgtctgaatcgagctcttgaagaagcagaaaagtataaagtggagctgagtaaantcaggcaaactaacaaggatattacaaatgaagaccatcaaaaaattgaagtgttgaaatcagaaaacaaaaaactagaaagacaaaaaggagaattaatgatagggttcaagaagcagttgaaattgattgacattttgaaaaggca

SEQ ID NO: 5378 - DNA, 526 bp, Mus musculus
tgtcctcttcaacgtgggcatcaatgagcaacagacactggctgagaggtttggagatacgtccttacaagaaggtatcaatggggaaagcttggtgcgggtaaattcctactttgagcagtttaaggaggttttgccggaggactgtctacctcgatctcggagtcagacctgccttccagagctgctgcggttcctgggacagaatgtccatgcacgcaagaataagaatgtggacatcctctggcaagctgctgaggtctgtcgccgccttaacggggtccgattcaccagctgcaagagtgccaaggaccgcacagccatgtcggtgaccctggagcagtgtctgatcctgcagcacgagcacggcatggccccgcaggtcttcacacaagccctggagtgcatgcgcagtgagggttgtcggcgagaaaacacaatgaagaatgttggaagtcgcaaatatgcatttaactccctgcagctgaaggccttccccaagcattacaggcctccagaagggact

SEQ ID NO: 5379 - DNA, 428 bp, Mus musculus
  misc_feature (260)..(260): n is a, c, g, or t
caattatctcagtcactcctagtggacgacaaagtgctgttgtggtgttcagagatatcacctctgcttgtaaggctgtgagtgcatttcagtccatgtcgggaggctcaatgttccagtgctcatggcagcatcgattcatggcaaaaaaacaaaacttggtcaagaaaatgtacttcaaaagtacacttagaaaaaagagaatcaacagtaggagaaccacaggagctccataactagctgggagtggacttaccctntccgaagcaaagacagcatcaaatagtgccaggatggtgacagcgattcccacagctgggccatttactactgcaaccagaggcttcggaaagtctataaaacagtttacaaattccctacagaaatggaaagaggagagcattaaagatttcaaagtagccctacct

SEQ ID NO: 5380 - DNA, 555 bp, Mus musculus
  misc_feature (159)..(159): n is a, c, g, or t
  misc_feature (232)..(232): n is a, c, g, or t
tggatgatcttctgacttcctacatcagccagatgctcacagccatgagcaagcagaggaactccaggagcgggaggtgaaccgcagaggagacgctggctcaggccttggccctctaggcagggaagctggactgaccatatctgctgggcatctganctgcctgccacgaggtccagactcttctgcatccacctatggcatctgggtttgctgtcaccctactttgttntggccttcctggtgtaagagtctgtgttccttggtcaagcttcctgattcagaccagctccatcaagcaacctcgggaaactccttgtctgctgggcatctgacctgcctgccacgaggtccagactcttctgcatccacctatggcgtctgggtttgctgtcaccctactttgttatggccttcctggtgtaagagtctgtgttccttggtcaactctcctgattcagaccagctccatcaagcaacctcttttgactttctgtatatggatggcacagaggaatcaaggacaacttagctctctgcatacttggaacaacc

SEQ ID NO: 5381 - DNA, 549 bp, Mus musculus
tatggtgtggtttgagttctgcagtgacttcaagaccatttggaagcgggagagtaagaacatatctaaagaaagattgaaaatggctcaggcatccgtcagcaaactgacatcagagaagaaagtggagacaaagaaaatcaatcccaccgctagtctgaaagaaagactgcgtcagaaggaagccagcgtggccaccaactaagatgaaaacagaaggaagttacaatatgaaagacagcacctcactgctcctgcagacacaagggccaccggggagttcctgaaagactagttagggacatttgctcatctccttctgaggccatctgcagaaagtcccctgtgccttctttggaaagtctcttgtcaatccacaagaacaatgcaaagttatgtttgggaacactacaggaatatgtaattgtttcttgcagaagtcttaagtccacccaataataagatcagaagatatttaattcttttcacattttatttatttaaagtggaaattctaagccttccagtatatacccttgtcatgagaaa

SEQ ID NO: 5382 - DNA, 463 bp, Mus musculus
  misc_feature (438)..(438): n is a, c, g, or t
aggaggtcggtcctccgcttctgactccgctctcagaagatgcagaaatcatgcacctgtcgccctggaccacccgcctctcctgcagcctcagccctcagtactcggtggccatcgtgcgctccaacctctggccaggggcctatgcctacgccactggcaagaagtttgagaacatatacattggctggggtcacaagtatagccccgagaacttcaacccaatgctgccagctctgattcagcaagagtaccccagcggccccgaaatcacggagatgagtgaccccacagtggaggaggagcaggccctgaaggctgctcaggagcaggccctggcagccgctgaggaagaggaggaagatgaggaagaggaggaggatgaagacctggaggactgaggccccaagctccttcccatagcccttccccttattngtagcaacagattgtattttcctat

SEQ ID NO: 5383 - DNA, 313 bp, Mus musculus
ggtccaagctttcatctttgccagaaaacatcaagagattgatgaatcttaaggaactatacatagagaacaaccgactggaacagctgccagcatccttggggttaatgccaaatctggaagttcttgactgtcggcataatcttcttaagcaactcccagatgccatttgccgtactcgaaatttgagagagctgctgctggaagacaacttactctgctgcctcccagagaaccttgatcacctggtaaatcttaaggtcctaacactgatgaacaaccccatggtcgaccctcccatatatgtgtgtaa

SEQ ID NO: 5384 - DNA, 392 bp, Mus musculus
  misc_feature (136)..(136): n is a, c, g, or t
taagaacattccaattccaaccctgaaggaatttgcaaagtctctggagaccaacacccatgtgaagaagttcagcctggctgcaacccgcagcaatgaccctgtggcccttgcctttgcagagatgctgaaagtnaacaagaccttgaaaagtctaaacgtagagtccaattttatcactggcactggaatcctggccctggtggaagcgctgcgggagaatgacaccttgacggagatcaagattgacaaccagaggcagcagttgggaacagctgtggagatggagatcgcccagatgctggaggagaactcaaggatcctcaagtttgggtaccagtttaccaagcaagggccacggacaagagtggcagctgccatcacaaaaaata

SEQ ID NO: 5385 - DNA, 547 bp, Mus musculus
  misc_feature (280)..(280): n is a, c, g, or t
  misc_feature (478)..(478): n is a, c, g, or t
  misc_feature (487)..(487): n is a, c, g, or t
  misc_feature (489)..(489): n is a, c, g, or t
  misc_feature (492)..(492): n is a, c, g, or t
  misc_feature (514)..(514): n is a, c, g, or t
  misc_feature (517)..(517): n is a, c, g, or t
agagattcctctccccaatgagcggggggatgttggaggaggtaactgggatccagcaaggattcagagaagccccccctaagtccttccgtcaatgcaggaacatctacagtcaacaagcccagtcttgaggggctcttgcaagatagctgtgcttttgcaaggacagagctgctggacacaaggaaaaagaaagaaggttctggagaacagagtccccagtgtgagagcaagggttaacactgtagaagcagaaaccctcaggggcatcctgacaganatgggaagccacagtgactggaaggaggtaacgcatgttacatctctgagtgagttactctgtatggcttccgttctcccccggaaatctcccagacttctcagtggtgtgtggctctgttgggataggagaaggagctgcaactctctctatccactgcagtaagccagcccggccctgagtaattcccagttattnatctgtaantnagnttcaagttccgtaccatgtgtntcntcacagaaccttggaggtagcccagatcct

SEQ ID NO: 5386 - DNA, 451 bp, Mus musculus
gaagattttgtagctggccttggttgggaggtaaaccttacaaaccactgtggcttcatgggaggccttcagaagaacagaagcactggactgaccactccctattttgctacctcgacagtagaagtaatatttcatgtatctacacgaatgccttctgattctgatgactctctgaccaaaaaattgagacatctaggaaatgatgaagtgcacattgtttggtcagaacatactagagactacaggagaggaattattcctactgagtttggtgatgtcctcattgtaatatacccaatgaaaaaccacatgttcagtatccagatcatgaaaaaaccagaggttcccttctttggtccactttttgatggtgctattgtgaatggaaaagttctgcccattatggttcgatccacagcaataaatgctagccgtgctctgaaatcac

SEQ ID NO: 5387 - DNA, 540 bp, Mus musculus
acccagcctttctggagccggacgagacattcattgtccctgactcctttctcgtggccctggacatggatgatgggaccttaagtttcatcgtggatggacagtacatgggagtggctttccggggactcaagggtaaaaagctgtatcctgtagtgagtgccgtctggggccactgtgagatccgcatgcgctacttgaacggacttgatcctgagcccctgccactcatggacctgtgccggcgttcggtgcgcctagcgctgggaaaggagcgcctgggtgccatccccgctctgccgctacctgcctccctcaaagcctacctcctctaccagtgatccaaatcccaggaccgccatacgacagccacctggtgccaagtcactgagcccgttggggtccgccgacccctgcgcctgggatggatgcccaccctcagccatgggcagacgtgccccctcatcctaccggctgcctctgctgggggaacctatgccaacggacttctcccttcccaacactggctgaagcagcagc

SEQ ID NO: 5388 - DNA, 76 bp, Mus musculus
agtcactggtgcaaagactgcaataccacctgtgggaccatgtttgacttcttcacccatatgcacaataagaagc

SEQ ID NO: 5389 - DNA, 445 bp, Mus musculus
agaagtcttcacattttcaaacggaaggactgaagcagatgtttctgctccaggaatgcagggatagaaaccacagagattatggaaataatgtgcgtccttgtggccagtagacagtcccccttaggtctgacttacagaaggtgggcctggctgttcgcacctttatggagaaagccctttcattttagctaccaggaaccagtgattgggtgagtaaatatgtgtgttgtgtccttctatctagaggaagaacaagctaagaagagacaccttatctagcacagaataaagtactaaactccacctctaatgttaaaattgtgggaactggtaagatgttttagcaaaaacacttcctgacaagcctgaggccctgagtttgaaccttgagacccacataatggaaagacagaaccaatctacgggttgtcttctaacttct

SEQ ID NO: 5390 - DNA, 560 bp, Mus musculus
gcaacacatttgtcaccaggctttgaaggtgacagcctgacaatgtgttggagacacttctgaagggcaagtgaacagacatactgtgaagtggctcaacaggaggagcctgagttgtggggtctatggatggcaaccagctgattctgtacagggtacacttgactgtgggtatgcaggtggcagctgcagccctcctgtgcttgtgtacgcatgactgcatggaccagcaccactgcctggccataacttcagtgtctcctaactgggtgtgctttatagctccagcttcctgggaggagcagtggagccagctccctcaccccttcttgccttccctctgcctggcctggaactcgggcttctgcccattgccctctgaagctgcttcccatctgatgtcactgggagacagcagctgtctgtggggtattggggtgcaggtagattagagctgtgaaatccatgtacattaatacccaatgggataaacttagattttttttttactctgaactctgaattgtttgtgcacatatttctgctaccaccaagactgt

SEQ ID NO: 5391 - DNA, 518 bp, Mus musculus
aatggcatggttggcctggtgccaaaaaactacgttaccattatgcaaaacaatccattaacctcaggtttggaaccatctcctccacaatgtgattacattaggccttcactcactgggaagtttgctggcaatccttggtattatggcaaagtcaccaggcaccaggcagaaatggcattaaatgaaagagggcatgaaggtgatttcctcgttcgtgacagtgaatcttcgccaaatgatttctcagtatcactaaaagcacaggggaaaaacaagcattttaaagtccagctgaaagagactgtttactgcattgggcagcggaaattcagcaccatggaggaacttgtagaacattacaaaaaggcaccgatctttacaagtgagcaaggagaaaaattatatctcgtcaagcatttgtcttgatagtgctcgtacgagtgactgttccacagctttaactggtcatgtaactggagactggacagaaagtgctgggccaattgtacttgctt

SEQ ID NO: 5392 - DNA, 333 bp, Mus musculus
ggtcctttgcatatcttacgattaaggacagaacaccgcagatcttaaccaaggttattgatacattgcatcgacataaaagtgaattttttgaaaaacatggagaggaaggcattgaagctgaaaagaaagccatctctcttctttctaaattacggaatgaactgcagacagacaaaccaatcacccccttggtggacaagtgtgttgacacccacatatggaatcaatacctggagtatcagcggagccttttaaatgaaggcgatggggagccacgctggttcttctcaccctggttgtttgtagagtgctacatgtatcggagaattc

SEQ ID NO: 5393 - DNA, 448 bp, Mus musculus
  misc_feature (114)..(114): n is a, c, g, or t
  misc_feature (138)..(138): n is a, c, g, or t
atggatggcacagccctttacgaggctgtggcagccatcttcatagcccaaatgaatggggtcatcttggatggaggtcagattgtgactgtaagccttacagccaccctggcnagcattggtgcagccagtattccnagcgccgggctggtcaccatgctcctcattctcacagctgtgggcctgccaacggaggatatcagtctgctggtggcggtggactggctgctggatagaatgagaacttcagtcaatgtggtgggcgattcttttggggctgggattgtctatcacctttccaagtctgagctggacaccattgactcccaacaccgaatgcaggaagacatcgaaatgaccaagacgcagtccatttacgacgacaagaaccacagggaaagcaactctaatcagtgtgtctatgccgcacacaactctgtcgtaatag

SEQ ID NO: 5394 - DNA, 389 bp, Mus musculus
  misc_feature (362)..(362): n is a, c, g, or t
gatgtgaaagttctctacgcagattatggaaacatcgaaaccctgcctctttccagagtgcagcccatcccagccagccacctggagctgcccttccagatcattagatgctcactagaggggccgatggagctgaatggaagctgttcgcagttagtgatggagctgctgagaaatgccatgctgaaccagagtgtggttctctctgtgaaagccatttcaaagaatgtccacgcagtgtcagttgaaaaatgttctgagaacggaatgatcaatatagctgagaatctggtgatgtgtggcctggcagaaaacctcacttctaaaaggaaaagtgcttccactaaagagataccacacancagagactgctgttgcacagagttaca

SEQ ID NO: 5395 - DNA, 496 bp, Mus musculus
  misc_feature (85)..(85): n is a, c, g, or t
  misc_feature (214)..(214): n is a, c, g, or t
  misc_feature (353)..(353): n is a, c, g, or t
aaacaggtgtatgaccatccctaccttttccacattttctcagcagatacacacttgtctgttagagagcaaactgccttttttnatagccacagacttctaagtaaaagaagcaaacaaaggagcgaagtggtatagggagatttactaatggccagtgggacatctgagaggcaatttgattttgatcatctcatcccacaagcctgaaggncagaaactctgccttaccttctgctgcacccctcccccacacgctgttgtctgttgatgctgctgtcaagttttcatccaggtagagtcctaacaataagccagtatgtaggacttgcctcccagcgcccttgtagctnatagctgcctagtttgctgttctagatctaccaaggcctaccttcttcagaccccatccctacctcttatgaatttgacttcctgtcagtcctttagaaagggacaggaaaatgccatgttctgaattctgatgccatttctg

SEQ ID NO: 5396 - DNA, 474 bp, Mus musculus
agtgcctcacagctggaacaactgaacaagcggtattggtacatttgtcaggatttcactgaatataaatacacacatcagccaaaccgctttcctgatcttatgatgtgcttgccagagatccgatacatcgcaggcaagatggtgaatgtgcccctggagcagctgcccctcctctttaaggtggtgctgcactcctgcaagacaagtacggtgaaggagtgacctgtgccctgcacctccttgggccacccacagtgccttgggtaggcagcacaggctccagaggaaagagccagagaccaagatggagactgtggagcagctacctccatcacaagaagaatttgtttgtttgtctgtttttaacctcatttttctatatatttatttcacgacagagttgaatgtatggccttcaacatgatgcacatgcttttgtgtgaatgcagcagatgcatttccttgcagttt

SEQ ID NO: 5397 - DNA, 557 bp, Mus musculus
  misc_feature (355)..(355): n is a, c, g, or t
ggacgaatcctaccttgaagtcttccactaaagggaaagtgcccaatctgaatgaagtaggaacaatgacagaatcacatcatttcataaaagaatcagacttagaaattgagtcactggtggaaacattttcatatgacaatgaagacaaacagtcaatgagtgatgatggacatttttctggaacaacacccaaatggtgtcaaaatgatacaaatagaaaaattacagttcaagactgcatgtatcctaacttgaagtctcccactgaggggaaaatacctacccgcagtaaagcaggaaaaatggcggaatcagctcatttcataatagaatcagatttggaaattgaatntctggaagaaactgtgtcatgtgacagtgaagataaacaactactggtataaagatatttcagttgtttttttcaatactgctttttggttggttttcaattgtatagaaaaggctataattaaatatattttaggttactttgttagtagtgatttataaatgtttcaggcttgttgtaaccaagctagttcccaaacaat

SEQ ID NO: 5398 - DNA, 392 bp, Mus musculus
  misc_feature (65)..(65): n is a, c, g, or t
  misc_feature (88)..(89): n is a, c, g, or t
  misc_feature (108)..(108): n is a, c, g, or t
  misc_feature (133)..(133): n is a, c, g, or t
gggacagctgaagccctcctgcagaacgcctacctcaccatccataatgaactgagaggtttgtnaggacagccccccgagggctgtnnaatccccaaggtgatcgtnagcaaccacaatctggctgacaccngttcagaacaagcaactgcaagctgtccttcagtgggtggctgcctcagagctcaatgtccctattttgtactttgctggtgacgatgaaggaatccaggagaagctgcttcagctctcagccactgccgtggagaaaggccgcagcgttggggaggttctgcagtcggtgctgaggtacgagaaggagcgacagctggatgaagcagtgggaaatgtcacgcggctgcagctgctggactggctgatggcaaacctgt

SEQ ID NO: 5399 - DNA, 367 bp, Mus musculus
gagatcaccaacctgctgcatggagacctgctttctgagaaccctcgaccggtggccagctcctttgggtctcaccgtgtggtccttgaccgctggaagggcatgaaccgagagcagcgggaggagatctggttcacgcagaagcggcaaatccaggagaagctgaggcttcaggaggaagagcgccagcacagcatggactgggatttgcgcaggatccggaaggctcatgccagcctgctgcatgagcggcagcagcagcgcttgcttcgggagcagcgcagggccctggactgcagcaacctcaacctggccaggcagcagtacttacagaaaaaacaaatgaatacagcctcctcaagtcagc

SEQ ID NO: 5400 - DNA, 290 bp, Mus musculus
attacgatacagactgacactgttgagaccatggctttaccccaaggaagtgggaataaagcagtgccgggaatgaaccctgctgacacggttatcaaaaaggaatcgttgcaagagttaaagtgcacagatgctgatgacgaggactgggatatatcgtccttagaggaagagaagtctctggggagtaaaatagagcagagggagccgcctccggccaagcgggaccccagctgcacccaggtgcagagggcctggggcccagtgaaccctcgggaattcaaggaaga

SEQ ID NO: 5401 - DNA, 434 bp, Mus musculus
  misc_feature (260)..(260): n is a, c, g, or t
aggctgcgctggatgttaccgagacacacacagaagcagatgtcatcacaatagcccgatataacttccaatctgcaaaaattaaggctaaaattgttaaggtggacagggaattcttgtaccttattttagacccaatgtttaagagtattagcgttatgggtaaggttatcaaccctttaacaaactagatcttctcaagtggtggggcttctttccaagtttgatttgctttttggcttctatcctctgattggctnggatatgcttgtaattgttcactgaagttgattaactttagtggtcacacatacacaagggactgtggatggtctgtgtcaggcatcagtcctgttggcatcactagcacatattcctgggcctgaaatctgtctctcttccacttcccagatgaacttctccatctgcatcac

SEQ ID NO: 5402 - DNA, 272 bp, Mus musculus
gactccgacaatggccgagcttggtgaagcggacgaagcggagttacaacgcctggtggccgccgaacagcagaaggcgcaattcactgcgcaggtgcatcacttcatggaactatgttgggataagtgtgtggagaagccaggaagtcggctagactcccgcactgaaaactgcctctctagctgtgtggatcgcttcattgacactactcttgccatcaccggtcggtttgcccagatcgtacagaaaggagggcagtaggccatacctt

SEQ ID NO: 5403 - DNA, 173 bp, Mus musculus
gctgtgtgtcaaagcaaaaactgggccatcatgtgaagtcacttgtgtttgagctgtgctgcaacagtgacagtggagacgacatagaggttccttatgtacgatacatcatccgctgatctcttactgactccgttctttcagatctctcagtctatatcaaaacctttcta

SEQ ID NO: 5404 - DNA, 527 bp, Mus musculus
  misc_feature (285)..(285): n is a, c, g, or t
  misc_feature (287)..(288): n is a, c, g, or t
  misc_feature (291)..(293): n is a, c, g, or t
  misc_feature (302)..(302): n is a, c, g, or t
  misc_feature (336)..(336): n is a, c, g, or t
  misc_feature (402)..(402): n is a, c, g, or t
  misc_feature (453)..(453): n is a, c, g, or t
  misc_feature (455)..(455): n is a, c, g, or t
gaaccaaatttagattgtaaggaagaagaaactatgcaattcaaaaagagccaaagtccttcaatttctcattgtcaggttgaacagttagtcagtaaaacatctgaacttgatgtgtctgaaagcaaaacaagaagcggaaaaatctttcagagtaaaatggtaaatggaaataatcaacaaggacaaacttctaaagaaaatcggaagagaagtcttcgtcaatttaggaaaacaataaatgcacctgagtgtaggtgacaaacaagatgccctggacttggngnnaannntccttcacntcttggaatctagtcaagagtcagtgctgaaganaaaggagagttagtgaaccaaaggaacatacctaaaaattatttttcttatgcaaatttgcagttntcaacatttaaactaatatgctgtattatttgaaggtgtgccttctgtacntntgaaaattattttgtagttcatagttattaaactaataaaagttttagctattatattgtgtttacctgaga

SEQ ID NO: 5405 - DNA, 312 bp, Mus musculus
atgtgaatttcctcctcagatattgaacagcagatgtgatgccatgatttatccaccgtttcagattcctatcaggacctgatacactcttcatgagaacctgagacggtttcaagtcagaggcatatctattggagctgtggacatttcacatttccttcttctcttcatctcatcctcttcagtctttccactggtctgtgccagaggaatttgcccagtaattctattagtcctgatttgtctttttctttgcttaaatcagttttattttagcccaatagtctgttcttgtggcagtgcattctgaga

SEQ ID NO: 5406 - DNA, 417 bp, Mus musculus
ccacatcccacatcctgaggacaagagcaatgacctgatgctgctccgtctcagcaagcctgctgacatcacagatgctgtgaagcccatcgacctgcccactgaggagcccaagctggggagcacatgcctagcctcaggctggggcagcattacacccacaaaataccaaatcccaaatgatcttcagtgtgtgttcatcaagctcctgcccaatgagaactgtgccaaagcctacgtacataaagtcacagatgtcatgctgtgtgtaggagagacgggtggaggcaaaggcacttgcaagggtgactcaggaggcccactgatctgtgatggtgttctccacggtatcacatcatggggctctatcccatgcgctaaacccaatgcgccaggcgtcttcacaaaacttattaa

SEQ ID NO: 5407 - DNA, 582 bp, Mus musculus
  misc_feature (156)..(156): n is a, c, g, or t
  misc_feature (212)..(212): n is a, c, g, or t
  misc_feature (223)..(223): n is a, c, g, or t
  misc_feature (248)..(248): n is a, c, g, or t
  misc_feature (260)..(260): n is a, c, g, or t
  misc_feature (447)..(447): n is a, c, g, or t
  misc_feature (462)..(462): n is a, c, g, or t
  misc_feature (469)..(469): n is a, c, g, or t
  misc_feature (538)..(538): n is a, c, g, or t
  misc_feature (540)..(540): n is a, c, g, or t
  misc_feature (555)..(555): n is a, c, g, or t
taaaattaaattgcctaagacgtcaaattctacatcagaaacaaatctagaatacaacaattcaaagaaaaccttggaaatgagtttgagaaatggcaacaaaaattcaatgaactttgttctgaaggggaatgcagccacatgttgcaaggacantcccaatacagactctaagaagagtgttgaagaattttctgatgacatatcagagngtataaacagntcaaatatggatttaatgttgcgtntaaatgagttcngagctgaattcacagatttggatgtatggtcaacaaattgctcacagaacaatgcaaagaagcctttaaagacgggaggaaagaaggaaagggactcagatattgattctggaggctcaaaagatgcaaagaaagagggaaagaaaaaaggcaagagagaatccaggaaaaagaggaatacagaatngagtgatgctgaatntggtgantccaaggatggaaagaaaaaatcaaaacacgataaaaaaaatgaaattaagaaaaagaaggatacagantntactggtagtggatntggggcgtccatggtttcaaagaaagg

SEQ ID NO: 5408 - DNA, 402 bp, Mus musculus
  misc_feature (171)..(171): n is a, c, g, or t
  misc_feature (188)..(188): n is a, c, g, or t
  misc_feature (197)..(197): n is a, c, g, or t
  misc_feature (201)..(201): n is a, c, g, or t
  misc_feature (212)..(212): n is a, c, g, or t
  misc_feature (226)..(226): n is a, c, g, or t
  misc_feature (251)..(251): n is a, c, g, or t
  misc_feature (253)..(253): n is a, c, g, or t
  misc_feature (255)..(255): n is a, c, g, or t
  misc_feature (289)..(289): n is a, c, g, or t
  misc_feature (312)..(312): n is a, c, g, or t
tctggatctgggacattcaaaagctgaagctgtttgtggtactagagcatatgtctccagtgcgctcatttcagtgggacccacagcagccgaggctggccatctgcacaggaggaagcaaggtgtacctgtggtccccagcaggctgcgtgtcggtgcaggtgcctgggnaaggtgactttccagtnctcggactntgcntggcacttaantggggattccttgnccctccttagtaaggaccacttctntntntgcttcctggagaccaaggagagggttggcacancctacgaacagcgggacggcatncctaggacctgagtggaaaccaaggcagtagactgctgattccaacgtgagctaacggctgcacaggttctccagatgggatgggctatt

SEQ ID NO: 5409 - DNA, 449 bp, Mus musculus
  misc_feature (230)..(230): n is a, c, g, or t
gcacctccttggttgaccccagaaactcctccccacgcctcaatccaatgccctcggcctcggcgtcgtcccctctgccaccccctctgccagccatctgcttttcctcagctccactcctggacttgcctgctggctacaaactggggtcctcggcttttgagccctacagcagactagaacaacagaaagtaggcagccctggccaaagtgacaagaaagctgacatntaagagtcccatccctgtgtgacacttgagtccccagcagagcactaccctagcctcctggcccccgtggactatactgagcaggcctggaagaggaagggtgggcacagcatgcgcatgtgcctctccacctgccctcagctcagagactgaaccaaatgactttggtcctaatgtactttctgatgtgtgagtgctagctatgtgcacctatgcgtg

SEQ ID NO: 5410 - DNA, 586 bp, Mus musculus
  misc_feature (285)..(285): n is a, c, g, or t
  misc_feature (294)..(294): n is a, c, g, or t
  misc_feature (319)..(319): n is a, c, g, or t
  misc_feature (346)..(346): n is a, c, g, or t
  misc_feature (375)..(375): n is a, c, g, or t
  misc_feature (390)..(390): n is a, c, g, or t
  misc_feature (397)..(397): n is a, c, g, or t
  misc_feature (444)..(444): n is a, c, g, or t
  misc_feature (451)..(451): n is a, c, g, or t
  misc_feature (473)..(473): n is a, c, g, or t
  misc_feature (485)..(485): n is a, c, g, or t
  misc_feature (497)..(497): n is a, c, g, or t
  misc_feature (534)..(534): n is a, c, g, or t
  misc_feature (543)..(543): n is a, c, g, or t
  misc_feature (554)..(554): n is a, c, g, or t
gaagaagtgtttcaaatgctgctgtaaagagaagaatatggagtctaatgcctgctgtttcagaaatgaggacaatgagactttggcgtgggagggtgtcatgaaggagaattaccttgtcaagatcaacacgaaagccaacgacaactcagaggagatgaggcatcggtttagacaactggactcaaagcttaacgacctcaaaagtcttctgaaagagattgctaataacatcaagtaaggctggcgatgcttgtggggagaaaccaaatcacaatgaggtcncagcaaccncctggatgtggaggctcatgggacnctgatggacagtactgctaatgacttntaaaggagacattttcaggtccctgagcncagggtggatgactnttagtcnccctcaagggcataggtcagggagcaaagtgtacagaggactttacncctgaanaggggtgcaaaggaccatgttnttctgtgaaggngcctgtgttttntgcatctcagagccttgtcctgatgctgagggattangtgttgacnctcctttcccncgactgtgactctggccctgattttatactta

SEQ ID NO: 5411 - DNA, 451 bp, Mus musculus
ggagtccagacagaaggccttgactatgacaggctgaagcaggacattttagatgagatgagaaaagagctggcaaagctgaaggaggagcttattgacgcaatcaggcaggagctgagcaagtcgaacactgcataaagaagcaaactacggaggggcaggacttgaatctggagaaaacaaaaattcctacaaacaactcttaacccccaaacttttaagctgtaagaagaaaatggatacacagtcaggagggaagccgtcaacctctgaaagcctcagacagtgactctggcgatcagctgtcccctcagtgtgctgctttattctgtctgacctttaccacaggatggagaatgatattggagttcccttagcagtactaaacccgtcaggcaagatcaccgtgcattgaaatattttcatgtctagatgagtctgcacgttttcc

SEQ ID NO: 5412 - DNA, 413 bp, Mus musculus
gtttatgtttcaatggtcaccgagcacatttgttcttcatacttgaaaaatggtgtgacttctgaagaaaatcccctgacaacactgtttaaaaaggtataaattagtatgtttggcttggtttgaacaatatgaacagttttaatatttatttatgttaatattcttaacagtttccaaagtatgtgtacctccaactctctttgaagtgttctggccttacaactgctcagtgttgcataaaacaatctatttttatatttgaaagacgaatgaagctatttcatagttttgccaacacagttattgtactttgtaatttcctaagacaatgttcacaatattacgacactggaacagttttgagtatatttacaacatttaaaaacagggaccattgtaatgaacttatt

SEQ ID NO: 5413 - DNA, 68 bp, Mus musculus
gttggcctgccctaagtggtataatcctaacatatagggatattggcattgagacagtaaattcattt

SEQ ID NO: 5414 - DNA, 296 bp, Mus musculus
tacagcaagacttcatcgttcacttcagggcatttcaacagagaaaggccgctgctcctgctgctccgagaagtgggaatcctggctacctcactgggaagccactcttagtgctaactggtgacacaagtcactcgatgaccctgttgcagagcgagggtaatgggctttgctctgctaagagacacgcagtacagtttggagtgaacgcagtatctgggtgccagttaagacccagagaggtgaactgcagccacttgcaggaggaggtttatcagactctgcacggaaggccc

SEQ ID NO: 5415 - DNA, 541 bp, Mus musculus
  misc_feature (316)..(316): n is a, c, g, or t
  misc_feature (325)..(326): n is a, c, g, or t
  misc_feature (339)..(339): n is a, c, g, or t
  misc_feature (347)..(347): n is a, c, g, or t
  misc_feature (354)..(354): n is a, c, g, or t
  misc_feature (359)..(360): n is a, c, g, or t
  misc_feature (383)..(383): n is a, c, g, or t
  misc_feature (394)..(394): n is a, c, g, or t
  misc_feature (436)..(436): n is a, c, g, or t
  misc_feature (469)..(469): n is a, c, g, or t
  misc_feature (471)..(471): n is a, c, g, or t
  misc_feature (501)..(501): n is a, c, g, or t
taggtggattagcatcagcctggatgagatcgagaacatcgaacaggagatagagatcctgagggaaagagactccttaggtgagacatcagcatctcgctcatctcctcaggagaggcctccactaaaacccttcgtcctcactcgaagtgttgcccaagcacaagtgtttggagctgggtacccaagtctggcaactatgaccgtgaatgactggtacgagcagcgccagaaaaatgaggtctcaccaactcttcaggaagcagaaaagcaggcaccaccatctgagactttcactgtatctgagaaggaaganccagacctnnagcaaaaggaagnatgaagangagaatnccctnnacaggatgcaggagtgggatgantggaaggacantcatcctaggggatatggcaaccgacagaacatgggctaatntcccctcccctcggtgtgaaaagatgaaggagntntcaccttcccagacaaggaaaaccctgttntcttcccttcctcaggcccctgcttcagaagtgtgcaaca

SEQ ID NO: 5416 - DNA, 345 bp, Mus musculus
acaagactggttgggccatggtatctctgagctacattcatggaagcagccaggctcagtttgtggcagagtcacacatcattctagtactgaatgctgctatcaccatggggatggttcttctaaatgaagcagcaacttccaaaggggatgtcgggaaaagacgcatcatttgcctcgtgggattgggcttggtggtcttcttcttcagttttctactttcaatatttcgttcaaagtaccatggctatccatatagctttttaattaaatgaagccaaatgggatttgcgtaaagtgagtgtttactgtgaagagaagcagttcctgacattatattatttg

SEQ ID NO: 5417 - DNA, 451 bp, Mus musculus
tacatcatggagacgtttgggatgaaatacagagatgcatttgcttatgtccaagaaaggagattttgtattaatcctaatgctggatttgtccaccaacttcagctctggctgtcctggaattcagcgagatctgcccctctgcctctgaagcaaaggcaggtatatcactgtgcattcaagactagtaaaaacaaacaaacaaataacagcttttagggctagagagatggctcagcaggaatatgaagccatctacttagcaaaattaacaatacagatgatgtcaccactccaaatagaaaggtccttagctgttcattctggtaccacaggtagtgtgaagagaacacatgaggaagatgacgactttggaaacatgcaagtggcaaccgcacagaacggctgacctgtgaggactgttacatgggtgtgagcttccatctggaaa

SEQ ID NO: 5418 - DNA, 423 bp, Mus musculus
  misc_feature (34)..(36): n is a, c, g, or t
  misc_feature (38)..(39): n is a, c, g, or t
  misc_feature (43)..(49): n is a, c, g, or t
  misc_feature (53)..(57): n is a, c, g, or t
  misc_feature (60)..(66): n is a, c, g, or t
  misc_feature (68)..(69): n is a, c, g, or t
  misc_feature (77)..(80): n is a, c, g, or t
  misc_feature (83)..(88): n is a, c, g, or t
  misc_feature (91)..(92): n is a, c, g, or t
  misc_feature (94)..(94): n is a, c, g, or t
  misc_feature (97)..(101): n is a, c, g, or t
gacacagcttgttctcaaacacatggagtcaagnnngnnaggnnnnnnnttgnnnnnttnnnnnnncnnagcccttnnnnccnnnnnnctnnanagnnnnnactcagcttccaaggcttttgtgtacacattttccaaggctctgagtgtggaatacagagataaaggaatcattattcaggtgctgaccccttattctatttcaaccccaatgacaaagtacctaaataacaagatgaccaagaccgccgatgagtttgttaaagaatccttgaaatatgtcacgatcggagctgaatcctgtggctgccttgctcatgaaatcattgcaataattctgaaccggatcccttccagaatcttctatagcagcaccgctcaacgattcctcctgacacgatactcagattacctcaaacgcaa

SEQ ID NO: 5419 - DNA, 515 bp, Mus musculus
  misc_feature (438)..(438): n is a, c, g, or t
tcaatgtgccttccccagacatagatacccaagccagggagcctccctccatgttggaggatcaggaggccatcgcacttaaacttgaggaagatcccctagggcaggatgcctctgggaggcaggagactctggctctgaggccagcttctatggcagagccacagggagacgaaaaacccggagagaacactgagcttgtgaaaagagcagttctggatccctttgaaccaaaagccacaatagagctgcctccgtctttacatcaagctctgcccacatcagctgatacatactcacctgtagatgtggcaatagatgaagctgcagatgaggctgcagatgtttcacctgccagtggtacaatctacttatgttttacccgtggactgcaactttgaggcaaacaggttgatcgtgggaatgggaccctcacantccaccctggaagcagggaaagcaagcagctggtgtggcagaaagtggacaaatcccagcagcggtgaacaatataa

SEQ ID NO: 5420 - DNA, 576 bp, Mus musculus
  misc_feature (332)..(334): n is a, c, g, or t
  misc_feature (337)..(338): n is a, c, g, or t
  misc_feature (343)..(344): n is a, c, g, or t
  misc_feature (354)..(355): n is a, c, g, or t
  misc_feature (360)..(360): n is a, c, g, or t
  misc_feature (372)..(372): n is a, c, g, or t
  misc_feature (375)..(375): n is a, c, g, or t
  misc_feature (377)..(378): n is a, c, g, or t
  misc_feature (382)..(382): n is a, c, g, or t
  misc_feature (387)..(388): n is a, c, g, or t
  misc_feature (390)..(390): n is a, c, g, or t
  misc_feature (397)..(399): n is a, c, g, or t
  misc_feature (403)..(403): n is a, c, g, or t
  misc_feature (407)..(407): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (476)..(476): n is a, c, g, or t
  misc_feature (495)..(495): n is a, c, g, or t
  misc_feature (510)..(510): n is a, c, g, or t
  misc_feature (521)..(521): n is a, c, g, or t
  misc_feature (523)..(523): n is a, c, g, or t
acactagtcaagatgctggttcacaaccctattgattcaacttggaccatttcacttgaatttcagtatgcacagaacctgatattatgggctatttttatgaagcttgtagttctggttttcagtgtgatagctttcaggattagctgcatgaaagatccatttctaatgatgcagatatattgctacaagttctctaccttagttttgggtattagcagtctttttatatttgttgctgtgagctggaaccatatggtagatctttatggccaaactactcttgactttccacccaaatttcctgtccagaaagaagccttgaaaaacannnatnngactnntgtatttccnntgggnatcctgactgcnacnanntcanttttnngngggatcnnntttntttntgagataagctatttgaaaatacagantcnanttgaggccaagagtgtttccaaagtggcccttcaagnggcctgaagtgaggccttntgcatagccaacatntgtcagatggntnttagaagaaatttacaattgacatacaaaacttatgtagtcaccaacttgttc

SEQ ID NO: 5421 - DNA, 510 bp, Mus musculus
  misc_feature (374)..(374): n is a, c, g, or t
cctagcatgttcgagaaggagtcatatgcacagatcttaagaccgagagagtcttttcgtgatgttcagttcgtggaacctccgtttgatgacgcaattgctgattcaggcaaagaatggaaaagtgccctggcaaaattaaagttcgctaattcatatagaatggagccactgaagaaatttcaagcacattcggtagaaactaaaatccagcagatattaaaggacagtcttaaagatgtcaaatatgatgacaaagcccctcatttgtcacttgaattggcagatcgaatattggcagcagtcaaagaatttgcataccatcgttataaattcattatacaagtattatttattcaaaagactggtcaagnaataaatattgccagcagatggatctgggatgtggcatgggacaactgggtagaagctaaacatgaaacagagtcttacgtggtattggccttggtgtttgctctctattgtgaatagctcaggaccagcattttc

SEQ ID NO: 5422 - DNA, 498 bp, Mus musculus
  misc_feature (385)..(385): n is a, c, g, or t
gcgagaggaggcctagcatgttcgagaaggagtcatatgcacagatcttaagaccgagagagtcttttcgtgatgttcagttcgtggaacctccgtttgatgacgcaattgctgattcaggcaaagaatggaaaagtgccctggcaaaattaaagttcgctaattcatatagaatggagccactgaagaaatttcaagcacattcggtagaaactaaaatccagcagatattaaaggacagtcttaaagatgtcaaatatgatgacaaagcccctcatttgtcacttgaattggcagatcgaatattggcagcagtcaaagaatttgcataccatcgttataaattcattatacaagtattatttattcaaaagactggtcaagnaataaatattgccagcagatggatctgggatgtggcatgggacaactgggtagaagctaaacatgaaacagagtcttacgtggtattggccttggtgtttgctctctattgtg

SEQ ID NO: 5423 - DNA, 505 bp, Mus musculus
  misc_feature (147)..(147): n is a, c, g, or t
  misc_feature (417)..(417): n is a, c, g, or t
  misc_feature (436)..(436): n is a, c, g, or t
agcacgaagatgacctccctgagaacctgagtgagatcgcagacctgtggaacagccccacccgcacccatggaacttttgggcgtgagcctgcagcagtcaagcccgatgatgacagatacctgcgtgcagccatccaggaatacnacaacatcgccaagctgggccagatcattcgagaggggcctattaagctgatccacaccgacctggaggaggagcctggggaccacagcccaggccagggcagcctccgtttccgacacaagccacccatggagctcaaggggcaagatggaatccacatggttcatggcagcacgggcacactgctggccactgatctcaacagcttgccggaggacgaccagaaggggctggaccgctcgctggagactctgacggcctctgaggccnactgcctttgagcgcaatngcccgcacagagtcggccaagtccacccctctgcataagctccgggacgttatcatggagagccctctg

SEQ ID NO: 5424 - DNA, 412 bp, Mus musculus
agctcagactccaaacaggtagcagacaaaatgttgacctttgattaatgaaaagaataccttgggatggaaaagacaaaagcacaaccaagaaggttctgaggagatgagcaaataacttcaaaagaactacagtgttccctgaacaatgtttattttatgtttattcttagatattcaccccattatatgtccatgtttttattgtctattgtggccacaaatacttcaaagtaccatgtgacaattgccccttccatatgatttacatgtggcagagtatggaattaggaaaaggacacactgtagtccttttctagacagcatccaaaaataaattttactactatgtattcataatatagatgagcttttcaagcaaattcttccttgtattattctctgtattttg

SEQ ID NO: 5425 - DNA, 553 bp, Mus musculus
  misc_feature (176)..(176): n is a, c, g, or t
  misc_feature (192)..(192): n is a, c, g, or t
  misc_feature (199)..(199): n is a, c, g, or t
  misc_feature (213)..(214): n is a, c, g, or t
  misc_feature (292)..(292): n is a, c, g, or t
  misc_feature (297)..(297): n is a, c, g, or t
  misc_feature (328)..(328): n is a, c, g, or t
  misc_feature (349)..(349): n is a, c, g, or t
  misc_feature (362)..(362): n is a, c, g, or t
  misc_feature (419)..(419): n is a, c, g, or t
  misc_feature (437)..(437): n is a, c, g, or t
  misc_feature (439)..(439): n is a, c, g, or t
  misc_feature (450)..(450): n is a, c, g, or t
  misc_feature (488)..(488): n is a, c, g, or t
  misc_feature (507)..(507): n is a, c, g, or t
gtcagcgtcctggattgtgtcgtcaatggggtagaaaggccagtgaagtctactctgttcccccaagtccctgtctccaaagctctttatcttagtaaatatctgcaaggctccagtctggcaggggtcaacataaggacggccttcaaaacctttgctaaaaaaaaaaacccccntttttttaaccccccntaacccnattaaaaaaaaaannccctgacggggtcctcttccagactcatgccatgctttggaatagggcaagccagggcttgtttggactggtcattangctancctaatctctgcatagcttgcaccttgatangttggagggagcccccttttntatcttaccctgnggcaagggtttgcacaacccctgcggaaggcacccctccccacacacaccttcttanggagggggtgctggagtntntttttttgttngctgaggagatactgctgaaaggttgccctttccccangctattcaccatacctacntctggggacgaaaggtaacccgaccaatttctcaaaggtttcaaag

SEQ ID NO: 5426 - DNA, 356 bp, Mus musculus
cctgctaagagggatgcatggctgcagttaagggcagcgactcgaaggcctaacagattcctggctaacgaatgcacttaagtctttatcaattattagtactaggagtaactgtgtaaatgtcttggtaacgacaacccagctgattcctgctcttgcaaaagtcctgctctacagcctaggaggtgctttccccattgagaacatttacagcgcaacgaaaataggcaaggaaagctgttttgagcgtatagtgtccagatttggcactaacataacttatgttgtgattggagatggccgggatgaggagcacgctgctaaccagcacaacatgcccttttggaggatatcaa

SEQ ID NO: 5427 - DNA, 418 bp, Mus musculus
aagaggcgactcatttttaccgtgggcacttccagcaccacaggtgagaccgacaccgtggtgtggaacgagatccaccacaagaccgagatggaccgcaacgtgacaggccacggctatccggaccccaactacctgcagaatgtgctggctgagctcgctgcccagggagtgaccgaagactgcctggaacagcagtgacctcgggcctgcctctgccgaccccacagccctgggcggggcgggtgggcaggaaggtgtgccttcggtgagaggcaagagtgtgtgttgggtttgtgtagcccactggggttgcacctcctcctaaaggttgggcttcttgcctctgctgccaccatcctgtctgcgccggggtctgcctggaaaatgggcaccctcctcagtattgtacttgtgg

SEQ ID NO: 5428 - DNA, 411 bp, Mus musculus
gtggagtaactgagcccgtaacttcccacagggacgactgctgccttgtctacagaagggaaatctcgggaacggctgtctgctgcgacaaggagtgtctgtgcccatcgctcctgttcacctgccagcctcctgtccccagggggggtgtcacacacccgggcctccccaagtgatggctcttgagcccaggaacatgcatggccctcaggatgaggagcccagcagggacacagttctgtcacagctcctcttgtccttgtctttccttcccaggttccagtctttaatttcaaggaaaggagagtttgaagttggcattctgttaacaaaatcaggcagtctcattccgaataggttctatgtacacgttccgatgttttgtagaacactcgtgcctgttgaaacgta

SEQ ID NO: 5429 - DNA, 267 bp, Mus musculus
tgcacagtgcagacgtagagggatttaaagacccagctctctacacttcctggttggagcctgttgatgctttcagtgtatggaaaacccagcgagcctttgacaagtatgagaagtctgcagccctggtcagcaacagccagctcttagtaaagccactggatatgattgtgggcaaggcgtggaatatgttctcatccaaagcctttatccatcagtacacaaaatttggaatggaggaggaagactttttggacagctttgcat

SEQ ID NO: 5430 - DNA, 278 bp, Mus musculus
gatgatgtctgaagctgcactcaatggcaacggggaagacctgaacagttatgacagtgatgaccaggaaaagcagtccaagaagaaaccccgcctcttctgtgacatctgtgactgctttgacctccacgatacagaggactgtcccacccaggcacagatgtcggaagatcctccccattccactcaccatggcagccggagcgaggagcggccatactgtgagatctgtgagatgtttgggcactgggcaaccaactgcaatgacgacgagacct

SEQ ID NO: 5431 - DNA, 577 bp, Mus musculus
ccttacagctgggtacgctttgagtggaagccagcctccagcctgcaccgctggctggccgtgtgtggcatcatcctggtgttcctgctggcagagctgaacaccttctacctgaagtttgtgctatggatgccccctgaacactacttggtccttctgaggctggtcttcttcgtgaacgtgggtggtgtggccatgcgtgagatctacgacttcatggatgaattgaagccccacaggaagctgggccagcaggcctggctggtggcagccatcacagtcacagagcttctcatcgtggtgaagtatgacccgcacacactcaccctgtcactgcccttctacatctcccagtgctggactcttggctccatcctggtgcttacatggactgtctggcgcttcttcctgcgggacatcaccatgaggtacaaggagacccggcgacagaagcagcagagtcaccaggccagagccgtcaacaaccgggatgggcaccctgggccagatgatgacctgctagggactggaactgcagaagaagaggggaccaccaatgacggtgtgactgctgagg

SEQ ID NO: 5432 - DNA, 225 bp, Mus musculus
caggaacacgaagatctccttcaaattgggggaagagtttgaagagaccactgcagacaaccggaaagtgaagagccttataacttttgaaggtgggtcaatgatccagatccaaagatggcttggcaaacagacaacaattaaaagaagaattgtggatggaagaatggtagtggagtgcaccatgaacaatgttgtcagcactaggacctacgaaagggtgta

SEQ ID NO: 5433 - DNA, 410 bp, Mus musculus
  misc_feature (295)..(295): n is a, c, g, or t
atggccaagcaaccttctgatgtaagttctgagtgtgacagagaaggtggacaattgcagcctgctgagaggcctccccagctcaggcctggggcccctacctccctacagacagaaccgcaagacaggagcccggcacccatgagttgtgacaagtcaacacaaaccccaagtcctccttgccaggccttcaaccactatctcagtgcaatggcttccatacgacagtctcaggaggaacctgaagatctgcgcccggagatacggattgcacaggagctgcggcggatcggangacgagttcaacgaaacttacacaaggagggtgtttgcaaatgattaccgcgaggctgaagaccaccctcaaatggttatcttacaactgttacgctttatcttccgtctggtat

SEQ ID NO: 5434 - DNA, 449 bp, Mus musculus
  misc_feature (363)..(363): n is a, c, g, or t
  misc_feature (372)..(372): n is a, c, g, or t
ggctcttcctagtttcaatggtttctgaagcataggcaggggtaccctgctactgaaacagcaagtcactctcagtgcaggacactgaggccttgctcttgcctgtggctggtcacaaaccctgattgaggcagtacctgagccgccacagcactctgacctgaggtcactgccaacccctgctagacaacaccagtgggcttcacttactgctatatcctcttttagacaggtttctcatgctcccatactttcaaaaagcccagaggctgactcccagcaacagtgactaaccgttcctgccaacagggccagagcctcaaagtccctggtacaagcagccttcacagaggacccagactntcctaggtnccttgaggccacgccagtgcccatgggcttccattcctctgttactcttttcaaacagctcttcatgtgaggctcct

SEQ ID NO: 5435 - DNA, 450 bp, Mus musculus
gattatcttccacttacagctttagtagatggacagatattctgcctccacggtggcctgtctccatccatagatacactggaccacataagagccctggatcgcttgcaagaagttccacatgagggcccaatgtgtgatctcttatggtcagatccggatgaccgtggcggctggggcatttctccacgtggtgctggctacacatttggacaagacatttctgaaacatttaaccatgccaacggtctcacactggtgtctcgtgctcaccagcttgtaatggaaggatataactggtgccatgatcggaatgtggtcaccatttttagtgcgcccaattactgctaccgttgtgggaaccaggctgctatcatggaattagatgacactttaaaatattcatttcttcagtttgacccagcacctcgtcgtggagagcctcatgtg

SEQ ID NO: 5436 - DNA, 435 bp, Mus musculus
  misc_feature (54)..(56): n is a, c, g, or t
  misc_feature (104)..(104): n is a, c, g, or t
  misc_feature (205)..(205): n is a, c, g, or t
  misc_feature (209)..(209): n is a, c, g, or t
  misc_feature (229)..(229): n is a, c, g, or t
  misc_feature (235)..(235): n is a, c, g, or t
  misc_feature (240)..(240): n is a, c, g, or t
  misc_feature (242)..(242): n is a, c, g, or t
  misc_feature (248)..(248): n is a, c, g, or t
  misc_feature (255)..(255): n is a, c, g, or t
  misc_feature (261)..(261): n is a, c, g, or t
  misc_feature (273)..(273): n is a, c, g, or t
  misc_feature (287)..(287): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (330)..(330): n is a, c, g, or t
  misc_feature (332)..(332): n is a, c, g, or t
  misc_feature (369)..(369): n is a, c, g, or t
  misc_feature (377)..(377): n is a, c, g, or t
  misc_feature (388)..(388): n is a, c, g, or t
ctcccggaacgctgccgacaaggagcgggcggcgggaggcggcggcggcagcgnnngaggacgaggcgcagagccgccgcgacgagcaggacgacgacgacaangggcgactccaaggaaacgcggctgaccctgatggaggaggtgctcctgctgggcctcaaggaccgagagggttacacatcattttggaatgactgtatantcantctggattacgtggctgtantgttanttgananttagcntttgagnaggaanggttacagttangaggcttgtggaantgangnanagaaaaagtcttttaaccagaaaggtgatctgtanantcggatgctccaacaggggatgttcttcttgatgaangctctaanagcatgttaanggagactcagcctccagagacagtccagaactggattgagttactta

SEQ ID NO: 5437 - DNA, 390 bp, Mus musculus
agaacttcctcctgtttgacatgacgacacatcctctcaccaataacaacattaagcagcgtctcatcaagaaggtacaagaagctgttcttgacaaatgggtaaatgaccctcaccgaatggacaagcgcttgctggccctcatttacctagcccatgcctcggatgttttggaaaatgcgtttgctcctcttctggacgagcagtatgatctagccaccaagagagtacggcagctccttgacttagacccagaagtggagtgtctgaaggccaacaccaacgaagttctctgggctgtggtagctgcgtttaccaagtaactgtcagaattcaatgtttcctttttctcatgtgaaccagtagtttttcttctattgactctggttt

SEQ ID NO: 5438 - DNA, 538 bp, Mus musculus
  misc_feature (112)..(112): n is a, c, g, or t
gaacacaaccatagcctgctttgtagccatactgatcggcctgtgccttacattactcctgctcgccattttcaagaaagcgttgccagccctccccatctccatcaccttncgggctcgtgttctacttcgccacggattaccttgtgcagcccttcatggaccaacttgcattccatcagttttatatctagcctttctgcagttagaacatggatgtttcttctttgattatcaaaaacacaaaaacagagagcaagcccgaggaggagactggtgactttcctgtgtcctcagctaacaaaggcaggactccagctggacttctgcagcttccttccgagtctccctagccacccgcactactggactgtggaaggaagcgtctacagaggaacggtttccaacatccatcgctgcagcagacggtgtccctcagtgacttgagagacaaggacaaggaaatgtgctgggccaaggagctgccgtgctctgctagctttgacccgtgggcatggagatttacccgcactgtgaa

SEQ ID NO: 5439 - DNA, 470 bp, Mus musculus
cctttgctgcccacttgtaagtttaaataaggacaccgccctacacaaacctcacccctgtcacatcagtgactctgaccacttttgttctcaaactctctcactattatctgtggttgccgtttcttcccaaggccagcctggacgaatttggggttgctctatcctgagagttgtaacctcaacttccaaagtttatattttcttgaaatgatggatctattgctcaacagtccctgtcatccttaagtgacttctgggtttcccacaaattcctcacttttagacacactctaagcttacttctggcctggatgcttcctctccctgtctctcccttgccccacagcggttccctgacagcagacaaggcagctctgggaggtagctagtatccaataacccaggggtttcctcatgtgatgcaaatactacgtgtccaaccaatcagtgctgtcaacgggctgcca

SEQ ID NO: 5440 - DNA, 507 bp, Mus musculus
  misc_feature (231)..(231): n is a, c, g, or t
  misc_feature (242)..(242): n is a, c, g, or t
  misc_feature (254)..(254): n is a, c, g, or t
  misc_feature (263)..(263): n is a, c, g, or t
  misc_feature (268)..(268): n is a, c, g, or t
  misc_feature (283)..(283): n is a, c, g, or t
  misc_feature (324)..(324): n is a, c, g, or t
  misc_feature (345)..(345): n is a, c, g, or t
  misc_feature (348)..(348): n is a, c, g, or t
  misc_feature (361)..(361): n is a, c, g, or t
  misc_feature (428)..(428): n is a, c, g, or t
tctccaacaagctcgcagcgtcgaagccaccctagccacagcgccccctctcggcctaggcttcccagccttcttaaccacagtaccccgcatcacttaaaaacagaagcattgcctctggtataccaatgagccaagtggagtttgaaatggcctgtgcttcactcaagcagctgaaggggcctgtgagtgatcaggagaaactgctggtgtacagcttttacaaacagnccacccagggngactgtaacatnccctgtccntcctnccacagatgtgagancaaaggccaaatatgaggcctggatggtaaacaaagggatntccaagatggatgccatgagnatntacattgctaaangtggaagagctgaagaaaaaggagccatgctaagagcattttggcagacacaaggaagtagcatggntccactggtaggggacgggtttaagattcctgatggctgaaacacactgaaagggtagcagcgttagcagaaacaccaa

SEQ ID NO: 5441 - DNA, 414 bp, Mus musculus
  misc_feature (104)..(104): n is a, c, g, or t
  misc_feature (106)..(106): n is a, c, g, or t
  misc_feature (159)..(159): n is a, c, g, or t
ggaagataggcagctcatctgtgtcctgtgtccagtcattggggctcaccggggccaccagctgtccacgctggacgaagccttcgaagaactgagaagcaaanantccggtggactgaaggcagcaatgatagagttggtggaaaggttaaagttcangagctcagaccctaaagtaactcgagaccagatgaagatatttatacagcaagaatttaagaaagttcagaaagttattgctgatgaggagcagaaggcccttcatttagtggatatccaagaagcaatggccacggctcatgtgactgagatattggcggacatccaatctcacatggataggttgatgactcagatggcccaggccaaggaacaacttgatacctctaatgaatcagctgagccaaaggcaga

SEQ ID NO: 5442 - DNA, 549 bp, Mus musculus
ccaggcctgatgcagctactataaaaaatgatatggacaagcagaaatccaccctgatagatgccctctgcaggaaaggatgtgccctggcagatcaccttcttcatacacagcctcacgacggggcagcagctggagatgctgaagcaaaggaagaagaaggagaaagtaccatggaatctctatcggaaacctattgggaaactacaaagtggacagatctttttgacactaaggttttgatatttgcatacaagcatgcattagtaaataagatgtatgggagaggccttaagtttgcaaccaaactcgtagaagaaaaaccaacaaaagaaaactggaaaaattgtattcaactcatgaaattacttggatggacccactgtgcatcttttactgaaaactggctccccatcatgtatcctcctgattattgtgtattctaaaataagaaccaaaactttacatttcaaaacagaaaattttatagtgaatggatatatgaagaattgtgtggcatttttagtctgactaatgcatgttttcatc

SEQ ID NO: 5443 - DNA, 311 bp, Mus musculus
caaccgacccagttggtgggttctgcccagagcgggctcctgcagcagcagcagcaggacttcgatcctgtgcagcgctacaagatgctcatcccgcaactgaaggagagtctccagactttgatgaaggttgcagcccagaatctgattcagaacactaacattgacaatggacagaagagcagtgacgcacccttgcagcgctttgacaagtgtttggaggagttttacgcactctgtgatcagctggaactctgcttgcgcctggcccacgagtgcctttcacagagctgtgacagcgccaaacactc

SEQ ID NO: 5444 - DNA, 516 bp, Mus musculus
  misc_feature (341)..(341): n is a, c, g, or t
  misc_feature (370)..(370): n is a, c, g, or t
tcagttatcccctgaggaccagttactgccttggagccaggctgaactcgatcccaaacaggtgtttaccaaggaggaagccaaacaatccgcagaaactatagctgccagccagaactcagacaagccctccagagacccagagactccccagtcctcaggttctaagcgcagcagacgaaaagcaaacagcaaggttctagggaggtcccctctcaccatcctgcaggatgacaactcccctgggaccttgacactacgacagggtaagcggccttctgccctcagtgagaacgttaaggacctaaaggaaggagtcgttcttggaactggaagatttntcaaagctggaggaggagcacgggagccnaaaccaggaccacgacaaggaaaatcagcattttgccttgttggagagctagggctgtgctggagtcatccccaagggcaccaaagaaagccctgttctgattcctctcaggcaccaactctggtacttggacatcgttcttttaa

SEQ ID NO: 5445 - DNA, 489 bp, Mus musculus
  misc_feature (258)..(258): n is a, c, g, or t
  misc_feature (260)..(260): n is a, c, g, or t
  misc_feature (458)..(458): n is a, c, g, or t
caggatttctcaaccctttatggaagcagccctttagaaaggcagaactcctcttccggatcaccccggatggaaatgtgctcggggagcaacaaggccaagaagaagaagtcgtcaagagtcccacctgacaaacccaagcaccagactgaagacgatttccagagggagctcttttccatggatgtcgactcacagaaccctatgtttgacgtcagcatgaccgctgacgcgctggatacacctcatatcaccccngnctccaagccagtgtagcactcccccagcaacgtacccacagccagtgtctcacccccagcccagtattcagaggatggtccgactgtccagttcagacagcattggcccagatgtaactgatattctttcagatattgccgaagaagcttcaaagcttcccagcacgagtgatgactgcccaccaattggcacccctnttcgagattcctcaagttctgggcattctca

SEQ ID NO: 5446 - DNA, 363 bp, Mus musculus
  misc_feature (146)..(146): n is a, c, g, or t
aagaagcagcaggacccctacttgctacggacaggccgctttgaagaggcgagcaccatgccttgccgcctggcactctcccctgatacccatgtcctggccttggccactggcaccaatattcatctcttcaacacacgccgcgnggagaaggaggagtactttgagtgtgtccatggggagtgtattgctgacttgacttttgacatcactggccgcttcctggcctcctgtggggaccgtgcagtgcggctcttccacaatacccctggccaccgggctgtggtggaggagatgcagagcctcctgaagcgggcatccagcgaaagtacccgccagaggctgcagcaacagctaacccag

SEQ ID NO: 5447 - DNA, 528 bp, Mus musculus
  misc_feature (116)..(116): n is a, c, g, or t
tggttttgaagcatccctatccaagggaagtggaagaaccttgcatttacgaatcagtccgggttcacacagcgatgcagacaggaaggacagagaacgacctcgtgcccactgcnccttctctgggcaccaaagaaggctatctcaccaagcagggaggcctggtaaagacctggaaaacaagatggtttactttgcaaaggaacgaactgaaatatttcaaagaccagatgtcaccagaaccaattcggatcctagacctaacagagtgctcagctgttcaatttgattactcacaggaacgagtaaactgtttctgcctagtgtttccattcaggacattttatctctgtgcaaagacgggagttgaagccgatgaatggatcaaaatactgagatggaagttgtcaaaaataagaaaacagctggatcaaggagaagataccgtccgatctaggtcatttatcttcaaatagacttgtgtgctcaggggcacggttgactgttccaggtgtctgatctgtggca

SEQ ID NO: 5448 - DNA, 304 bp, Mus musculus
ttccgaagctataagctgctgttgaagaaatctgggtgcagaacaccgcgaatcgagctagaagagatgggaccatcactggacctggtcatgaggaggacacacctagcatcagatgacctttataaactgtccatgaaagtgcccaaggctctcaagccaaagaagagaaagaatatctctcaggatacttttggcacaacatttggaaggattcatatgcaaaagcaagacttaagcaaactacaaacgaggaaaatgaaggggttgaagaagcgacctgcagagaatggagtagacgacc

SEQ ID NO: 5449 - DNA, 500 bp, Mus musculus
  misc_feature (420)..(427): n is a, c, g, or t
  misc_feature (429)..(432): n is a, c, g, or t
  misc_feature (434)..(434): n is a, c, g, or t
gggtcctcaacaaaatcctgaaaggcaacattcgcctgggcaagctggaggagagggtaaaggggtacaagaagcaggcagcactgaagctgggggatatccatcaccgcctgaaggaacagcaggaggactttgccggcaaagcagctcagtaccagaaggaggtgaagcacctacatcggatgctgcaggaaaagcaggaggtcctggatgaggcgctgcagcagaaaagaaatatggaaggtgagcttgaaatggtcctggagtccactgccaaggagaacaggaggatgcggagccttctccaggccaccctggagagaagaagcacacagcacgtcacagctcctccggacacttgcttgagacgctcctctcagggagacctactgattggccatgatttcagctatggtgatnnnnnnnntnnnncnaccaccaaccgccagagtctgggggaatctatggcgtagatctcctgtctgaggtgtctacttcct

SEQ ID NO: 5450 - DNA, 571 bp, Mus musculus
  misc_feature (331)..(331): n is a, c, g, or t
  misc_feature (336)..(336): n is a, c, g, or t
  misc_feature (364)..(364): n is a, c, g, or t
  misc_feature (366)..(367): n is a, c, g, or t
  misc_feature (370)..(370): n is a, c, g, or t
  misc_feature (399)..(400): n is a, c, g, or t
  misc_feature (502)..(502): n is a, c, g, or t
  misc_feature (545)..(545): n is a, c, g, or t
gaactcagtcgctaccaaacaaaattcaggcctttgtctgaggaagagagttcccatatccaaggcctcccatccaagggccccacaccaccctggttggtggatataaagtatctctcaccactgttgctggcttatgaagacagaatgaaagagaaggacaaactcagcaccgccctggaggaggaaatgaaaacctttaggcttcgagttcaggaagtcgtgaaggaaaacgaagccttgcaccaagagttaactaagagaagccccgtcaccgtagaggaatggaggcagcttcagactcaagcagagctggttctagatgagaacnagctnctgatagagcagttggagattcagcaancnnaanccagggacacccaccaggcgcacctccannacgtttctaagctgactaaacaacttgtgctcctggaagcaaagactcagggccaggaaaagcagctcgtggaaagcacggagcagctggagagcttgcagngccaaatgcacagagctcaaggcacagctggatagcaagatcncagtggacgtccatacatcaattgtc

SEQ ID NO: 5451 - DNA, 507 bp, Mus musculus
  misc_feature (309)..(309): n is a, c, g, or t
  misc_feature (356)..(356): n is a, c, g, or t
gatgccatcgatgccctcatgaagaaggccttcagctgctcctctttcaattccaacaccttccttaccaggctgctcatccacatgggtctgctcaagagtgaagacaagatcaaggccatacccagcctgcatggccccctgatggtgttgaaccacgtggtgaggcaggactatttccccaaggcccttgcacccctgctcttggcatttgtgacaaagcccaatggcgcgctggaaacctgctcctttgcccgccacaatctgctgcagacgctatacaacatctagatttaaaggcagctgctncttgtccctcgccctgccccagtgactgagggtcttggatggactgnagctcggccagcatctccattggatattttgaccagaggaagggagagggtcttgtctcctgtgtcatattggtcctttgatactgtgttggtttggtgtgtgtgtgtgggtatgtacttcctgtctggattgcagatcttcatctccctg

SEQ ID NO: 5452 - DNA, 132 bp, Mus musculus
ccgggtatacttagtggaagaacatgggtctgtccacaaccttagccttcccgagagcaccttgctgcaggctgtcacaaacacccaggtcattgatggcttttttgtgaagcgaaccatggatattaagga

SEQ ID NO: 5453 - DNA, 113 bp, Mus musculus
acaccaaggaggctgcccataccttagaagcctgctctgcatccatcttccctccccagaactttgctttactgtttatgctcatgtaatcttgacagggaaattgtcatttt

SEQ ID NO: 5454 - DNA, 431 bp, Mus musculus
cccgagagttcattggaagtttcctggaaatgtttggtccagaaggagcactgaagcacatgctgaaggagggaaaaggtcggatgctgcaggccatcagtcccaagcagagccccagcagcagccctactcatgagcgctccccctccccctcctttcggtggcccttctctggcaagacttccccatcttcctccccagcaagtctttctaggtgcagggctgtgacctgtgacatcagcgaggatgaagaggactaacttttcatccctgttccctctctcccccactgcccatcacctccagaagctctctgtcgaattccattttgtgatcccaacactaaacctaaggacatctacaaagaaaagacaaccggggcaagaggacctgggaatggggaaccaaaacagcccatgccctgagacatt

SEQ ID NO: 5455 - DNA, 519 bp, Mus musculus
acaggcttcatctgctttgacgcagcaacaaaggctgtactttggaggtataaattttctcagcttaaaggctcatcagatgacggcaaaagcaaaatcaaatttctgtttcagaatccagatacgaaacagattgaagcaaaggagttggaattttcaaatttatttgctgttcttcactgtattcattcattttttgctgccaaagtagcttgtttggaccctctgtttttaggtaatcaggctgccactactgctgctgtcagctctgcttctacaagcaaggcaaagcacctggcttgacatgctgagctctgcctgacagccttcagggtcactcactccctacttccaccctgaagagaccatgctgtcaccaagtcaaccatggagtcagactgcaattccagcagcagaaaggtcaggaggcatctgtaaatgaccctgggatggcagagcaacctatttttttctccactgatctctaccaggatacagctgccatcatgtttggtgaca

SEQ ID NO: 5456 - DNA, 483 bp, Mus musculus
gagtgggctttacacaccagacacatctgctctgcccacataaccatctgctcatggccagtggacaggtttattcagtcccagagtcaaagcgtcaatgcctactgaaccaatgtacactgtggcacaatcaacctccaacagctgacccacactgggctacctcggggagcacatgagctggggcatctttgaggacaggaggctaaggctactttctagcaaccctgctgcactgaggtgcagggggtggctctaccctggagacgtagccagatccccaagctacaggagctggcccttggtcgtggctgctcggagcttctgtggcatggtctcctggctctttctgcagctccatgtggcccagggaatggcagtgggagaaggcaggagactggggggacttgggactgcagggactcagcattagccatcctgatgcagcctctgcagccagctctcgggaatatcctaccatca

SEQ ID NO: 5457 - DNA, 514 bp, Mus musculus
tcacacatatttgccatctccaagggcccctccacggcagccacggtgcctttcacagacatatgtaagccaatagcaacaacggacttagaaagccaaggtcaagactgcggtgcagcggcctcacgccccctcatccaggagctcaatgatgagccggcagaggaagcagcaaaccagccactgccgccccaaacctgtgcgagtgaccctgcacttgcccaccctagtgaagatggagacagcgacagccagctgcctgcagccactctgctaggagatggagcggaggatgaagcagagtcttcggtgcacccgaaggagcccagcacccgggtaggcctagaagatattgaatttggcttggactgaaccccaaggcagtctacattgttgggctagcggtggcgcagcagatgcagggcaccctctcccgtgcatcactgtgctcttgagcctgcaaggcaggtgcgtgaagctacaccaatgtgccttgtacccaacacgtcggtat

SEQ ID NO: 5458 - DNA, 538 bp, Mus musculus
  misc_feature (36)..(36): n is a, c, g, or t
gcagatcgacagctgtacctatgaagcgatgtatancatccagtcccaagcactgtctgtagcagaaaacagcgcctctggggaagggaatctggccacagctcacacgagtactggccctgaggaatccgaaaacgaggatgatggctatgatgtgcctaagccacccgtgccagctgtactggcccgccggaccctgtctgacatctccaatgccagctcctcctttggctggttgtctttggatggtgaccctacaaacttcaatgagggttcccaagttcctgagcggccccccaaaccattccctcggagaatcaactcagaacgaaaagccagtagctatcaacaaggcggaggtgccactgctaaccctgtggccacagcaccctcaccgcagctctcaagtgagattgaacgcctcatgagtcagggctattcctaccaggacattcagaaagctttggtcattgcccacaacaacattgagatggctaaaaacatcctccgggaatttgtttctatttcttctcctgct

SEQ ID NO: 5459 - DNA, 535 bp, Mus musculus
agatacacgatctccagtacaaaatattctgggaaaatttgaaggtgacattaacaagaggcttcacataaagagaaaacgcatggaaacttatatcaaagattctttcaaagacagcaacgtgaaattagaacaactttggaaaacgaacaaacaagagagaaagaagattaacaacaaattttgtgagcagtatataactacatttcagaagtttgatatggatgtccagaaattcaatgaagaacaagaaaaatcagtgaacaattatcaaaaagaacaacaagcattaaaactgtccaaatgtagtcagagccagaccctggaagcaattaaagacatgcatgaaaactacatggagggtctgatgaacttggagaccaacaactacaatatgctttttgatgtagatggtgaactgagaaaagaaatgtcagtgtttaaaaaagacctcatgaagcatactctgaagtactcttctagtttcccatcttcagactaaggaagcatgcatattttgcacttgctggtacat

SEQ ID NO: 5460 - DNA, 540 bp, Mus musculus
  misc_feature (348)..(348): n is a, c, g, or t
  misc_feature (356)..(356): n is a, c, g, or t
  misc_feature (363)..(363): n is a, c, g, or t
  misc_feature (381)..(381): n is a, c, g, or t
  misc_feature (450)..(450): n is a, c, g, or t
gcaagcagatactggtgccttttcccccacagactgctgcttcccctgatgagcagaaggtatttgccctctgggagtctggagacatgagtgaccagcatcggcaggttttgcttgaaatattttccaaaaattaccgagtacgtcggaacttgatccagtctcggctgactcaagaatgtggagaagagctaagcaaacaggaggtggataaagtgctaaaggactgttgtgtaagctgtggtggcatgtggtaccttaaggggacagtacaatcctgacaataggagcaaactgctaactcgacgaatccaagcccagggaaggatggcagagccacacgtagtnttgacttncctcaanacacaggaagaggatctncctacctggtggcctgtggcgctgcctggcccagaggacagaggggctcatgctcagccagtggcaggntcagcgtaagtgagagcgctcccagcagagaccagcgggccttctttgcagtacaatttgaaattcctgatgtattttgcttattgggtt

SEQ ID NO: 5461 - DNA, 577 bp, Mus musculus
  misc_feature (94)..(94): n is a, c, g, or t
  misc_feature (175)..(181): n is a, c, g, or t
  misc_feature (183)..(187): n is a, c, g, or t
  misc_feature (217)..(217): n is a, c, g, or t
  misc_feature (359)..(359): n is a, c, g, or t
  misc_feature (361)..(361): n is a, c, g, or t
  misc_feature (375)..(375): n is a, c, g, or t
  misc_feature (389)..(389): n is a, c, g, or t
  misc_feature (394)..(394): n is a, c, g, or t
  misc_feature (424)..(424): n is a, c, g, or t
  misc_feature (444)..(444): n is a, c, g, or t
gagtgaaagcctagtgcctgtcaaggcagggacatctagagaacaagatgacttactctcactaagcccagagtcaggacaggagccgcccaangtcacctttgttggaggacgaaagcctcaagccttacctgcagaaacaggcagactctgtagcaagctggatggctttgannnnnnngnnnnnggcagagttggagcagagaaggcaaaaggncacttttggagctgacagaacaccccaacatgagcttggagatccactacaaggctgagctggaggaagaacgccgggcgcgtagacggatgcgcttggctctcctcaaatctaattccactgggatctgtgccctgccccntnaccgaaacaacctntccctggacaacgnccttntcgatgaggacaaacagaaccagatgattngtgacctccagcagcagatnttagagcaaaacaagttacaccaggagtttttggaaaaagccaggaaacgcttgcaagagtttcaaaaatcattttaaaagcagacccacccatgataaatacatccctgatggctgctttgcctgcaccgtg

SEQ ID NO: 5462 - DNA, 432 bp, Mus musculus
aaaccaaagccttctgaccaagctttctcttgaggaagaaaatcatctcattcagttaaagtgtgagaaccttaaagagaaactagagcagatggatgcagagaataaagagcttgagaagaagctggccgaccaagaggagtgtctcaagcacagtgacctggagctgaaagagaaggctgcagagtacacagccctgtccaggcaactggaagccgctttggaagaaggaagacaaaaggtttcagaagaagtagagaaaatgtcatctagagagagggctttacaaattaaaatattagatctggaagctgagcttagaaagaaaaatgaagaacaaaaccaacttgttgacaagatgaacactaaaacccagcaccaggctatctgcttgaaggaaatacagcacagccttgagaagtcggagactcg

SEQ ID NO: 5463 - DNA, 504 bp, Mus musculus
aagctgcagcgctgcaaggagaagtgtgcagagcaggcgctcaccattagggagcttcaaggccaggttgatggaaaccaaagccttctgaccaagctttctcttgaggaagaaaatcatctcattcagttaaagtgtgagaaccttaaagagaaactagagcagatggatgcagagaataaagagcttgagaagaagctggccgaccaagaggagtgtctcaagcacagtgacctggagctgaaagagaaggctgcagagtacacagccctgtccaggcaactggaagccgctttggaagaaggaagacaaaaggtttcagaagaagtagagaaaatgtcatctagagagagggctttacaaattaaaatattagatctggaagctgagcttagaaagaaaaatgaagaacaaaaccaacttgttgacaagatgaacactaaaacccagcaccaggctatctgcttgaaggaaatacagcacagccttgagaagtcggagact

SEQ ID NO: 5464 - DNA, 469 bp, Mus musculus
cagtgagctttccactccagagaaacccccgagccagaggttcagcagccggtgggaacctgccctgggcgagccctccagcagcatccccaccactgttggctcacttcccagttccaaaagcttcctgggcatgaaggcccgggagctgttccgtaataagagcgagagccagtgtgatgaggacagcgtgaccatgagtagcagcagcctttctgagaccctgaagacagaactgggcaaggactcgggcacagaaaacaagacttccctgagtctagatgccccacacccatcttccccaaactcagacaatgtggggcagctccacatcatggactacaatgagactcatcctgaacacagctgaagagggtctgtcagtgttcatttgcgtctttgtcggcacagaacagaaggtgtgaatgcacggtctaggcttctgtttccagggtctgagcagctgctt

SEQ ID NO: 5465 - DNA, 162 bp, Mus musculus
  misc_feature (116)..(118): n is a, c, g, or t
gagacagagggcttactggacaaactggtccacctggtgctccaggaataagaggtattccaggtgttaaaggtgatcggggacaaattggcttccctggaggtcgaggaaacccnnnagcaccaggaaagccagggaggtcgggatctcctggacctaaag

SEQ ID NO: 5466 - DNA, 519 bp, Mus musculus
  misc_feature (319)..(319): n is a, c, g, or t
  misc_feature (399)..(399): n is a, c, g, or t
  misc_feature (468)..(468): n is a, c, g, or t
aatagatggtatacagcagttctgtgatgatctggccctcgatccagccagcatcagtgtgttgatcattgcatggaagttcagggcggccacacagtgcgagttctccaaacaggagttcatggatggcatgacagagttaggatgtgacagcatagaaaaactaaaggcccaaatacccaagatggaacaagaattgaaagaaccaggacgatttaaggatttttaccagtttacttttaattttgcaaagaatccaggacaaaaaggattagatctagaaatggccattgcttactggaacttagtgcttaatggnaagatttaaattcttagacttatggaataaatttttgttggagcatcataaacgatcaataccaaaagacacgtggaatnttctgttagacttcagttcaatgattgcagatgacatgtccaattatgatgaagaaggagcatggcctntccttattgatgactttgtggaatttgcacgccctcaaattgctgggacaa

SEQ ID NO: 5467 - DNA, 536 bp, Mus musculus
  misc_feature (38)..(38): n is a, c, g, or t
  misc_feature (167)..(167): n is a, c, g, or t
taaacgccttggtggagggccagatgatgcaaaagaanatcatgaggcatagttttttttctggagtaaactggcaagatgtatatgacaaaaagcttgtacctccttttaagcctcaagtaacatctgaaacagacacccgatattttgatgaagaatttacagcntcagactattacaataacaccacctgaaaagtatgacgacgacggcatggacggcatggacaacgagcggcggccacacttccctcagttctcctactctgcaagcggacgggaataagttcctttcagtctgtttctacactgtcatcttagactttgcctgagactgattcctggacatctctaccagtcctcgctcttacagttagcaggggcaccttctgacatccctgaccagccaagggtcttcaccctcaccacctttcactcacatgaaaccatatacacagacactccagttttgtttttgcatgaaattgtatctcagtctaaggtctcatgctgttgctgctactgtcttactattat

SEQ ID NO: 5468 - DNA, 59 bp, Mus musculus
aagtggaaacaattactctgaatgtggatgctgtagacacacatcgtgacaagccaact

SEQ ID NO: 5469 - DNA, 403 bp, Mus musculus
ttctgtattctgatgctgtatgcccagcccaaggccacgtattatttacagctagaagatgatatcgtagcaaaaaagatgtattttacaaaaatgaaagattttgtaaatagtctcacttcaaaaaattggttttttattgagttttcagtccttggatttatagggaaactctttcgatcgaaggacctcactgactttgtgcattttttcctgatgttctatgagacaaagcccatagatatacttttagatgacattttcctgatccgggtgtgcatctcaggggagcctgttaggagctgtttgcagcgaaagaagggatttcgaattcagtacagaccatctctgttccagcatgtgggcactcagtcatcatttccaggacgagaacagcacctca

SEQ ID NO: 5470 - DNA, 476 bp, Mus musculus
  misc_feature (198)..(198): n is a, c, g, or t
  misc_feature (201)..(201): n is a, c, g, or t
  misc_feature (203)..(203): n is a, c, g, or t
  misc_feature (205)..(205): n is a, c, g, or t
  misc_feature (207)..(208): n is a, c, g, or t
  misc_feature (215)..(215): n is a, c, g, or t
  misc_feature (217)..(219): n is a, c, g, or t
  misc_feature (230)..(230): n is a, c, g, or t
  misc_feature (236)..(237): n is a, c, g, or t
  misc_feature (241)..(241): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (254)..(254): n is a, c, g, or t
  misc_feature (256)..(256): n is a, c, g, or t
  misc_feature (263)..(263): n is a, c, g, or t
  misc_feature (265)..(268): n is a, c, g, or t
  misc_feature (271)..(271): n is a, c, g, or t
  misc_feature (275)..(275): n is a, c, g, or t
  misc_feature (281)..(281): n is a, c, g, or t
  misc_feature (315)..(315): n is a, c, g, or t
  misc_feature (317)..(317): n is a, c, g, or t
  misc_feature (342)..(342): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (398)..(398): n is a, c, g, or t
  misc_feature (410)..(410): n is a, c, g, or t
gacttagacagaaaggccatcccacagaaaacactaaagctcagaagcattctagtatcttgagcaggctgtatggtaactagtatgtgtgttataattccttttgaaaagacatccaaagaaataggaagcagagacttggttcagcccaaggctggttgcatcgcccgcctttttgtcttttaacgaacacgtttnagntntnannccaccantnnnctctatgtgantccatnntcanacactntngngangnacatatntnnnntantcantcattnttaaacacatcacagatggacctatggatagttntncagtgtttattttgggaacacgttntctttctgtnttnttntcactgatttccgactgcattgctgttgagataagttttntatgtaatagtntcagaggactcctgtaaactcatgtggaatgcatgaccgacccctgggcacactttttcaatggtt

SEQ ID NO: 5471 - DNA, 486 bp, Mus musculus
acttgttctggtacctattcatcggaaggtacattggagcctggtggtgatggacctaagaaaaaagtgtcttaaatatctggattctatgggacaaaaaggccacaggatctgtgagattcttcttcagtatttacaggatgaaagcaagaccaaaagaaatacagatctcaacctcttagagtggacccactacagcatgaagccacatgagattcctcagcagttgaatgggagtgactgtggaatgtttacttgtaaatatgcagattatatttctagggacaaacctatcacattcactcagcaccagatgcctctcttccggaagaagatggtgtgggagatccttcaccagcagttgctgtgacaatgccccgcctggtcttctagctgctggtggttctttgatggatgtttccatatacctcatgcattgtgggttaaaaagtccccgatcatttctcttctctcacaggtactgag

SEQ ID NO: 5472 - DNA, 368 bp, Mus musculus
  misc_feature (129)..(129): n is a, c, g, or t
  misc_feature (152)..(152): n is a, c, g, or t
  misc_feature (160)..(161): n is a, c, g, or t
  misc_feature (203)..(203): n is a, c, g, or t
  misc_feature (208)..(208): n is a, c, g, or t
  misc_feature (210)..(211): n is a, c, g, or t
  misc_feature (213)..(213): n is a, c, g, or t
  misc_feature (215)..(215): n is a, c, g, or t
  misc_feature (217)..(219): n is a, c, g, or t
  misc_feature (221)..(222): n is a, c, g, or t
  misc_feature (230)..(230): n is a, c, g, or t
ctggacctcagggtgagcagctagtggtgccagagagactgctggtggttctggacatggaggaggggactcttggctactctattgggggcacgtacctgggaccagccttccgtggactgaaggggnaggaccctctatccctctgtaangtgctgtnnggggccagtgccaggtccgcatccgctacatgggcgaaagangagtngnngnancnnnannccttctgnacctgagccgcctgtgtgtgcgccatgctctgggggacacccggctgggtcaaatatccactctgcctttgccccctgccatgaagcgctatctgctctacaaatgacccagtagtacagggtgtgctggcaccctac

SEQ ID NO: 5473 - DNA, 507 bp, Mus musculus
aggacttcaaggtgacgctgcagcagcagaactcactggagcaatgggcagcctggctggacggcgttgtgagccaggtgctcaagccctaccagggcagttccggcttccccaaggcggccaagctcttcctcctcaagtggtccttctacagctccatggtaatccgggacctgaccctgcgcagtgctgccagcttcggctccttccacctcatccggctgctctatgacgagtacatgtactacctgatcgagcacagagtggcccaggccaagggcgagaccccaatcgcagtcatgggagagtttgcaaacctggccacctcactgaatcccttggaccctgacaaagatgaagaagaagaggaggaagaggagagtgaggatgagctgccacaagacatctcgctggcggctggcagcgagtctcccgcactaggccctgaagctctggagccaccagcgaaactggcgcggactgacactcgtggcctctttgtgcagg

SEQ ID NO: 5474 - DNA, 570 bp, Mus musculus
gaacttctgcggcatttttggtcttgctttcctgttaatacaccattcctagaagaaaaggtagtgaaaatgaagagtaatttggaacggttccaagttacaaagctctgcccattccaagaaaagattcggaggcagtatttaagcacaaatctggtaagtcacatagaagagatgctgcagacagcctacaacaagctccacgcgtggcaatcccggcgcctgatgaagaagacgtgaagcgtttatggtgctcacaggttttgtgggttgaaaaaaaacttacctgcagtcactctggaaacctggctgaagacaagcagatgctcacaccgggggaaacatctgcagcacgcccgccgactcccagagctgatgctgttgtacttgcacatgaaaactgaaacagaaggaagggacgggattcacctaactctggggagggaaaccaaggcagaaccaaaatgagctaagttgcaaatatatatgtatgtgtacatgtatatgtatttaaagactgtttactgcagttactcaggaactgcttttcattcacgttaagctgctttc

SEQ ID NO: 5475 - DNA, 354 bp, Mus musculus
gagccggatcctaaagagtcagacaaagctgaggagcctggactgccgaagaagccccccagagagcagaggattatcaaggaaatgcaatttataactatggatgaattcagtgacgttcctgcgtacatgaaatcccgtttaacatattgtcaaattaatgatattattaaggaaattaacaaggcagtagttagcaaatataagattatgcatcaaccaaaagcatctatgagctctgtgaagagaaatctctaccagagatttattaatgaagaaacgaaggacacgaaaggtcatcacttcatcgtggaagctgacataaaggaattcacggctttgaaagttgacaag

SEQ ID NO: 5476 - DNA, 532 bp, Mus musculus
  misc_feature (184)..(184): n is a, c, g, or t
  misc_feature (187)..(187): n is a, c, g, or t
  misc_feature (189)..(189): n is a, c, g, or t
  misc_feature (193)..(193): n is a, c, g, or t
  misc_feature (212)..(212): n is a, c, g, or t
  misc_feature (248)..(248): n is a, c, g, or t
  misc_feature (255)..(255): n is a, c, g, or t
  misc_feature (267)..(267): n is a, c, g, or t
  misc_feature (311)..(311): n is a, c, g, or t
  misc_feature (481)..(483): n is a, c, g, or t
  misc_feature (485)..(495): n is a, c, g, or t
ccctcatctctctacacaggataatggcagctagactagcaggaagcgtcccggctctggctggacctaagatgccccgtcgaggaggctgatgctctctgctcaagcccagagcccgtgttcttgctgtggcaagcgcctccatcctcagggggaggagaccagagattgcccagccactgcnccnangcancctctaggaggtgaacttngacctggggtctgtgtgagacagacagtaggcactntgaaatnctgaaggaggtnggaagagatgtgcaaatgagggtacagaaacctcctccctgctnagcggactacacaccaggtccccaagagaggcctggctggtaacacaagcctttcttgccatcttaggccaaagagtgcaggagttctgcctctgcagaaggttggttgtgtctgttctgtggctgggaagaaagtgccccttcagggttaaaagcgttctgtcctcaannnannnnnnnnnnnggccttgttccctgtcctctcagcgagatttacctgg

SEQ ID NO: 5477 - DNA, 510 bp, Mus musculus
gggacagttgcagctatctatgacgtgaccctgaacttcagagggaacaagaacccatctctactggggatcctgtatgggaagaaatatgaggcagacatgtgtgtgaggaggttccccctggaagacatcccagcagatgagaccagcgccgcccagtggcttcacaagctgtaccaggagaaggatgccctgcaagagatgtacaagcagaagggtgtattcccaggggagcagttcaagcctgcccgaaggccgtggaccctcctgaacttcctgtgctgggccaccatcctcctctcacccctcttcagcttcgtcctgggtgtctttgccagtggatccccgctcctcatcctgacgttcttggggttcgtgggagcagcttccttcggagtccggagactgataggagtgactgagatagagaaaggctccagctatggcaaccaagagcttaagaaaaaggaataattaatgctgtgattgaacacccataacctgatgcgg

SEQ ID NO: 5478 - DNA, 432 bp, Mus musculus
gagaccgaggtctacatctatgagcaccgagaggagttccagaagcttgtccagctgctgctgtctccctgagctcccggggcctgccagcacactgagggccaagctgggcctggcagctccatgtccatctgacactaggactcagagcacaaaccggttcccacgaggcacctctcctggtccatctgcactttactactcgaggctgaaagcccagagttcccctcagcccctttccctgactatgaaggacaactgactccatcaaggaccccacatatcagagatcaacactacggtgccagtggtcccaggctccctggccactgctgctcaccccttctgcccaccccctgatgtcagggactagagaaaaggggttccaccctatcctagtggaatccaggctaatggcatccagcgccattc

SEQ ID NO: 5479 - DNA, 423 bp, Mus musculus
agctgctctacagtgtaccggacagcggcggcagccgggactcgcagccagctgcaggactggagacccgttccgatggaaagccgcggcgatgcgctagctctcgccggacggagtgctgagcagatgccggctccgagtcagcaaacggacacttggaatgggctggccgaggaacggtatggcgactgtcccgaggcatcctggccctaattcacattgtccttttctcgggagggatcttgcaggaacccagacatcaggggccccttccaagggacagtacagagtgctgcgggccttgggacaactcatcttgggcctcttttccgaagagggcttctctcttggcggccttggttctcttggcttgacaagacttttttttttttttctgtgataaatctacttctttgcatatgg

SEQ ID NO: 5480 - DNA, 364 bp, Mus musculus
  misc_feature (183)..(183): n is a, c, g, or t
gctgagttccgaataaagtatgttggtgccatcgagaaactggccgtgtctgaggggaagagccttgaaggaccactagacctgataaattacatagatgtcgcccagcaagatggaaagttgccttttgtgcctttggaagaggagttcattctgggcgtttctaagtacggcataaaagtntcgaccacggatcagcatggtgttctgcataggcatgccctgtatctaatcatccggatggtgtgttacgatgatggcctgggagctgggaaaagcttgctggcactcaagaccacagatgcaagcaacgaagagtacagcctgtgggtttaccagtgtaacagcctggagcaagcccaag

SEQ ID NO: 5481 - DNA, 479 bp, Mus musculus
tacgagtgcctcacgtgcggcgagagcttcagctggagctccaacctcatcaagcaccagcggacgcacaccggcgagaagccctacagatgcggcgactgtgggaagggcttcagccagcgctcgcagctcgtggtgcaccagcggacgcacaccggcgagaagccctacaagtgcctcatgtgtggcaagagcttcagccggggctccattctggtgatgcaccagcgagcgcacttgggagacaagccttacaggtgcccggagtgcgggaagggcttcagctggaactccgttctcatcatccaccagcgcatccacacgggagagaagccctacagatgcccggagtgcggcaaaggcttcagcaacagctccaacttcatcacacaccagaggacgcacctgaaagagaagctttactgaagtggcagaaaagagaaggaagtgctgagctgactctgcagggagaactccca

SEQ ID NO: 5482 - DNA, 553 bp, Mus musculus
  misc_feature (300)..(300): n is a, c, g, or t
  misc_feature (306)..(306): n is a, c, g, or t
  misc_feature (317)..(317): n is a, c, g, or t
  misc_feature (325)..(326): n is a, c, g, or t
  misc_feature (328)..(328): n is a, c, g, or t
  misc_feature (347)..(348): n is a, c, g, or t
  misc_feature (355)..(355): n is a, c, g, or t
  misc_feature (367)..(367): n is a, c, g, or t
  misc_feature (396)..(396): n is a, c, g, or t
  misc_feature (411)..(411): n is a, c, g, or t
  misc_feature (419)..(419): n is a, c, g, or t
agccctattaccctagaacttcaggtggggaaaaaaaccagcaaaacaaaacagccgtaagtttaaaactgctgtttcgctcatgacatcagtaatgaggacttccttagactggatctcagatgaaagaacaatgcttgttgccctctgaatatattaaaacgtttattttgagaaaggagacgcgtttgatgggaggcaaatacatgttaagactgatgagtgaagagttagccactgtggaaaccaacccgggagagccatggggccggccctccctggagggatgcccctctggancagagncagtgaggatnatgtgtgnngnaagcctcctttgacctctnnggaatcntgatattcgacntcagttgagcctctgatacatatactatntctgagaacaaatancaggtttnatccatctaaggaaaagtcttgctaacttatgaactggactgcatggttttcttataaaccttagctaaaatgagcccgagcacacccttagtttgacacacttggtactgactcttttaattcagcccaaatt

SEQ ID NO: 5483 - DNA, 514 bp, Mus musculus
ggagggtctgcgtgacaattactttcaggctctatcttaaaataactcgatgaaagcgcttgcctaagcgcaggataccctatctacactccccaatacctaaagttaaaaaaaaaaaaaaatagcactgcctgaagcacacccagctttgcaaggattttggagctggacacagtcctccaggcctggcctaagctccagcatcctttgctgggattgggatcctcgaattgtcagactagatcacaggtcaaccatccatcaaacagaggacacgcagaatcttagcattgaatgtcttgtaggagacactgaggaaaaactggaaggttgggtccatcctgggttaaataaattacatcaaattatattatataatactatgtatactaatatctttgaagatagccttaattctcctgcctgggagtgggcactcaagtgctgggcttatagatgaatttcatgacacacagatgtagcaacagtatctcttgatacaatactctctggg

SEQ ID NO: 5484 - DNA, 527 bp, Mus musculus
gaatcggaacaaactgcgccggcagcactcctacgacaccttcgtggacctgcagaaggaggaggccgccttggccccacgcagcgtgagcctgaaagacaagggccgattcatggatgggagcccctacgcccatatgtttgagatgccagctggtgagagctcctttgccaacaagtcctcagtgaccactgccggacaccatcacaacaatcccggcagcggctacatgctcagcaagtcgctctaccctgaccgggtcacgcaaaaccctttcatcccacttttggggatgatcagtgcttgcttcacggcagcaaatcctacttcttcaggcagcccacggtggcaggggcgtcgaaaacaaggccggacttccgggcccttgtcaccaataagccagtggtgtcggcccttccatggggctgtgccaggtcgtttccagaaggacatttgtatagggaaccagtccaacccctgtgtgcctaacaacaaaaaccccagggctttcaatggctccagcaatg

SEQ ID NO: 5485 - DNA, 78 bp, Mus musculus
cggtgttccccgatgggacatttgtgacagtgaagaggaacggagacaaaaccatcatgttcagcaacggagagaaag

SEQ ID NO: 5486 - DNA, 235 bp, Mus musculus
aagcgactcacgattcccttgacaatcctggagatcccctgcacatgaggagtaaagagacatccaaaaattgtaaagaaagagaccatgtagccaccaccatcttgggagagaggtcagagaagcagtagccagaaatgaggtcctggacatggcttccgtggccttgtacagaccatgccttctgtcggagtctggccctagagcagagggtacaatgggagcaacgtgacca

SEQ ID NO: 5487 - DNA, 510 bp, Mus musculus
gatcaaacccagaattgttctccttatttttgtttctggaaaagttgtattaacaggtgctaaagttagagcagagatttatgaagcatttgaaaacatctaccccatcttaaagggattcaggaagaccacatagttgtctgccatgttctcctgccttccctatccacgtgttttttaaaaccagtcagttttggtaccactgatggtacagttggtgaggacactcagttacaggtggcagcatgaagtgacactgtgtgtcctactgcaggatactagaaaggttccccctctgcactgaaatcaccctgcagcactactgtgagttgcttgctctgtgctgctacttgggcggcactgcccatttatttatatttagattttaaacactgctgttggtgattgttggtttaagggacagaactttaagtgttcaagccacctgtacaattggacttttcattttaatctttcccacacaagccagtttttatatttctaccagaa

SEQ ID NO: 5488 - DNA, 486 bp, Mus musculus
  misc_feature (73)..(74): n is a, c, g, or t
  misc_feature (76)..(76): n is a, c, g, or t
  misc_feature (85)..(85): n is a, c, g, or t
  misc_feature (91)..(91): n is a, c, g, or t
  misc_feature (111)..(111): n is a, c, g, or t
  misc_feature (120)..(120): n is a, c, g, or t
  misc_feature (132)..(132): n is a, c, g, or t
  misc_feature (153)..(153): n is a, c, g, or t
  misc_feature (157)..(157): n is a, c, g, or t
  misc_feature (216)..(216): n is a, c, g, or t
ttgttaaatctgctgaaaggcctgtgcctgaagcacttgggcaagcacctgaaggctgagcactactttattnntnttatcaggnaggagnaaatgttaaagtacgaccantatttggtnccatatagttantatgaactgggaatgctacantatntaaaaggagactatgccaatgcaatgaaaaacctcgacaacataaagaactataaagantattccatggaagcccggctacagtttagggctcatattgcccttgaacaaatagctaaattagaaaagtgattcttaacccagtgtgcttctgtgtagtatgagtgaaatatctacaatcagtcaagtaattagtaggtagaaaagtacttcctctgtgaaaagcaaaaatccaagtggcagctgctaagaacctgctaactaagaaagggacacgccattgctctgctctctcctcctcctcctcctccttccccataaaattcaatg

SEQ ID NO: 5489 - DNA, 453 bp, Mus musculus
  misc_feature (210)..(210): n is a, c, g, or t
  misc_feature (229)..(229): n is a, c, g, or t
  misc_feature (244)..(244): n is a, c, g, or t
  misc_feature (247)..(247): n is a, c, g, or t
  misc_feature (259)..(259): n is a, c, g, or t
  misc_feature (264)..(264): n is a, c, g, or t
  misc_feature (268)..(268): n is a, c, g, or t
  misc_feature (287)..(287): n is a, c, g, or t
  misc_feature (313)..(313): n is a, c, g, or t
  misc_feature (393)..(393): n is a, c, g, or t
ggtccagatggccatattgctttcaatgaaccaggatccagtttagtatcaagaacgagattaaagacgctagcaatggacaccattttggcaaatgctaaatattttgatggagatttatcaaaagtgccaaccatggctctgactgttggtgtggggacagtgatggatgctagggaggtgatgatcctcataacaggtgcgcacaangccttcgcgctgtacaaanccatggaagaaggantcnatcacatgtggncggtntccnctttccagcaacatccacncactatttttgtatgtgatgaagatnccactctagaattaagagttaaaactgtgaaatactttaaaggtttaatgcatgtgcacaataaacttgtggacccactnctacagtatgaaagaagggaactgaaggagacccagttgtgctccgaagaacctttccat

SEQ ID NO: 5490 - DNA, 325 bp, Mus musculus
gaggctcagcagaattgtgtcggatgaagaaatctaccaggacctgctggataagctcgtgctccaagccttgctccggctgctggagcctgtgatgattgtccgctgccggccacaggacctccacctggtggagtctgcggtgctaagagccatccctcagtacatgaggctctgccagaagcatttggaggtacaggttgaccaaactgaacacttgccttccaatgctgctggaggggtggaggtctacagcagcgatcagaaaataaaggtttccaacaccctggaaagtcggctgaatctcgcggccatgcagaagatg

SEQ ID NO: 5491 - DNA, 536 bp, Mus musculus
gatcctacagtgttagtttgtcagctagccaacatgcttggcaaactagattggataaaatctcgaacatggcgtttaaactctgataaaggcagtaagagttaaggttaggtactttttgagcaatttcctcaaagataaaacattgcaacctgcaggaaagctcatgaagactcagtagtagaaacgagccattaaaggagaatgctttaaatgaaagaaacaagaaaaaagatggtcttatatagtggatgggaggactagccaatagtattagaaggaaaacaacacgatgaaagggaccattgttttgtgtaagataaaaacacttaaagttcttaggtatgtgcatgtatgctctatgtaaatatgttacaaatttatgtctataaaatctgtatttcagtaagcattgaaaagatatggaaaagatatttagtgaacaggcagggaacagaaggcagtgtggtatggggggtatagaacagaatacagccaagtttgaataaaaggtttttctttatgtacttctgtgt

SEQ ID NO: 5492 - DNA, 499 bp, Mus musculus
gttcttctataatgtgcgcctggctcagaaggccatccaggctgcccttcctggcatctgccacacggctttggtggtgtctatatattccttcatgtacgtagcttttgggtacttggtgttcggtcagcatgaatggaattacagcaatatgattcacgccacccaaaccatcttctcctactgcgtgtcagcctttcagaacacagaattttccggcaacaaggttctcggggtcctgtttctgtcgtctttcatgttggtgatgatctgtatcttcatcaacttgtttcaggcagtgattctgtctgcctatgatgagatgaagcagcctgtgtacgaggagccgtctgatgaggccgaggctgtaacctatctgtgcaacaggctaaaatctgggtttgactttctcaccacccgatctagagacaaagaccaatccaacttcttcgtcgacatgctctatgggcagccggagaagaatactcgccggttcctg

SEQ ID NO: 5493 - DNA, 54 bp, Mus musculus
cgccatattctctcggttcatacaaaggaccttccatttaggtgtaagagatgt

SEQ ID NO: 5494 - DNA, 138 bp, Mus musculus
cagagctcccaggaaacagactgacacatggaaatctgccacagcagaggcgcgctggccacaggaggtcactgcttctttggccaatattctgatatctccctgcactgtttccaaaaagcacatggtagccctaag

SEQ ID NO: 5495 - DNA, 338 bp, Mus musculus
ttggtccagtttcccttgtgggaatccttgaaagccctctgggcgtggcggcggggtcatgtggtggattcttggcagtcagcagtctgcggagcttttgcaggtggctttgcagctgcagtgactacacctctggacgtggctaagacaaggatcatgctggcaaaggcgggttccagcactgctgtggggaacgtgctctctgccatgcacggggtgtggcgctcacagggactagccgggttattcgcaggtgtcctcccgaggatggcagcaatcagcatgggcggcttcatctttctgggcgcctatgaccaggcgcgaagcttgctgttaga

SEQ ID NO: 5496 - DNA, 455 bp, Mus musculus
tacctgattactatagcccagcaatgctggggctgaagactgaccaagaggtcctagcagagctggtgaggatgaagctaccagcagtggcagccctgatggatggccatggtgtgttgtggaccctgctggtgtcccgctggttcatctgcctgtttgtggacatcctacctgtggagacggtgctacggacctgggactgtctgttcaatgagggctccaaaatcatattccgggttgctctgaccttaattaagcaacaccaggaatttatattggaagccagcagtattccagacatctgtgacaagtttaagcagatcaccaaaggggactttgtgacagggtgtcacgcattcatgcagaaaatcttttcagaaccaggaagcctgtccatgacgaccatcaccaggcttcggaagagctgccgagcagcgctgcaggcacagagctga

SEQ ID NO: 5497 - DNA, 594 bp, Mus musculus
tccagccatacccagttgagatacttccaggcagagtctacctgggcaaaatcagtcaagcctgcaatgctaagatgcacaaggacttgaaaattaaagcacatgtcaatatttccatggagacaacaccctattttataggcaatgcagacaagctcttacatatcaagcttgaggattctccagacaccttgctttttgactatttccgccacatctgtcactttatagaacttcacctcaggctccactctgtcgttctggtcttttccacccggggcatcagccgcagcgttgctgctgtggtggccttactcatgcattataatgaggagacgctgaagaggtcctgggcccaagtgaagaaatgcaaaaccaacatgcgtccgaatcgggccttcgtggctcagctgctggagtgggagaaagtcctccatggggaatatctcacagacatctccgagcctatctactgacctttgcctggaacgcagctatggtcactgaggagtcttggttgggactttgggggactggggagctgggtttgcacttggagtggtcctggagaagacctttgctgcctggaggttc

SEQ ID NO: 5498 - DNA, 322 bp, Mus musculus
tacaagtcccaactatacacccaccagccctaattacagcccaacctctccaagctattccccaacctcacccagttattcccccacctcaccaagctactccccctccagcccacgatatacaccacagtctccaacctacacaccaagctcaccaagctacagtcccagctcaccaagctacagccccacttcacccaagtacaccccaactagtccttcctacagtcccagctcaccagagtacaccccagcttctcccaaatactcacctacaagccctaaatattcacccacttctcccaagtattctcctaccagc

SEQ ID NO: 5499 - DNA, 553 bp, Mus musculus
tgggtccacaactgccacctttgctgcagctgtcctctatgtgaagaatgaacggtgggatggggtacccttcatactgcgctgtggcaaagccctgaatgaacgcaaagctgaagtgagactgcaattccgagatataccaggcgacatcttccaccagaagtgcaagcgtaatgagctggtcatccgtatgcagcccaatgaggcagtatacaccacgatgatgaccaagaagcctggcatgttctttaaccctgaggagtcggagctggacctaacttatggcaacaaatacaagaatgtgaagctccctggtgcctatgaacgcctcatcctggatgtcttctgtgggtgccagatgcactttgtccgtactgatgaactcagggaaggctggcgtatcttcacaccactgctgcacaagattgaacgagaaaagccccagcccttcccctatgtatatggcagccgtggccccacagaggcagatgagctgatgaggagagtgggcttccagtacaagggtacctacaagggtactcacaagcactga

SEQ ID NO: 5500 - DNA, 145 bp, Mus musculus
gtgaacattcggctgctctatgttctcaaggactgcaccaaggactgcacatttatttatagagaacacgtgcctccagaactccctagggtgcttaaagatgtcaagaacttctactttgtcatgtgctgttcaagtataactt

SEQ ID NO: 5501 - DNA, 391 bp, Mus musculus
gagttcaaagaagctttctcactatttgacaaggacggggatgggacaataacaacaaaggagctggggacagtgatgaggtccctggggcagaaccccacagaagcagaactgcaggacatgatcaatgaagtagatgcggatggtaatggcacaattgatttccctgaatttctgacaatgatggcaagaaaaatgaaagacacagacagtgaagaagagattagagaagcattccgtgtgtttgataaggatggcaatggctatattagtgcagcagagcttcgccatgtgatgacaaaccttggcgagaagttaacagatgaagaggttgatgagatgatcagggaagcagacattgacggggacggtcaggtaaactacgaagagt

SEQ ID NO: 5502 - DNA, 222 bp, Mus musculus
tcgcggcctcaaagtcacaccagtaaccagtgcaatcagtgcacctgcagccaccactgccggagctgcagccaggcaggccacgcgggctctagctccagccccagccctggcccgcccatgaagcaccccaagccatccgtgcactctcgacactcacctgcaagacccagccaccgcgggagctgccccaagaacaggaagacctttgaagggaaagtg

SEQ ID NO: 5503 - DNA, 219 bp, Mus musculus
gatatcatcgattctttttatcaagagcaaaaacagtagtcaggagccatgcttgtggcttctgctggagaccagcccggcaagcatcttcctgagcgccaggtgtctccagtgggcaaaagaacctgtgacaagctgcttccaccctttagttcagggcagagcactgacatctccaatgccttcacgtgcaagtagtttcaattctaaccactgctc

SEQ ID NO: 5504 - DNA, 380 bp, Mus musculus
  misc_feature (311)..(311): n is a, c, g, or t
tcgtctttacctttagcctcggaagcttgctgtgctacttgtattgttttggagtatatcctgaattctgtgcctcagattagaatgataacagcttgactactgactgatatattagtatgttgtatttgccttccagttatataatatataaactcatttcatttaaatagaatgaccttttgtttctaagtgaattcaaattagaactttagtctggtaataataaactttgttagtgtagtattattattgcttacatttgaaacagcattgcattcttgacttagagttaagatcttaccaaaagnctagagtgaaagcaacagggagtaaactaccgtaacccgtgctggcttgtaacttgttttgtgggcttt

SEQ ID NO: 5505 - DNA, 541 bp, Mus musculus
  misc_feature (462)..(462): n is a, c, g, or t
  misc_feature (464)..(464): n is a, c, g, or t
  misc_feature (514)..(514): n is a, c, g, or t
ctttaagtccctgggcagtactgcagggacagatattacagtcaacagtgtgattctgcttcctaaaaacccagagcacttcgttgtgtgtaaccgatcgaacacagtggtcatcatgaacatgcagggccagatcgtcagaagcttcagttctggtaaaagagagggtggtgactttgtttgctgtgccttgtcccctcgtggcgagtggatctactgtgttggggaggactttgtgctctactgcttcagcacagtcactggcaagctggagagaacgctgacggttcatgagaaggatgtgattggaatcgcacaccacccgcaccagaatttgattgccacctacagtgaagatggcctcctgaagctctggaaaccctaagtcagcctttacggtgcagcccaggagcatgtacttaagtgcagggcatggccatgtattccgactacttttccatntntgcgtcctagcataaaacttgtaaaaaataataagtcaggtgtgatgtanttgaggagcttcggattgattctttta

SEQ ID NO: 5506 - DNA, 525 bp, Mus musculus
  misc_feature (195)..(195): n is a, c, g, or t
  misc_feature (222)..(222): n is a, c, g, or t
agtgtgactggctcaacagctaccaccagacctgcagggacgtggttgggaaggagctgcagagccagggccgccaggaagctctcgagtggctcatcagagagacagagcctgtctccaggcagcattgatgtcgcctggcgttggtttttcgtaggatgctctgggggaaggaggacacaaggcagacccctngacttctctctcctcacctcctcctcntccccgactcctctttttacttttagacactaagaagagctgaaactcttcttacctactttgatattttcttgcaaacagtcttttatgaatttttaattgttgagaatgagccaggaataaaactgctacaccagaaggaggggccccacgaagccgaagacttgacaagggggagacaccccaagccctctggccagggatggccaacactgactgctccgcgatggtctcgttccaggtgctaggacctcagtcacggtcaccttgatgttcatgagaccctcctatgatcagtgaata

SEQ ID NO: 5507 - DNA, 490 bp, Mus musculus
  misc_feature (36)..(36): n is a, c, g, or t
  misc_feature (79)..(79): n is a, c, g, or t
  misc_feature (82)..(82): n is a, c, g, or t
  misc_feature (125)..(125): n is a, c, g, or t
  misc_feature (178)..(178): n is a, c, g, or t
  misc_feature (253)..(253): n is a, c, g, or t
  misc_feature (314)..(314): n is a, c, g, or t
  misc_feature (328)..(328): n is a, c, g, or t
  misc_feature (338)..(338): n is a, c, g, or t
  misc_feature (374)..(374): n is a, c, g, or t
  misc_feature (465)..(465): n is a, c, g, or t
aaattgccaccaaagggtgcatggagaccatccctncaacattgccactgtattgacctctattcagctgctcatggcngancccaatcctgatgacccactaatggctgacatttcttcagaantttaaatataacaagatagcttttctcaagaaagccaagcagtggacagaggntcatgcaagacagaaacaaaaggctgatgaagaggagctaggcacctcatcagaagttggtgactctgaggaaanccattccacacagaaaaggaaggccaggccattaggaggaatggaaaaaaagttttccccntgacgttcagagantctatcctgntccctcttagttacggcagtctgtgtcaaggtggtntcttttgcttgcttcttttaaatgttttcctttgtatttgatgacaaatgtttgtatccttacaaaagaccttgtatgtttacgaattctnccatgcagcgattctttaaggatag

SEQ ID NO: 5508 - DNA, 463 bp, Mus musculus
  misc_feature (255)..(255): n is a, c, g, or t
  misc_feature (261)..(261): n is a, c, g, or t
  misc_feature (265)..(265): n is a, c, g, or t
  misc_feature (267)..(268): n is a, c, g, or t
  misc_feature (275)..(276): n is a, c, g, or t
  misc_feature (284)..(284): n is a, c, g, or t
  misc_feature (303)..(304): n is a, c, g, or t
  misc_feature (309)..(309): n is a, c, g, or t
  misc_feature (314)..(314): n is a, c, g, or t
  misc_feature (318)..(318): n is a, c, g, or t
  misc_feature (323)..(323): n is a, c, g, or t
  misc_feature (325)..(325): n is a, c, g, or t
  misc_feature (339)..(339): n is a, c, g, or t
  misc_feature (359)..(359): n is a, c, g, or t
  misc_feature (374)..(374): n is a, c, g, or t
  misc_feature (388)..(388): n is a, c, g, or t
  misc_feature (390)..(390): n is a, c, g, or t
  misc_feature (392)..(392): n is a, c, g, or t
  misc_feature (430)..(430): n is a, c, g, or t
  misc_feature (432)..(432): n is a, c, g, or t
gacttttccagcgtgtcctgaatcacacaatccaagtgtccaacctctgtggtgccttgtttctacattagcaactcagctagcacccatgggtgtgcatcctcacagtggcagcaggtcccacggtgtttggagatggcttggggatccgtgaggatggcatgaccagctagccccgagactgccacctctcctggctcatgatggaggaccttcccgggtcttctgcagagtgagcaagcaaggaccgtgganttgagncccngnnctctganntctgggantcagtatacacaccccaannccagnagggnactntcctntngacatctgtacccntgggagttacagaggaaggntcatgacctcagtgnccatcagctgagancntntcggcgaatttgctttgtaaggacgtgatctttcttgntnctgagggaaaaccagcgcatcagtgggttct

SEQ ID NO: 5509 - DNA, 547 bp, Mus musculus
  misc_feature (190)..(190): n is a, c, g, or t
  misc_feature (195)..(195): n is a, c, g, or t
  misc_feature (230)..(230): n is a, c, g, or t
  misc_feature (265)..(265): n is a, c, g, or t
  misc_feature (361)..(361): n is a, c, g, or t
ggattttacagaagtggccaagctaaggaaaccattcccctccaggagagcactctatacacagaggaccgcctggggctaaagaaaatggacaaagcaggaaagctagtgtttctggctaaggaaggggaccatcttcaaatatctaaagaatggtttactgcccacatcataccttttcttaagtgangcccntggcactttatagcagagttcatgaaaccacagcntcttccaagccatgtacatagttcatgctcagccntgaactctaatctagcctgcaaccagcccttttctctcctcttatcatctaacataccctacttggaaagatctaagatctcaatcttatcctttnccgcctgctatcaccatatggtgttggattcaagtttaattagctaataaccatggagattgttttacaactttgtgatatggtcaagctcccgtttaagaaatgggagtctgttgttgcagatcagtaattgtgcctaaaagagacagaagtgaaaaagagacaagctctgagggcaaaacccat

SEQ ID NO: 5510 - DNA, 416 bp, Mus musculus
  misc_feature (336)..(336): n is a, c, g, or t
ggaagctgcctttgaatctgtttttgttgaaactaataaggtttccagtgcacctgattctacagggaaaaatggagacaaacaagatctttgatgtgtttcatgtttgtgggcaggtgaacaatattttagagtattttaaaaaatcatttcttacagagaaattaatttgcagttgaatgaaagcatttgctcgtggctgtgccgagtgttctgctgctagaagttatgtagtcacacgctagctgctagtcaagtgatctgtctacacttgactgtcttgtggaccacgaggacatttgtttcacctagtttttaagattatggagatagttntcagctccatcttatctcagtccctaggcttattggaacagtaaatttgatgaacagtagaacacacaagctgcctcaga

SEQ ID NO: 5511 - DNA, 515 bp, Mus musculus
  misc_feature (417)..(417): n is a, c, g, or t
  misc_feature (472)..(472): n is a, c, g, or t
  misc_feature (482)..(482): n is a, c, g, or t
gtgctgttcatcgacgaggtccacatgctggacattgagagtttctctttcctcaaccgggccctggagagcgacatggcgcctgtcctcatcatggccaccaaccgagggatcacccggatccgaggcaccagctaccagagtccccacggcatccccatcgacctgctggaccgcttgctcattgtatcaacgtcaccctacagtgagaaggataccaagcagattctgcgcatccgctgtgaggaggaagatgtggagatgagtgaggacgcctacacagtgctgacccgcattgggctcgagacctccctgcgctatgccatccagctcatcacagcggccagcctggtgtgccggaaacgaaagggcaccgaggtgcaggtcgatgacattaagcgtgtatactccctcttncctggatgaatcccgctccacacagtacatgaaggagtaccaagatgccttcctnttcaatgagntcaaaggcgaaacaatggacacctcctgagctg

SEQ ID NO: 5512 - DNA, 383 bp, Mus musculus
  misc_feature (281)..(281): n is a, c, g, or t
gagttttttgagatgttgccttccagtgagttccaaatcagcgtggtagactgccagcctgtccatgatgacgctacaccaagccagaccaccgtgcttgtggtcatctgtggaacagtgaagtttgaaggcaacaaacagcgggacttcaaccagaacttcatcttgactgctcaggcgtcacccagtaacacggtgtggaagatagcaagtgactgcttccggttccaggactgggccagctagtgggggtgaccgaggcatcttagcttaagcccagntctgcagagaaatgccagtctcaaatctcaggatgtggagaacacaagttcatttttgttgtcacagcagcactgcagactggatgttggactcccagaatc

SEQ ID NO: 5513 - DNA, 447 bp, Mus musculus
  misc_feature (81)..(81): n is a, c, g, or t
  misc_feature (287)..(287): n is a, c, g, or t
  misc_feature (306)..(306): n is a, c, g, or t
  misc_feature (327)..(327): n is a, c, g, or t
  misc_feature (347)..(347): n is a, c, g, or t
acacttcagtttctcgcagatatattaccaaagaagattttagctagtaagtacctgaaaatgctcaaagagaagaggganagaggaggaggacaatgaggacgatggaagcgaccttggtgaagccctggcttaggccagcaagaagagctctcatcctgtcctgtgagcacatgcaaggacagactaacagctgcgaagtgaagggcactgcaactttgtctcagacttgcaacttgttgcattccctcttgcagtggaaaggactggacagcagcagcctcctntacaggcccttcagccatntcctctctcccactgggagantcctgggcagatggcactgntctggctttgggtacagtagcacacaccactgaacctcacattgaacttgcagggcagacctgggaagctccctggcagctgtgtagtcgcgtggacaca

SEQ ID NO: 5514 - DNA, 560 bp, Mus musculus
  misc_feature (27)..(28): n is a, c, g, or t
  misc_feature (68)..(68): n is a, c, g, or t
  misc_feature (442)..(442): n is a, c, g, or t
gcgattccaaccgagtgtaccggaggnnggctgcggctgcgcgacccccgacggccgctgcgcctgcncgacgtgggacagccgcgccatggcggacgaagaacttgaggcgctgaggaagcagaggctggccgagttgcaggccaagcatggagatcctggtgatgcagcccaacaggaagcaaagcaaagggaagcagaaatgagaaacagtatcttagcccaagttctggatcagtcagcccgggccagattaagtaacttagcacttgtaaagcctgaaaaaactaaagcagtggagaactaccttatacagatggcgcggtatggacagctaagtgggaaggtgtcagaacaaggtttgatagaaatacttgagaaagtcagccaacagacagaaaagaaaacaacagtgaaattcaacagaagaaaagtaatggantccgatgaagacgacgccgattactaagaggacgcacttagacagacttccggagcagtgtctaggacagtcaccaccttgtaaatgtttactttgttccctgtctatatatgccttt

SEQ ID NO: 5515 - DNA, 511 bp, Mus musculus
  misc_feature (379)..(379): n is a, c, g, or t
  misc_feature (445)..(445): n is a, c, g, or t
  misc_feature (447)..(448): n is a, c, g, or t
  misc_feature (478)..(478): n is a, c, g, or t
accatggccctcatgggtccaactgacctgcgctggagctgctcttatctacgggggaggggggtggcacagcagcttgggtcccccccaacctccaggagctagtggaggggtgtgtaacagggtcatacccctccctcttgtccaccctacccccagggtgagggagcctccccttccctttcagactggatgtgcctttatcctctaatgccccgacctctgaacacccccattctccgcctgttggtgggggtgctccttgacccacccagatttgacagttcaggggggctcccctgctatccctcctcccatcctgtaccccccatttctggggcctcatcactgtggaagacggggatagtgagggtattcntgggtgggaggcatggggaaggttttggaatagaaccaggggtatgtatgaaggggggtgacaagntnntcccaggggagttgggaggaaataaccttntctggtggatgagaaggcgtatttatttttcac

SEQ ID NO: 5516 - DNA, 427 bp, Mus musculus
  misc_feature (331)..(331): n is a, c, g, or t
  misc_feature (333)..(333): n is a, c, g, or t
  misc_feature (338)..(338): n is a, c, g, or t
  misc_feature (340)..(340): n is a, c, g, or t
  misc_feature (344)..(345): n is a, c, g, or t
  misc_feature (348)..(348): n is a, c, g, or t
  misc_feature (355)..(356): n is a, c, g, or t
  misc_feature (361)..(361): n is a, c, g, or t
  misc_feature (364)..(364): n is a, c, g, or t
  misc_feature (373)..(373): n is a, c, g, or t
  misc_feature (382)..(382): n is a, c, g, or t
  misc_feature (399)..(399): n is a, c, g, or t
aagggtccttcgaagaactgtgcaggaacaaggatatcaataaagctatcctggacgacttgttgaaacttgggaaggaagccggtctgaagccatttgaacaggtcaaaggcattgctgtgcacccggaattattttctattgacaacggccttctgactccaacactgaaggcgaagaggccagagctacggaactatttcaggtcgcagatagatgaactgtacgccaccatcaagatctaacgtgaggaaggatacttagaagaaatggcgcatctccacaatcctcctcgtaccaatggccttcgagttggtaactttgcctgcangngagtntngggnnaanggaaatnnccctnccnccggacttntccacgggntcttaccatagggatantcgagggcacggaacactgccttactta

SEQ ID NO: 5517 - DNA, 508 bp, Mus musculus
  misc_feature (240)..(240): n is a, c, g, or t
  misc_feature (338)..(338): n is a, c, g, or t
  misc_feature (340)..(341): n is a, c, g, or t
  misc_feature (346)..(346): n is a, c, g, or t
  misc_feature (358)..(358): n is a, c, g, or t
  misc_feature (450)..(450): n is a, c, g, or t
agaggaccgcaagccgcagctggcaaagaatgaagcctctgagaagctctcgtgctgtactgggttgaagagtgtggttctgagagccagtttatgattttaatgttttattaactcggtgatttttgtcagaccgaatggcatttgaaacagtttatagtagttttgataggatttcagggaagccaagtttatgttagaaatcatttgggggggtgtgtcttggaattaagaagatanagaatgcagcatccaggtaattaactccacacattgccacagggagatttggaactggtgtttgaagtttcaaagccttgtcaaatgctacaaaggtnanngggtncgtgtagttggnccacttctgtgcgtaaagatatgaaaggataaaggttaagtttactgcgaagcttgaggtggaagtaaacgctacttagatggtgtggtgtntcctttgaaatgttaactggagcaccgctcctggaagatggcagcgatcttgaacctt

SEQ ID NO: 5518 - DNA, 327 bp, Mus musculus
  misc_feature (239)..(239): n is a, c, g, or t
  misc_feature (260)..(260): n is a, c, g, or t
  misc_feature (288)..(288): n is a, c, g, or t
gtcactttattgcacactaagatatctctaaggcgctttatgtttgcaaaactggtggtccatttttaagccccatattatgagatgaggactgtgtcaacatgaaaaaactttaacatatgacctaaactattttcttatggcagaaaatattaaatgtatacttactcctagaaatttatttatttaaacttgctgtatatagaatagctacttatacattaaatattttaagttancctttgaaaaggaaatttggncctaaaaaagttaatttcattagaaaanaaatggtaccaggcatgaaccttgtctctctttgaagaa

SEQ ID NO: 5519 - DNA, 303 bp, Mus musculus
  misc_feature (227)..(228): n is a, c, g, or t
aactgggctgagctgacacctgagctgctgaaggtcctgcattctcgggttgctggcagactgatcatccacgcagatgagctggcccagatgtggaaggtgctgaatctccccacggacctgtttaacagtgtgatgaacgtgggtcgcttcacagaggagatcgagtggctgaagtttttagcccttgcttgtagctctcttggagttaccattgccaaaactcnnaagatagtgtgtgaagttttatcctccgaccatgatggaggaccaccccggattcctttcagcaccttccagttt

SEQ ID NO: 5520 - DNA, 533 bp, Mus musculus
  misc_feature (314)..(314): n is a, c, g, or t
  misc_feature (316)..(316): n is a, c, g, or t
  misc_feature (329)..(329): n is a, c, g, or t
  misc_feature (331)..(331): n is a, c, g, or t
  misc_feature (343)..(343): n is a, c, g, or t
  misc_feature (353)..(353): n is a, c, g, or t
  misc_feature (373)..(373): n is a, c, g, or t
  misc_feature (376)..(376): n is a, c, g, or t
  misc_feature (407)..(407): n is a, c, g, or t
  misc_feature (432)..(432): n is a, c, g, or t
  misc_feature (479)..(479): n is a, c, g, or t
aagaagctaagccatgacacccacgcgctgcatttgatcgcagccctgctagagaatgaatgtcaggtcctacaacagagggtagacatcctcaaggatttccatctccacgaagcgggactggggcacgagaagcctttgcagatgtcctgtgagcaggacaagaaatgtccgaagttagcggaagcagacaagacggacgctttcaagcataccacgagggcaacggaaggcacgattaggaaaccgaagatcctcaggagcccggatgtttgctttactaagaaggctcggaataaccgcttcaacgcccntnttgcaaagaaatntntggtggggaaanaggagaaccnttagcagctttcggtagaantcnccagaagcagatacaacttgagacaaaactntcatcaacccagggtagagagcttntgattccaccaaggaggaggcctaggataagaggaacctatattatntcagtagttagagaagtttgggccttaacaaccattgtatgaccgttaaccaag

SEQ ID NO: 5521 - DNA, 473 bp, Mus musculus
  misc_feature (363)..(363): n is a, c, g, or t
  misc_feature (416)..(416): n is a, c, g, or t
agaaatgccttgctgccttggcgtccctccgacacgccaagtggttccaggccagagccaatggactgaagtcatgtgtcattgtcatccgtgtcctaagggacttgtgtacccgagtgcccacctggggtcccctcagaggatggcctctggagctgctgtgtgagaagtccatcggcactgccaataggccaatgggtgctggtgaagccctgcggagagtgctggagtgcctggcatccggcatcgtaatgccagatggttctggcatttatgacccttgtgaaaaagaagccactgatgctattgggcatctagacagacagcaacgggaagatatcacacagagtgcgcagcatgctntgcggcttgctgcctttggtcaactccataaagtactgggaatggaccccctnccttccaaaatgcccaagaaaccaaagaacgagaacccggtggactacactgttcaa

SEQ ID NO: 5522 - DNA, 379 bp, Mus musculus
aggcatcttcatctttggtgattacatgcacattagcaaatctgtcttgtcctgattcactgttgtaaagcatgagcagaggctagaagtaccatccgggttgctgagagatgctgagaagcaggactctctgctttgactccttccccatcatggttaaagtacaaggcactgtgaatgaaggtagttgtcagggttagctgccaggggtatgggtgttattttatttttagggggaaagtagttttattttaattttatggcccccttccccctcccccctcttaaaggatctaattgcagtggttaaatgcagctaaccagtttttttagaatatgctctctagccaagtctaactttagacgctgtagatggaca

SEQ ID NO: 5523 - DNA, 529 bp, Mus musculus
  misc_feature (47)..(47): n is a, c, g, or t
  misc_feature (88)..(88): n is a, c, g, or t
  misc_feature (127)..(127): n is a, c, g, or t
  misc_feature (142)..(142): n is a, c, g, or t
  misc_feature (417)..(417): n is a, c, g, or t
  misc_feature (442)..(442): n is a, c, g, or t
  misc_feature (458)..(458): n is a, c, g, or t
  misc_feature (461)..(461): n is a, c, g, or t
tggaaccgggcacagcatagccttccccgggcagcagccctggagcnggacagagccctcaccgcccccatcagctccccgggagccngaggaggggctgccctgccctggctgctgccttggcccnttcagctttggcttnctatccatgtgcccccgccctaccccagctgttgcccgctaccgcaacttgaactgtgaggcgggcagtcttctctgccaccgagggcatcatgccaagccacccacacccagcctgcagctgcctggggcacgctcttagcagtgaggcctgtgagctcaggcttccaaccttggccttcgggataccctgtaaggacagtgcacttgctggacaatgccagccccagatgggctgactagctcttctccccgtataggggagcctcagcatgntctcaatggacagagcacctcctanccgacccctgggttcnctntcccattgggatcaccgaactagacacagcattgctgacacacaggactaacacgtgcaaagtattta

SEQ ID NO: 5524 - DNA, 494 bp, Mus musculus
  misc_feature (318)..(318): n is a, c, g, or t
  misc_feature (355)..(355): n is a, c, g, or t
  misc_feature (367)..(367): n is a, c, g, or t
  misc_feature (373)..(373): n is a, c, g, or t
  misc_feature (375)..(375): n is a, c, g, or t
  misc_feature (384)..(384): n is a, c, g, or t
  misc_feature (391)..(391): n is a, c, g, or t
  misc_feature (402)..(402): n is a, c, g, or t
  misc_feature (404)..(404): n is a, c, g, or t
  misc_feature (407)..(407): n is a, c, g, or t
  misc_feature (409)..(409): n is a, c, g, or t
  misc_feature (419)..(419): n is a, c, g, or t
  misc_feature (463)..(463): n is a, c, g, or t
gaacatcgcttcctaaagagacgtttggagcagctatcagtgcagagtgtagagcgtgtgcgcacagacagcactggctctgctgtgtccacagatgactcagagcaagaggtggatatagagggcatggagtttggccctggggagctggacagtgctggcagcagcagtgatgccgatgaccactacagcctacagagcagtggctgcagcgacagcagctatgggcacccttgcaggcggcctggctgccctggcctttcgtaggctccatgtcctttgcttcttggcccacctgcctgctcacctagccaagcntctcagccttccaatcctcccttgactgaagccagcntcgtcatgggcntactgntngtgccattntcgaagntacagctgctntntgntntgcctgcctntgcctgcctacccttcggtcaggactcaagttgcctgccccttntccgcagggctagaccccatgcagggaagca

SEQ ID NO: 5525 - DNA, 506 bp, Mus musculus
  misc_feature (412)..(412): n is a, c, g, or t
ttggatctttttacgttgaacatatattttagaatatgttaaaggatcaccacgatgcctgcaatgtgagagcaggttcatcggggtagtttgctaacagtcaggaaagctaaactggtcagtattaatgtctagccctaccaaaaaatagccagtagcgtctgaagatgaaaggagggaagcatttccaggaaacagcctggtgtagccactgcgggcgtggagctgtttcctctccgctgctttacacagagcctgaaaaaggacattctcagctaaagcatgtgtgcctgtttcatctaatcaagcagagctaagcagtcctatcaaatacaattacattggtaattactaaactatcaggttattaatttataatttacaagaagagaggaagttaactggcagaagnaagtgttgaatgagacccagatttaaagctggcttaactcaaaccactattaatggttttctgtatagattattcattatgtcaagccaaggtc

SEQ ID NO: 5526 - DNA, 369 bp, Mus musculus
  misc_feature (238)..(238): n is a, c, g, or t
atggaacgcgtgattgatgttttacgagtgattcatgaagttggaaaagaaagcacgaacatcttcagtccctcagactctctaaaagcagagggtgacatcgaacacatgactgaaggctttaagtctcatctcatccgtctgattggaaatctgtgctacaagaataaagaaaaccaagacaaagtgaatgagctggatggcattcctctgatcctggacagcagcaacatcgatngacaacaacccctttatgatgcagtgggtggtgtatgctgtgcgaaatctcactgaagacaacagccaaaaccaagatgtcattgccaagatggaggagcagggcttggcagacgcatccctactgaagaa

SEQ ID NO: 5527 - DNA, 449 bp, Mus musculus
  misc_feature (101)..(102): n is a, c, g, or t
  misc_feature (357)..(357): n is a, c, g, or t
gacgcctatgccttatgacttacaaggattagatttctttcctttcttatcaggagacaatcagcattacaacacctccctgctagccgcagctgcagcgnngcggtctcagatgaccaggacctcctgcactcctcccggtttttcccgtatacctcctcgcagatgtttctcgaccagctaagtgcaggagggagcacatctctgccagccaccaacggaagcagtagcggcagcaacagcagccttgtgtcttccaacagtctgagagagagccatggccatggtgtggccagcaggagcagcgcagacacagcgtccatctttggcatcataccagacattatctcattgganctgacgctctcaccctgctgctcccaccccatcccagattaaatgacttggcagaagagaactctatgctctgttttaccttatcctgttta

SEQ ID NO: 5528 - DNA, 201 bp, Mus musculus
  misc_feature (86)..(86): n is a, c, g, or t
  misc_feature (88)..(88): n is a, c, g, or t
tgtttgacaatgcactgagcgctctgcgaccagaggaaatcgcagctctgctctctggcctggtgtgccagagccccggggacccngngcgaccagctcccaagtaccctcaaacagggggtagaacgagtcaaagctgtggccaagcggattggcgaggttcaggtggcctgtggcctgaaccagacagtggaggagttt

SEQ ID NO: 5529 - DNA, 323 bp, Mus musculus
  misc_feature (287)..(288): n is a, c, g, or t
  misc_feature (290)..(291): n is a, c, g, or t
  misc_feature (293)..(293): n is a, c, g, or t
  misc_feature (297)..(297): n is a, c, g, or t
ggacgacaaatagaattctggcctcctcttgctgcagcagtaacatactgggatcggtgaatgtgtgcggctttgaacctgatcaagtcaaagtgcgcgtgaaagatgggaaggtctgcgtgtcggccgagagggaaaacaggtacgactgcctcggatccaaaaagtacagttacatgaacatctgcaaagagttcagtctgccgccatgtgtggatgagaaggacgtgacgtactcctacgggctcggcagctgtgtcaagatcgagtctccatgttacccttgnnanntntccntgtaatccttgcaacccatgtagccc

SEQ ID NO: 5530 - DNA, 552 bp, Mus musculus
  misc_feature (377)..(377): n is a, c, g, or t
  misc_feature (380)..(380): n is a, c, g, or t
  misc_feature (383)..(387): n is a, c, g, or t
  misc_feature (390)..(392): n is a, c, g, or t
  misc_feature (394)..(396): n is a, c, g, or t
  misc_feature (398)..(403): n is a, c, g, or t
  misc_feature (405)..(418): n is a, c, g, or t
  misc_feature (427)..(427): n is a, c, g, or t
ggatggtgattatcactggaccaccagaggctcagttcaaggctcagggaagaatttatggaaaaattaaagaagaaaactttgttagtcctaaagaagaggtgaaacttgaagctcacatcagagtgccgtcctttgctgctggcagagttattgggaaaggaggcaaaacggtgaatgagctccagagtttatcaagtgctgaagttgtcgtcccccgtgaccagacacctgatgagaatgatcaagtagttgtcaaaataactggccacttctatgcttgccaggttgcccagaggaaaattcaggaaattctgactcaggtaaagcagcaccagcagcagaaagctctgcagagtggaccacctcagtcaagncgnaannnnnggnnnannngnnnnnnannnnnnnnnnnnnnaggcagatnccaaaccaaagacagatttgcttaaccaacagacgggtgctgacccatccagaaccacgtgcacgagtttttacctagctggttgtttccgaggaccaggcactcgatcctgtctctgtgagaat

SEQ ID NO: 5531 - DNA, 78 bp, Mus musculus
gttcataatgtggttacagtcatattacactgaccctgagggtattatgtaacccttcagaaaaccactttgcctcat

SEQ ID NO: 5532 - DNA, 242 bp, Mus musculus
gtccaccaaaagtcttccatgaaatgtagcagagtttctgtctgccctgcattacctgccagcgagtcaaggtaggggatccagcaaacggttttgggaattcagactgtggaaacatcggacttccctttgcccttcctcaacttagtggcaaagccctgtatggatacttgtaggtgcgggtgatcctcaaggccatgctgctttctgagttgttcttgttgctttgttcataatgtggt

SEQ ID NO: 5533 - DNA, 445 bp, Mus musculus
  misc_feature (309)..(310): n is a, c, g, or t
  misc_feature (313)..(313): n is a, c, g, or t
  misc_feature (417)..(417): n is a, c, g, or t
gaggaactggctgggcaccagacaccaatcacagatattgccactgagcgtgcccaggggcaggatggtgttgctgacatggtgacagcagatgactcgggtgtcctgtgtgtctggaggtcgggacctgagttcaccttactgacccgaataccaggattcggggtcccatgcccctctgtgcagctgtggcaggggatcgtggcagcagggtatggaaatgggcaagtgcgcctgtatgatgccagcacaggggccctccacgtccagatcagtgcccacgcccggaccatctctgccctggacctnnctnccagaggtcggcaagctactgtctgcagctgaggacacctttgtgcacatctggaagctgaacagaaacccagaaagtggctctattgaggtggaacactgccnatggtgaatgtatttctgacacccaggt

SEQ ID NO: 5534 - DNA, 531 bp, Mus musculus
  misc_feature (265)..(265): n is a, c, g, or t
  misc_feature (269)..(270): n is a, c, g, or t
  misc_feature (311)..(311): n is a, c, g, or t
  misc_feature (322)..(322): n is a, c, g, or t
  misc_feature (333)..(333): n is a, c, g, or t
  misc_feature (339)..(339): n is a, c, g, or t
  misc_feature (342)..(342): n is a, c, g, or t
  misc_feature (347)..(347): n is a, c, g, or t
  misc_feature (376)..(376): n is a, c, g, or t
  misc_feature (461)..(461): n is a, c, g, or t
  misc_feature (463)..(463): n is a, c, g, or t
  misc_feature (471)..(471): n is a, c, g, or t
  misc_feature (473)..(473): n is a, c, g, or t
  misc_feature (476)..(476): n is a, c, g, or t
  misc_feature (486)..(486): n is a, c, g, or t
  misc_feature (488)..(488): n is a, c, g, or t
gataaatctggagaaaacgtaagtttctcagaggaatggcagcgttttgcacgttctgtagagacaccaatggaaaactggaatttgttaagtggtgaacagcaagttaggaatgcttcagaattggaccttatggaagtacagaatccagtaactcatgatgatgggaatgcaaatcctgaagaagtagttggagatacacgaaagaagatcaacaacaaattgtgtgagcagaagtttgatatggatatacagaaattcaatnaagnnacaagaaaaatcagtgaacaattatcaaaaagaacaacaancattaaaactntccgaatgtantcagantcngaccntggaagcaattgaagacatgcatgagaantccatggagggtttgatgaacatggagaccaacaactacgatatgctttttgatgtagatggtgaagagacattatgaagcatantntgaagtantnttntcctttcccntnttcagactaatgaagcatacatatttctcacttgctggtacat

SEQ ID NO: 5535 - DNA, 531 bp, Mus musculus; identical to SEQ ID NO: 5534
  misc_feature (265)..(265): n is a, c, g, or t
  misc_feature (269)..(270): n is a, c, g, or t
  misc_feature (311)..(311): n is a, c, g, or t
  misc_feature (322)..(322): n is a, c, g, or t
  misc_feature (333)..(333): n is a, c, g, or t
  misc_feature (339)..(339): n is a, c, g, or t
  misc_feature (342)..(342): n is a, c, g, or t
  misc_feature (347)..(347): n is a, c, g, or t
  misc_feature (376)..(376): n is a, c, g, or t
  misc_feature (461)..(461): n is a, c, g, or t
  misc_feature (463)..(463): n is a, c, g, or t
  misc_feature (471)..(471): n is a, c, g, or t
  misc_feature (473)..(473): n is a, c, g, or t
  misc_feature (476)..(476): n is a, c, g, or t
  misc_feature (486)..(486): n is a, c, g, or t
  misc_feature (488)..(488): n is a, c, g, or t

SEQ ID NO: 5536 - DNA, 310 bp, Mus musculus
actggagtgacgtcacagttggactcattcagggagctgctatggctatactggttgctttgtatgtatccgatttcttcaaggacacacattcttacaaagagagaaaggaagaggatccacacacgactctccatgaaaccgccagttcacggaactactcaaccaatcacgagccctgaagggtacaggggcgctggcccgcttcaaaggcaacagctggaggctaaaggcagggggatgcgtattacttcctgctgtacagaccattctataaaggactgctgctatctatacctcctggatgccc

SEQ ID NO: 5537 - DNA, 344 bp, Mus musculus
ggcaagactcttacgacccatgctccagtttgggctcattgctttttccatatatgtgggcctttctcgagtgtctgactacaaacaccactggagtgacgtcacagttggactcattcagggagctgctatggctatactggttgctttgtatgtatccgatttcttcaaggacacacattcttacaaagagagaaaggaagaggatccacacacgactctccatgaaaccgccagttcacggaactactcaaccaatcacgagccctgaagggtacaggggcgctggcccgcttcaaaggcaacagctggaggctaaaggcagggggatgcgtattacttcc

SEQ ID NO: 5538 - DNA, 527 bp, Mus musculus
  misc_feature (281)..(285): n is a, c, g, or t
  misc_feature (287)..(287): n is a, c, g, or t
  misc_feature (291)..(292): n is a, c, g, or t
  misc_feature (298)..(298): n is a, c, g, or t
  misc_feature (300)..(300): n is a, c, g, or t
  misc_feature (317)..(317): n is a, c, g, or t
  misc_feature (322)..(322): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (346)..(346): n is a, c, g, or t
  misc_feature (367)..(367): n is a, c, g, or t
  misc_feature (382)..(382): n is a, c, g, or t
  misc_feature (411)..(411): n is a, c, g, or t
  misc_feature (419)..(419): n is a, c, g, or t
  misc_feature (457)..(457): n is a, c, g, or t
  misc_feature (476)..(476): n is a, c, g, or t
  misc_feature (482)..(482): n is a, c, g, or t
  misc_feature (484)..(484): n is a, c, g, or t
  misc_feature (489)..(489): n is a, c, g, or t
  misc_feature (491)..(491): n is a, c, g, or t
aagctggtggaactcgaccccaagagcaatgcctacatcctcatcaacgccctggagccagtgggcaaggatggtgaactgagaggctaccagagaacgcccaccaccggcctcctgatgattattttagggctcatcttaatgaatggccacagcatcccagaaaacgatgtctggtgttttctacgtcgtttgggggtgtatcccaccaagaagcattcagttttcggctatccgaagaaactcattactgaagacttcgtgaaacagcgttacctggnnnnncntcgnntacccnanacagatcctgtggactntgagntccagtgggntccncgancaaatntggaaaccagcaagatgaaantccttaagtttgtanccaaaatccataatcaagatcccaaggantggcccantcagtactgtgaagctttggcggatgagcagcgtaggntcagaccagagccaaatgntccagntntgacntnttgaagtaaacgttcaggattcacgagcataagcta

SEQ ID NO: 5539 - DNA, 527 bp, Mus musculus
  misc_feature (50)..(50): n is a, c, g, or t
  misc_feature (400)..(400): n is a, c, g, or t
  misc_feature (480)..(480): n is a, c, g, or t
tcagctgtgagcctgtcatggaagagaaagttcaggagcaaagtagtctnttagagaatggggcagtccaccagggagacacctcgtggggctccagtggttccgggtctcagtccagccagggccgcgacagccactcctccagcctgtcggaacagtcctccgactggcccgcggacgacatgtttgagcatcctgcctcctgtgagcttgtgaagtcaaagactaaatcagaagagtccttctctgacctgaccggctccctgctctccctgcagttggatcttgggccttcacttttggatgaagtcctgaatgtcatggataaaaataagtagccaggagtcagctctttttcttgggagtaagaggtaccaaaataagcagaaaacaaaaaaantcaactaaccacagctgatggaaagagctgctctgactgtttttatttgcagccatgtgatgcattttctaaaataacgntcctgttcctacaaaatatttttttaaccatcatgccctgtttgcaa

SEQ ID NO: 5540 - DNA, 155 bp, Mus musculus
gcatgttatgagaaggaaacttacttatttggcacctacgcctttttttcctagccttttttgtatattgtatcttttgggttcaccacagcgaagtctccagcgttatgattttactctttgcatattcgagcaaccttacaggatttgggatt

SEQ ID NO: 5541 - DNA, 406 bp, Mus musculus
  misc_feature (353)..(353): n is a, c, g, or t
  misc_feature (371)..(371): n is a, c, g, or t
  misc_feature (381)..(381): n is a, c, g, or t
gcataccattgcttctttgtctgatcaggatgcaaaaccatccttcagcatggcgcatttggataacaacagcactgagccagggcttacactgggaggctacttctgcccacagtgccgagcaaagtactgcgagcttcctgttgaatgtaaaatatgtggtcttactttggtgtctgcacctcatttggcaagatcttaccatcatttatttcctttggatgcttttcaagaaatttccctagaagaatataaaggagaaaggttttgttatggatgtcagggggaattgaaagaccaacatgtctatgtttgcacagtgtgccaaaatgttttttgtgtggactgtgatntctttgttcatgactctntccattgttntcctggctgtattcataagatccca

SEQ ID NO: 5542 - DNA, 492 bp, Mus musculus
  misc_feature (52)..(52): n is a, c, g, or t
  misc_feature (264)..(264): n is a, c, g, or t
  misc_feature (412)..(412): n is a, c, g, or t
tgcttcggacacaggcggacctgatgggggtggtggggagagaggcgttgcnggaggaggcgaaggtcctgaggagcctgcgctgcccagcctggaaggtgtcagcgaaaagcagtacaccatctacatcgctcctgggggcggagcgttcacgacgctgaatggatcactgaccttggagcttgtaaacgagaagttctggaaggtgtccaggcccttagagctctgctatgcccccacgaaggacccaaaatgatgtcacanaggggacagctggaacatggggaccacagggtgtctctgtgtcccagctcagcctgccagcttcatctcccaaagccccccagccagacagcaagaggacaaaggaggacaaatggcttttatacaaagtatctatattgaattagtntatattggacagcacgggccctgtacccactactgccttttctatagaccctagtttcctaccctgctggtgataggcag

SEQ ID NO: 5543 - DNA, 484 bp, Mus musculus
gagaccgggatcgagacagagacaaagagcgggatcgagacagagaccgggaccgagatcgggaacgagaccgagagggccctttccgcaggtcagactcattccccgaacggagggcccctcgaaaggggaacacactgtatgtgtatggagaggacatgacgcccaccctcctccgcggggccttctctccctttggaaatatcatcgacctctccatggacccacccagaaactgtgccttcgtcacctacgagaagatggagtctgcagatcaggctgttgctgagctcaatgggacccaggtggaatctgtgcagcttaaagtcaacatagcccgaaaacagcccatgctggacgctgctactggcaaatctgtctggggctcccttgctgtccagaacagccctaagggttgccatcgagacaagaggacccagattgtgtacagtgacgatctataggaaaccttgtggatggcttc

SEQ ID NO: 5544 - DNA, 502 bp, Mus musculus
  misc_feature (255)..(255): n is a, c, g, or t
  misc_feature (399)..(399): n is a, c, g, or t
taagcatttgtaaaggtctgatcctgagacaaggctgtacacaatcagctctcagaattcatcctctcaccccgggtctgctcaacccatataatttttatttttgattatttaataaaatgtagctgttaagttattaaaatagtgagttaactttagattccttaatcgtttcctaagcaatgcttgagtgctgtaaaatgtaaggaagagattgtgggtaacaaaagagacattgcaaagtacagaaagtcncagttaacttcaaggtttaatgaccctttggtcagagaaaaaagaatgccagttgctttctaagcccaacggataggaagcctctgttctccaggcaaggattagtgggcatattctataagaaaacttacagctattgccctntcaaagcaagaaggaaaggttttgtctttgtattaagataggaagttagtcatggagtgaaatagatgattaggtagaagtgtttctgtgtctttatttgcaa

SEQ ID NO: 5545 - DNA, 319 bp, Mus musculus
gaggagcccacatagtctcctgctgccgccccagcacaacctcagttgtagaggactgggtctagccaccgagtgaaagagtgtcagaaccacagagacctgcagggccatacagagtcactgggacgcaatgggtgaggtatggagtgcaggatggacccctggagggccttatgctgctgtctgtatctcctcccgactccacacacctagctgacacccaaaaagaatagctactgcttggacaagaggctcccagcacatagggactcacgggagctcacgtctgtatccaggttgggccgagaggctccattct

SEQ ID NO: 5546 - DNA, 223 bp, Mus musculus
  misc_feature (30)..(30): n is a, c, g, or t
  misc_feature (73)..(73): n is a, c, g, or t
  misc_feature (77)..(77): n is a, c, g, or t
  misc_feature (93)..(93): n is a, c, g, or t
  misc_feature (172)..(172): n is a, c, g, or t
gtgatgccagccagcggtgcagtgtgtgtnccaccttatttagctaaaggagatcgtgcaattcattgggatnctgnaaggagatgaatgggnttcggagtgaatgtggcagttaaaatacaccttcatttttttggacttgcgtatttagccccctggaacagagttgttntggatttcaaagataagactgctaccgtagcatcacaatagtcagtggtga

SEQ ID NO: 5547 - DNA, 474 bp, Mus musculus
  misc_feature (253)..(253): n is a, c, g, or t
  misc_feature (317)..(317): n is a, c, g, or t
  misc_feature (362)..(363): n is a, c, g, or t
  misc_feature (365)..(365): n is a, c, g, or t
  misc_feature (372)..(372): n is a, c, g, or t
  misc_feature (374)..(374): n is a, c, g, or t
ccttagagatacaaccctgggctttaacccaaatgaaccagaatatgacgaccatccagttaccctcacaatccgaatcatcagtgggatccagttgcctgttagctcatcctctaacacgcctgacatagtagtgatcatagaagtctacggtgttccaaacgaccacgtgaagcagcagactcgtgttgttaagaataatgcttttagtccaaagtggaatgaaacatttacatttcttattcaagtgccngaactggcattgatacgttttgttgttgaaactcaacaaggcttattatcaggaaatgaattantcgggcagtacactttaccagttctttgcatgaacaaaggttatnntngtgttcntntgttttccaaatccggtgcgaaccttgaaccttcctcactgtttatttatgtttggtacttcagagagtgacgcatgtaactgacgcgttagctacacat

SEQ ID NO: 5548 - DNA, 528 bp, Mus musculus
  misc_feature (348)..(348): n is a, c, g, or t
  misc_feature (360)..(360): n is a, c, g, or t
tcgggttcagattcagctcggatttacagagtatggaaacatctgctctgggactgacacagataaacagagagaatatacaaaagccaggcaagctccagctgagcctgccatttgaagcaaggttgaatgcctccatgggtcctggacgaaccgttgtcattaaaggggaagtgaacaccaatgcccgaagctttaatgttgacctagtggcaggaaaaacaagggatatcgctctgcacttgaacccacgcctcaatgtgaaagcatttgtaagaaattcctttcttcaggatgcctggggagaagaggagagaaatattacctgcttcccatttagttctgggnatgtactttgangatgataatctactgtgatgtccgggaattcaaggttgctataaatggtgtgcacagcctggagtacaaacacagatttaaagacctaagcagtattgatacactatcagtcgatggtgatatccgtttgctggatgtaaggagctggtagctaccatgactgccaaa

SEQ ID NO: 5549 - DNA, 151 bp, Mus musculus
tgtggtcccgcagacttgaaaaccttaaccagctttggtttgctgctggttgttgctttggaatcctgtcagtgaccccctggagtccaggatgcatggtcatttgaaatatgtgtaaagtcaaatgttcactcaggctttaaagcaaata

SEQ ID NO: 5550 - DNA, 566 bp, Mus musculus
  misc_feature (317)..(317): n is a, c, g, or t
  misc_feature (320)..(320): n is a, c, g, or t
  misc_feature (322)..(322): n is a, c, g, or t
  misc_feature (325)..(325): n is a, c, g, or t
  misc_feature (327)..(327): n is a, c, g, or t
  misc_feature (332)..(332): n is a, c, g, or t
  misc_feature (396)..(396): n is a, c, g, or t
  misc_feature (410)..(410): n is a, c, g, or t
  misc_feature (483)..(483): n is a, c, g, or t
  misc_feature (497)..(497): n is a, c, g, or t
atttcatcaaagactccatgggttgggaggagctttataatatataaaagctgtgataagaaacctttcaggtggttagtcacttgtaaactttttcttaaggcaattttttttctacttgtatatttactaacttccaagagacatttcctgtgctggagagtccagtgtcccaagctggagcagtgagactcctgcattgtggtgcagctccacctgccatatgtgaaaactgcagtgataacacagatgctaaagcattcccaaggcttgcaagccaggctagcccctcccctctcctctcctctcctctcctntcntntcntntcctntccggtaggcagcatgctgctatgtacaaacttgtaccaaatgttgcagaagcagagataaaancctttgttcccttnttgagttgagactgagttttatctccagaggaagagatgtccctgtactgaactctgttggaaggggttgcanccatgagcagagtncaaacacgggagggtaaggtgtggaaagtgctttcctggtgtcagagtgggaagacctccccagtcact

SEQ ID NO: 5551 - DNA, 564 bp, Mus musculus
gaaggccagacacgtggcacccagtgacacagttctgatgtttaatgtggccttggtcttgcaaagattagctacctctgtcctgaaagatgaaaaaagtaatctgaaggaagtccttaatgctgtgaaagagctggagctcgcacacaggtacttcagttacttgagcaaagttggagataaaatgagatttgatttggcccttgctgcctctgaagccaggcagtgctctgacttactgagccaggcccagtaccatgtggcccgggcacgcaagcaggatgaggaagaacgggagctgcgggccaagcaggagcaggaaaaggagctcttaagacagaagcttctcaaagagcaggaagagaaacgtctcagagaaaaggaagaacaaaagaaacttttggaacagcgtgcccagtatgtggagaagaccaaaaatatccttatgttcactggcgagactgaagcaacaaaggagaagaaaagaggtggaggtggagggcggcgttccaagaaaggaggcgagtttgatgaatttgtcaacgatgacaccgacgatgacct

SEQ ID NO: 5552 - DNA, 579 bp, Mus musculus
  misc_feature (345)..(345): n is a, c, g, or t
  misc_feature (351)..(351): n is a, c, g, or t
  misc_feature (399)..(399): n is a, c, g, or t
  misc_feature (434)..(434): n is a, c, g, or t
  misc_feature (475)..(475): n is a, c, g, or t
  misc_feature (512)..(512): n is a, c, g, or t
  misc_feature (546)..(546): n is a, c, g, or t
agactgacatacagggtgccctttcagcttatggaacagccacacgcatcctgcaggagaaagtgcaggccgatgtccctcccgagattttgaataatgttggggccctccattttagactcggaaacctgggggaagcaaagaaatacttcctggcctcactggaccgcgcaaaggcagaggccgagcatgatgaacactactacaatgccatctctgtcaccacatcctacaatttagccaggctctatgaggccatgtgtgaatttcacgaagcagagaaactgtacaaaaacattttacgagagcatcctaactacgttgattgctatctacgcctagganccatgnccagagataaaggaaacttctatgaagcttcagactggtttaaggaancccttcagatcaatcaggatcatccggatgcctgntctttgattggtaacctccatctggcaaaacaagaatgggncccaggtcagaagaagtttgagaggatattaaaacanccagccacacagagtgacacctactctatgctgncccttggcaatgtgtggctccagactttgcatc

SEQ ID NO: 5553 - DNA, 518 bp, Mus musculus
  misc_feature (115)..(115): n is a, c, g, or t
agatagctctgttgtcatcagcccacctgagttctatcacacaccaggttctgttgagaatcttcggcggcaggcctgtctggttgctgttgagaatgcatggcgcaaagctcangaagtctgtgacctcgttggccaaactctgggaaaacctttactaatcaaagaagaagaaacaaaagactggtaaggccaaacggatgatcatcagttatccagactgccaggcacattaactgtacaacagaaaatcaaaagtgcaaccatccatgcagcttcgaaggtgttcattacttttgaggtaaaaggaaaagagaagaaaaaaaagcatctttaaaattctaactaaaacatgatgtgtctgtacttttaaatctgtttttatacatttttacagtgcttctttctgtctcggacattcaacatattgtatggcatattaagtaagcctcagtaaaatctgccactttttgaacataatgccacagaatatatacgattactttctagtttccaga

SEQ ID NO: 5554 - DNA, 373 bp, Mus musculus
  misc_feature (244)..(244): n is a, c, g, or t
gtcttgcttgtatttgttgtataaaactgtagaacctgagctgcatctgagaaaagcacagttcatgttccatgaaacatgttaacgttttccatttcatcacaatctatatgcttttcttttaaaatgtttcatacaatgtattttgattatattatttcccccccccagctccccacagattctaccccctccatctgtagaatccaaaataaatccaagaccacccagccccttccccctntgaagggactttccaaactatattagtgggccaagtacagagccagataaagaagctggccgactaaacaatgctgagaaaaaaaccacaagggcaggcagagtgagggactaggccaaagatagtcac

SEQ ID NO: 5555 - DNA, 473 bp, Mus musculus
  misc_feature (359)..(359): n is a, c, g, or t
  misc_feature (361)..(361): n is a, c, g, or t
  misc_feature (407)..(407): n is a, c, g, or t
  misc_feature (413)..(413): n is a, c, g, or t
ggaggatgccttttacacactggtaagggagatacgccagtaccgaatgaaaaagctcaacagcagtgacgatggcactcaaggttgtatggggctggccctgtgtgctgatgtagtaagacactttgaaagttctgtcatcagaaaagagccactttgaagctgcactgatgccctggttctgacatccctggaggagacctgttcctgctgctctctgcatctcagagaagctcctgcttcctgcttccccgactcagttactgagcacagccatctaacctgagacctcttcagaataactacctcctcactcggctgtctgaccagagaaatagacctgtctctcccggtcgttntntgccctgggttcccctagaaacagacacagcctccagctggctttngtcctntgaaaagcagtttacattgatgcagagaaccaaactagacatgccattctgttgacaaca

SEQ ID NO: 5556 - DNA, 437 bp, Mus musculus
  misc_feature (321)..(321): n is a, c, g, or t
  misc_feature (336)..(336): n is a, c, g, or t
  misc_feature (349)..(349): n is a, c, g, or t
  misc_feature (380)..(380): n is a, c, g, or t
  misc_feature (407)..(407): n is a, c, g, or t
ttgcaaatgtgcatccatgggtgaaggtgaatctcaaactggaggacattgtgacagtctctcatgcctaaagactgagaaatgtcactctccaagtaagcttggtatgaaggggaagcacctagttggtagagttacgagaatcagaacacataggcgcaaaaaacccaaataccagtgtgtgggtacacaaaccacagcagaattcagggatgacttgggggatctcgaggataaaagccaaaaaggctttttgaattctcatcctgaatgtgtgacttcctgcagaaggtaaattagaaaaagaaaggaattcaaganttcagaaccttctanccaagaatgaatntaaaatagatatcatcagaagcataaagatntaagtggttttgaaaggcaaattagtntacttagccaccaaggctcattgaaagtat

SEQ ID NO: 5557 - DNA, 471 bp, Mus musculus
  misc_feature (197)..(197): n is a, c, g, or t
  misc_feature (208)..(208): n is a, c, g, or t
  misc_feature (214)..(214): n is a, c, g, or t
  misc_feature (225)..(225): n is a, c, g, or t
  misc_feature (231)..(231): n is a, c, g, or t
  misc_feature (255)..(255): n is a, c, g, or t
  misc_feature (289)..(289): n is a, c, g, or t
  misc_feature (299)..(299): n is a, c, g, or t
  misc_feature (302)..(302): n is a, c, g, or t
  misc_feature (304)..(304): n is a, c, g, or t
  misc_feature (308)..(308): n is a, c, g, or t
  misc_feature (329)..(329): n is a, c, g, or t
  misc_feature (375)..(375): n is a, c, g, or t
  misc_feature (390)..(390): n is a, c, g, or t
  misc_feature (432)..(432): n is a, c, g, or t
gaatgaaaccttgcaggtcctgccacagaagcaagaagcagaggaaaggccatggagagacttaataaagggttttacaagggtacctggatcccagggggaagtagtttatccttggggcacagtggcagggctcattcagaacggtgagtaagtgtcaggtgtgatattcaaagacctggttcctaacaccagancacagcgaagntggagntcagaaataantcccanccactgaaggaagtatggcttcantctggagagctcagaaaagactcgaccctaggancccacacaancgntnatanccacaagtgagagggcattancaacaggaagctaaggattgagtaaggcaatggggaatggtggganccagcagttacaacnctttactcacctggatgggcttgttaaaacacagattaccanccccactccctgcattctgactcagtaggtccgggacgg

SEQ ID NO: 5558 - DNA, 430 bp, Mus musculus
  misc_feature (370)..(370): n is a, c, g, or t
accaccagaagttgtaccaggaccaggtcatcagtctcaggaggagatactgtgtcctgagaaggaccagaaattcctcatgggcaggagggcaccacagctccatccatgtgacacacaggttgccgatagggagtacacgcttgagccccttgtgccctggtgggcagacatcgggtcctgtagccgccacaacccatatcaccttcgttcacggtctcgttcctgtccatcatcactcggcatccttccctctcacagtaccccacccccatcattccatcctcttaggtggtttagaaactttgcagtgaccctgggaagggccacatcaccaaggagtactggcccatgcaataagacgtcacantcccaacagaggcggggcttcccctccatcccaggctgtcaggctcagcgttcatttgac

SEQ ID NO: 5559 - DNA, 413 bp, Mus musculus
  misc_feature (254)..(254): n is a, c, g, or t
atgtaaatttgagcccccactgtttcatccaaacgtgtatccttctggcacagtgtgcctgtccatcctggaggaagacaaggactggaggccagctatcaccatcaaacagatcttattaggaatacaagaacttctaaatgaaccaaatattcaagacccagctcaagcagaggcctacacaatttactgccaaaacagagtggaatatgagaaaagggtccgagcacaagcgaagaagtttgccccctcantaagcagcggccctgggctccatgacgaggaagggattggcttggcaagaacttgtttacaaccttttgcagatctaagtcgctccgtacagttactagtcgcctgggagggttgagcgggcgccattttccatttccgccactggcatattcagtctt

SEQ ID NO: 5560 - DNA, 461 bp, Mus musculus
agaatgacgagccacccaaggtagtggtgaccgaagtaaaggaagaggatgctttctactccaaaaaatgtaaactattttacaagaaagacaacgaatttaaagagaagggtgtggggaccctgcatttaaaacccacagcaactcagaagacccagctcttggtgcgggcagacaccaacctaggcaacatactgctgaatgttctgatcgcccccaacatgccgtgcacccggacaggaaagaacaacgtccttatcgtctgtgtccccaaccccccactcgatgagaagcagcccactctcccggccaccatgctgatccgggtgaagacgagcgaggatgccgatgaattgcacaagattttactggagaaaaaggatgcctgagcactgaggctgaccaaggcatgttgccacgttgctgcttcccctccgtccctaacttagtcacattctttc

SEQ ID NO: 5561 - DNA, 592 bp, Mus musculus
  misc_feature (150)..(150): n is a, c, g, or t
  misc_feature (194)..(194): n is a, c, g, or t
  misc_feature (200)..(200): n is a, c, g, or t
  misc_feature (225)..(225): n is a, c, g, or t
  misc_feature (240)..(241): n is a, c, g, or t
  misc_feature (243)..(243): n is a, c, g, or t
  misc_feature (246)..(246): n is a, c, g, or t
  misc_feature (273)..(273): n is a, c, g, or t
  misc_feature (292)..(292): n is a, c, g, or t
  misc_feature (301)..(301): n is a, c, g, or t
  misc_feature (308)..(308): n is a, c, g, or t
  misc_feature (340)..(340): n is a, c, g, or t
  misc_feature (349)..(349): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (364)..(364): n is a, c, g, or t
  misc_feature (379)..(379): n is a, c, g, or t
  misc_feature (408)..(408): n is a, c, g, or t
  misc_feature (411)..(411): n is a, c, g, or t
  misc_feature (413)..(413): n is a, c, g, or t
  misc_feature (437)..(437): n is a, c, g, or t
  misc_feature (497)..(497): n is a, c, g, or t
  misc_feature (508)..(508): n is a, c, g, or t
  misc_feature (510)..(510): n is a, c, g, or t
  misc_feature (512)..(512): n is a, c, g, or t
  misc_feature (516)..(516): n is a, c, g, or t
  misc_feature (521)..(521): n is a, c, g, or t
  misc_feature (524)..(524): n is a, c, g, or t
ccaggtcattccaactatcgcagttaccatagccatcgtgcccaccacctcctgggtgataggaaccgcaactcgccttcctacacactgaaattcaggactgctgaggaagcccagcgtggaagactcgctcccaaaggctcccagacntcaccatgaaagcttctgtctgggcccctgcagccctcgaagtncatgangtcgacatgcagcctgagggtgaantaaagaccaacgggnntnctnggcagactgtccccatcaccagaggantggaggatgacaagggctnccagccccntcaatcntgtggagacccaagagataggcagacagctgntgggcagancncngnagccacccnggtcaccacccagantcgggagtgacagagataaggggaccagnctntncgctttccaagagaaaactggagntcctacttggagagcctgagagaattaagaggaagaagaagtaacaaagctgagcacacntctggggctgntntncagntcctntcntcccctcggtggggacaaggttcccaagtgcaaataaaaacggcaccacaaggaggtgcccgtttttg

SEQ ID NO: 5562 - DNA, 539 bp, Mus musculus
  misc_feature (335)..(336): n is a, c, g, or t
  misc_feature (349)..(349): n is a, c, g, or t
  misc_feature (355)..(355): n is a, c, g, or t
  misc_feature (377)..(377): n is a, c, g, or t
  misc_feature (384)..(384): n is a, c, g, or t
  misc_feature (386)..(386): n is a, c, g, or t
  misc_feature (392)..(392): n is a, c, g, or t
  misc_feature (399)..(399): n is a, c, g, or t
  misc_feature (414)..(414): n is a, c, g, or t
  misc_feature (429)..(429): n is a, c, g, or t
  misc_feature (448)..(448): n is a, c, g, or t
  misc_feature (456)..(456): n is a, c, g, or t
  misc_feature (487)..(487): n is a, c, g, or t
ggcggacctttccttcaagaggagtaacgcagcaggaaaccttgggagctacaccacttacaaccagacgggatacatgccttcctttctcaagaaagaagtgggatcagctggccagaggatccaattggcacctttaggtgcgtcggcttcggactatacctggagcacaaaaactggacgaggccagttttcgggacgaacttacaaccccacagccaaaaatctcaatattgtgaaccgcacacagccagtcccctcggtacacgggaggacagactgggtggctaagtatggaggccaccggtaggagaggtggaagccctgactcattnntccgtagaggacnatcaanccccttgatcccgggagccctntacagantntatttntaccganttccacaagacgcanacaactgcgggcgcntcaaagagcggagggcagntcccgatngcttccttttccagaaatgcaatgcattttnttaacttgtggccagcagtgctgacgcagcaccgtgctgagactttttgaga

SEQ ID NO: 5563 - DNA, 497 bp, Mus musculus
  misc_feature (225)..(225): n is a, c, g, or t
  misc_feature (230)..(230): n is a, c, g, or t
  misc_feature (234)..(234): n is a, c, g, or t
  misc_feature (245)..(245): n is a, c, g, or t
  misc_feature (247)..(248): n is a, c, g, or t
  misc_feature (250)..(250): n is a, c, g, or t
  misc_feature (252)..(252): n is a, c, g, or t
  misc_feature (255)..(255): n is a, c, g, or t
  misc_feature (258)..(258): n is a, c, g, or t
  misc_feature (266)..(266): n is a, c, g, or t
  misc_feature (304)..(304): n is a, c, g, or t
  misc_feature (365)..(365): n is a, c, g, or t
  misc_feature (433)..(433): n is a, c, g, or t
ctcccaccttggcaatgtcagaaagatggtaactacctttcggttttctgcatttgaaactgtgagatctgtgagcgggtgcatctaagccgggtatctttcttagaagcaaacctctctccagtctctatcagagtctgcccgtctcgttttagtcctgttgttggaccttgaccaaactgggaactcacgatgactgtctgactctagctcggtgagttccanccttncatncaccagggttntnntntncgnctncagctttnaaggacacggtttgcttgaaaccgtatctgatgcttgnccatctgactctcctaactcctgttcccgtgtgtaactacctgacacaaaggtgaaacgtnccagctgctcctcaggcaaacccttgctgctgccggtcactgactagcctctgaccctcacattaganccgcagggcaaatgcactcagttgccacagcagagtttcatgcagctcgttgttcctactttta

SEQ ID NO: 5564 - DNA, 272 bp, Mus musculus
  misc_feature (26)..(26): n is a, c, g, or t
  misc_feature (52)..(52): n is a, c, g, or t
  misc_feature (70)..(70): n is a, c, g, or t
  misc_feature (167)..(167): n is a, c, g, or t
  misc_feature (169)..(169): n is a, c, g, or t
  misc_feature (188)..(190): n is a, c, g, or t
  misc_feature (196)..(196): n is a, c, g, or t
  misc_feature (230)..(230): n is a, c, g, or t
  misc_feature (238)..(238): n is a, c, g, or t
gaatcttcttatagcacatgtcctgngtgggaataggccctaccgaggaagncatggctgattcagggcnttgttcccttttctcttcagacaacgactcttggtagagaactgaggcggctgcactgctaccaagtgtccaagaggagcagcaggctggagggctntnctgctaaaagtgcagaaannnaaagcngctgaacaataattttcctttagagttttggttnaagttttnatttttgttctttgagttattgttatgttattta

SEQ ID NO: 5565 - DNA, 567 bp, Mus musculus
  misc_feature (308)..(308): n is a, c, g, or t
  misc_feature (337)..(337): n is a, c, g, or t
  misc_feature (340)..(340): n is a, c, g, or t
  misc_feature (372)..(372): n is a, c, g, or t
  misc_feature (432)..(432): n is a, c, g, or t
  misc_feature (434)..(439): n is a, c, g, or t
  misc_feature (441)..(442): n is a, c, g, or t
  misc_feature (506)..(506): n is a, c, g, or t
  misc_feature (517)..(517): n is a, c, g, or t
agagacggaaactacacctgagccccgagcactgtagtaacttttatgtggagcagtatgggaaaatgtttttcccaaacttaacagcttatatgagctctggacctcttgttgctatgatattagctagacataaggccatctcctactggaaagaacttatgggaccaagtaacagtttagtagccaaggagacacacccggacagcttaagggcgatatacggtacagacgagctcaggaacgcacttcatgggagcaatgacttcgctgcctcagagcgagagatcaggttcatgtttccagcngtgattattgaacccattccaattggacnaanccgctaaggactacataaacttgtacgtagcnccaaccctacttcaaggactcacagagctttgtaaggaaaagccaccagacccttacctntnnnnnncnntgattggctgatgaaaaataatcccaacaaacctaaactttgtcatttcccagtgacagaaganccttagattgntcctcagagcgagagccaagttaccttactgtaagaagccgctccccatg

SEQ ID NO: 5566 - DNA, 472 bp, Mus musculus
  misc_feature (119)..(119): n is a, c, g, or t
ttctgccatcgagctgctctcaatatctccttccaagagctgggctgggaccgctggatcgtacaccctcccagtttcatcttccactactgccatggtagctgcgggatgcccacatntgacctgcccctgccagtccctggggtgccccctaccccggttcagcccctgtttttggtgccaggggccaagccctgctgtgctgctcttccggggagcatgaggtccctacgcgtccgaaccacctcagatggaggttactctttcaagtatgagatggtacccaaccttattactcaacactgtgcttgtatctaaaagcacctccgcctcctcctcccatagccgatggccacagtcaattcaccaccccagggtcctcagctaggaggaggacagagtgtggaaagtagacagtttccacttccttttccctacatctttcagtatgagggatccatatcctgctcca

SEQ ID NO: 5567 - DNA, 516 bp, Mus musculus
  misc_feature (146)..(146): n is a, c, g, or t
  misc_feature (279)..(279): n is a, c, g, or t
  misc_feature (285)..(285): n is a, c, g, or t
  misc_feature (287)..(287): n is a, c, g, or t
acagtgatgtggtacagctccgggagcggcactggcggatattcagtctctcagggaccctggaaacagttcgaggacgaggggtggtgggcagggaaccagtgttatccaaggagcagcctgcattccagtatagcagccatgtntctctgcaagcttccagtgggcacatgtggggcacatttcgttttgagagaccggatggctcccactttgatgtccggatcccaccattctccttggaaagcaataaagatgagaagaccccaccctcaggcncccttntncactggtaggccagctgaggcccaggttggccctaagaacaacagctctcaacccataattgctgcagaactctaaacctctccctactgtgaaattctttttttggagggagattgtaacttttcttggaagacccacataagactcctccaaggttggccttggccgctgtccaggacaccacgttccagcaaagctgtcagggaactgttcagttgtcccatgttt

SEQ ID NO: 5568 - DNA, 346 bp, Mus musculus
ttcctcagaggctggacatcttggggcactggtaacagtgagcagcactggactaagttccgggtctctctaccctccgcccagtgtagaggaggccagtgtagagttggactgacctgactatagacacggattacccaccagcacttctggcttcactaggcctggagaagagtgaggcaaaaccagtcaggtttctgggaactgtgggcttctgagcattgagcaaagcctgtcaagcatccagaccacaggggcaggaattcagccaagaagcagcttaagttatggtcagtgaccaagtcaagctgcttttggagcttctttcaggccaacaggagccaga

SEQ ID NO: 5569 - DNA, 327 bp, Mus musculus
gaaggacgcattcagcttactagcatattcggatccttggaatagtccagttggaaatcagcttgacccaattcagagagaacctgtgtgctcagctcttaacagtgcaatattagaaacccacaatctgccaaagcaacctccacttgccctagccatgggacaggccacacagtgtctaggcctgatggctcggtcaggagttgggtcctgtgcatttgccacagtggaagactacctacattagctatgcacttcaagagctcacactcacattgtggcaaacagtcaacatggaagtagaccggctctgctgatttgaaattt

SEQ ID NO: 5570 - DNA, 535 bp, Mus musculus
ccgatgcgccttcaaaacagtgtcaagcgtcagccttgtttcagtttgcagagatctcttcaagcacttcgcagttgggtggcactgagcctgtgaaacgctgtggaaattctgcactctttcaactggcagagatgtgtctggcatcagagggggtgaaaatggaagacacaaaactaataaaatcaaaagagtcagatggaggaagaattgaggaaatagaaaaggggaaggaagagagaggcacagaagtggagaaaaccactgaaacttcgttccagaaggaagcagaatttgggaagtcagctaagggcaacgtgagagagtctaaggacttaagagacatcgaacagctacagatggataatgtcatggctatcaaagtggaagaccccaaagaaattaggaaggagccagaggatgatcagaaatacagtcacttccctgatttttcttactctgccagtagcaagataataattagtggtgtccccagtagaaaggaccacatgtgccatcctcacggaattatgat

SEQ ID NO: 5571 - DNA, 559 bp, Mus musculus
ggcattttggatgccaagccaccaaagaaaaaagtgaaatccaaggagaagaaagtttccaaggagaagtgctcagacatcaccaaagagtctcgacctccagatttccttagcatttctgccagcaagagtgttcctggggaggtgccagagggcataaaagcagaacccttgacccctaccgaggatgcactgccacctagcctaccaggacaggctaagcctgaggatagtgattgtcacagaaaaacggagacctgtggctccaggaaatctgagaggtcttgcaaaggtgctctttataaaaccctggtgtccgagggcatgctcacctctctccgagctaatgttgacagagggaaacgaagctcaggaaaaggaaactcctctgatcatgaagggtgttggagtgaagagagctggacatttaatcagagtgggaccagtgggagcaagaagtttaagaagaaactaagggaagactccttccttggttctgcgaagctggatgaagaatttgaaaagaaattcaacagcctccctcaatatagtcctatta

SEQ ID NO: 5572 - DNA, 435 bp, Mus musculus
  misc_feature (313)..(313): n is a, c, g, or t
  misc_feature (320)..(320): n is a, c, g, or t
  misc_feature (359)..(359): n is a, c, g, or t
  misc_feature (389)..(389): n is a, c, g, or t
  misc_feature (391)..(391): n is a, c, g, or t
  misc_feature (396)..(396): n is a, c, g, or t
agcacgtattcagcctctcggagaaggatcttcgtcaacaagcacagaggtgggctgaaacctacaggctggatgtcctagaggcagtagctccggagaggccccgctgcggctactgcaacgcagaggcctccaagcgctgctccagatgccagaatgtgtggtattgctgcagggagtgtcaagtcaagcactgggagaagcacggaaagacatgtgttctagcagcccaaggtgacagagccaagtgaaggccgtagctgccgagggccgacagaagagcgcacccagactgtgactgagcttcagggantcgtggntcgcccctgtcagacctcaatttccctggtgagcacagntgagtcaagtagagctgcaaaccaccacantnttcanttcctgccccacccagcgaatacgcagaggaccaggcca

SEQ ID NO: 5573 - DNA, 512 bp, Mus musculus
  misc_feature (321)..(321): n is a, c, g, or t
  misc_feature (346)..(346): n is a, c, g, or t
  misc_feature (401)..(401): n is a, c, g, or t
  misc_feature (403)..(403): n is a, c, g, or t
  misc_feature (417)..(417): n is a, c, g, or t
  misc_feature (428)..(428): n is a, c, g, or t
  misc_feature (451)..(451): n is a, c, g, or t
  misc_feature (466)..(466): n is a, c, g, or t
  misc_feature (472)..(472): n is a, c, g, or t
  misc_feature (475)..(475): n is a, c, g, or t
  misc_feature (477)..(477): n is a, c, g, or t
atggtcggacttgtggtaggccttattcgcctgatcgctgagtttgtatacggaacaggcagctgcgtggctcccagtaactgtcccaagattatctgtggagtgcactatatgtactttgccatcatactcttctttgtgtccataatagtaatcctgggagtctccttcctaacggagccgattcctgatgttcacctgtaccgcctatgctggagtctttggaacaacacagaggagcggatagacttggatgcagaagaattggaaactcaagaagaagctggtggtgctcttgaagaagattctgagcaatcccgnggctgtctcaagagggcatgctgcntattgtgtggtttgcagaatacagggcccaagctgaccaaagaagaggaggcagntntgaggcagaagttntcagacacatntgagaagcccttgtggagaaccntcatgaacatcaatnccgtcntcntnctgggtgtggctgtctttgtccatgcctattttgc

SEQ ID NO: 5574 - DNA, 481 bp, Mus musculus
  misc_feature (161)..(161): n is a, c, g, or t
  misc_feature (267)..(267): n is a, c, g, or t
  misc_feature (346)..(346): n is a, c, g, or t
  misc_feature (396)..(399): n is a, c, g, or t
tgaagctctaggagtgcctgcttgccttcctggctgctcactgccccagggatgtgcctgctgccaccaccacctacaccacctgcacctgtgccacggaagtctgtgacaagccttgaccactctctggattggtgtgccctgagcaagtggcctgcctntgccctctcctgctgcctccagcacagcaggttttggagttcatttgacactggtagagtttctacacatttggagcaggcagagggacctatggccagatgccangggaggtacccagagaccccacagcgtggttcatgcagatcgtgtgtatcagtcctgagtcaaaatggccaaggacctnctgacaacagtgccaccttctcaccattccacctcccctccgctcctggnnnncccagccagcccaggagaaattcgacattggaactgtttctgtcgatcctcctgcccctccaatggccttgaagtctctgct

SEQ ID NO: 5575 - DNA, 535 bp, Mus musculus
  misc_feature (348)..(348): n is a, c, g, or t
  misc_feature (392)..(392): n is a, c, g, or t
  misc_feature (438)..(438): n is a, c, g, or t
gacaggtgctctagttcacagttacaggggaacaggtggaatttttgaagtttgctggaacgcagcaggagacaaagttggagccagtgcttcggacggttcagtttgtgtcttagaccttcggaaatagcgttactagttggaagccatggaccgactatgaatgtgtacatagccacaagactatccctgacccatatactgctatagtcccacttgaaccatggccagtccactacagccaaatctaagagaaatatatacatgcagtatatatgaacacagctgtaccctgaagatgacagtctcatcccagcttgtgaattctgctcaccaagtgctgggatntaacctgctgtgcccctaagtagcgtttagaagtttggatatgnaaaccagaagagaaggaatatgcgttataagagcaaaccacacatntcccagttttgaatattaatgacagccttgtttccccctttgaatcagcagacacatggattatattctttttcccctcagtagtgcgcagtttgta

SEQ ID NO: 5576 - DNA, 65 bp, Mus musculus
ctattcacaggagccaatgtccatactgacttgccttccactgagcctacactagccagtgtggg

SEQ ID NO: 5577 - DNA, 358 bp, Mus musculus
tattccctagagaactccctttggcccagggcctgagctttgtggaaggtggattacacttctcagagagaggcctgctccagctattcacaggagccaatgtccatactgacttgccttccactgagcctacactagccagtgtgggtctacctccacgggctcagatgcccaccgatctccccaggcattctcatacagagcacagaagctgccaaccacacggacaaaactcaacatcttggtgacttaagatttgggcctctgtgattggccccttccaagggaacctgtgacacacagtggacctggagacagctgctgtgcctagcctacccttggctggacagcagtccag

SEQ ID NO: 5578 - DNA, 402 bp, Mus musculus
  misc_feature (230)..(230): n is a, c, g, or t
gtaccgcagcatcatcctggctgagatctcccagaaactacgggaaatggaggacattgatcgcaggaggagcaaggagctgaggaaagccctcgccaccacttaacccaagacaagggcgggctcacccagtgagactgccaacccggcacaacagccagaaccagtgcccttcactctgccacacagcacccatcccaggcctgcccacccatgggggctgggccacnccagatcatgacatggctttgtcctgtggcatgaaacagtgtcctagtcactgcctggggatgcagaagccgcagagtagtgtcatagctactgtgtttctttctctagggaaaagccccaggcacaccatggcgatgcccaggctcacccaccttggacatgtgcctaagg

SEQ ID NO: 5579 - DNA, 468 bp, Mus musculus
  misc_feature (167)..(167): n is a, c, g, or t
  misc_feature (189)..(189): n is a, c, g, or t
  misc_feature (213)..(213): n is a, c, g, or t
aggtattgcttaactgccccaaactataggcttaagtctttacagaaaaaggcacctgctcctgcaggaagaataacagttccaaggttaagtgttggttcagtttctagtagaccaagtactcccaccctaggtacaccgactccacaaaccatgtctgtttcaanctaaagtaggcaccccaatgtnccctcacaggacagaggtttacangtacagatgcctgcttctcagtcccctgctgtaaaagcttctatacctgcaacatcaacagttcagaatgttcttattaatccatcgttaattgggtccaaaaacattcttattactactaatatggtatcacagaatacagccgagtcagcaaatgcactgaaacggaaacgtgaagacgatgatgatgacgatgatgacgatgatgatgatgactatgataatatgtagtctagccacgatgcatgtaacctg

SEQ ID NO: 5580 - DNA, 566 bp, Mus musculus
  misc_feature (280)..(280): n is a, c, g, or t
  misc_feature (309)..(309): n is a, c, g, or t
  misc_feature (317)..(317): n is a, c, g, or t
  misc_feature (326)..(326): n is a, c, g, or t
  misc_feature (337)..(338): n is a, c, g, or t
  misc_feature (342)..(342): n is a, c, g, or t
  misc_feature (351)..(351): n is a, c, g, or t
  misc_feature (372)..(372): n is a, c, g, or t
  misc_feature (408)..(408): n is a, c, g, or t
  misc_feature (421)..(421): n is a, c, g, or t
  misc_feature (423)..(423): n is a, c, g, or t
  misc_feature (444)..(444): n is a, c, g, or t
  misc_feature (446)..(446): n is a, c, g, or t
  misc_feature (448)..(448): n is a, c, g, or t
  misc_feature (450)..(450): n is a, c, g, or t
  misc_feature (452)..(452): n is a, c, g, or t
  misc_feature (454)..(454): n is a, c, g, or t
  misc_feature (456)..(456): n is a, c, g, or t
  misc_feature (459)..(459): n is a, c, g, or t
  misc_feature (464)..(464): n is a, c, g, or t
  misc_feature (466)..(466): n is a, c, g, or t
  misc_feature (485)..(485): n is a, c, g, or t
  misc_feature (507)..(507): n is a, c, g, or t
  misc_feature (524)..(524): n is a, c, g, or t
  misc_feature (541)..(541): n is a, c, g, or t
accttcaaaaggtgttggagagcgaggaaggccgcagggagtatctggccttccccaccagcaagagcccaggtgctgggcagaagggccggaaggatctgctgaagggcaatggccgccgcatcgactacatgctgcacgccgaggaggggctgtgccctgactggaaggctgaggtagaagaattcagttttatcacccagctgtccggcctgaccgaccacctccccgtggccatgcggctgatggtgtctgcaggggaagaggaggcatagaccanccatgccacggtctcgagcagtagggccntctgccgncccttcaanccacagcccgnncctnggctgtgtnccctccattgagcacccagtnctgggggaaggagggcaggggacagggaaggacgancccatcaatcccntncaagcctgggaaccaggctgntntntncntntnggnccaantntgcggacagaggacttggnccagcctgggagcccccggctncctgaccagtgccattntttcagtcacgattttntacagaaatacacagcacaacctag

SEQ ID NO: 5581 - DNA, 502 bp, Mus musculus
  misc_feature (256)..(258): n is a, c, g, or t
  misc_feature (264)..(264): n is a, c, g, or t
  misc_feature (266)..(268): n is a, c, g, or t
  misc_feature (271)..(274): n is a, c, g, or t
  misc_feature (276)..(281): n is a, c, g, or t
  misc_feature (286)..(286): n is a, c, g, or t
  misc_feature (297)..(297): n is a, c, g, or t
  misc_feature (377)..(377): n is a, c, g, or t
  misc_feature (407)..(407): n is a, c, g, or t
agtaagctggttcttgacctttcctgtgaaatatccttgattaagtctgaatgccatcgtgttaaaatgcaaagagctggtttgcaaaatgaattgttcttcacattttcagttgcatctatagacacagaaaaaggatccaagccatgtacagaccatagttgtgaagcttccaaaagattatctaaggctaaaaatctcatagagagattcttcattcagcaagtagaagtcctgggcaagcgtgcggagccannncctganannnacnnnntnnnnnnaaccnttcagatggtntgggtgaaccgctgctttccagggtatggcataaatgtcctgaagcatcccaagtgcccagagtgctgtgtggtctgcanccctggatccttcaatccccgggatggaantcattgcctccagtgcaacaacagcctggtgtatggagcgaagacatgcatgtaggccagggccttgtgggacccagcagctcattcaacataaa

SEQ ID NO: 5582 - DNA, 474 bp, Mus musculus
  misc_feature (348)..(348): n is a, c, g, or t
  misc_feature (358)..(358): n is a, c, g, or t
  misc_feature (385)..(385): n is a, c, g, or t
ctgcatcagtggaccaagggtggcccagggcacggctgctgtgattgtgaatacaaagtataaggaaacaaagtccagtttaaggtcttattgcagagcaaaatgggagatgctgaagcaggcaagaagatctttgttcagaaatgtgctcagtgccacacggtggaaaaaggcgggaaacacaagacaggtccaaatctctggggcctctttggtcgaaagacaggacaagcaccaggattttcttacacggatgcaaacaagaacaaaggtgttatctggtcagaagaaactttgatggaatatttggagaacccgaagaaatatatccctggcactaaaatgatntttgctggtntcaaaaagaagagtgagagagaagatntcattaagtatttaaaacaggccacatcctcatgaagtgaagtagtatttcagcttcaaaatattcgctaccagtttcaaatattgtgt

SEQ ID NO: 5583 - DNA, 475 bp, Mus musculus
  misc_feature (325)..(325): n is a, c, g, or t
  misc_feature (329)..(329): n is a, c, g, or t
  misc_feature (339)..(339): n is a, c, g, or t
  misc_feature (341)..(341): n is a, c, g, or t
  misc_feature (348)..(348): n is a, c, g, or t
  misc_feature (353)..(354): n is a, c, g, or t
  misc_feature (359)..(359): n is a, c, g, or t
  misc_feature (362)..(362): n is a, c, g, or t
  misc_feature (398)..(398): n is a, c, g, or t
ctaagtcaagtgtgctcccgtgtgagctcgcctgcagaactcagtgtgccctgaagcagtgctgcgggacacggccacaggtgcattctgggaaggatgcagagaaggcgccaacagttagcatttcttgtttagaactcagtgagaatctagagaagaaggccaggaggactaaagctgaaggcagtctccctgctgtggtgatagagattaaaaacgtgccaaacaaacagcccgaatcatctttgtgagtcttgaaaaagatgtgatatttgacttttgcttttaaactgcaagagaaaatagactccattgaaatactaantttnccaagtagtntnattgaantcctnntctgntcncacagtttaattctatttttgtaagaacataatggnactgcctaatagagagtgctacattgcacccttgtgattcttagtgcatagtgcagctatgctggaacacgtttgaa

SEQ ID NO: 5584 - DNA, 571 bp, Mus musculus
  misc_feature (86)..(86): n is a, c, g, or t
  misc_feature (100)..(100): n is a, c, g, or t
  misc_feature (309)..(309): n is a, c, g, or t
aaatgcctggagtctatgcgtcaaggtgaggaggcaaagattcaccttcctggatcctctgcacctcttgctaaactcagactggnattccttcaccaantggccgggactcctgggagatggaggctatggagaaggaggctctggccaaagaagaacacagaaggggtacagaactgtttcgagctgggaaccctcaaggggctgcccgatgctatggacgggctctccgactgctgctgacgttgcccccacccggccctcccgaacgaactaccctttatgccaatctggctgcctgccagttgntgctaggacacccccagttggcagcccagagctgtgaccgagtgctggagcgggagccgggccatttaaaggccttataccgaaggggggttgctcgggctgccctcggggacttggaaaaagccactgctgatttcaagaaagtgctagcagtagatcccaaaaaccgtgcagcgaaagaggagctggggaaggtggtcattcagggaaggaaacaggatgcagggctggctcggggactgcgcaagatgtttagctgatt

SEQ ID NO: 5585 - DNA, 525 bp, Mus musculus
gcagaacttttcattgccttgggttcttattggtgggatgaggcagtgctggggttgaacccaggtacctcacacaaagtgctatagcactgaactttatacctcagtccatgaggtgttctgtgtactcattgattcacagtttttgtgtatagatacatgaaattatatcgcatagcttccactaacctaagacctgtcctccctccatccctaccgatagccctaccatcaccagaatgtttttatcattttaagaacatttcataaacagaattgtacttttaaaaacaattttttatttagctttctaccttttgaaatgtactgtcttactccaaataatatcctgagatctatccaagtgttgggtgtgttggtaattaattcttttcttattctttacttccactccccccccaagttgtttcaaattgttgtttccaaagggggggggaacgctcatcgacttgaaagatttaggtttctgctgaagttaaaatgtggttgccctgtattaaagct

SEQ ID NO: 5586 - DNA, 287 bp, Mus musculus
  misc_feature (61)..(61): n is a, c, g, or t
  misc_feature (146)..(146): n is a, c, g, or t
accactcttgcctcacaacaagtgagcttcagcctgcagagggggaggtgtgaagcaagcntgactctccttccctccaaccccaccctctttctgccttccaatgaaccccatttggtgtgggcagcactggcttccttcccttntctcctgagctgccaaatcgaagccagtctctaacctgggtgaataccgtttatttaaaaatgccaaacatagcctagatatagaatatggtcatgtatctatcgccttctctatttaatagttttctgctttctaaccaa

SEQ ID NO: 5587 - DNA, 528 bp, Mus musculus
  misc_feature (477)..(477): n is a, c, g, or t
gcctaaggtcattgttgtctgggtagggacaaacaaccacgaaaatacagcagaagaagtagcaggtgggattgaggctattgtacaacttataaacacgcggcagccacaggccaagatcattgtgctgggtctgttacctcgaggtgagaagcccaaccctttaagacaaaagaatgccaaggtgaaccagcttctcaaggtttccctgccgaagcttgccaatgtgcagctccttgatatagacgggggcttcgtgcactcggacggtgccatctcctgccacgacatgtttgattttcttcatctcacaggagggggctatgcaaagatctgcaaacccctccatgaactgatcatgcagttgctggaggaaacaaccggaggagaagcagaccaccattgcttgactggcccatcagtgttacagcatcccgcttcctcagatcagttagaccactggcactacagaatccntttcttaaggcactttgcattgtacaatgttcctggatgcttgtatgtttg

SEQ ID NO: 5588 - DNA, 457 bp, Mus musculus
  misc_feature (383)..(383): n is a, c, g, or t
  misc_feature (398)..(398): n is a, c, g, or t
  misc_feature (400)..(400): n is a, c, g, or t
  misc_feature (432)..(432): n is a, c, g, or t
gtcaagattcaaacagttgcagccaaacaaggtgaatccgacccagaaaggaaagaaacaagacagaaagtagatgatgacagaaaacatgagatagaagctgctatagtgcgaataatgaagtctaggaagaagatgcagcacaatgttttagtagcagaggtaactcagcaactgaaggctcgattcttaccaagtccagttgttattaagaaacgtattgaaggacttattgagagagaatatttggcacgaacacctgaggatcgcaaagtatacacatatgtagcataaaatgcattcagaaatttgatttattcttggactgtactcttcgcatggactgggaagttcttttaaatcatactattaagacgaccatntcttctgttaaattncnagtacgtgttatagaccactcagatcaagccntctactccctctgagagttttcaac

SEQ ID NO: 5589 - DNA, 441 bp, Mus musculus
cagagctgcacccagtagaactaaagcctttccaggattaccgaaagctgagcagcaaccttgggggtcctgggtcgtcacggactcccccatctggaaggcccttctctggtctcaattcccgtctcaaggccccaccttccacctacagtggagtattccgaactcagcgcattgacctctaccagcaggcttccccaccagatgccctgcgctggatgccgaagccttgggaacgggcagggccaccttctcgagaagggcctccccgaagagcagaggagcctgggtcccggggggagaaggagcctggattgcccccaccccgctgagggagttccccttgacccccatccccggggcttgtatatagattataaatatataagggggaaaggggtgggtggggaggggttgtgggtctggagtctcacttcccct

SEQ ID NO: 5590 - DNA, 321 bp, Mus musculus
atgttgtgtctacagagcccacgtctagggataccaagcagtcctgtgttctcagaggaagtcgtacacattgtgccctagcaaaggccctcaggtgaaagagcagagctgtgaagaactatctatcaggtttggagttcaatgacactcgagttttggtccattctgaagccatggattaatcttaaagaatcagtcagcccttttcaatggctcctttatatttttatcaattttcttcatttatctgaccccaaagccctgttatgccacagaaatggagctctacagccattaagacacattacaggccaaggagca

SEQ ID NO: 5591 - DNA, 343 bp, Mus musculus
tcccatcaacaattctgtcattcctgttgactataagagttttaaagccacttggactgaggtggtgcagatcaatcgggagcggtggcgagccaaggtacccaaagaagaaaaagccaagaaggaagctgaagagaaggctcgcctggctgctgaggaaaagcaaaaggaaatggaagccaaaagccaagctgaacaaggcacaaccagcaaaggcgagaaaaagacatcaggagaagccaaaagtcaagtcaatggaacacgcaagggtgataaccctcgtgggaagaactccaaaggagaaaaggcaggcgaaaagcagcagaacggtgacttgaaagac

SEQ ID NO: 5592 - DNA, 543 bp, Mus musculus
  misc_feature (345)..(345): n is a, c, g, or t
  misc_feature (377)..(377): n is a, c, g, or t
  misc_feature (399)..(399): n is a, c, g, or t
  misc_feature (403)..(403): n is a, c, g, or t
  misc_feature (423)..(423): n is a, c, g, or t
  misc_feature (488)..(488): n is a, c, g, or t
gaccaaaccgttctatcaggcattaatccaagaaaaacctttggacagctgttctgtggctcattggataatttcgggatcctatgtgtcggcttataccgtatgattgatgaagaggaacccagccaagaacacaaaaggtttgtgatcaccaggccatccaatgagtgccacctgctgccctcagatctcgtgttttgtgccatccctttcaacaccacctgtggcaaatcagacagcagtcctttcaatttcaggctcaaaacaactctacaaacgcgacgacgccattggcccaggggtcgaatttcttcgattcgcaccatgccgacgagtcccacgatntttacccagtcgacgacacgggagagaggtgntctcagcaccaccactcccgantctntcctttggacacgttagatnccagtgatattgttcaagaaaaataaaaacagaaacatgctatttttgtgccagttgcttagtgntcagcgagttggcaagcccacggtgctgtggaagggaccatcttatcccagtgaa

SEQ ID NO: 5593 - DNA, 515 bp, Mus musculus
  misc_feature (38)..(38): n is a, c, g, or t
  misc_feature (45)..(45): n is a, c, g, or t
  misc_feature (49)..(49): n is a, c, g, or t
  misc_feature (301)..(301): n is a, c, g, or t
  misc_feature (310)..(310): n is a, c, g, or t
  misc_feature (312)..(312): n is a, c, g, or t
  misc_feature (315)..(315): n is a, c, g, or t
  misc_feature (318)..(318): n is a, c, g, or t
  misc_feature (343)..(343): n is a, c, g, or t
  misc_feature (345)..(345): n is a, c, g, or t
  misc_feature (354)..(354): n is a, c, g, or t
  misc_feature (366)..(366): n is a, c, g, or t
  misc_feature (374)..(374): n is a, c, g, or t
  misc_feature (390)..(390): n is a, c, g, or t
  misc_feature (392)..(392): n is a, c, g, or t
  misc_feature (397)..(397): n is a, c, g, or t
  misc_feature (466)..(466): n is a, c, g, or t
  misc_feature (488)..(488): n is a, c, g, or t
  misc_feature (490)..(490): n is a, c, g, or t
ggtggtgggtacacaatactgctcagaaggggtaaagntcccccnaatntataagagacaatgagattgcttttaagtggaagccatttaaatttaaatttttttaatttataaaaagctaggtgaagaacatgaacgtttctgtactcattttaatccaaaagacctagaacttaaatggacattaaagtcacccagattaagccaaaacctacattttgtattttaaagtctaactggtcaacaaaaatagattggcgctatgggcccataaagtgtgactggctttgttcccaaaatnttttatacntngangantcaaccttccttctttcacactttntntccatattntttggtttattngtggtttnttagttgactcatcantnatagntctttttattatattaactgcttaatccattttgatgtaagggtaaaagtttaatttgatgaaaaaaanttgtgtatgaagaccctattgntnttctggagcttgtacattcaagaat

SEQ ID NO: 5594 - DNA, 464 bp, Mus musculus
  misc_feature (139)..(139): n is a, c, g, or t
  misc_feature (172)..(172): n is a, c, g, or t
  misc_feature (208)..(208): n is a, c, g, or t
  misc_feature (211)..(211): n is a, c, g, or t
ggtgacgccttctggaacagcagcaagtatggcatggtgacgtaccttctgaggatgatgaccagttgggccattgtctgcagcgtttggtacctgcctcctatgactcgagagaaagatgaagatgctgtgcagtttngctaacagagtgaagtctgccattgcccggcanggaggattggtagacctgctgtgggacggtggattnganagagagaaaaggtgaaggacacattcaaggaggagcagcagaagctatatagcaagatgatagtcggaaaccatgaggaccgcagccggtcctgagcctccgtcttgtgctggctgaagccgccacctctaaatcctgaagtgtgagccagctgcagttgttgctgccacagcctctaccgtcatccccgccacccactgctgcatccttccggactctggccctcaggctgttctggactccaggactggag

SEQ ID NO: 5595 - DNA, 377 bp, Mus musculus
gaagctattcgagagggaccctgacaagaggctgggagtaacaggaaacatcaggattcacccctttttcaagactatcaactggtccctcctggagaagcggaaggtggagccgccctttaagcccaaagtgaaatccccttcagactacagcaactttgacccagagttcctgaatgagaaacctcagctttccttcagtgacaagaacctcatcgactctatggaccaggaagccttccatggcttctcctttgtgaatcccaagtttgagcaattcctggacatttaattaagctcccagacctgctttaaacgccctggcagagtaggcccgtctgccctggtttgcaccgcattgcccgtggagaacagtg

SEQ ID NO: 5596 - DNA, 455 bp, Mus musculus
tggcccagtgatcatgtctcttgaggagaagatggaggctgatgcccgctctatctacgttggcaatgtggactatggtgcaacagcagaagagctggaagcccattttcatggctgtggttcagtcaaccgtgttactatactctgtgacaaatttagtggccatcccaaagggtttgcatatatagagttctcggacaaagagtcagtgaggacgtccctggccttagatgagtccctgttcagaggaagacaaatcaaggtgattcccaaacgaaccaacagaccaggcatcagcacaacagaccggggtttcccgcgctcccgataccgtgcccggactaccaactacaacagctcccgatctcgattctacagtggttttaacagcaggccccggggtcgaatctacaggggccgggctagagcgacatcatggtattccccttactaaa

SEQ ID NO: 5597 - DNA, 39 bp, Mus musculus
ccgggctagagcgacatcatggtattccccttactaaaa

SEQ ID NO: 5598 - DNA, 317 bp, Mus musculus
  misc_feature (134)..(134): n is a, c, g, or t
  misc_feature (154)..(154): n is a, c, g, or t
  misc_feature (156)..(156): n is a, c, g, or t
ggcaaccaggcgaggatcccagataaaggacgatttgctgggctagaaatgtacggaggactcagctcagagttctggtgcaaccggcttgctatgaagggctgtgaagatgaccgagtctccaactggctcanagctgagttccttagcttcnangagggggatttccccaccaagatttgtgacacaaactatatccagtacccaaactactgttccttcaaaagccagcagtgcctgctgagaaaccagaacagaaagatgtcccgcatgaggtgtatgctgaatgagaggtacaacgtgctaagcctggctaa

SEQ ID NO: 5599 - DNA, 479 bp, Mus musculus
  misc_feature (35)..(35): n is a, c, g, or t
  misc_feature (412)..(412): n is a, c, g, or t
agattttactgcagccattgccgagctcggcgggnattctctaaagaaaatagaaatctggaaattacctcctgtgctgttagtgcacctgaaacgattttcctatgacggcaggtggaagcagaagctgcaaacatccgtggatttcccattggaaaatcttgacctgtcacagtacgttattggtccaaaaaacagcttgaagaaatataacttgttttctgtttcaaaccactacggcgggctagacggaggccactacacagcctactgtaagaacgcggcaaggcagcgctggtttaagtttgatgaccatgaagtttctgatatctctgtgtcttctgtgaggtcatcagcagcttatatcctcttttatacttccctgggaccacgcataactgatgtagccacnatagagaggagtaggctgtcggcttattgacgtctccaaattgcagcctcacatctaatgcttacaa

SEQ ID NO: 5600 - DNA, 371 bp, Mus musculus
ctctaggttggtctcagccttgtgatgtttggagcataggctgcattcttattgagtactaccttgggttcacagtctttcagacccacgatagtaaagagcacctggcaatgatggagcggatcttaggacccatcccagcacatatgatccagaagacaaggaaacgcaagtatttccaccataaccagctagattgggacgagcatagttcagctgggagatatgttaggagacgctgcaagccgttaaaggaatttatgctgtgtcatgacgaagagcatgagaagctgtttgacctggttcgaagaatgttggagtatgacccagcgagaaggatcaccttggatgaagcattgcagcaccctttc

SEQ ID NO: 5601 - DNA, 539 bp, Mus musculus
  misc_feature (200)..(200): n is a, c, g, or t
  misc_feature (248)..(248): n is a, c, g, or t
tggacttaaagttgggccccgccatcaagctttgccatcacatagagagaatcaagtttgctttttatgagcagtttgccaactgagaaggacgagcgactgagctgggtctttgaagcacagtgcagcaaacccttcgccctgctctgcaggtgactgcaggagtcctgggctgtcctgtcggcctgcaagtggtggcnttgctatctttgcactttcagggaaggaggacccacactgagaaagcnaaaaacagcacaaaaatggctctcttacagtggaaatatggacttttgtttagaagattccagtttaaaaaaagttgtgagaaaaccgtaaaagtctgaattaccattaatgggacctgaaaacaaagaatgatggtgacagctggacagcaccaatttggttattttcattctgttccttccctctgtagattggactctgttctctgctttctctttcttgaaaagagaggacatagctttaagtcagcactggttgggactgtgcctaaggcacatcagtgcttcatt

SEQ ID NO: 5602 - DNA, 573 bp, Mus musculus
  misc_feature (502)..(502): n is a, c, g, or t
ggtgtgaaaccaatggccatcctctcagtactcctcgccgggcacgagggcataaactgaggaaaatcgcagtggttcaaccagaaaaacaaatactgtcttcaagaactgtccacgagggcctgaagaatcagctgaactctacccactcagtgatgatcaatggaaaatactgttgtccaaagatatacttcaaccaccgttgcttctcagggccatatcttaataaaggaagaattgctgagctgcctcaatgtgtgggacctgggaactgcgttctggtacttagagaggttcttactttgcttatcaacgcagcatacaaacccagccgcgtcctccgtgagctccagctggacaaagactctgtgtggcacggatgtggggaagtcctaaaggccaaatataaaggaaagagttaccgagctactgttgagatagtgagaacagcagaccgagtgactgaattctgccggcaaacatgcatcaagctggaatgttntcccaacctctttggtccacgcatggttctggatacatgttctgagaattgctctgtccttacaaagacca

SEQ ID NO: 5603 - DNA, 478 bp, Mus musculus
  misc_feature (274)..(274): n is a, c, g, or t
  misc_feature (276)..(276): n is a, c, g, or t
  misc_feature (355)..(355): n is a, c, g, or t
  misc_feature (397)..(397): n is a, c, g, or t
tgccgggcctgcgtggacttcaagtcgtggatgcggacccagcagaagcgggacatcaagtttagggaggactgtccacaggatcgggaagaattgggtcgccacacctgggctttcctccatacgctggccgcctattacccggacaggcccacgccagaacaacaacaggatatggcccagttcatacatatattttccaagttttacccctgcgaggaatgtgcggaagacataaggaagaggataggcaggaaccagccagacacaagcnantcgagtatccttcagccagtggctgtgccgcctgcacaatgaggtgaatcggaagctgggcaagcctgattttgactgntcgagagtagatgagcgttggcgtgacggctggaaggacggntcctgtgactagaagattaccagcagttcgtgaggggcatctagcctggttctatgggcaacagcctgattgacgattaaa

SEQ ID NO: 5604 - DNA, 461 bp, Mus musculus
  misc_feature (347)..(347): n is a, c, g, or t
  misc_feature (390)..(390): n is a, c, g, or t
ggaacatctactttgactgcagcagaagttggaataattgagagtattcagctaagaaatttcatgtgtcattcaatgcttggaccttttaagtttggttctaacgtcaactttgttgttggcaataatggaagtgggaagagtgctgtgctcaccgcactcatagttggtcttggtggaaaagcagttgctactaacagagggtcctctttaaaaggctttgtgaaagctggacagaactcagcagatatctcaataacattaaggaacagaggagatgatgccttcagagcaaatgtgtatggtgactctatagttgtgcagcaacacattagcgtggatggaangtcgatcttacaaactaaaaagtgaaaaaggcaccgtggtttntactaggaaagaagagctgattgcaattcttgaccattttaacatccaggtggataatccggtttctgttt

SEQ ID NO: 5605 - DNA, 174 bp, Mus musculus
gaacactggtcacagccgtggccacgagtcctccatgaagaagctcgtggcctgtgtgagtcaagacaacttttccctgtcatcagagggcgaggaagaggaggaggacgaggaagaggaggaggaggaagaagaagaagaggaagaggagcaaatcccggtgaagggcaagct

SEQ ID NO: 5606 - DNA, 426 bp, Mus musculus
  misc_feature (251)..(251): n is a, c, g, or t
  misc_feature (394)..(394): n is a, c, g, or t
tgaagtgttccgtccttgctatcagcactgggcactgtacttgggtgatggctacgtgatcaacattgcacctatagatggcattcgctcatcatttacaagtgctaagtccgtgttcagcacaaaggccttggtgaaaatgcagcttttgaaggatgttgtgggaaatgacacatacagaataaataacaagtacgacacaacataccctcctcttcctgtggaggaggtgatacaacggtcagagttcnctattgggcaggaagtagcctatgacttgctggtcaacaactgtgagcattttgtaaccttgctgcgctatggagaaggagtgtcagagcaggccaaccgagcaatcggcaccatcggattggtggcagctggtattgatatnttcacattcctcggcttgtttcccaaaagaca

SEQ ID NO: 5607 - DNA, 472 bp, Mus musculus
gtctccttcatggacgtgaacagcacctggaggaccgtggaccacctctccgccactgcctgcggctgtctgggctgaggatgatctatctccaagcctttgcacactagacccatgtgttgccctacctggaacagctccaccgggcctcactaaccaggagcctcaactcagcaggatatggaggctgcagagctcaggccccaggccggtgagtgacagacgtcgtcggcatgacagacagagtgaaagatgtcggaaccactgaccaacagtcccaagttgttcatggatcacagctctacagacaggagaaacctcagctaaagagaactcctttgggagaatccagaaatggccctctgtcctggggaatgaattttgaagagatatatatacatatatacattgtagtcgcgttgctggaccagcctgtgctgaaaccagtcccgtgttcacttgtggaagccga

SEQ ID NO: 5608 - DNA, 515 bp, Mus musculus
  misc_feature (107)..(107): n is a, c, g, or t
  misc_feature (124)..(124): n is a, c, g, or t
  misc_feature (126)..(126): n is a, c, g, or t
  misc_feature (135)..(135): n is a, c, g, or t
  misc_feature (168)..(168): n is a, c, g, or t
  misc_feature (329)..(329): n is a, c, g, or t
aggagagagcccgagctctacttgcctccacagccatttctactgctgtggacaattcaggttctggggacaagcccagcagtgtctcccactctgagtaatgaggntggttctttacaccatntnttaaagagnagcaatcaagcctccaaacagcagagatttagnttctttttcctttcagtactgtttcagatatttctctttacaaggtttattagctttagagtctactccattcattccttgtactgcccacacagttgttactgattgctgggtttcagaataagaaccttgctgttgttaaaagcaaattgagaacattntcagctttgagacctagaggaagatcagatagcattgtgactgaattttccttagaaatgggagagtagttaattagtatcagtaagtcaaggaaagtgtaaacatacggttaaaactggaattcctgttctcttagtctgcattgtgaaacttaaggtgtgcacctcacttacttgacttagtca

SEQ ID NO: 5609 - DNA, 444 bp, Mus musculus
acgcattctggcgagactacattaatggctcattattagaggcactgaaaggtgtcttcatcacagactctctcaagcaagctgtgggccatgaagccatcaagctgctggtgaacgtggatgaggaggactatgagctgggccgacagaaactcctgaggaacttgatgctgcaggcattaccctgacctttccccttctcacctttctggggactgttcgctccgtcacctctggagctgacatactgttctggggtttgttctctaccctttccaaccaatcacaccgcctttttttttttttttttttaaaaggaaaagacaaaggaaggtggaagtggtgtccctgccctccctgcacccatgtgcctgggcttccccgtttcctgttgccacttaccctattgtgtgtctacagccaccttaccactgagccgtaaga

SEQ ID NO: 5610 - DNA, 597 bp, Mus musculus
  misc_feature (48)..(48): n is a, c, g, or t
  misc_feature (130)..(130): n is a, c, g, or t
  misc_feature (159)..(159): n is a, c, g, or t
  misc_feature (223)..(223): n is a, c, g, or t
  misc_feature (227)..(227): n is a, c, g, or t
  misc_feature (229)..(229): n is a, c, g, or t
  misc_feature (259)..(259): n is a, c, g, or t
  misc_feature (261)..(261): n is a, c, g, or t
  misc_feature (265)..(265): n is a, c, g, or t
  misc_feature (281)..(281): n is a, c, g, or t
  misc_feature (308)..(308): n is a, c, g, or t
  misc_feature (311)..(311): n is a, c, g, or t
  misc_feature (317)..(317): n is a, c, g, or t
  misc_feature (341)..(341): n is a, c, g, or t
  misc_feature (362)..(362): n is a, c, g, or t
  misc_feature (370)..(370): n is a, c, g, or t
  misc_feature (462)..(462): n is a, c, g, or t
  misc_feature (476)..(476): n is a, c, g, or t
  misc_feature (520)..(520): n is a, c, g, or t
  misc_feature (564)..(564): n is a, c, g, or t
gagggcaacggcaacactgtatccattgagactgtggtctgaggacancaggggaaattgtggacagaaacagtggaatgctggaggcttttagcttgtgcttggaatgcaatttaagcacatttaaatntcctaactatgatacagagggaagcattntacatgcatgggggtcatgcactgatgactttgtattgttacctatatatgtgatatgatgggntctntnttttctatcgttatcaaagactcattcttntngtanctgtctggtagtgatnaacagtgaactataaagactgctctancangaagtntcccaaatgtgacctggagaaccnggggagactgtgtaatgactnctgtgtgntcctatgtgacatcaggcaagtggctttggggagcctggtttcctccactcagtggaagtagtgacaacctgtagctcaggttattgtctantctgatgaggtagncaaagcacccagctcattgtcaaagttcaataaatatccatctntcctcatcctttaactagaacacaaagtgcttatacaaatattnccttgtgtttataaatgttgaatgtagatcccc

SEQ ID NO: 5611 - DNA, 400 bp, Mus musculus
  misc_feature (35)..(35): n is a, c, g, or t
  misc_feature (368)..(368): n is a, c, g, or t
  misc_feature (372)..(372): n is a, c, g, or t
tgaaagatggcaccacctgtggagtaggaaagatntgcctacacaagaagtgtgtcagtctgtctgtcctttcaaatgcttgccttcctgagacttgtaataggaagggggtctgtaataacaagcatcactgtcactgtgactatgggtggtccccgcctttctgcctgcacagaggttatggaggtagtattgacagtggtccaacatctcaaaaaagaagagtcattatcactgtcctgtcaataactgtgcctgttttatccatcctaatttgtctgctcatagctgggctttatagaatatattgtaaaataccttctggtcccaaagagactaaggcctcttcaccaggttaggaagacatntagnttaatagccgcctatgcactaagtttgg

SEQ ID NO: 5612 - DNA, 78 bp, Mus musculus
gaaaaagcgctgtaatactgaaccacctaacagcttgggcatctcagaatatagagaaattgagtaaataaaccttga

SEQ ID NO: 5613 - DNA, 487 bp, Mus musculus
  misc_feature (290)..(290): n is a, c, g, or t
  misc_feature (295)..(295): n is a, c, g, or t
  misc_feature (297)..(297): n is a, c, g, or t
  misc_feature (305)..(305): n is a, c, g, or t
  misc_feature (308)..(308): n is a, c, g, or t
  misc_feature (311)..(311): n is a, c, g, or t
  misc_feature (325)..(325): n is a, c, g, or t
  misc_feature (332)..(332): n is a, c, g, or t
  misc_feature (341)..(341): n is a, c, g, or t
  misc_feature (344)..(344): n is a, c, g, or t
  misc_feature (346)..(347): n is a, c, g, or t
  misc_feature (350)..(350): n is a, c, g, or t
gtcatcaatttcgacttgcctagtgacatcgaagaatatgtgcatcgcattggccgtacaggtcgtgttggaaaccttggccttgccacctcattcttcaacgagaggaacataaatattaccaaagatttattggatcttcttgttgaagcaaaacaagaagtgccatcttggctagaaaacatggcttttgaacaccattacaagggtggcagtcgtggacggtccaagagcagatttagtggaggatttggtgctagagactatcgacaaagtagcggtgccagcanttccngnttcagcantgnccntgctagcaacagtngcagcgntggaggcanccntnncancagcagagggtttggtggaggtagctatggaggcttttacaacagtgatggatatggaggaaattatagctcccagggggttgactggtggggtaactgagcctgctttgccataggccactctaccaaacaaatac

SEQ ID NO: 5614 - DNA, 599 bp, Mus musculus
  misc_feature (431)..(431): n is a, c, g, or t
  misc_feature (433)..(433): n is a, c, g, or t
  misc_feature (461)..(461): n is a, c, g, or t
  misc_feature (472)..(472): n is a, c, g, or t
gcaccagtcttgaggctggcccctcttctccgcccaaggtggatgttcgcatgattgactttgcacacagcacattcaagggcttccgggatgaccccactgttcacgatgggccagacagaggctatgtgtttggcttggagaatcttatcagcatcatggagcagatgcgggatgagaaccagtaggccctgtgctgggcctaggacccccctcctctccacccacaggcagggaccattgctctgaacttgctgtgaggacacacagacttgcttttaaagggttatatttctctttggtgtaaactaaaagaaatgtttttagctgtagcctggaatccatatatataaagtagaggagggcagaacatttgtcctctcagccaggctccttagctctgtggctgtgactgctgtgtccaggctgtntncaggaaggaagaggtggccccagtgggncttgacagcanagagaatgaatgccttgaactttggtctcccttgcctaaggcgtttgggatctgtggctgtggggctctgctgatggtgaggtgaagcctcggctggcaacggtctccatgccatcatccttatttc

SEQ ID NO: 5615 - DNA, 430 bp, Mus musculus
  misc_feature (334)..(334): n is a, c, g, or t
  misc_feature (336)..(336): n is a, c, g, or t
  misc_feature (364)..(364): n is a, c, g, or t
  misc_feature (375)..(375): n is a, c, g, or t
cactgttcacgatgggccagacagaggctatgtgtttggcttggagaatcttatcagcatcatggagcagatgcgggatgagaaccagtaggccctgtgctgggcctaggacccccctcctctccacccacaggcagggaccattgctctgaacttgctgtgaggacacacagacttgcttttaaagggttatatttctctttggtgtaaactaaaagaaatgtttttagctgtagcctggaatccatatatataaagtagaggagggcagaacatttgtcctctcagccaggctccttagctctgtggctgtgactgctgtgtccaggctgtntncaggaaggaagaggtggccccagtgggncttgacagcanagagaatgaatgccttgaactttggtctcccttgcctaaggcgtttgggatctgt

SEQ ID NO: 5616 - DNA, 361 bp, Mus musculus
  misc_feature (44)..(44): n is a, c, g, or t
tactccgaagctttaacgtttgattctcataaaggcttctggtntcagctgctggaagaagggaaaacaaaatcccttgggaagagtaaaggaagaaaataccccccgatggactctgatagcagagcgtttctgtccagctactaccgcgaccacaacgtggagctctcgaagctgctgcacaggctggggcagcctctgccctcctggctgagacaggagctgcagaaagtgaggtagcatggagaaaagaagcagacctcatctagagctcacagacgacactaccaaaaagctgtggaacacatacctctgcatcacagaaaacgagcaaggctcttccatgtgctggcatgtggat

SEQ ID NO: 5617 - DNA, 527 bp, Mus musculus
  misc_feature (96)..(96): n is a, c, g, or t
  misc_feature (265)..(265): n is a, c, g, or t
  misc_feature (325)..(325): n is a, c, g, or t
  misc_feature (389)..(389): n is a, c, g, or t
cccaggatagcattgttctctacaagaaccataaacgctggagaagagctgacttttgactatcaaatgaaaggttctggagaagcatcttcagantccattgaccacagccctgccaaaaaaagggtcagaacccaatgtaaatgtggagccgagacttgcagaggttacctcaactgaagtgtcaggaaacggagctcatgaagaaaaagctcattagaagaaaaacaaaacaaaaactaacaattgaaaaagtatttgggantcctttctattacctacatattgtattatatgatgttaatatacagttcatggctcaagncattgccaagtatattactgtttattctgaaaaggactgcggggcacataaacggtagatattnggtggttaaatggaaagtgaactatgtataaatcactgtttgcttacttgagaagtcggaatagacaattattccctttagtgtttgaaaagtgaggctaccacagttactatgaaaccttttatcttgactcaaaca

SEQ ID NO: 5618 - DNA, 373 bp, Mus musculus
acaggctgctcaccatgagatctatgaatgttccatctgcctgactccactctcctttcatggcgatggccggcaagcagccataggaaccagcagccagcgtcccagagagacagtcctcctgtcctgtgcacatctgttccacaatgcctgcctcctggctttggaggagttttctttaggagacaatgcccctttccatgtctgtcctctctgtcgctcctgctaccaaaagaaaattgttgaatgctgaattcatgtccaggaagttaaatgtctgactagaacaagaaaggggtaaaggctatcctgcttttggatgagctgcatgggtttggggtagaggactacattgctgactgttctttgtgat

SEQ ID NO: 5619 - DNA, 157 bp, Mus musculus
taacaattgtgtggtgatcttctcaaaaacatcctgctcttactgttccatggccaagaagattttccatgacatgaatgtcaactacaaggctgtggagttggatatgctggaatatggcaaccagtttcaagatgcgcttcacaagatgactggg

SEQ ID NO: 5620 - DNA, 574 bp, Mus musculus
  misc_feature (199)..(199): n is a, c, g, or t
  misc_feature (240)..(240): n is a, c, g, or t
  misc_feature (309)..(309): n is a, c, g, or t
  misc_feature (336)..(336): n is a, c, g, or t
  misc_feature (342)..(342): n is a, c, g, or t
  misc_feature (348)..(348): n is a, c, g, or t
  misc_feature (354)..(354): n is a, c, g, or t
  misc_feature (359)..(359): n is a, c, g, or t
actcttgatgagcagggccggcccatcccggagtggaagcgccaggtgatggtccgcaagctgcagcagaagatgcaggaggaagaggagcagcggaggaaggaggaagaggaggaggcccggctcgccagcctgcctgcctggagacgagacattcttcggaagaagctggaggaggagagggagcagaagcgaaaangaggaggagcggcaaaagctggaggaaatacagagggcganagaacagtcggagaagctgcggacactaggctacgacgaagccaagctcgcgccctggcagcgacaggntcatcttgaagaagggggagatccctnaagtantaggangtctcntcggncttcttgcgtgtagcctcacaagttctgagagatggggagcggcccccagcccccgccccatcctgtcaggttggtgcggaagggctaggatccttgccgcccttcccttcggtgccggaaccctcccaattcccctccctggccccacatccccaaccctgctgctggagtctctcgcaaacccctgtgtcgcctggaaaaaagtgcccaagct

SEQ ID NO: 5621 - DNA, 550 bp, Mus musculus
gaaggcatatcttaccaacctgtatctttctgctgattctgaaaaagtacaagaagcaataaaagaaggtattgcctctgcaaccatgtatgctggagccaaagacatggcttattgcgacacacagctacgcgtggcctttgatggggatgctgtcctcttctcagatgaatctgaacatattgccaaggatcacgggctggacaaatttttccaacatgaaacactatttgagaataagcctcttgctcagggtcctcttaaaagctttctggaagatttagggaaactgcagaaaaaattctatgccaaagacgaacgattgctttgccccatcaggacctacctggttacagctcgtagtgcagcgagttcaggtgcccgtgtgctgaagacccttcgccgatggggtctagagatagatgaagctcttttcctggctggagcccctaaaggtcccatcttagtgaagattcggccccacatcttcttcgatgaccaaatgttccacattgaatcagcacagaaatttggtaccatcacggcccat

SEQ ID NO: 5622 - DNA, 578 bp, Mus musculus
  misc_feature (177)..(177): n is a, c, g, or t
  misc_feature (278)..(278): n is a, c, g, or t
  misc_feature (296)..(296): n is a, c, g, or t
  misc_feature (338)..(338): n is a, c, g, or t
  misc_feature (409)..(409): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (463)..(463): n is a, c, g, or t
  misc_feature (479)..(480): n is a, c, g, or t
  misc_feature (533)..(533): n is a, c, g, or t
  misc_feature (540)..(543): n is a, c, g, or t
gcattgctcatgcagtgcaaccacaccgtcatcacgctggggacctttgggatctgggctgcctacctcacgggtggggacactgtttacctggctaactttacccagcccaactcccccttccacacggttttcaagccagaagcagcttacctgcccgagtgggtgggcatcgcngctgacctgggacagccaaacacagtaggctctggccatgcctcagccagagcccccaagaggcactggggggccttgctgtagtgcacatgctcagtggntttccagtcctgtcttcnatgctttgcagctgagtgaccacaggtcagtgatgtcacctnactgccttcctggtgctctgagcacagtctgggcttagctgagcagcagcacactcgggtgctttgagctnctcatngncnactgctagccactgtaggcctaccattcgctgcatctggagtgnctgtctcatggaggcnnagtgtgtagctagggtttctacagctctgataaaacaccatgacagtaaacangttgggnnnnagagctactcagctacagctacacttcacacacag

SEQ ID NO: 5623 - DNA, 132 bp, Mus musculus
gctgtgcaccgctgctgtcttactggctgcacccagcaagacctgttgggtctgtgtccccactgaaggatcacagggctcaggcggtgcgtccttaattgctccccacctcctggctatgtcattgcaaca

SEQ ID NO: 5624 - DNA, 465 bp, Mus musculus
  misc_feature (147)..(149): n is a, c, g, or t
  misc_feature (152)..(152): n is a, c, g, or t
  misc_feature (158)..(158): n is a, c, g, or t
  misc_feature (199)..(199): n is a, c, g, or t
  misc_feature (358)..(358): n is a, c, g, or t
gatcatccaaaggtgcagctagtgataatagacggaattgcttttccctttcgtcatgaccttgaagatctatcccttcgtactcgattactaaatggcctcgcccaacaaatgatcagccttgcaaataatcacagattagctgtnnnttnaactanatcagatgacaacaaagattgataaaaatcaagctttgctngttcctgcattaggggaaagctgggggcatgctgctacaataaggctcatttttcactgggaacaaaagcaaagatttgcaacattgtacaagtcaccaagccagaaggagtctacgataccatttcagatcacacctcagggatttagagacgctgtngtcactgctgcctcatcacagacagagagttctttgaatttccggaaacggtcacgagaaccagaggaagaatgctgaccaaatgctgatgccagtgtatccagtta

SEQ ID NO: 5625 - DNA, 403 bp, Mus musculus
tgaggtcctgagtgaagagcccattctgaagtggtataaagacgcacatgttgcaaagggcaaaagtgtcttccttgagcaaatgaagaagtttgtagaatggctcaaaaatgctgaggaggaatctgagtctgaagctgaagaaggtgactgaattttgaaacaacatcctcagtaaagcaaacaggagttgtagataaaatgtcatgtctcatgtgtcctggttcttacatcttcctacctccctatatcaagcatgatataagggctttcatggcaatttttattttaactgtttttatggttactggaaatgttggctttggtttctgaaaccacgtgtgaggagcaagctgcaggagccgtagaattgaatctgatgttgcattggttttcagttacc

SEQ ID NO: 5626 - DNA, 481 bp, Mus musculus
  misc_feature (338)..(338): n is a, c, g, or t
acagatgtctgtgtgttcgcagcacaagaagacctagagaccatgcaagcattcgctcaggtttttaacaagctaatcaggcgctacaaatacctggagaaaggttttgaagatgaagttaaaaagttactgctcttcctaaaggggttttcagagtcggagaggaacaagcttgccatgttgactggtgtccttctggctaatggaacccttaatgcatccattcttaacagcctttataatgagaatttggttaaagaaggggtttcagcagcttttgctgtaaagctctttaaatcatggataaatgaaaaagacatcaatgcagttgctgcgangtcttcggaaagtcagcatggacaacagactgatggagctgttccctgccaataaacaaagtgttgagcatttcactaagtatttcactgaggcgggcttgaaggagctttcagagtatgtccgtaaccagcagaccattggg

SEQ ID NO: 5627 - DNA, 556 bp, Mus musculus
  misc_feature (515)..(515): n is a, c, g, or t
  misc_feature (526)..(526): n is a, c, g, or t
agcgactcctacgtggaactcagcgagtaccgggaccagcactttcggggcgacaatgaagaacaagaaaagttactgaagaaaagctgtacgttgtatgttggaaatctttccttttatacaactgaagaacagatttatgaactcttcagcaaaagtggtgatataaagaagatcatcatgggtctggataaaatgaagaaaacagcatgtgggttctgttttgtggaatactattcaagagcagatgcggagaacgcaatgcggtacataaacggaactcgtctggatgaccggatcatacggacagactgggatgcaggctttaaggagggcaggcagtatggacgtggacggtctgggggtcaggttcgggacgagtatcgggaggactacgatgctggaagaggcggctatgggaaactggcacaaaaacagtgagtggggtgagccccaagtacacaggtcacggtacatcaacacagtggtgatgctggagaacgttacccaaggtntcatcagtgtntctgctgtactggaagccacctctggtttt

SEQ ID NO: 5628 - DNA, 334 bp, Mus musculus
  misc_feature (282)..(282): n is a, c, g, or t
  misc_feature (288)..(288): n is a, c, g, or t
  misc_feature (298)..(298): n is a, c, g, or t
ggaccaggctctcactgggtgtaattgctgctcttgccaagtttgaagattgatgttggtagcaaaatttctcaaggtgttcactggagccccctcccctcgggccagctctagtgtaggcatgcatctagggatggcctggcctgttttcttctctggacatgttggttggctgaagttgtaacctgctgcacgcttgtgggctgacatggccagaggctttcatctcaccatgtgagtgatgcctacccgatgacagaagtgttgtgcgactgggctctnccctcnccctcccagnccaccctttacagacactggtatcatctggtacact

SEQ ID NO: 5629 - DNA, 409 bp, Mus musculus
ggagttactcagtccagctgggatggttgttgagggtgcactgagttcatgtgcacttacttacaggttatttttagaactttcaagctaaaagctccttccctcttctgatgttgtatgtgaacatgggcccctcagctagtcctggccagtgagatatgcttcccagccatatccagtgggtctctaacctcctgtctagcttatctgccactgtctggctaggcttcagccacagaaatccaacttgaatacagaaggtatccagacctggtgcttggttggccaggccccacattagccctcactgctggaggctgctttccacatcctcttgtttagtaccagcatcatgggtcttactccaggggctgttcttgttgatagaccttcatcacagagcccagag

SEQ ID NO: 5630 - DNA, 521 bp, Mus musculus
  misc_feature (435)..(435): n is a, c, g, or t
agatagaaccttgattgccccagaggaactctcccttgtccacaatctaaggaaaatggtgaaaaatgactggcatggaggtgcaatcgtgttgagcttgagccaaaccgggtctctctttaagtccagaacagcctatttgccgcatgagctgctgggaaaggaaggatttaatgccctggagccttttcttcccatcctcattcccaactataatccaaaggagtttgaaagttccttccagtactacttagagaacaactggcttcaacatgagaaagcttcaacagaagaagggaggaaggagctgaggttcctgagtaactgcaaccctgagcagctggagcggctctgtgcctcgctgtaagcacggacagcggcggtggcatgctgggaagacaggcttccttcagctaccgtgcgcgcatgaggaantcccaaggttccaagctgaacaccctgacctgcactgatggatatgaaatgataggatgttgttgtcctacagctaacaccagttt

SEQ ID NO: 5631 - DNA, 494 bp, Mus musculus
  misc_feature (272)..(272): n is a, c, g, or t
  misc_feature (275)..(275): n is a, c, g, or t
  misc_feature (289)..(289): n is a, c, g, or t
  misc_feature (392)..(392): n is a, c, g, or t
gaattggctatccatacccacgtggccctgtttttcctggccgaggtggttactcaaacagagggaattacaacagaggtggaatgcccaacagagggaactataaccagaacttcagaggacgaggaaataatcgtggctacaaaaatcaatctcagggctacaatcagtggcagcagggtcaattctggggtcagaagccatggagtcagcattatcaccaaggatattattgaatacccaaataaaacgaactgatacatatttctccnaanaccttcacaagaangtcgactgttttctttagtaggctaactttttaaacattccacaagaggaagtgcctgcgggttccttttttagaagctttgtgggttgattttttttttttncttttcttttttgtacatttttaattgcagttttaaagtgaatcgtaagagaacctcagcattgtgcacgataagagaatgtgtcagtatttcagggttcta

SEQ ID NO: 5632 - DNA, 520 bp, Mus musculus
  misc_feature (52)..(52): n is a, c, g, or t
  misc_feature (61)..(61): n is a, c, g, or t
  misc_feature (69)..(69): n is a, c, g, or t
  misc_feature (72)..(72): n is a, c, g, or t
  misc_feature (82)..(82): n is a, c, g, or t
tttatccaaaatgtccccttagaggaccgagttagaggaccaaaaggacctngaagagaangaaggatngtngaggttgtanatgatgattggcttgccaggagctggaaaaactacctgggttactaaacatgcagctgaaaaccctgggaaatacaacattcttggaacaaatacgattatggacaagatgatggtggcaggttttaagaagcaaatggcagatactggaaaactgaacacactgttgcagagagccccacagtgtcttggcaagtttattgaaattgctgcccgtaagaagcgaaattttattctggatcagacaaatgtgtctgctgctgcccagagaagaaaaatgtgcctgtttgcaggcttccagcggaaagctgttgtagtgtgcccaaaagatgaagactataagcagaggacacagaagaaggcagaagtagaggggaaggacctaccagaacatgctgtcctcaagatgaaaggaaacttcacccttccagaggttgca

SEQ ID NO: 5633 - DNA, 448 bp, Mus musculus
  misc_feature (376)..(376): n is a, c, g, or t
  misc_feature (381)..(381): n is a, c, g, or t
  misc_feature (388)..(388): n is a, c, g, or t
  misc_feature (392)..(392): n is a, c, g, or t
  misc_feature (399)..(399): n is a, c, g, or t
aagtctctcttgtataagtttcatcacttatacatggttttgattttgttatttttctaaatagtgttcagaaaactctggatccaaaatgtggcatttttctgagaatgaagattatacattaagaagcttttaaaatatacttggtgttcaaattgggatgtgtgttcctagaagtggtaattcatactgaccatgacttcaagttggaagagaaatgtctgaggagggagggttccctgagaccatggagactggttatccttcctgccagaattcctatccagactgtgttgcaatatgctaatctcatttatagagaaagtgcataaaagctatattttgaagaatgagtggtttcaaaagaaaacttctnccctnccctgtntccnccttctntcctgtggatactgaagcattgggttgcgaactatctgtagaactgaca

SEQ ID NO: 5634 - DNA, 505 bp, Mus musculus
  misc_feature (296)..(296): n is a, c, g, or t
  misc_feature (377)..(379): n is a, c, g, or t
  misc_feature (399)..(399): n is a, c, g, or t
  misc_feature (455)..(455): n is a, c, g, or t
aacatggctttcattttcctcaatcggttcttggatctgactgatgcaatcgaagaagggaccctggatgccctggaccattcagattttcaggatactgacattccctttgaggtgccgctcccagccaagcagcacgtcccggaggcccagagagaagaggtccgagactgggtgctcacagtctcgatggaccagagactggagcaggttctgccccgggatgagcgaggtgtctatgaggcttccctagttgccgcgagcactggagttcgggcactgccctgcctcatcancaggttaccccattttgaggaacaaaattgaatttaagcggcctgggaaggctgctaacaaagacaactggaacaagtttnnncttatggccatcaagacctntcacagcccagtgtgccaggacgtgctcaagttcatcagccagtggtgcggtggtntccctagcaccagcttttcctttcagtgactggcgcagccgagacgctta

SEQ ID NO: 5635 - DNA, 446 bp, Mus musculus
tgacactgttactgtgtgcccgtcatagattggtttttagtgttgcccttgctgtgtgataaatgctatatctagtttacctagcagaagcttgaccctgcgatagtatggacctttggacagacttagtttttgcacataaccttgtacaatcttgcaaaagaggccagcaacataagatatatatctggactctcctgtattatagaatttttttcttgttctgagtatccttgacattacaattgtcaaaaatggtatttcagatctctttctgagaccttttaagctaaaataacatgcaagaattgattttacagctactaattttgacaccttttagacctgtaagagtgttgtatcagagcaacaagcacagttgagtgctgcgtttgggatatttagtttcctctttagttgagcaccactgggtgtattcatttata

SEQ ID NO: 5636 - DNA, 101 bp, Mus musculus
gtataaaacataaggctgggttccaaaatacttgctttttagtagcttggtgccatggattatcctgttgagtctatgtcatgacaggataggaaaacaca

SEQ ID NO: 5637 - DNA, 257 bp, Mus musculus
  misc_feature (202)..(202): n is a, c, g, or t
aaatgatgaatgctccagaaactgggttggtaagcacaagatagaggcaaggcagtgtaattttaaaaggactttgctcctttcaattttccttagcttgtctgagatactgacctgtacattttgaacatattaaagagtaactaagtattctgagcagaaatagcagcatttggtgtagttgcacttttgatttgatgancctgtgatgtgctagatccctttaactaatgtatatgtccattttgcattttatt

SEQ ID NO: 5638 - DNA, 493 bp, Mus musculus
  misc_feature (150)..(150): n is a, c, g, or t
  misc_feature (250)..(250): n is a, c, g, or t
  misc_feature (297)..(298): n is a, c, g, or t
  misc_feature (451)..(451): n is a, c, g, or t
aaaacaagctttgagattgcggagcttaaggagagattaaaagcaagtcgtgaaactataaactgtttaaaaaatgaaatcaggaagcttgaagaagacgatcagacgaaagacatttgagcaactggcggtaagtcggctgcagagccnggggcgccgcggagggacttgccacagacgctgcggtgtttctgggaggagctgcgagcgcggtccccagccggccgtggctttctcagagaggactccnaggtacccacactgtcaggctgcctcccggggcacatgtgtgctctnnaagactcgatgctgggtagcattccacgacgttaagcacaacttttaaagtgtttgttttgttttaaattgaactctatgtgtagtttatcctcctcaggcaggcgtagcggttgtgttgtaaagtctaacgtgtgcgggttttgtacctctntcctaggtaggattagtgactggtatgtgtgtttagttcttc

SEQ ID NO: 5639 - DNA, 482 bp, Mus musculus
  misc_feature (64)..(64): n is a, c, g, or t
  misc_feature (322)..(322): n is a, c, g, or t
  misc_feature (344)..(344): n is a, c, g, or t
  misc_feature (447)..(447): n is a, c, g, or t
  misc_feature (451)..(451): n is a, c, g, or t
  misc_feature (457)..(457): n is a, c, g, or t
gaacgtttcagagttgctagagcatcagcctgtgatatggagtttatgacgctctttttttggnagatgacctcgtgctgagggaggtggtagctgcagatccaggaggagcggggaccccagaggcccaaggccagtgggcatggccacttgctgcctgtggttgcctgtgtgaacactgggaagcaggatctgactgtttagcatgagagaatacccagctcggccctggtctggcttctatagatacatagtgtatacttgtgtagactttgcatatatacggatttgtagtattttcctgttttgatgtctaatctgntatctataatgtaccctagtantcggacatacttttgattgtacaattgtacatttgtatacctgtaatgtaaatgtggaggagtttgatcaacacgaacacgtttttggtaagaagagaatcanccancccgtncactctgtatatcccaccttttatg

SEQ ID NO: 5640 - DNA, 533 bp, Mus musculus
  misc_feature (200)..(200): n is a, c, g, or t
  misc_feature (313)..(329): n is a, c, g, or t
  misc_feature (365)..(365): n is a, c, g, or t
  misc_feature (463)..(463): n is a, c, g, or t
agatctcagctctgatattcgctcggcagtacctggctaacctcctcccgtctgtctttgacaaactcaggaatagtggcttcttttatgatccaattgaaagagatattgaggtaggattcctcccatggctaatgaatgaagttgaaaaatccatggaacacagcatggtgggaagaactgtgcttgacatgttaatncgcgacgtggttgaaagaaggatcaacgattacgagcacaaggaagccatgccgcctggtcagaagacaaatgtgattaatggtcctaacacagtgacagatccctcggtgannnnnnnnnnnnnnnnnccacattgcacacgcagaagccagttttagacagantctcctcacagccagcaccatcccaagaaaggaagcctgtggaagaggggggacaccttatggcagagtgaccaagagccagagagcagctcaacatntggtcagttataatgcaaggcaggcacatgacccatccaggctttacaaactgtgatactcagccactaa

SEQ ID NO: 5641 - DNA, 312 bp, Mus musculus
  misc_feature (259)..(259): n is a, c, g, or t
  misc_feature (282)..(282): n is a, c, g, or t
  misc_feature (284)..(284): n is a, c, g, or t
gaaatgttggctgtcgacgcaccgaggagacataaagtgtctgtccatgttcttgccagggaaatggattcttgtcctgttgttggagagttcccctctcagaatgatataaacttgtccgaagcgccacccttgccacaacctgaagtgattcacaacatgactgagttcaagcgtggcctgccactgtttcccctcgtgaaaccacatattaacttcatggctgcaaaactctgaagaaagtagacatgttcctgtntcttccagggcctgggaaaacantntcagctttgagtagtttctggcttgcta

SEQ ID NO: 5642 - DNA, 435 bp, Mus musculus
gttcaaagtcacagcacgagcctaggaataggatgtctccacagaattcatgttgtgttgtcgccattttgtatcagctggacctgccattctaggattatgaggccaccttggaggaggaagtggtgtggtacacacttgggtgacatcataacatgcttccagatcatagtgttcagtgtcctctgaagtaactgcctgctgcctctgctgcccttgaacccatgtacggtcgccagacagggaccagtgagctcccgaccccaaacatgcagagtgggggccctgtcttctttgtgtgtaattgccaaacgtctaaagcttcatgtgctgggctgtgtacatattttatggatttaacactggtaactgcatattttgatgccaacaaagttttagggatacaatggtaccttgccaacatcgagtgacttt

SEQ ID NO: 5643 - DNA, 346 bp, Mus musculus
cttctccctcttcgacaaggatggagatggcaccattaccaccaaggagctggggactgtgatgagatcgctgggacagaaccccactgaggcggagctgcaggacatgattaatgaggtggatgctgatggcaatgggaccattgacttcccagagttcttgaccatgatggccagaaagatgaaggatacagacagcgaggaggagatacgagaggccttccgtgtctttgacaaggatgggaatggctatattagcgctgccgagctgcgtcacgtcatgacgaacctgggggagaagctgacagatgaggaagtggatgagatgatccgagaggccgacatt

SEQ ID NO: 5644 - DNA, 477 bp, Mus musculus
agcagctgacgtgcttgctagttttcaggttcgcaccagagatgcagtgtcttaagtcctgtcaggagagtgacttttaaatgtatgtatttcaggctttcaccattaacagattgcatatatacaatccattgacttttaataaattggtagttgatattttattgaatggagaattacgaatatagattataaattctgtctttaattgacctttttcttgggcgctattttaatgatttaagtaggagttatattttcagaaactttctagacagtttggaaatttgggtgctatatgaagaaaagcatttgaggctgtatcatatttcagatataaacaccttgttttcttgaatgttttatttattggtttttaaaaaaaacttttctgttatcaagatggtgcctgttaacctaaacacagatatatttattatataaattgcaaaatatttcttagctacttgtgaacag

SEQ ID NO: 5645 - DNA, 475 bp, Mus musculus
  misc_feature (73)..(73): n is a, c, g, or t
  misc_feature (106)..(106): n is a, c, g, or t
  misc_feature (195)..(195): n is a, c, g, or t
  misc_feature (202)..(202): n is a, c, g, or t
  misc_feature (220)..(220): n is a, c, g, or t
  misc_feature (392)..(392): n is a, c, g, or t
aagagaatagctgaactttctgaaaaagaagatcagaaaatatttctagacttgcaggctgaaggattccctntcatcgagaccagtaccctgactgaggaaggtntcattcaagttaaaacagaggcgtgtgacaggcttttggctcaccgagtagaaacgaaaatgaaaggaaataaagtgaatgaggttctnaacagantgcatttagctgtgcccnacaagagagatgataaggagagaccccctttcatcccagaaggagtgatagctcgaaggaagagaatggagattgaagagcccaagaagaagagggagcgagatcttgagctggaaatgggagatgattacattttggatcttcagaaatactgggacttaatgaattcatntgagaaatatgataagataccagaaatttgggaaggccacaatgttgctgattatattgatcctgctatcatgaagaaattag

SEQ ID NO: 5646 - DNA, 485 bp, Mus musculus
gtatagaatcggaccatatcagcctaatgttcctgttggtatagactatgtgatacctaaaacagggttttactgtaagctgtgttcactcttttatacaaatgaagaagttgcaaagaatactcattgcagcagccttcctcattatcagaaattaaagaaatttctgaataaattggcagaagaacggaggcagaagaaggaaacttaagatgtacaagaagcttaattcaaagaaaacgatggttctttgattttaatgttaaccttttttaaaatacaatactgatagttagaaaactactgtacacttttgttttagtggaaaataatagatgtctgttgtgtttaagtgttatagcaaaaagtacacatacggttaagttaatgaaaatgtttttgtttcatccgagtgacaacagacaaaagtacttcctaaagattgactgttgtaagctatggaaaacaacttgcaccactaagag

SEQ ID NO: 5647 - DNA, 231 bp, Mus musculus
ttcttttaatgtcatgctgtttagatgataagaaatattaagaattggctttagatttgtaatttttttctcttgagttcctgctaggttttatattctagtagtcaatgttatttcagtgaaatgtaaaaatattcccgttctctttgaccagtattaatttcttgagaacctattgcctgtcacttgaatcctgtagctgtcatacatctctggtataagcaacatttg

SEQ ID NO: 5648 - DNA, 342 bp, Mus musculus
tgtcctaattccgttgcagctatgaatgtaaaccattcctcaaggcactgctgttagctgatgcattttatatctgtaaaaccatactcagaactgtttacgtagaactcagctgtcctgtgctgccacagcaccaaccacaatgctttgctccctgagtaggagtcctcgtccgtgtgcttatacccggcactcgtctgagcctgtgatggcagagcctctgtcgaaggctgcactgagggctcatgggagctctttagaggaattctggccttagagttagccccaggagttgtgcgtgcagctctgcactgtacagcgtgttcctgtcacacagtggac

SEQ ID NO: 5649 - DNA, 439 bp, Mus musculus
  misc_feature (39)..(39): n is a, c, g, or t
  misc_feature (163)..(163): n is a, c, g, or t
  misc_feature (182)..(182): n is a, c, g, or t
  misc_feature (299)..(300): n is a, c, g, or t
  misc_feature (302)..(303): n is a, c, g, or t
  misc_feature (339)..(339): n is a, c, g, or t
tgaggactgtggtgcccactttgaagactccaaccaccncacatctactgctcacctgctgtcactgtccaggagaccccagccctccaaccttccccttggggtgcccacttccagtcctggcttcaggctactgctgagaggtggctgggaaccaggaatnggggctaggaccccggggntgaaggccgtgccaaccctatccccactatcctcaagagggaccaggaaggattgggttatagatccccaccccaaccccgagtcacacactttgcagcgcgggatacccgggctgnntnntgggagagagagagtccctcgagttgccacactgantcagagggagaacagaaggcaagaagaaaagggcagagcctgggagcgagatctaagactgtacatgaacctcgagttctgactgatatggactggccct

SEQ ID NO: 5650 - DNA, 413 bp, Mus musculus
  misc_feature (50)..(50): n is a, c, g, or t
  misc_feature (348)..(348): n is a, c, g, or t
  misc_feature (367)..(367): n is a, c, g, or t
  misc_feature (379)..(379): n is a, c, g, or t
tggttttctgtgatatctccgctgaagaggacctatttacaggtgagggntgactaccagtttgagatctacaggctcatgaggaaggagaacaaaaactgctggggtgagtatcacccttacaataatgtgctgtggctgcattacctcacagacaagattctgaataagatgaaatttaagactaaatgccagagcgcagccatgaagcaaataaggaaaaacctgcaacatttccacaggactgtactgagtttcagctctgccacggacctgctctgccaacacagtctatttaggtaagccaggaacttagactttcagagcctctttaagtacacttttagncctctggtactaatctctnccactagagccnagatggaggtgaaagcacatccttaagagttcct

SEQ ID NO: 5651 - DNA, 572 bp, Mus musculus
  misc_feature (294)..(294): n is a, c, g, or t
gaaagccgcctacgtgttgttctatcagcgtcgggatgacgaatgctccagcacatcttcgctcggcagtttccccggttctgatggaggggtgaagctgagcagctcacaccagggcatgggggatgaggaggcttacaacatggacaccaactgatgtggcctctgtgaccctgccaccctcccaacaccagcatcctcccccaggagaatatctgtggcactcttgaagactgctcatatcaatctcaaaccagatgaggacattacctccttttatgagaagaggaaggnaaagagaaaccctgctttctgagaagggctctatgttaagaggctggattattttttcttttaaacgggtggtgagagaaaaacctgtggagctcaattgtgggctggggtttggtgcacagtggcatgtgtctcatggattccaaagagtggagaggaagaccctgcaatgagcatggtgcagccatgaagacccacctgcagggctgctccgaactgggttttggattctggtgcccacactgctcaccccagtagtctggccacagtaaaccaag

SEQ ID NO: 5652 - DNA, 362 bp, Mus musculus
cactggagaagtctgggtccgctttgacctgcaactttttgaacaaaaaactctcctttgagggcctggggaagccagaaccaggggagctgcccacaaggctgggtctaaagacagattttgctctcccaggacagaggagcatcacatggcttcatccatcaaacagccacactcgctgggcctgtattttattgcacactaaattgctagcaatctatgcaaacatgatcttttaaacaaacgccacagcacagtgccttgtactagtgttaacctgttcagctgtgttagatgccagggtttccattttcagggctataaaagtattatgtggaaatgaggcatcagaccaccggacg

SEQ ID NO: 5653 - DNA, 469 bp, Mus musculus
gggaactccaatgataccagataatggcgcagtgcacaatgataggtttccccaaggacctccatcccagatgggttcacccatgggaaatagaacaggttctgaaactccccaggcaccgatgagtggtgtagggcctgtaagtggtggtcctggcggctttggtagagggagtcaagggggcaattttgaaggccctaataagcgtcggagatattaaataatggttcattcctgactgtttagaaaaacattcaatggtatgtctttacaccatgtctgttactagggagaaatggttttactgttaatgtatgtagactaaagtttttcttttgtaaaacttgagttttttttgtattttctttattcataagctttgtagattagcttggtgaaaaagatgcccatcattgtgaatgttgaaaagtgtttgtgaccttagctaacgatagctatgtggcattat

SEQ ID NO: 5654 - DNA, 429 bp, Mus musculus
gggtactgacagactccttggagtatgtatatataaaataacaaacttgtattcatattctttcagtgatgtgttgttctacaatccagaatggcttttgcaccattttttaaaccagttttcccccctttgccgttggtaccagagttgctataaatgactgctgctttaagggttaaatattttgttagtgaagatacaaccagaacactaaattatgataaaactttctgactgagtgataggtaaatttagttgggctatattcaaaattattttattatcaaacccataccatttgttttactggaaaaggaaaagtggtttgctttttactgctggatcatattttgtgtagtaaagaaattctttggtcaatgttgtaatctttatatttcaattttaaggtttccttatctgtattatagt

SEQ ID NO: 5655 - DNA, 460 bp, Mus musculus
  misc_feature (347)..(347): n is a, c, g, or t
  misc_feature (425)..(425): n is a, c, g, or t
  misc_feature (427)..(427): n is a, c, g, or t
gaccagccctttatgggttcattttctacatattccatgtggaacttaaagaactgccaatcacagggacagacctggggacaaacacaagccctcagcatcactttgaacagaattccatcatccctggtccccctttcctctttggagcctgttcggtactgctggctctgctcgttgccttgtttattccggaacacactaatttaagtttaaggtccagcagttggaggaagcactgtggcagtcacagccatcctcacagtacacaagcgccaggagaggccaaagaacctttactccaggacacgaatgtgtgacggaaatcaggaagacttctctctctncgcagcacccaggtcttagttttcacctgtagctctggatgtacattccatttccatctgcagtgtactttaagactntncttaagaaatacttgcatgaactccgtgggaac

SEQ ID NO: 5656 - DNA, 445 bp, Mus musculus
  misc_feature (297)..(297): n is a, c, g, or t
  misc_feature (313)..(313): n is a, c, g, or t
gatattgaagcccagttgatacatgaaccctcagtcaacggctcctcaactacagtaccaaaggcagcatcctccgtcactgctggagtggccagttcactctcagagaaaatagtcgatacccttgggaacagtcggccaggggcgccgcttacctcagtccagatccgcttcattcagaacatgatacaagaaacactggatgacttcagggaagcttgccatagagacattgtgaatctgcaagtggaaatgattaaacagtttcatatacagctgaatgaaatgcactctttnctggaaagatactccntgaatgaaggcttagtggctgagatcgaaaggctgcgagaagaaaacaaaaggctgcgggcccatttctgaagactctgggcaccttgatttgttatgagttaggatgtttctggcaactataatacacgga

SEQ ID NO: 5657 - DNA, 405 bp, Mus musculus
  misc_feature (130)..(130): n is a, c, g, or t
  misc_feature (276)..(276): n is a, c, g, or t
  misc_feature (293)..(293): n is a, c, g, or t
  misc_feature (328)..(328): n is a, c, g, or t
  misc_feature (341)..(341): n is a, c, g, or t
gctccacttttgaccaatacgtcagaagacaaatgcgagaaagataatatgcttggatctaacacaaccaacacaatttgccctgataattatcaaacagcacagctgcttgccttaattttagagttanctcacattttgtgtggaacatcacacataccacataaaaaactacatcatgaacaaggacttgctaagaagagtcttggtgttgatgaattcaaagcacacttttctggccttgtgtgctcttcgctttatgaggcgaataattgncctgaaagatgaatttnataatcgttacatcaccaaaggaaatctttttganccagttataaatncccttttggataatggaactcggtacaatcttttaaattcagctgttattgaattgtttgaatt

SEQ ID NO: 5658 - DNA, 521 bp, Mus musculus
  misc_feature (353)..(353): n is a, c, g, or t
  misc_feature (359)..(359): n is a, c, g, or t
  misc_feature (409)..(409): n is a, c, g, or t
  misc_feature (411)..(411): n is a, c, g, or t
  misc_feature (426)..(426): n is a, c, g, or t
  misc_feature (428)..(428): n is a, c, g, or t
  misc_feature (444)..(444): n is a, c, g, or t
  misc_feature (450)..(450): n is a, c, g, or t
  misc_feature (470)..(470): n is a, c, g, or t
agggaaaactgtccgagcacctgcggcactgtgacagcatcctccgggagatgctgtccaagaagcatgctgcctatgcgtggcccttttacaagccagtggacgcggaggcgctggagctgcatgactaccatgacatcatcaagcaccccatggacctcagcacggtcaaaaggaagatggatagccgagagtacccagatgcacagggctttgctgctgatatccggttaatgttctcgaattgttataagtacaaccctccagaccacgaagtggtggccatggccaggaagctccaggatgtgtttgagatgaggtttgccaagatgcccgatgagcccatggaggcncctgcnctgcccgctcccacggcccccatcgtgagcaagggggctgagagcagccncnagtagtgaggagagntnttcagattcaggcagntcagantcagaagaggagcgagccantcggctggctgagctgcaggagcagctgaaggccgtgcacgaacagctggc

SEQ ID NO: 5659 - DNA, 463 bp, Mus musculus
gggcctgcccatgagctatgatgaaaagcgacaacttagccttgacatcaaccggctgcccggcgagaagctagggcgtgtggtgcacatcattcagtctcgggagccctcgcttcgggactcaaacccagacgagattgagattgactttgagaccctgaagccaaccacgctgcgggaactggagagatatgtcaagtcttgtttacaaaaaaagcagaggaaaccattgtcaacaagcgggaagaagcaggcagccaaatcgaaagaggagctagctcaggagaagaaaaaggagctggagaagcggctgcaggatgtcagtggacaactgaacagcaaaaaacccactaagaaagagaagtccggctcagctccctcaggaggcccatcaaggctcagcagtagcagctcctctgagtctgcgagcagtagctccagtggatcgagctccgacagcagt

SEQ ID NO: 5660 - DNA, 575 bp, Mus musculus
  misc_feature (317)..(317): n is a, c, g, or t
  misc_feature (324)..(324): n is a, c, g, or t
  misc_feature (329)..(329): n is a, c, g, or t
  misc_feature (348)..(348): n is a, c, g, or t
  misc_feature (367)..(367): n is a, c, g, or t
  misc_feature (389)..(389): n is a, c, g, or t
  misc_feature (392)..(392): n is a, c, g, or t
  misc_feature (428)..(428): n is a, c, g, or t
  misc_feature (474)..(474): n is a, c, g, or t
  misc_feature (484)..(484): n is a, c, g, or t
  misc_feature (517)..(517): n is a, c, g, or t
  misc_feature (543)..(543): n is a, c, g, or t
tcctaagcctgaactcaccgaagatcaaaagcaagaagttcgggaagcctttgacctcttcgattctgatgggagcgggaccatcgatgtgaaggagctgaaggtggccatgagagcacttggctttgaacccaggaaggaagagatgaagaaaatgatttcagaagtagacaaagaggccacaggaaagatcagcttcaatgacttcttggctgtgatgactcagaagatggccgagaaagataccaaagaggaaatcctgaaggctttcaggttgtttgatgacgacgaaactgggaaaatttcattcaaaaacntcaagcntgtgnccaatgagctgggggaaancctcacagacgaggagctncaggaaatgattgatgaagctnatngtgatggcgacggagaagtgaacgaggaagagtttnttaagatcatgaaaaagaccaacctttattaagtgactggctgagntccctgcttntgcttttgtgaaagtatgacagaacagctgtgntctgttccttcttcctgcctcctttntcttggttggcttctaagcctctagatcaatt

SEQ ID NO: 5661 - DNA, 262 bp, Mus musculus
  misc_feature (69)..(69): n is a, c, g, or t
  misc_feature (73)..(73): n is a, c, g, or t
  misc_feature (115)..(118): n is a, c, g, or t
  misc_feature (120)..(121): n is a, c, g, or t
  misc_feature (123)..(124): n is a, c, g, or t
  misc_feature (126)..(128): n is a, c, g, or t
aaaacaaccattgcatgtttgcttttgatgtatccctttgtgaaatcagcacttctggggccaatgaanaaanctgtgcagcattcactcccctcccccctcccctcccctcccnnnncnncnncnnngtagagatgtgtttgatcagcaagtcaggagtcaaactgctgcctttaaaaaaacacacaaaaagctgattcagttcaaaattaatgcaaatctttcaaaactgggtttctgatacttgtggatgtttttcttc

SEQ ID NO: 5662 - DNA, 436 bp, Mus musculus
  misc_feature (346)..(346): n is a, c, g, or t
  misc_feature (369)..(369): n is a, c, g, or t
  misc_feature (397)..(397): n is a, c, g, or t
aatactatacaaccaaacatccgcctttacaggtcgttattcttctaagcagtaggtaacttttcctgggtttcattctttctagtgtactagatccagaaatttagtgtgatgccctgctttctcttttctttgacttaacattggtttctgaaagaatctttgctacctagaacctgcagtctgttttatggcaacactggataatggctttttgaaattgagggggaaaaattggagcatctgtaaacagaaatgccaaattattgatagtcatcgttgctgcttcacattagtatgagactgatgcagaaggaagcccattcttcgtgttcagtgctggggntggggtggggacttttcttaaancgaaaataattactgctattttaaaatntcttgattattgaatgtgagaccctctgacatgatttga

SEQ ID NO: 5663 - DNA, 256 bp, Mus musculus
  misc_feature (68)..(68): n is a, c, g, or t
cggtagtacgtgtgtctttttgctgagggcagttatgtttctccaatattacctcaacgagcagggcnatcgcgtttatacgctgaagaaatttgaccctatgggacaacagacttgctccgcccatcctgctcggttctccccagatgacaaatattcaagacaccgaatcaccatcaagaaacgcttcaaggtgctcatgacccagcaaccgcgtcctgtcctctgagggctcgttaatcttttacgctgctca

SEQ ID NO: 5664 - DNA, 510 bp, Mus musculus
  misc_feature (37)..(37): n is a, c, g, or t
  misc_feature (151)..(151): n is a, c, g, or t
  misc_feature (313)..(313): n is a, c, g, or t
  misc_feature (323)..(323): n is a, c, g, or t
  misc_feature (325)..(329): n is a, c, g, or t
  misc_feature (334)..(334): n is a, c, g, or t
ctatgatgaagcactctctccaacatctcctgggccnctgtcagtaagagccgggcacggagaacgtgatctaggaaacaccattacaaccccatccacgccagagttacagggcatcaatcccgtgttcttgtccagtaatcctagccantggagcgtcgaggaggtctacgagtttattgcttctctgcaaggctgccaagagattgcagaagagtttcgttcccaggagattgatggacaggcccttttattacttaaagaagaacatctgatgagtgccatgaacatcaaattaggtcctgctctcaanatctgtgccnannnnnaatgntcctcaaggagacctaagtgaccctctgcacaattcagactaaggcagaaggcctggctgttcaggttataacctggaagagctgttccttttgtgtgacctgtggggtttggaggcagaactcttaaggattggttgctggtgctacatggtgacagctttgataccttctctgg

SEQ ID NO: 5665 - DNA, 509 bp, Mus musculus
gactgcactgaagttgattccatccaagtgttgctaagatataagagaagtctcattcgcctttgtcttgtacttctgtgttcattctcctcccccacccccaatttttgctagtgtgtccactatcccaatcaaagaattacagtatacgtcaccccagaacccgcagatgtgttcctggcccgctctgtaacagccggttagaattaccatgacacacacatttgcctttccacagtattcgaaaaagaacttgcatttctattaccttagcaggaaagatctggttttgctccactccatgcaggagcggactttgctggtgtgagagtctgagtacagctttctagcaaccttctgtttcctttcacagcattgtccttgctgtcctcttgctgatggctgctagatttaatttatttgcttccctccttgataacattagtgattctgatttcagtttttcatttgttttgcttttgtttttttcctcgtgtaacattggtgaa

SEQ ID NO: 5666 - DNA, 576 bp, Mus musculus
  misc_feature (324)..(328): n is a, c, g, or t
  misc_feature (339)..(339): n is a, c, g, or t
  misc_feature (419)..(419): n is a, c, g, or t
  misc_feature (436)..(436): n is a, c, g, or t
  misc_feature (441)..(441): n is a, c, g, or t
  misc_feature (507)..(507): n is a, c, g, or t
  misc_feature (550)..(550): n is a, c, g, or t
tgtcatctccgagaccgagctgaaacaagtggcttacattttcaaatgtgacaaatccactcttcagataaagggaaaagtgaactccatcactgtcgataactgcaagaagtttggcctggtgtttgatcatgtggtgggcattgtggaagtgatcaactccaaggacattcagatccaggtaatggggagagtaccaacaatctccattaataagacagaaggatgccacctgtacctcagtgaagatgcactagactgtgagatcgtgagcgcgaagtcgtccgagatgaatgtcctggtccctcaggatgacgattatannnnnattccccattncccgagcagttcaagacaatatgggatggctccaagctggtcaccgaacctgcagagatcatggcctgacatccaagaanatagccttccctgagtntcctntagcgaacagaagcaagcagctaataggagctagattttaccatagccccgacgcccgtgtccgtntccgaatcctgcagttctgtgccatggaaaacagtatcttttntggcaggcttttatgggcgttttgaa

SEQ ID NO: 5667 - DNA, 475 bp, Mus musculus
  misc_feature (386)..(386): n is a, c, g, or t
  misc_feature (408)..(408): n is a, c, g, or t
  misc_feature (438)..(438): n is a, c, g, or t
gagacaaggttttccacagtgacctggcagtaccagtgtgggctcacttgtgaggacaaggccgaccttctccctctcagtgcctctgttgagttcattaatgtccctgcgcagatgccccacccccctacgagattccagatcaacttcacagagtacgactgtacccggaatgagctgtgttggccccaacttctgtaccctctgacccagtattatcaaggggagccccagtctcagtgtgtggccaaaggcctgatgctgctgtcactcctcatgctggccatcctcctcaggcacccctgggtcaggatgtgcaaagcccgggactcagctgccatctaccattaagtttcctggaagactcagggcatccactcagcggntcctcatcggcccttgcgcctntctgaaacctgtcagtttgagacaggtctntccacatatccctggcttgcttctaagctcacagaga

SEQ ID NO: 5668 - DNA, 439 bp, Mus musculus
aagcagcagttttgtcctcaggagtagtccagacttcttgcccttgagcactgctgtctcttcaaactccttttatttattcctgttctcatgctagagcccaggttctccatctgtatcctcctagtagctccttccctccagggaaggatcaggcaacctctggtatcctagatgctcaatgcctagaacctgccaggacttcaattctgggatattccctacagacattttgacaggctttgaggttctacatcctggtcccaggctcccaacccccagttgagtagggacctctccactctacaggccaagcctagctatattaaactcatagtttttaggagcttcagaccatttgcttttgtgctgctagtcccggaaaggcatgagaaattgttaccagacagcaccttgctgggtttcactccttgaagaa

SEQ ID NO: 5669 - DNA, 441 bp, Mus musculus
tccagatacttctgcagctcgtctgcgccccggaagctgcccctgctcgggggtcacgatgggcagcaagatggcttccgccaccagggtcgtgcaggtagtgaagccacacgctccattaataaagttccctaacagaagagacaaacctaaactcagtgcctcagaagctttggggtctgcagcgctcccctcccactcctctgcaatttcacagcattctaaaggaagtacgtcccccgatttactgatgcaccaggggccaccagacactgcagaaattataaaatcattacctcagaaatacagaaggaaacctatgtctcaagaggaaatggaatttatccagcgtgggggtccagagtgaccgtcgtggctgctgcttgtcaccagacagaagggttagctttacaataaaggacttccacaatgtcaaatgaa

SEQ ID NO: 5670 - DNA, 469 bp, Mus musculus
  misc_feature (404)..(404): n is a, c, g, or t
  misc_feature (409)..(409): n is a, c, g, or t
gaaatttgagttgggccgacctttgccacttcacttcttaaggcgagcctcaaaagccggagaggtggatgttgaacagcacactttagccaagtacctgatggagctgacgctcgtcgactatgacatggtgcactaccatccttctcaggtggcagccgctgcctcttgcctgtctcagaaggtgctgggccaaggaaaatggaatttgaagcagcagtattacacaggctacatggagagtgaagtcctggaagtcatgcagcacatggccaagaacgttgtgaaagtcaatgacaaccgtaccaagttcatcgctgtcaagaacaagtatgccagcagcagactcctgaagatcaagcacgatccctcagctgaactccaaaatcatcaaagacctggcntcccntctgctgggcagcccctagacactggactgccatcctgcgcttctcagatcctgtatgta

SEQ ID NO: 5671 - DNA, 537 bp, Mus musculus
  misc_feature (406)..(406): n is a, c, g, or t
  misc_feature (408)..(408): n is a, c, g, or t
  misc_feature (419)..(419): n is a, c, g, or t
  misc_feature (421)..(421): n is a, c, g, or t
  misc_feature (504)..(504): n is a, c, g, or t
  misc_feature (506)..(506): n is a, c, g, or t
  misc_feature (509)..(509): n is a, c, g, or t
gaccccaaaatgcaggtttacaaagacgaccaggtggtggtgattaaggataaataccccaaggcccgtcaccactggctggtcttaccgtgggcctccatttccagtctgaaggttgtgaccagtgaacaccttgaacttctcaaacatatgcacgctgtgggggagaaggtgatagcagattttgctggatccagcaaactgcgcttccgattgggctaccatgccattcccagcatgagccacgtacatcttcatgtgatcagccaggattttgattctccttgccttaaaaacaaaaagcattggaattcttttaatacagaatactttctggaatcacaagctgtgatcaagatggttcaggaagccggcagagtgactgttaaagatggcacttgtgagntnttgaagctgcntntccgttgccatgagtgtcagcagctgctgccttccatcccgcagctgaaagagcacctcaggaagcactggggcgggtgacantngtntcggcgaccaagggcagtgctagcatct

SEQ ID NO: 5672 - DNA, 534 bp, Mus musculus
  misc_feature (108)..(108): n is a, c, g, or t
  misc_feature (348)..(348): n is a, c, g, or t
  misc_feature (351)..(351): n is a, c, g, or t
  misc_feature (415)..(415): n is a, c, g, or t
  misc_feature (438)..(438): n is a, c, g, or t
  misc_feature (441)..(442): n is a, c, g, or t
  misc_feature (463)..(463): n is a, c, g, or t
  misc_feature (480)..(480): n is a, c, g, or t
  misc_feature (507)..(507): n is a, c, g, or t
agaacccaagaaccaactcctagatacatactgttggtgtattggagatgaagttagagtcatctttcagttttaaggccatgtgtaaagtttaaccatatgtacaantacctattctgtattagaaatagctagttgaaacttaatacttctcaaaactcatgttcctgtgtccacaaactaagtttatatgtgaacttactgagtctttttgtgtcataccaaaataaagcaaggacttattttttttcccaaagccaatacaatttgagccaatccctcaagatggtcactttacactgaaagctgagctcagcaggagcactgtgggaaacaaagcattgactnctngagtacagagtttaaaatagacttttcttttagaactagaattagagtagttaacgttcatccnccaaccattgttacgtgtgcatnacnngtcgctcttgtggtgatagantcttatttatttttatnccagcttatactgtgagaactcattantcagtttgggtctcatcaaccctgcta

SEQ ID NO: 5673 - DNA, 442 bp, Mus musculus
  misc_feature (29)..(29): n is a, c, g, or t
ttgagcagttgacttaggccgttctctcngcccaaagtcccctcagcaatggcgagtcagtcgcagggcatccagcagctactgcaggccgagaagcgggccgccgagaaggtgtccgaggcccgcaagcgaaagaaccggaggctgaagcaggccaaagaagaagcccaggctgaaattgaacagtaccgcctgcagagggagaaggagttcaaggccaaggaagctgcggcattgggctcccatggcagctgcagcagtgaggtggaaaaggagacccgggagaagatgaccgtcctccagaactacttcgagcagaacagggatgaagtcctggataacctcttggcctttgtgtgtgacatccggccggaaatccatgaaaactaccgcataaacggataggaggtggaagcgcctgctctgtgggttggcatgagat

SEQ ID NO: 5674 - DNA, 495 bp, Mus musculus
aactctattacagtggtccgttcaagagaaaagatctcttgtccctattgtcacataacgtttaccatgagaacctgtctcttaacccacctcaagatccacttcagacgtcaacccaaccagcacttctgctgcaaagagtcggcccactcatccaacacactcagaatgcaaaagatctacacttgccccgtctgtgacagctcctttaggggaaaggagagcctgctggatcacttgtgctgccaaagaccaatcagattcagtaaatgctgggaaatcctgggtcatttgctcggctatcttcatgaacccgtggtgctgggaaatatttttaaagtaagggactcctcgggaaagaggatggaatccaggaggagaagacggaaacgtgcctgcactgagaatcctgaaacagaaggcctgtctgggaaaggtagggtggctccgtgggaaatggagggtgccaccagccctgagagtcctgtgacagaa

SEQ ID NO: 5675 - DNA, 522 bp, Mus musculus
cagtcgcctttttcagtgcagtagacattgaccagtgcctcaggaaggaagtgaccatggactgtaaaactccttctaacccaactgggatggaaaggagatatgggatcccccagggtgaagcactggatatttaccagataattgaactcaccaaaggctccttggaaaaacggaagccagcctggaccctagctctgtctggaggttctgtatttgctcctgtggagctttattggagcggtgcaggttcctaaactcaggctttcagatgtgcttttttgcaaaaggcagccatttttctgtagcaggacctgcccaggaaagtcctcctaacggaaggcacaattcagtgcgttcagaaccaggacaccaacatcagtgcaggctgtgtgacaaggggtactgttgggcacaaatgaagcagatgccccaaaggtcacattaactcaggcatttcttcctcctcttcttggctggttctctgtcctgctgtgtatgtgctgatgcagtgccctagaa

SEQ ID NO: 5676 - DNA, 487 bp, Mus musculus
  misc_feature (279)..(279): n is a, c, g, or t
  misc_feature (333)..(333): n is a, c, g, or t
  misc_feature (346)..(346): n is a, c, g, or t
  misc_feature (351)..(351): n is a, c, g, or t
  misc_feature (366)..(366): n is a, c, g, or t
gaatcttcaccttactgaagcatgtgcaaggcagtttacaaacaaggctaatattcttacaaaatgtcattaaggaagcatccaggtttaagaaacgaatgctaatagaacaactggagaacttcttggatgaaattcatcgaagagccaatcaaatcaaccatattaatagcaattaaaagaaaatagaatgaggccacttatttcattgtcttctccaaatacaaagtaaatacaagactgttgtaatcttgtattcattctttgacatgcattgtnggctatttgagatactaaaaacattctacagttcctttccatcattttacagtncccttttcatttnagctnacttttgtaaagtgnaaagtatcacaaattttttttctttcttcccttttttctttttctttctttcttttttttaaccaactaaaactattcttcaaatcctctcgcttgtcattggctcttgcgtgtcagtttc

SEQ ID NO: 5677 - DNA, 115 bp, Mus musculus
gctacagagcatggcttcagtttgcatcagttaccgttcggttgccaggcggacctgtgtacctttattaaagctatgttaaatagaatttaagaaagaagctttgtttcctttg

SEQ ID NO: 5678 - DNA, 477 bp, Mus musculus
  misc_feature (416)..(416): n is a, c, g, or t
  misc_feature (418)..(419): n is a, c, g, or t
  misc_feature (424)..(425): n is a, c, g, or t
aaccccactctggataatgaggcaaattatgtaacctggagtgtgcttttccagtggtggcacctttttgtcttgagttcctcctggggggagaagagtaggggagaacccaggtgttcagagggtgcgtctgcctggaatcaaagggtctgttttgcagagttactgcatggttgttaatgcttagaatggcaacaaggtagaattattaatcaaaggcctatcgttaatatctgaatatccttccttcagggtttgataggtttaatagactgagtcagatgactctgatattaatcagaattgtctcctctgaggacggctgataagcactggcttgctgtccccttggggaaaagcaaacccccaaattgcataatttacttcattatccacatagtggggtcagttacttngnnacacnnatccctgtttgaagataacagaatcttagtaaatccgacaaagcctgcagac

SEQ ID NO: 5679 - DNA, 328 bp, Mus musculus
aacagcttcctgagtcagcctatatgcaccagctcctgggcctcaatctcctcttcctgctatctcagaaccgagtggctgagttccacacagaattagaacgattacctgccaaggacatccagaccaatgtctacatcaaacaccctgtttccctcgagcaatacctcatggagggtagctacaacaaggtattcctggctaaggggaacatccctgccgaaagctacaccttcttcattgacatcctgctggataccatcagggatgaaatcgcaggatgcattgagaaggcctatgagaaaatcctttttgctgaggctacccg

SEQ ID NO: 5680 - DNA, 343 bp, Mus musculus
cttggtttgacttctctatttcaggatgtttttaagtcattttttattttttccactggggaccaaacctcagaagcagcttttcatcctcttgacagttgcaagcctgccgctgagagtgtgcatgctcttgtcctaaccacacacccttggtgggagcgcctgctgccaggccaccgcagttactgcttagtacccaagttgactgtgtttgttagacacacctgtgtttacttatagactaggtttataatggggcggggtaggggtcattttatggtgtttgaaagctggggaagtagggatgtcagtgctgtgctttaagggcgcagtctcaatgact

SEQ ID NO: 5681 - DNA, 365 bp, Mus musculus
  misc_feature (287)..(287): n is a, c, g, or t
accctgcctttccaagttcaaatctggtttaaactcgccgggaagagtgtgtgcctgtctgacttggttcttcaccatggcttctcacaagaccttcaggatcaagcgattcctggccaagaaacaaaagcaaaatcgtcccattccacaatggattcagatgaaaactggcaataaaatcatgtacaactccaagcggagacattggagacgaaccaaattgggtctataaggaaccacacgtacttatgctgtaacttactgtagcgtttacagcgttaccgctntctggacagctgagtgtgtttcttaggaatataagttttctttctgtgctttagtgagttcattcagcagttcagtaa

SEQ ID NO: 5682 - DNA, 483 bp, Mus musculus
tggagtctcagtaccagcagagcatggacagcaaactgtcaggacggtaccggcggcactgcggcctcggcttcagtgaggtagaagatcatgatggagaaggtgatgtggctggagatgacgatgaggacgactcccctgatgctgagagtccagatgactcggacagtgactctgagtctgagaaggaggagtctgcagaagagcttcatgctgctgagcatcctgacgacacagaagacccgaagagcaaaaaagatgcgaagagcaattataagatgatgtttgtcaagtccagtggctcctaactaccaaacacttagtctttgtattaaaagtaagccttattgttataatgcacagtggaggactgcttatagagcacagacctttgtattataatttttaaaaaggcccttttaaataactacaaagagtgtttgctttcaaatgccatgggttacatttctccaggcatgacta

SEQ ID NO: 5683 - DNA, 493 bp, Mus musculus
aacagcctatcatgaatctggtcatgctattattgcatattacacaaaggatgcaatgccaattaataaagctacaatcatgcctcgagggccaacacttgggcatgtatcactgttgcctgagaatgacagatggaatgaaactcgagcccagctgcttgcacagatggatgttagcatgggaggaagagtggcagaggaactcatatttggaactgatcatattacaactggtgcttctagtgattttgataatgcaacaaaaattgctaagaggatggttaccaaatttggaatgagtgaaaagcttggagttatgacctacagtgatacaggaaaactaagtcctgaaactcaatcagccattgaacaagaaataagaatccttctacgggagtcatatgaacgagcaaaacatatcttgaaaacacatgcgaaagaacataagaacctggcagaagcattgctgacctatgagactttggatgccaaa

SEQ ID NO: 5684 - DNA, 539 bp, Mus musculus
actacgagtatgactgggccggcaagcccctgccgacacccatcggcaccgtccaccctgacgtgccctcccagccaccacatcgcgacaaagctcagctccacaccaagaaccaggcgctcaactccactaatggagagctgaacacagacgaccccaccgcgggccactccaacgcccccatcgcggcccccgcagaagtagaggtggcagatgaaacaaagtgctgctgcttcttcaagaggagaaagagaaaatcgctgcagcgacataagtgagggtgggtgcagccgctcaagatccccaggcgggtgtctaggaaactggcagtgtccttggtggtgtggggctccttggcccacctgcaggcaccatctttcgggacttggggtcccttccttcacacaggactttggcggaaatctctacacccgtgtctcatcatccccttcgagagcattaactatttaaacccaggagagaagcgctgtgccgtccctgctgcgcccctgttagctcataaagtccagcttgtcccc

SEQ ID NO: 5685 - DNA, 498 bp, Mus musculus
  misc_feature (368)..(368): n is a, c, g, or t
  misc_feature (370)..(371): n is a, c, g, or t
  misc_feature (373)..(374): n is a, c, g, or t
  misc_feature (380)..(380): n is a, c, g, or t
  misc_feature (443)..(443): n is a, c, g, or t
agcttttccatgttgcttgtacacatttagatgtggatttagtctgtataactgtaacagagaaattaccattttacttcaaaagaccccctgttaatgtggcaattgagcgaggcctgggctttgaacttgtctatggtcctgctatcagagatgcaacgatgagaaggtacacaatctccaatgccctcaatttgatgcagatctgcaaaggaaagaatgtaattctgtccagtgctgcagaaaggcctttggaaataagaggaccatatgacgtggcaaacttaggactgctgtttgggctttctgaaaatgatggcaaggctgccgtgtccacaaattgcagagctgtatttctccatggaganannannaaaaanctgcttttggaattatttctacagtgaagaaaccacggccatcagaagcagatgatgaatctncttccagtgtgcaagaaagctaaatgtgagggctgagacgagtcctgagtctcca

SEQ ID NO: 5686 - DNA, 465 bp, Mus musculus
gaaaaagatcctctcgacctgcttcggcctccagctctactaaagatataactggtgccgtgcaatccaagcgaagaaaatccaagtaagcgagctggaagatgacttgatacttgtaaatgtgtgtgaattttacaaagagcaattttcagctgtgactttttaaatctatttctgtacagttagtcattttaataacgcggtccttttcctagtccctgaaacctgtctcataaagtttaacggggagcagcccttttggtgttgcaaaatgaagttcaaggcttctaaaatgttgccatgtattgaaaggcgctaatgccattgtaaatgttattagtttcacatttcttaagcagcctagagtacagggtgaacatttgtagatcttctaatgatgtattgtgctgtggaagtactgtgtgtgaatagcagtagtggggcaaaacgcaatcttgtcatttg

SEQ ID NO: 5687 - DNA, 543 bp, Mus musculus
ggcattctccagagcgatccagaggcaacgtgggggtcctttaccgccagggcccctaccaggaaagatggtcggtccctggttcccagcgcctcctaggagagagagaagaaaggtgcccaacccttagctcttccttcggagcaatggctgaattcatggactatacttcaagtcagtgtgggaaatactacttgtctatgccagaggaaggaggagcaacccatgtctaccgttatcacagaaggaaacctccagagatgcacatgtactcagatactgggcacagtcaggaacaaagaaactgcagaggcgagacatctgttggacaagaaagcatctaccaaacatcagagcattctcaagagtcctcttggcctactgagaacatctctaaggacctctacatcgaagtctacccagggacctattctgtcactgtgggctccagtgccttatccaagaagacgcacgtggttgcagttgaccccgggcaaagtgtggacttggtcttccccgtgtgatgttgaccgtcactaccaa

SEQ ID NO: 5688 - DNA, 465 bp, Mus musculus
  misc_feature (317)..(317): n is a, c, g, or t
  misc_feature (397)..(397): n is a, c, g, or t
agcagccagtactgattaccacaagaaaggttttattatccccggactgagggtgaatgggatggatattctctgtgttcgggaggcaaccaagtttgcagctgatcactgcagatctggaaaggggcccattgtgatggagctgcagacctaccgttatcatggacacagtatgagcgacccagggatcagttatcgttcacgagaagaagttcataacgtgagaagtaagagtgatcctataatgctgctccgagagagaattatcagcaacaacctcagcaatattgaagaattgaaagaaattgatgcagatntgaagaaagaggtggaggacgcagctcagtttgctacgactgatccagaaccagctgtggaagatatagccaattacctntaccaccaagatccaccttttgaagtccgtggtgcacataagtggctcaagtataagtcccacagtta

SEQ ID NO: 5689 - DNA, 425 bp, Mus musculus
  misc_feature (169)..(169): n is a, c, g, or t
tagagtgtcacccttatctgaaccagagcaagctcctggactactgcaagtcaaaagacatcgttctggttgcctatggtgctcttggcagccaacggtgtaagaactggatagaggagaatgccccatatctcttggaagacccaactctgtgtgccatggcggaaangcacaagcaaactccggccctaatttccctccggtatctgctgcagcgtgggattgtcattgtcaccaagagtttcaatgagaagcggatcaaggagaacctgaaggtctttgagttccacttgccagcagaggacatggcagttatagataggctgaacagaaactaccgatatgctactgctcgtattatttctgctcaccccaattatccatttttggatgaatattaacgcggaagcctttgttgtgacatc

SEQ ID NO: 5690 - DNA, 183 bp, Mus musculus
tacaaagcaacggagaacgacatttacaacttcttctctccactcaaccctgtgagagttcatattgagattggtcctgatggaagagtgacgggagaagctgatgttgagtttgctactcatgaagaagcagtggcagctatgtccaaggacagggccaacatgcagcacagatacatagaa

SEQ ID NO: 5691 - DNA, 568 bp, Mus musculus
gtctctcaggaatgtatgaccacagatatggagacagcgagttcacagtgcagagcaccaccggccactgcgtccacatgagagggctgccctacaaagcaacggagaacgacatttacaacttcttctctccactcaaccctgtgagagttcatattgagattggtcctgatggaagagtgacgggagaagctgatgttgagtttgctactcatgaagaagcagtggcagctatgtccaaggacagggccaacatgcagcacagatacatagaactcttcctgaattcaacaacaggggctagcaatggggcttatagcagccaggtgatgcagggcatgggcgtgtcagctgcccaggcaacttacagtggcctggagagccagtcagtgagtggctgttacggggccggctacagcggtcagaacagcatgggcggatatgattagtattgtaggaacatttgagttatttcaatcagaaaatttcacaggcagccaataagcagtcaagagcagtttataactctagaggaagctgggggacccactttgcaccatgagtttgt

SEQ ID NO: 5692 - DNA, 527 bp, Mus musculus
gagattttttctccgaatgacaagaaatccttctgctcaattgaaggggaatggaatggtatcatgtatgcaaaatacgcaacaggggaaaacactgtctttgtagacaccaagaaattgcctataatcaagaaaaaggtgaggaagttggaagatcagaatgagtatgagtcccgcagcctttggaaggatgtcactttcaatttaaaaatcagagacattgatgcagcaacggaagcaaagcacagacttgaagaaagacaaagagcagaagcccgagaaaggaaggagaaggaaattcagtgggagacgaggctctttcacgaggatggcgaatgctgggtttacgatgagcctttactgaagcgtcttggtgctgtgaagcattaggccgacaaccgagtccacacctggtgaccagggcagtaggcgtaattaagcaacaatcgatcttccttcaggagagcttgtcacttccttcttaacgcagtggttcctatctcagggatactggacttgacgacaca

SEQ ID NO: 5693 - DNA, 216 bp, Mus musculus
  misc_feature (125)..(125): n is a, c, g, or t
  misc_feature (127)..(127): n is a, c, g, or t
  misc_feature (129)..(129): n is a, c, g, or t
catttttctaccacacgcatagtcaaactcctagcccaaagaaccgaagccacttgaggtgggccccttggcagtgtgggggttagaagtcggcccactgccctgacctccaccaggttttagangntntttatgccagcctgcccttctagagaaagcgccactaccctgcatgggtggggtcttgtggcctgtggcactttgtcctcttctgca

SEQ ID NO: 5694 - DNA, 551 bp, Mus musculus
  misc_feature (106)..(106): n is a, c, g, or t
  misc_feature (147)..(147): n is a, c, g, or t
  misc_feature (307)..(307): n is a, c, g, or t
  misc_feature (309)..(309): n is a, c, g, or t
  misc_feature (311)..(311): n is a, c, g, or t
  misc_feature (414)..(414): n is a, c, g, or t
  misc_feature (436)..(436): n is a, c, g, or t
aggcagagtagtgacatttcaccaggtttagataacacaaacctgtcgaaacctcaacgccacttcccagctctgaatgcagaggctagcaggaaactaggtttantgggtgcttagctttgttggttcaacctgagtgttgagtanacccaaaccatgtgaatacccaaaccatgtgttcccatttttctaccacacgcatagtcaaactcctagcccaaagaaccgaagccacttgaggtgggccccttggcagtgtgggggttagaagtcggcccactgccctgacctccaccaggttttagangntntttatgccagcctgcccttctagagaaagcgccactaccctgcatgggtggggtcttgtggcctgtggcactttgtcctcttctgcatgtctgaggccactgncaattgctgcccatgtccaganttgtcctatcccagttttgaaagccccttatttataacttttatactgtggcgcctgtctcctccccggctgtacggggtgggactgttttaacgtttcgtttgtacggatgtat

SEQ ID NO: 5695 - DNA, 546 bp, Mus musculus
  misc_feature (379)..(379): n is a, c, g, or t
  misc_feature (400)..(400): n is a, c, g, or t
  misc_feature (513)..(513): n is a, c, g, or t
taggccgacccataggtgccctggccaggggagcaattggaggaagaggcctacccataatccagagaggcttgccccgaggaggactacgtgggggacgtgctaccagaaccctgcttaggggtgggatgtcgctccgaggtcggggtatgataggtcggggaagagggggctttggaggcagaggccgaggtcgtggccgagggagaggtgccctcactcgccctgtattgaccaaggagcagctggacaaccaattggatgcatacatgtcgaaaactaaaggacacctggatgctgaattggatgcctacatggcacagacagatcctgaaaccaatgattgaagcctgcctgcctgcccgcctgcctgttagantcttgttaaagtcaccacatntataaaacaaccttgagaaaacatgagaagaaatctgatcgatgctggaaggacctgtcacaataggctgtggacttacctgccaccagttggtgcatttagtctgttctgtntactttttgatactgtgttatatgaaaccctat

SEQ ID NO: 5696 - DNA, 240 bp, Mus musculus
gtagagaacacgaacaccgctgcgccctcctgcgaggccggctgaacgaggaaataattgctaataaggcctctgtagccatggctacttctgacgtgaaaccaaaatcaataagtcgtgccaagaaatggtcagaggaaatagaaaatctgtacagatttcaacaagcaggatatcgggatgaaattgaatataaacaagtgaaacaagttgccatggtcgaccgatggccagagacag

SEQ ID NO: 5697 - DNA, 564 bp, Mus musculus
  misc_feature (292)..(292): n is a, c, g, or t
  misc_feature (305)..(305): n is a, c, g, or t
  misc_feature (308)..(308): n is a, c, g, or t
  misc_feature (323)..(326): n is a, c, g, or t
  misc_feature (330)..(330): n is a, c, g, or t
  misc_feature (366)..(366): n is a, c, g, or t
  misc_feature (371)..(371): n is a, c, g, or t
  misc_feature (390)..(390): n is a, c, g, or t
  misc_feature (409)..(409): n is a, c, g, or t
  misc_feature (430)..(430): n is a, c, g, or t
  misc_feature (449)..(449): n is a, c, g, or t
  misc_feature (460)..(460): n is a, c, g, or t
  misc_feature (466)..(466): n is a, c, g, or t
  misc_feature (515)..(515): n is a, c, g, or t
agctaactccaaattttcatctttaacatactggtgcagtttagctgtcttctctgcatctccagtttctttaattctaaacaagaaacactaaaaaattcgtgtcttaacatctttgtaagtttaaaaaaagtagtggaatgtttagatgttttgtttttgaagatgtaggccattctgagaaaagcagttgggagatgtttaatccttgaatgttttacactgcctcccccaccacattcataaccctgtggacagtcctacctcaccctggtcaacccatgtgaccctnactgttatggccngancagtgtctccatttnnnncatncacaaaactgtttcttggtccaaaagattaaaactnccctntgaagtgttcacctttctntcttgctggattaggcatnactcataagttccaggaaatntccagcactatccccacgnccctcattttntacaanccatgacaaaggaaaaaggacaaggaattctaacagtgaggaatgattntcatatgggaccagaatatcatgtggctcaggctttcttaaaacagaaa

SEQ ID NO: 5698 - DNA, 325 bp, Mus musculus
  misc_feature (295)..(295): n is a, c, g, or t
gagcagtttactttatagcctaggaatagacatttcaacacactgagccagacactggaggccgcagatggacctccagggttgaatgtttaaaaggggatccaaacatacgagcagatgactgctgtatgaagtgatggggcaggagtacaggtgcaaactcatatgtactgcttaactttctgaagtgtgctctgacttgaagtgcgtgatttattttattttatttttttttaaccatgaagacaaagcacggagtactgtttagaggaacctgctactattggagtaaatntctttgaatttttccagactattgagatag

SEQ ID NO: 5699 - DNA, 568 bp, Mus musculus
  misc_feature (404)..(404): n is a, c, g, or t
  misc_feature (483)..(483): n is a, c, g, or t
  misc_feature (500)..(500): n is a, c, g, or t
  misc_feature (523)..(523): n is a, c, g, or t
gtacatgagcatgctggcggccagtggccccacgtgggaccagtgtcctccgttccagtggagcaaatcgccattccacagcatgctgcacatgggccagcccgacctctggatgttctcacccatcagggtgccatgggactgagagagagtccgcctccgcctagctgccttcattttgtgtggccagtgggtcatacacctgccgtccacccctcgggcttctgtcttcactagactctggtcctagcggcttccttcgcaaggacacaacccagtgggctcagagttgcctctgtctctgagccctctgccccttcatggctcatcctccctgtccctgtcaccagcaggctggggcttatgcttggctgtgggcctggtgggatccggggcacacattntcctagtgctggtccctcagcatatgtgtgaactgacaggggacattatggttgtcactgctggcctgtgggcccatcncctcaggaggcagcccntgtgcccttctgggcagctcttnctaagtgcaggagcttgagaacaaaaccaaagtttctggctgctt

SEQ ID NO: 5700 - DNA, 396 bp, Mus musculus
gcggttacaggaatggaaagcacttaagaagaaacaaaaatttggggaattgagagaaatttctggaaatcagtatgtgaatgaagtcacaaatgcagaaaaagacctgtgggttgtaattcatctctatagatcaagtgtcccaatgtgcttggtggttaaccaacatctgagtgtcctagcaagaaagtttccagaaaccaaatttgttaaagccatcgtgaatagctgcattgaacactaccatgacaactgtttaccaacaatttttgtttataaaaatggtcagatagaaggcaaattcattggaattatagaatgtggagggataaatctcaagctagaagaacttgaatggaaactatcagaagttggagcgatacagagtgacttgga

SEQ ID NO: 5701 - DNA, 554 bp, Mus musculus
  misc_feature (419)..(419): n is a, c, g, or t
  misc_feature (450)..(450): n is a, c, g, or t
  misc_feature (458)..(458): n is a, c, g, or t
tgagcaaggtgcacagggccagcctggagtgggagcggtgggaacagaaggcgaaggagaagaattaaatggaggaaaaggccactttggtcctggtgctcctggtcctatgggtgatggggacaaggatagtggcaccagggctggtggtgtggagcaggaacaaaatgagccagttgctgagggcactgagagccaggagaatggaaatcctgggggtaggcagatgcccctccagggctctaggttcgcccagcatcgactgagggaactggagtccattttgcagcgcactaattcctttgatgtcccaagggaggatcttgatagactgatggatgcctgtgtgtccagagtgcagaattggtttaagatcaggagggctgcggccagaagaaacaggaggagggcaacaccantccctgaacattttagaggaacattcgagtntcctgctntgtcgtggagtgagatggggagaaagatgcccttttgcgacaccgagattttgatttgatcacatatgccggctatgacagcccttacttttcaag

SEQ ID NO: 5702 - DNA, 315 bp, Mus musculus
  misc_feature (239)..(239): n is a, c, g, or t
  misc_feature (285)..(285): n is a, c, g, or t
ggctctcctcttacgacacagggtattcatcttatgtttcattggggcatgagggccttacgtcattctcttccccctggcacttgatgattctggaatgggcaactatatacccattacaccttcaggcaaagttattaatggaagaaatattaatacaaagaaagcttttgagaaccgtcaagaaagagaagctgaagatgacagtgagttgatatcctttcttgtaaatagtgtgncaaatgaagagcattttacagacaaatgtaactggagaagacagtngttcaacaattactcaccaaattcctacag

SEQ ID NO: 5703 - DNA, 476 bp, Mus musculus
  misc_feature (121)..(121): n is a, c, g, or t
  misc_feature (177)..(177): n is a, c, g, or t
  misc_feature (269)..(269): n is a, c, g, or t
  misc_feature (281)..(282): n is a, c, g, or t
  misc_feature (298)..(298): n is a, c, g, or t
  misc_feature (311)..(311): n is a, c, g, or t
  misc_feature (315)..(316): n is a, c, g, or t
  misc_feature (320)..(320): n is a, c, g, or t
  misc_feature (325)..(326): n is a, c, g, or t
  misc_feature (333)..(333): n is a, c, g, or t
  misc_feature (377)..(377): n is a, c, g, or t
  misc_feature (436)..(436): n is a, c, g, or t
  misc_feature (451)..(451): n is a, c, g, or t
ttcctggtttcccaagaacttatgagtcttctgtctggactgctgcagccttgccctgagcagcggaccactttggagaagctgatcagggacccctgggtgacacagcctgtgaaccttnctagctatacttgggaagaggtgtgtaggaccaaccagccagaaagtggcctgctntcagctgcaagtctggagattgggagtaggagtccaagtgaaatggctcagagagagggtctctgtgggcctcctgctcccagggagactcntggtgaccagcnnctgcttgcatcttaanggacccctctttnccanntcanctganncaagctntcctgctctttggtttgggcagttgtatggatttcagggctttnctacctggagaaaggaagttgtgaaggattgggatgacttctgcttctagattcctatncaaatgctacaagancctgcgatgctagttttcttaggtt

SEQ ID NO: 5704 - DNA, 517 bp, Mus musculus
  misc_feature (282)..(282): n is a, c, g, or t
  misc_feature (291)..(291): n is a, c, g, or t
  misc_feature (337)..(337): n is a, c, g, or t
  misc_feature (418)..(418): n is a, c, g, or t
  misc_feature (482)..(482): n is a, c, g, or t
  misc_feature (488)..(488): n is a, c, g, or t
gatgggctgctcagtcttcatgacagctgtcttaaagtttatcccgatgccagtgctctacggagttttcctctacatgggagtctcttcgctacaaggaatccagttcttcgaccgtctgaagcttttcgggatgcctgcaaaacaccagccagacttcatctacctgcggcacgtgccgctgcgcaaggtgcacctgttcacgctagtgcagctcacctgcctcgtcctgctctgggtcatcaaggcatcgccggccgccattgttttcccaatgatggntgctggccnttggtcttcgtcaggaaagtcatggatctctgcttctccaagcgtnagctaagctggctggacgacctcatgcctgagagcaaaaagaagaagctggacgatgcgaagaagaaggaggaggaggagnccgagaagatgttggacattgggggtgacaagtttcccctggaaagcaggaagctgctaagtantcctgncaagagcagcagcttcagatgtgaccctt

SEQ ID NO: 5705 - DNA, 221 bp, Mus musculus
  misc_feature (144)..(144): n is a, c, g, or t
aaaacaggtgcacgaggccttcggtctataatggaaaagctgttactagaaccaatgttcgaagttcctaattctgacattgtatgtgtggaagttgacaaagaagtagtagaaggcaaaaaggaaccaggatacattcgggcnccctcaaaagagtcctctgaagaggaatatgactctggagtggaggaggatggatggcctcgtcaagcggatgctgc

SEQ ID NO: 5706 - DNA, 461 bp, Mus musculus
  misc_feature (344)..(344): n is a, c, g, or t
  misc_feature (367)..(367): n is a, c, g, or t
  misc_feature (411)..(411): n is a, c, g, or t
gagatgtcatccctggaaaagccaacaaaagccttgcccaggaagtccaaagatcccctgctctctcagcgcatctcctccctcacagctacactgcacgcacacagtcggaagaaggtcaagaggaaacaccctcggcgggcacaggactccaccaagaaacctccaagtgccacacgtaccagcaagacccagcgccgccgtcggatgactggaaaagccaggcacaacggggagtgagccctcaaacctgggggtcccagcttgagtccttggctgtccctgtaacccagctacaccgagggttacctgcagcctaagcctgaaaatcaggactttgccangccagggtcatccttgctttgancccagaaggaacggacttctgagagcccgggttcccggagcctncagaaccgtgctggggctcgttcacaagtgtacatccacctgggactgaa

SEQ ID NO: 5707 - DNA, 546 bp, Mus musculus
  misc_feature (364)..(364): n is a, c, g, or t
  misc_feature (519)..(520): n is a, c, g, or t
actgtgagcgctgtgggaaagctttccgtcagagttcccaccttaccaggcatgagagaactcatactggtgagagaccatatgtgtgcatcaagtgtgggaaggcattcacacagagctcacaccttattgggcatcagaaaacacatgggataaaattcaagaagcagcccaaattgtagcctttgtgcctttcaaagcactatttttttttttcagccttgagatgtactatgcagacactcagtatgacagataggctttgactaaggagagccccacaccttaaggacagctcaggacaccacctagcaggcagtgagtgaaaccatcagggagttcttaattgcttcatttatcctcnaaaggaaataaaatatctgaaaatgcatctaagtttaagaagtcaagtaccaaaaattgcactgatatttctatacaggataaaatgtgtaagtgaaaaaaaactaaaagtatatagctaaataagctattatatttgtgtggaacttttttttnnctgctgtgatagctattttttgttat

SEQ ID NO: 5708 - DNA, 543 bp, Mus musculus
  misc_feature (259)..(262): n is a, c, g, or t
  misc_feature (265)..(271): n is a, c, g, or t
  misc_feature (273)..(279): n is a, c, g, or t
  misc_feature (281)..(281): n is a, c, g, or t
  misc_feature (293)..(293): n is a, c, g, or t
  misc_feature (298)..(298): n is a, c, g, or t
  misc_feature (313)..(313): n is a, c, g, or t
  misc_feature (315)..(315): n is a, c, g, or t
  misc_feature (319)..(319): n is a, c, g, or t
  misc_feature (323)..(323): n is a, c, g, or t
  misc_feature (338)..(338): n is a, c, g, or t
  misc_feature (340)..(340): n is a, c, g, or t
  misc_feature (347)..(347): n is a, c, g, or t
  misc_feature (360)..(360): n is a, c, g, or t
  misc_feature (362)..(362): n is a, c, g, or t
  misc_feature (377)..(377): n is a, c, g, or t
  misc_feature (383)..(383): n is a, c, g, or t
  misc_feature (390)..(390): n is a, c, g, or t
  misc_feature (444)..(444): n is a, c, g, or t
  misc_feature (446)..(446): n is a, c, g, or t
  misc_feature (483)..(483): n is a, c, g, or t
  misc_feature (485)..(485): n is a, c, g, or t
  misc_feature (503)..(503): n is a, c, g, or t
  misc_feature (512)..(512): n is a, c, g, or t
aggacgatgcctgcaaaggacgatgtatctctgcggctgaggagcagcattctgagtccacgaagctggatcaccttctagaaaagcagaaaccatctgtgtttgtggagatcgacctgggagaccatactgaggaggaggtcatcacctgtgccatcaaagaagagaagaggctccccaacataggagacttgtctgaagatgagataaggaccagctgggtatgctgcatcccgtaccacacaaagaagaaggcaannnnaannnnnnntnnnnnnnanaagaaccatcantcatntcaggacaagacccntntgantcanccgctagtagagctntntggggantaaaggaagacancntaggcctggaatggntccatnatccccnccatgggcagggccagagtgacagcacccaacggatacccaaggcaagagaccntnttccaatccaaggccaatcacagccctaggaaccaantnttcaggaccagcaggcantcccgcttnctggctatcacagaacttaagagccagctaa

SEQ ID NO: 5709 - DNA, 518 bp, Mus musculus
  misc_feature (296)..(296): n is a, c, g, or t
  misc_feature (310)..(310): n is a, c, g, or t
  misc_feature (321)..(321): n is a, c, g, or t
  misc_feature (351)..(351): n is a, c, g, or t
  misc_feature (372)..(372): n is a, c, g, or t
  misc_feature (376)..(376): n is a, c, g, or t
  misc_feature (379)..(379): n is a, c, g, or t
  misc_feature (388)..(388): n is a, c, g, or t
  misc_feature (463)..(463): n is a, c, g, or t
tgagtatgccaagaagtaccaccccctgactctggaatgcaaaaacgagaagaaaccgctgcaggagccccctatccctggctgggcaggctacctgcccagagctagggtcactgaatttggctatgccacaaggtataccatcatggccaaaaagtgctacaaggacttcctggatttggtggagcaagccaagagggctcagctgaagccatatgagcaaacatacgatgtgagggctgcccagcctcttagcccttcttcaaaaatcttgcagctgcaaggtctctcacccncatttccagaattntctgggccagntcaaacacccccaagtgaggacccccaagntcccaggccctgtggttgtgntcantgntccagccantcatgcagcaggaatgtgtatggggagccaccatccttagcaaaggcttttgccgagagctagagccctgcatcntccctaggagatgtaagcctcaagggagcacagacacctgttgtacttgcatcaa

SEQ ID NO: 5710 - DNA, 170 bp, Mus musculus
aagaggagagtgtccagttcctggaacagcagaccttatgtaaggacgaagccagtgacttcacaataatcctagaggaaatggagcagctcttagaaatgtagctcaaggcaggtggccggacggcttcttcctggataaaccctcggcagaggctacttaggatatct

SEQ ID NO: 5711 - DNA, 446 bp, Mus musculus
  misc_feature (299)..(299): n is a, c, g, or t
  misc_feature (304)..(304): n is a, c, g, or t
  misc_feature (314)..(314): n is a, c, g, or t
  misc_feature (323)..(323): n is a, c, g, or t
  misc_feature (357)..(357): n is a, c, g, or t
  misc_feature (364)..(364): n is a, c, g, or t
cagctcctcctgtgtaaacaaactttcctctaagcacccctcttatttccagaccccttccttcctgtctaccctcatgtctacctcttctccaagagcactgctggatagttgcctagttcctctttcccatctggaaactagctactttcagccagaggagcaaatccttcaggaactgaacaagatttctctagacccagagcttaaaattggaggaagcagatatgacctcacatccttggtaccagggaatctgcagccagggacagagactggaaatcatgaagtggaagatnctcantccctggatnatcttgatnccttcactcaggaaacactggacagaatgaattntcattgntcaagaacgcaagttttaccaaataacatttcgggatggagaaaccagagggggaaactgaagtgacaggacctcaggattt

SEQ ID NO: 5712 - DNA, 514 bp, Mus musculus
  misc_feature (276)..(276): n is a, c, g, or t
  misc_feature (293)..(293): n is a, c, g, or t
  misc_feature (298)..(299): n is a, c, g, or t
  misc_feature (322)..(322): n is a, c, g, or t
  misc_feature (324)..(324): n is a, c, g, or t
  misc_feature (339)..(339): n is a, c, g, or t
  misc_feature (348)..(348): n is a, c, g, or t
  misc_feature (379)..(379): n is a, c, g, or t
  misc_feature (382)..(382): n is a, c, g, or t
  misc_feature (412)..(412): n is a, c, g, or t
  misc_feature (418)..(418): n is a, c, g, or t
  misc_feature (432)..(432): n is a, c, g, or t
  misc_feature (434)..(434): n is a, c, g, or t
gagtaggatgcctccaggacatgtacgcaagcagccccttgtggaaagcatggatctgggagatggatctgggaaacttactgcatcgtctgcagcacagatatgaagaggagtctaagggaaaagctgcaaactgtaaagaacttctgaaaatgtactcgaagaatgtggccctctccaaatcaaggatcttttggacctggctaatcaagtatttgcaaaactgacatcagatttcttaatgtctgtcagaagacactaattccttaaatgaantactgctattttttttnaatcnnaaacttttcatttcagattttananaagggtaactttttnattgcattngctgttgtttctataaatgactattgtaatnccnacatgacacagcttgtgaatgtgtagtgtnctgctnttctgtgtacatantnatcaaagtggggtacagtaaagaggcttccaagcattactttaacctccctcaacaaggtatacctcagttccacggttg

SEQ ID NO: 5713 - DNA, 485 bp, Mus musculus
ttgtatctcacaaatctggtctagattcagttatgaatgtaggcattagttaaaattaacaagatgcagagtattaatttcttaagacaagtgatttctgtaagtttgagccctatgtggaaagcattgtggaaccttaacctttttgtacacactcttgtgggacgtgtcatataaatgtcagcactaagtaatgtcttgtttgtggctgaatatttttcgtagatgtttttgaagttgacatgacttacgtgcatttaaatatatattgccatccttagtttgtaattaagatttggaaaatggttgtggatttctgagcatgtgcagactggtctagctagttcaggaactggtgcatgtatttttcaaagacaaagaaagtgtactgcgaaaacttgcaggaagattaattttgtggcagttttctaaaactgacaaccaggtgggaccaaagtttatgtgcctttagtcttaatttacct

SEQ ID NO: 5714 - DNA, 512 bp, Mus musculus
  misc_feature (77)..(77): n is a, c, g, or t
gaaaattgaatactggcactccatctcttagaacatatgaattctagtgttcaatattcattattggttgtttttgntgtgctgatttttggtgatcagacctcagctcccttaatactgccctttttcctttaagagatttcatgtgtgcacagagaggccacccttttcaggactgtgcattttcaggtttgtgatgataaaaagatcgaccaatgggagctttcctatgacctttcaattggctctgaagttccagcatgtggttgcttcactcctggactgtgattttcagtgggagatggaaatttttcagagaactgaactgtggaaaatgacctttcctcagcttgaagctacttttaaaatctgcgggtctggaccaaaagaagaacatcatgtttgtagtcaagatgacagatacagtgagagcaacagctaactccaaaggtggcttcactggagagaaagaaagtgtcttgagcaagacagtattgtcagaagatcccagg

SEQ ID NO: 5715 - DNA, 173 bp, Mus musculus
gatttgaccccaacaccagggaggatctgccctaccactactatgacaaaaaaggaaccaaatttaccaccaagtggcaggagtctcaccagctgcctgctgagtttcagctgctctatcgaatgcatggggaagggctcacgaagctcactctgtcacactgtgcctaagaa

SEQ ID NO: 5716 - DNA, 470 bp, Mus musculus
  misc_feature (238)..(238): n is a, c, g, or t
  misc_feature (266)..(266): n is a, c, g, or t
  misc_feature (279)..(279): n is a, c, g, or t
  misc_feature (286)..(286): n is a, c, g, or t
  misc_feature (291)..(291): n is a, c, g, or t
  misc_feature (321)..(321): n is a, c, g, or t
  misc_feature (328)..(328): n is a, c, g, or t
  misc_feature (401)..(401): n is a, c, g, or t
  misc_feature (426)..(426): n is a, c, g, or t
tccgaaaaaccattggccgcctacaagtcaagtgcaagaacgctgcagccggctgcttggacacacaccctctggctcatcgcaaggagcatcaggactcatgcccctttgagctgatggcctgccccaatgagggttgcactgtgcaggtgctgcgaggggtcctggatgaacaccgccagcattgccagcagaatggacagcagcgctgccccttaggctgtgggtccaccctggntgccttggaaggtgagcaccacaactgntaccgcgagctangtgatgnttggntccaacgccatgagcgcaaccggaccctgntgctggncctgctggggcgtgtacgccgggtgcacctcaccaccagcatcatccaccagcagctggcacagctgagcaanttcctggaggatgatgataacctgntcctgaatgcccaggtgcaagagactgaggttaccccggaggct

SEQ ID NO: 5717 - DNA, 351 bp, Mus musculus
gaaggactgactgtgcaaagacccctctcagttgtttagacactaacaaaatttatacttagcttaatccacttcatggttgttaacattttatactcattgggcaactaaatggctaagttcaatagggatagtttgcccttacttagacaatctctccttgcattagtctttgtcacaccgacctgagttgcaaatttttatcattacttttaatttaaagtcttcaacataactttgggctttaaaagttaaagttcttacgctatgaccgttctcacattatttatagattcatcattttaaatgtagtttgtgaaagtacgtagggtgttgctaaagattcttcat

SEQ ID NO: 5718 - DNA, 537 bp, Mus musculus
  misc_feature (361)..(361): n is a, c, g, or t
  misc_feature (363)..(363): n is a, c, g, or t
  misc_feature (382)..(382): n is a, c, g, or t
  misc_feature (385)..(385): n is a, c, g, or t
  misc_feature (393)..(393): n is a, c, g, or t
  misc_feature (420)..(420): n is a, c, g, or t
  misc_feature (422)..(422): n is a, c, g, or t
  misc_feature (430)..(430): n is a, c, g, or t
  misc_feature (446)..(446): n is a, c, g, or t
gagcgccacaacactctatgggaaggtctacatatgtggtgggtttaacggaaacgaatgcctgtttacagcagaagtgtacaacactgagagcaatcaatggacagtcattgcacccatgaggagcaggaggagtggaataggtgtaattgcttacggggaacatgtatacgcagtgggtggctttgatggagccaatcgactgaggagtgcagaagcctacagcccagtggctaatacttggcgcacgatccccactatgtttaaccctcgtagcaattttgggatcgaggtagtggacgacctcttgtttgtggtgggtggctttaatggctttaccaccacctttaacgttgagtgntntgatgaaaagaccgatgantgntatgacgntcatgacatgagcatataccgcagtgntntgagctgntgcgtggtaccagggntagccaatgttggggagtatgcagctagacgggacaacttcacgggattagcactgcgagatgaagtaaagtattccgcttcgacaagtac

SEQ ID NO: 5719 - DNA, 452 bp, Mus musculus
  misc_feature (161)..(161): n is a, c, g, or t
  misc_feature (165)..(167): n is a, c, g, or t
  misc_feature (173)..(174): n is a, c, g, or t
  misc_feature (222)..(222): n is a, c, g, or t
  misc_feature (231)..(231): n is a, c, g, or t
  misc_feature (233)..(233): n is a, c, g, or t
  misc_feature (246)..(246): n is a, c, g, or t
  misc_feature (265)..(265): n is a, c, g, or t
  misc_feature (284)..(284): n is a, c, g, or t
  misc_feature (294)..(294): n is a, c, g, or t
  misc_feature (300)..(300): n is a, c, g, or t
  misc_feature (324)..(324): n is a, c, g, or t
  misc_feature (364)..(364): n is a, c, g, or t
  misc_feature (366)..(366): n is a, c, g, or t
  misc_feature (417)..(417): n is a, c, g, or t
gaaggagaacacgaaggatgcccaagaggagtacatcaagcgagcccaggccaacagccttgcttgtcaaggaaagtacaccccaagcaatgagtcaggggcagccgccagtgaatccctcttcatctctaaccacgcctactgagcagaggtggcctaanggcnnnccctgnnagcaccccaggtccctgcctacccacttgctcttgagaagaggtagcnttcaggctntntcccatcaacccntcttgccacccctcacgantttggtgtgtggtattgtnctgtgaatgntgactntcatcccttccatcccgctgccantcaacaactatttaaagggggaaggaggaagggccctttntnttgaagatttgctgggcgcggaggtggcaggtatcacatttttagggtatntctgtaataccactccagccatcccatgtgttttt

SEQ ID NO: 5720 - DNA, 481 bp, Mus musculus
  misc_feature (253)..(254): n is a, c, g, or t
  misc_feature (257)..(257): n is a, c, g, or t
  misc_feature (262)..(264): n is a, c, g, or t
  misc_feature (268)..(268): n is a, c, g, or t
  misc_feature (271)..(271): n is a, c, g, or t
  misc_feature (278)..(278): n is a, c, g, or t
  misc_feature (291)..(291): n is a, c, g, or t
  misc_feature (333)..(334): n is a, c, g, or t
  misc_feature (337)..(337): n is a, c, g, or t
  misc_feature (340)..(341): n is a, c, g, or t
  misc_feature (343)..(344): n is a, c, g, or t
  misc_feature (347)..(348): n is a, c, g, or t
  misc_feature (350)..(350): n is a, c, g, or t
  misc_feature (353)..(353): n is a, c, g, or t
  misc_feature (362)..(364): n is a, c, g, or t
  misc_feature (369)..(370): n is a, c, g, or t
  misc_feature (376)..(376): n is a, c, g, or t
acctaccacatgaagcacactgctgagccagagccaagggaactcttcttataaattactcttagcgtgattctcacacatgccctccggccaccattggaagctaatggactgtccactgtggcaatcagaccataagaacaacacctcaccagtcgagcagaatatctggatgccttaaatttataatatgagacttgttataagatacattttggaccatatctgtatatagaacttgtttgttcatttnnttnttttnnnaatntantatttgnaaacatgatcggncaatgtatgcattgaaacattggacacttgtttgattcgatnnttntcnnannacnntnctnccaggaccnnnacacnnttggtnttttgtgaattgcatgaggatttgctaatgttgatattcactttttccatcacaagggcagctgcagctcagctcattgaggccaggtcactggttttattttct

SEQ ID NO: 5721 - DNA, 392 bp, Mus musculus
  misc_feature (26)..(26): n is a, c, g, or t
  misc_feature (87)..(87): n is a, c, g, or t
  misc_feature (116)..(116): n is a, c, g, or t
  misc_feature (337)..(337): n is a, c, g, or t
  misc_feature (341)..(341): n is a, c, g, or t
ggtggacggcaagaaactgcgtatcngggagtacaaggccatcatgcggaaccggaggcaggaaatgcgacagtacttcaacgttgngcaacaagcacagatccccatcgcgacgnccggagttgtataccccagcgccatcgccatggcaggaatgccgtcccctcacctgccctccgagcactcgagcgtgtccagcagcccggagcccgggatgcccgtgatccagagcacttacggcgccaagggagaggagccccacatcaaggaagagatccaggctgaggacatcaacggagagatttacgaggagtacgatgaggaggaggaggacccngatntggattatgggagtgacagcgaaaaccacattgcgggacaagccaactgat

SEQ ID NO: 5722 - DNA, 559 bp, Mus musculus
  misc_feature (227)..(227): n is a, c, g, or t
  misc_feature (382)..(382): n is a, c, g, or t
  misc_feature (534)..(534): n is a, c, g, or t
tcttcagacaccagcgattcagactcgggctaaggggccaggccagatggggcaggaaggctccgcaggaccggacccctgaaccacccttccccactttcccttgctgtgacgcttcttcatctcacccctccataggagagctggctctgcagtggggaggaaggcagggacatggacaaaatacgattgaattcctagccctcttgggtgtggtgtccctgttngaggatgatgggggtggggcaagggtatgggtgggagtggggatgataggcctggcataaagccccctgagctgtagctgtcctgttcacttctaagggccctgttttgaggttttaatttatttaagctatgtggtaaggctgggggtgtgtanccgtggtcctccctccagcttccatggggagggaagaagagggagctctttttgttttttacattgactttttttttctacttttcccttttacttccactccatttggggcctggggattttagtcacctctccagttggccccaagactntcttttctttcttgagtctaacatg

SEQ ID NO: 5723 - DNA, 299 bp, Mus musculus
atggatgtagacacagactgttgctagcctgacctcattatggggattagggtgatcttcaaggcctttctggtctccgttctcccatgcagggcaatttggactgtttttgccccaggctgtttagctgccaggacaacactggcagagagaggctgaggcgctgggctgcagtagcagcaggcaacagcctgatgcctgtgacagtgccccaggaaggttttcaggcagtgccttgctccctggaccctgacccaccgtgttgcctctgttgattggccagtactgtcatttccatc

SEQ ID NO: 5724 - DNA, 551 bp, Mus musculus
  misc_feature (340)..(340): n is a, c, g, or t
  misc_feature (359)..(359): n is a, c, g, or t
  misc_feature (372)..(372): n is a, c, g, or t
  misc_feature (375)..(375): n is a, c, g, or t
  misc_feature (420)..(420): n is a, c, g, or t
  misc_feature (436)..(436): n is a, c, g, or t
  misc_feature (461)..(461): n is a, c, g, or t
  misc_feature (517)..(517): n is a, c, g, or t
  misc_feature (519)..(519): n is a, c, g, or t
acagtgattgtggaatcccgctgacgcatttgcaggtagatggaggaatgaccgcaaacagagttctcatgcaactgcaggcggacattctgtgtattccggtgatgaaacctttcatgccagaaacaactgcactgggagtcgcaatggcagcgggagcggcagaaggagttagcgtgtggagtctggatcctaaggatttgtcaagtgtccagatggagaagtttgaaccccagatcaatgtcgaggaaagtgaaggtcgttacgccacatggaagaaagctgtgctgaagtcaatgggttgggttttgactcagtctcctgatggtcgcgaccctantattttcagcagcctgacnctgggcttttatntantgagtagtatggtgatattaattggagcaaggtacatgtaaggtntcccataaatcatgcntccttgtggattccccaaggagagntctttacctaatgaaagaatccagcagttgtttcaatgtaataccactatttggantntggatttgtttatgtgccccttgttgcatgta

SEQ ID NO: 5725 - DNA, 424 bp, Mus musculus
gaaacaccacaacaagtattccagaatattttaaaaagagatatcccatggccagaaggcgaagaaaagctatctgataatgctcaaagtgcaatggacatgcttttaaccattgatgattcaaagagagctggaatgagagaactaaaacagcatcctctcttcagtgaagtggactgggaaaatctgcagcatcagactatgcctttcgtaccccaaccagacgacgaaacagatacatcctattttgaagccagaaataatgctcaacatctgaccatatctgggtttagtctgtagcacatgcgtgtcatttttatctaacttgtgatatagaattaagttttacagtaatatgctacttaatactagattggtctaaatgggataaaagtcattattttacccagactgaacagctttt

SEQ ID NO: 5726 - DNA, 467 bp, Mus musculus
tctggctgtagcagtggagaccacagcatggcccagcagtcctgtcctaggacaagaaagggaaaagcttatgcacaaacatacctcagcctggcgagcacagcactgctgacttggtcttatccctgccccaggacacacacactcagtaacacgcacacagcccttacactggggtctgaccctcttctgcctcataagccctatccacgaggcacatgcagggttgggcaaggggtctggtgctatgagaagcctgtttggccagtgtgtctcaggatttagtcataaaggatagacccttcctacccaggggtgacagggacagtgctgcaagacttttcagtcatcaaatactctttcctcaggcagcttgttcccctgtccctctcaatgcccctcactgccctcaagccagcagcaggctcctagccagaaaatgcaagagctgggtgccttgtgtgccc

SEQ ID NO: 5727 - DNA, 589 bp, Mus musculus
  misc_feature (328)..(328): n is a, c, g, or t
  misc_feature (355)..(355): n is a, c, g, or t
  misc_feature (406)..(406): n is a, c, g, or t
  misc_feature (414)..(414): n is a, c, g, or t
  misc_feature (474)..(474): n is a, c, g, or t
  misc_feature (481)..(481): n is a, c, g, or t
gccggaagatctgtatggcttcatgcaggatccctctctaacctttagtcctgctctaatgcagcacaaccagtctcctaccccagggctggtagaggaagaggagaaaaatgttgatgatgatgagtgtgacgtagaggtttgtgatgaaaaagaggagagcgaggaggaggaggaggaggaagtggacagagggtcagaggatgaagatgtggatgaggaggaagttgaagcggctggcaatggggaggaaggggaagaggaccaagaagaggagtatatgttggaagagacggggctggaggagggagaacagagagcggaaganaaattcttgcctctgggaatgcctttntcaatcctagtaggggacgaagaagaaagagagaactttatgaactatgantacttaanccaagaacaaataattcccaatgtgccagaggcagatctatttatggtaccggacattanccattantcatcaggaagggaactgagaaacgaaatggaaccgatttgaggctaatatggattaacagcttgttaaaaacgaattcaaaagtgagttccattaataaacatcgat

SEQ ID NO: 5728 - DNA, 373 bp, Mus musculus
agatacggtctcctgaactgacttcagaaatgtgtttccaggcatttctacagtagtgttctagtgttcacttggctcaccctgctaggtttcagtcacccagagattgtgtttactcaggcatcacgtatttatttcaaggtgactcagaacaatccttcggcttctgtagccgtttctctccatttttaagatcacacaggagacgaggtcagctttccaaaaccactctgtttccgtcacttgcggtaggccggcttcaaagccatcatgaaacctagaaagttgtggagctgagtatgtggctgagggcctgaggcaggagcaggtggcggaggttacctgtgtcaccacattgcttctttgtcagagt

SEQ ID NO: 5729 - DNA, 373 bp, Mus musculus
  misc_feature (111)..(111): n is a, c, g, or t
  misc_feature (339)..(339): n is a, c, g, or t
tgatttccaccatctgggacttggaattgcacgtagctggtctccgattgctcaacaacctcccgctacctgactatgtgcacccacagctgcggcgggtgatgcctgccntgatggagatcatacagtcagactgcatcctggcacaggtacaagctgtccgcctcctgagttacctggcacagaagaacgaccttctttatgacattctcaactgtcaggtgcgtcccaacttcctgaacctcttccagtcttcacagccgggcagtctgctgttcgaggtgctggtgtttgcggaacacttgagtgaaggtcggaacgccacccactaccgagcgntcaaatggcattacaacgagcaatccctgcacga

SEQ ID NO: 5730 - DNA, 505 bp, Mus musculus
  misc_feature (113)..(113): n is a, c, g, or t
  misc_feature (261)..(261): n is a, c, g, or t
  misc_feature (278)..(278): n is a, c, g, or t
  misc_feature (299)..(299): n is a, c, g, or t
  misc_feature (368)..(368): n is a, c, g, or t
  misc_feature (392)..(392): n is a, c, g, or t
  misc_feature (436)..(436): n is a, c, g, or t
tcacacttgaccaaggtgcttttccagtcggacatctacccagtgcttttcacctgcctcctggggctcagcaacggctacctcagcacgctggtgctcatctatgggcccanagattgtgccccgggagctggctgaggccaccagtgttgtgatgttgttctatatgtctgtgggcttgatgctgggctcagcctgcgcggccctgcttgaacactttatctaggagggggcggcaaggatgtgggtactgtgtgagtntgtgaggcttgggtccnttaggagatggacagggtaanccaaggtctcgaggtgttaagcaaggggttgacattttgtttgatgcagagcagagcccactcagactncctttctctcagactgcttgtganccacatccttgcacatcttgggcaaggagacattccaaacacancccagcctggctcatacctgtaatctcagcattcaagagaatgaagctggaggcccactgtgagttcaa

SEQ ID NO: 5731 - DNA, 570 bp, Mus musculus
  misc_feature (351)..(351): n is a, c, g, or t
  misc_feature (353)..(353): n is a, c, g, or t
  misc_feature (373)..(373): n is a, c, g, or t
  misc_feature (386)..(386): n is a, c, g, or t
  misc_feature (413)..(413): n is a, c, g, or t
  misc_feature (425)..(425): n is a, c, g, or t
  misc_feature (431)..(431): n is a, c, g, or t
  misc_feature (476)..(477): n is a, c, g, or t
  misc_feature (480)..(480): n is a, c, g, or t
  misc_feature (487)..(487): n is a, c, g, or t
  misc_feature (527)..(527): n is a, c, g, or t
ggcctacgaggtcttatcggacgtccgcaagcgcgaggtgtacgaccgctgcggcgaagtgggcgaggtgggcggaggcggcgcggcgggcagcccgttccacgatgccttccagtacgtcttctccttccgagaccccgcggaggtcttcagggagttcttcgggggccacgaccctttctccttcgacttcttcgggggagacccccttgagaacttttttggggatcggaggagcacccgtggaagcagaagccgaggggctgtacccttctctacctcctttaccgaattcccaggatttgggggtggcttcgcttcgttagatactggattcacatccttcggttntnccaggaaactcgggcctttnttctttctccatntcttgcggcggtggggcggcaggcaantacaagtcggtntcaacntccaccgaaataattaatggcaaaaaaatcaccaccaagagaatnnttnagaatgntcaagaaagggtggaagtggaagaagatggagagttaaantccctgataattaatggcaaagagcagctgcttcgcatcaata

SEQ ID NO: 5732 - DNA, 418 bp, Mus musculus
  misc_feature (316)..(316): n is a, c, g, or t
gaactccaccagaggcaattgcactgtgcagccgtctgctggagtacacacctaccgcccggctaacaccactggaagcttgtgcacattcatttttcgatgaattgcgggacccaaatgtcaaactaccaaatgggcgagacacacctgcactcttcaactttaccactcaagaactgtcaagtaacccccctctggccaccatccttatccctccacatgctcggattcaggccgctgcttcaccgcctgccaacgccacagcagcctcagatactaatgctggagaccgtggacagaccaataacgccgcttntgcatcagcttccaactccacctgaacagcccccaggagccagctgcgcgggaaagaccagcacttacttgagtgccactcagcaacactggtcacgtttgg

SEQ ID NO: 5733 - DNA, 473 bp, Mus musculus
  misc_feature (288)..(288): n is a, c, g, or t
  misc_feature (293)..(293): n is a, c, g, or t
  misc_feature (301)..(301): n is a, c, g, or t
  misc_feature (303)..(303): n is a, c, g, or t
  misc_feature (330)..(330): n is a, c, g, or t
  misc_feature (342)..(342): n is a, c, g, or t
  misc_feature (364)..(365): n is a, c, g, or t
  misc_feature (401)..(401): n is a, c, g, or t
gtgcaacaagtgtgccactcgagtcaccttccccaagtgcaaagggtgcctcaaagatattgaggaaggagaccataatgtggaatacaaaggtagtatctggcataaaaactgctttgtctgcaccaactgcaaggacatcattggaaccaaaaatttcttccctaaagatgagggattctactgtgtgacttgttatgatgccttgtttaccaagcattgtatgaaatgcaaaaagcccatcacatctggaggagtcagttaccaggatcagccctggcatagtgnagtgntttgtatntntttcctgctctaaggagctgagtgganagcgtttcactnctatggatgaccagtatttttnntgtggattgctacaagaactatatagccaagaagtntgctgggtgcaagaaccccatcactgggtttggtaaaggcgccaatgtggtggcccatgagcagaattcctg

SEQ ID NO: 5734 - DNA, 544 bp, Mus musculus
  misc_feature (47)..(47): n is a, c, g, or t
  misc_feature (109)..(109): n is a, c, g, or t
  misc_feature (296)..(296): n is a, c, g, or t
  misc_feature (308)..(310): n is a, c, g, or t
  misc_feature (315)..(315): n is a, c, g, or t
  misc_feature (317)..(317): n is a, c, g, or t
  misc_feature (337)..(337): n is a, c, g, or t
  misc_feature (351)..(351): n is a, c, g, or t
  misc_feature (357)..(357): n is a, c, g, or t
  misc_feature (430)..(430): n is a, c, g, or t
  misc_feature (483)..(483): n is a, c, g, or t
agcaagaagcatgggtgttcctattttaaaacatggaagacagtttnaaaacaataagctgatctaagaaaaccagattgtttcagagcatcttaacaataactacttntagaagcttataaaactaaccctcctataattctttaaattaatgatatttttgtttaatagtgaaatagtttgagtttgaaacttgcatgacaatatctgagtatcctcagacatacatgcagtttagagattcatcctgtaaaagtgacaaactaaatgggtggccaagaaatgcaaagctatcntcaacattaatnnnacatntncaagtcaagacttgaatccnttgtaactgttgtntgcccntggtgcatatattcaagaaagctgcgaagttccttaggattttaggacgtttccttaagaggctagctggatntctggggatatgggttggctacaatccttcataagtcatccttaggtaccacntcctacttccctgaaatacaggattacccagcaactgtattctctgttgtgatattacata

SEQ ID NO: 5735 - DNA, 515 bp, Mus musculus
  misc_feature (487)..(487): n is a, c, g, or t
agcaatgcacatactgactggttattggatgtttatgctaggaatataaagacattaaagaagctcccaagtgttcttaaagagctgcctgagaatctaaatgtatgtcctggagtgcatactgaggccttactggtgacactgaaaatgatgtgtcagtcaatcacagagctgtcatgatgccagaaagtatgaatcagatgtctgaacgtgcaacatgctttgtcatttagtatatccatagcttatggaaaaaatattaatttcagttactcactgacagcaaagtttcatagcacttataaaacatctacagatctaaaatatgggctcaggatttaactcagaaacatacaataagaaaatgaagtagttttgttcggtataaatggtttcactgatttttaaaaaacagatttgttcttcaaatatttatttatattatatatatagaaaattaatttaaatattttttcaagtcaaaatntcctttcctctgagtgctacaggtctga

SEQ ID NO: 5736 - DNA, 385 bp, Mus musculus
  misc_feature (264)..(264): n is a, c, g, or t
gtctacaacaaggacaccaccatagccgccaagcttctggcattcaatgcagacaccgaagttaagacaaagaacggctacacgccgcttatacttgcggtgctagaaaacaaacaggagatggtggaactcttactgcaggctgcagccaacataaacgccctggataactgcaagaggtccgcccttatacatgctgtgagaactcagtctaaaaacatgatcagccttcttctccagcaaggcgccaatgcatctttggtngacatctatggagctactgcacaaagttacgctgtttttgaaacctttcaagtgctttcccaaggccctggtcccagacctgagctaacaacaaaagaggccagacacagttttgatacca

SEQ ID NO: 5737 - DNA, 528 bp, Mus musculus
gcagtccgagagctaatcaacatctacttgaagcagtttcatctagctccagtgatggatgacgcagaagtggcccactggttcctgcccagggagcacatcattgacacgtttgtagtggagaaccccagtgggaagctgactgacttcctgagcttctacactctcccctccacggttatgcaccacccagctcacaaaagcctcaaggctgcctattccttctacaacattcacacagagacacccctgctggacctcatgaatgatgcgctcattatagccaaattgaaaggatttgatgtgttcaatgcactagatttgatggaaaataagaccttcttggaaaaactaaagtttggtataggagatggcaacttacagtattatttgtacaactggaggtgtccagggacagactctgaaaaggttggacttgttctacagtagatgaagatgttatttctagaaggcaacattctcatttgttaatattctatttagtgatgcctggaaatgtcattccaa

SEQ ID NO: 5738 - DNA, 532 bp, Mus musculus
  misc_feature (147)..(147): n is a, c, g, or t
  misc_feature (175)..(175): n is a, c, g, or t
  misc_feature (180)..(180): n is a, c, g, or t
  misc_feature (203)..(203): n is a, c, g, or t
  misc_feature (294)..(294): n is a, c, g, or t
  misc_feature (330)..(330): n is a, c, g, or t
  misc_feature (365)..(365): n is a, c, g, or t
  misc_feature (463)..(463): n is a, c, g, or t
tttagctctaagtacttgaccagtgagaagagcgggcaaacctccttttagaattctgcagacagtaaatggagacactgtttatgttttggtgatgtgttggtgactgcaccccacaccccaaatccaaatgtaacaggaatacantaagaagaaaccacagcgagaggaaacnagggnaaacctccccaagccttacttcncagataaagggtaacttagaaaacaatacaccgtgaagtgaccccaggaggcatttcctgggtgttgttcctagaatgagtttaactaacncatacattttctttaccacagggggaaaaatggagncaatctagacgattttgtaaccttaggttgtaatntggcttgaaaattagtacatctttaaaagttaccactgatatttgagttcattattttgttaaaaaaattgcttttaaagtacttatgttacaggaanccatcctgaaatggaaccggtctaaaaaaaaataattgtggtgtgtggttgcagctgtacctgaaataa

SEQ ID NO: 5739 - DNA, 389 bp, Mus musculus
  misc_feature (217)..(217): n is a, c, g, or t
  misc_feature (354)..(354): n is a, c, g, or t
atcagcaaccgctggaagctggccagccaggtccaggtccagaaagaacctaaagaagcaaccaagaagaaggtagctgagcaaacagctgcccgggaggaggcgaaggaggaggctgcagccggtgtgctggaacaggctatccctgtgcggcagcaggccgcgctagaaaatgctactaagaagagagaacgagccaccagtgacctgaggactntagagcaaaaacaggagaagaaacgactaaaaagctccaagaaagccaaggaccctgatcccccagggaaagacttcagtccctatgactacagccagtcagacttcagggcctttgctggggacagtaaatccaanccttcctcccagttcgaccccaataagctggcacc

SEQ ID NO: 5740 - DNA, 489 bp, Mus musculus
  misc_feature (385)..(385): n is a, c, g, or t
  misc_feature (443)..(443): n is a, c, g, or t
tctaatcctggacttgtacttcgaagtctgagtgccttgaccggaccacagcttctgactctggcccaaagccccgctggctctcatgtatttgatgccatcctgagtagcccctcagtgacacacaagcagcgtcgtcgtgtgctgaagaccctaaagggacagtatgtggctcttgcctgtagccgccatggcagccgtgtattagatgccatctggagtggagcagctttgggggctcggaaggaaattgctgctgaattgggagaaaagaaccaggagttgattcaagatccttttggccaccatgtggctcgaaatgtggcccttactaccttcttgaagaggcgagaggcttgggaacaacagcaaagtactgtggccnaagcggaggcgggcattgagctctatacttgaagactgagacttgcaacgggactcgntcttgatggggaggggaacatgcttacccttcctgtttacattgga

SEQ ID NO: 5741 - DNA, 301 bp, Mus musculus
tccatcccaacaccttgtgtatgaaatacttactggaggtcaatctccctgatgaaatgcacactttaacctgtcaagtagtaaagttgactggaattggggaagtggattttctgacgtttgatcctatagctaaaacgaaaaggacagttaaatatgatgtgcaggctatggctgtcattgtggttgtgttgaagctgctgtttttgctggatgacaagctggaatggtcttactcagatcttgctgaagcgtacaacgaacaacacagagaagacacgccccagtttgatttcagaaa

SEQ ID NO: 5742 - DNA, 218 bp, Mus musculus
aggcatgaattgcatctggtggtatgtaagtgaaaacacacgccttattttccagcattttcagctttttgtcataggggtgtggcacaagtgttgcagtttgtcccaggttgaaaagcctgaggctggtagaagcgcctttttgcctcagctccgtggttcctggtggttgcctatgtttcaggcctgtacttaggctaggtttagaaaccagccca

SEQ ID NO: 5743 - DNA, 538 bp, Mus musculus
  misc_feature (298)..(298): n is a, c, g, or t
  misc_feature (300)..(300): n is a, c, g, or t
  misc_feature (303)..(303): n is a, c, g, or t
  misc_feature (321)..(321): n is a, c, g, or t
  misc_feature (325)..(325): n is a, c, g, or t
  misc_feature (327)..(327): n is a, c, g, or t
  misc_feature (512)..(512): n is a, c, g, or t
atttcgaggctgtttctatccccatgccttcaacgtcaaattttctgatgtgaaaatctacaaagttggagcacccaccattccagattcctgtttacctctgggtatgtctcaggaagacaaccagctcaagttagtgcctgtcacccctggtagagatatggtgcaccatctcctgagtgtgagcactgctgagggcacagaagagaacctttctgagaccagtgtggctggattcattgttgtgaccagtgtggatgtggaacaccaagtgtttactgtcctgtctccagccccncncgncccattgcctaagaactntctntnctcatcatggatatccggttcatggatctcaagtagtaattgcaagaagcctcactttctgggccatagagttctggtcatcaccaaaggcagatggaatggactatagcaatcttattaaggcagctgacaaggcccaactagcagaaagcacatttgctacctcttgaaactggtagtagccnagactcctggctattatttggttcat

SEQ ID NO: 5744 - DNA, 388 bp, Mus musculus
  misc_feature (354)..(354): n is a, c, g, or t
attccttgcggaattctgtgggagaaaagatcctatcccttcgcagttgctccgtgggctctctaggggctctgggctctgcctgctgcagtgtcctcagtgagctctctgaggagcaggctttccatgtcagctatctggatattgaggaactgagcctgagtgggctctgccagtgcctagtggaactgtccacccagccagccactgtgtgttatggttctgcaaccaccagggaggcagcccgaggtgatgctgctcaccgcgccctacagtacctcaggatcatggcgggtagcaagtagcatcccactgcagtgatggatatgcatcttttacttcttgctccttctngcccctgggtccatgtatccacctagctctggta

SEQ ID NO: 5745 - DNA, 401 bp, Mus musculus
  misc_feature (318)..(318): n is a, c, g, or t
  misc_feature (340)..(340): n is a, c, g, or t
  misc_feature (343)..(343): n is a, c, g, or t
gtttcttctaacacttctgactcagataatttgaattttcagtggctcatcttagccagaaaattgccatgcagctgtgtctaagtctgactctttgagagcacctttgcacttgtctgagtacaaaggtgcggggttgtgtatttcttcacacactcttgacttttgtgtcaggtctcgggggttgctagtagaagcctgaaggtcatctacagaatattctaaagggagaaaatgaagtcaacattaagatcttccaacttaatttcccctcagattggtcttaggcattttaatagctgtaggtgtcatgaaaangaatctcactgttttattagcnccnttctgtatacacaggtgcagtgttaagatgattggactttgaaaagctggctgtacat

SEQ ID NO: 5746 - DNA, 545 bp, Mus musculus
accagtttccttctggcggttgatcgcagaggttccggtgaggcgttcggcgtgtgagctctgcggcttcgtttcctgatatgcaccgaccgaattttcgacccccaactcctccgtaccccagcccggggataggaggttggggtggcggaaataacttccggggtgccctgggcggggggccgcggccgccctccccgcgggacgggtacgggagtccgcaccacactccgccctgcgggccccgggctaggccgtacgggagcagccagtctccgcggcacggcggcaacttctcgggggcccgcttcgggtctccgtccccgggcggctacccaggctcctactccaggtcccccgcggggtcccagcatcagttcggctactccccagggcagcagcagacctacccccagggttctccaaggacatctacaccatttggatcagggcgtggtagagaaaaaagaatgtctaatgagttggaaagttattttaagccttcaatgcttgaagacccttgggctggcctagaaccagtgtct

SEQ ID NO: 5747 - DNA, 194 bp, Mus musculus
actgccccaactcagtattggtcattatcgacgtgaagccaaaggacctaggacttcccaccgaagcctacatctcagtggaggaagttcatgacgatgggacgccaacgtcaaaaacttttgagcatgtgactagcgagattggagcagaggaggcggaggaagtcggagtggagcacttactaagagacatc

SEQ ID NO: 5748 - DNA, 501 bp, Mus musculus
  misc_feature (476)..(476): n is a, c, g, or t
gtccaactgcatccaactgaaaacttccgttattaagggtattaagagccaactgactgagcagtttccaggtatcgagccgtggcttaatcaaatcatgcctaagaaagatcccgtcaaaatagtgagatgccatgaacacatggaaatccttacagtcaacggagaattactgtttttcaggcagagaaaaggacctttttatccaacgctaagactacttcacaaatacccgtttatcctgccacaccagcaggtcgacaaaggagccatcaaatttgtgctcagtggtgcaaatatcatgtgcccgggtttaacgtctcctggagcgaagctctacactgctgcagtagataccatcgtggcggtcatggcagaggggaaagagcatgccctgtgtgtcggagtcatgaagatggctgcagcagacattgagaaaatcaacaaggggatcggcattgagaatatccattatntaaatgacgggctgtggcacatgaa

SEQ ID NO: 5749 - DNA, 573 bp, Mus musculus
  misc_feature (280)..(280): n is a, c, g, or t
  misc_feature (289)..(289): n is a, c, g, or t
  misc_feature (309)..(309): n is a, c, g, or t
  misc_feature (320)..(320): n is a, c, g, or t
  misc_feature (330)..(330): n is a, c, g, or t
  misc_feature (339)..(339): n is a, c, g, or t
  misc_feature (353)..(353): n is a, c, g, or t
  misc_feature (366)..(366): n is a, c, g, or t
  misc_feature (387)..(387): n is a, c, g, or t
  misc_feature (420)..(420): n is a, c, g, or t
  misc_feature (422)..(422): n is a, c, g, or t
  misc_feature (436)..(436): n is a, c, g, or t
  misc_feature (439)..(439): n is a, c, g, or t
  misc_feature (441)..(441): n is a, c, g, or t
  misc_feature (446)..(446): n is a, c, g, or t
  misc_feature (458)..(458): n is a, c, g, or t
  misc_feature (464)..(465): n is a, c, g, or t
  misc_feature (478)..(478): n is a, c, g, or t
  misc_feature (489)..(490): n is a, c, g, or t
  misc_feature (543)..(543): n is a, c, g, or t
  misc_feature (545)..(545): n is a, c, g, or t
gagtcaagccgcacttgtgccttgcccaaattgtggccggacttttgctgtggaccgcctacctgtacaccagagaagttgtaaatctcaacctagtggaccaaaaacttcaaattcgaacatagaaaggaaaggcggtccaaatccacccactaattccaagcaacagaggaacatggaagcacccaatggggacaaggtaactggtgtcatttaagatgaagtaggtggactggggacacactacatcttcaaaaggatgagagaactattcctagantcagccacntcagccccaacgatggtttntaccaaagccntacttgtgtntcaaagcancctgtccaagtggntctccttttggantccaggggctgagtgtgtgtntatttttgcaaagtagacctaacagaatccttntntggcttgttcatantcntnttcantcctacagcctnaaagannatggactgttttntctgatccctnntcccagtaatccctgggagagactgttacttaaaatgagtcattaatgctgtntntacattacagagatatgattcccaaccc

SEQ ID NO: 5750 - DNA, 571 bp, Mus musculus
aagcgcacatgcatcgtggatggcaagaagctccggattggggagtacaagcaactgatgcgctcgcgaaggcaggagatgcgacagttcttcactgtggggcaacagcctcagatgcccatcaccacaggaacaggtgttgtgtatcctggtgctattactatggcaacgaccacaccatcacctcagatgacatctgactgctctagcacctctgccagccccgagcccagcctccctgtcatccagagcacgtatggtatgaagatggacggcgcaagcctggctgggaacgacatgattaatggagaggatgaaatggaagcctatgacgactacgaagatgatcccaaatcagactatagcagcgagaatgaggccccagagcctgtcagtgccaactgaggagcttttgtttgctgaattaaaacactctgacatttcgctccctttcccccaacaacaacaacaaagttcttaaagagcccgcatgcatttgtggctccacaatacatcagcagaatggtcttaattgcttcgtaacgtgtgagacagattacgttttcctgat

SEQ ID NO: 5751 - DNA, 519 bp, Mus musculus
  misc_feature (240)..(240): n is a, c, g, or t
  misc_feature (252)..(252): n is a, c, g, or t
  misc_feature (254)..(254): n is a, c, g, or t
  misc_feature (273)..(273): n is a, c, g, or t
  misc_feature (285)..(285): n is a, c, g, or t
  misc_feature (295)..(295): n is a, c, g, or t
  misc_feature (299)..(299): n is a, c, g, or t
  misc_feature (327)..(327): n is a, c, g, or t
  misc_feature (331)..(331): n is a, c, g, or t
  misc_feature (335)..(335): n is a, c, g, or t
  misc_feature (385)..(385): n is a, c, g, or t
  misc_feature (462)..(462): n is a, c, g, or t
  misc_feature (464)..(464): n is a, c, g, or t
  misc_feature (489)..(489): n is a, c, g, or t
ctcttggtggcaatgactcctatcagattgctggtgcagcctacacagaggatagaaggccgcacctatgccgattacgggtccgttgacgaatgcatggaaggcatctgtaagatgtacgaagagcacctgaagaggttgaacccccggagcaagtccatcacctatggcgtcagtcagctgtttgagtttatcgaccggatggtagacctcacctgcatggtgttcctcgaagacacncagacgtacaantntcacaaccgagagtgggtnaaagagaggatntacatgcttntcantcagcaggcacagctggagggctcggantgancttntaggagcttccggaagagctggggctggctggggccacagggaacatttntgatcaaagcagcagaagcaagctatagtgatgagccattttccatggaagactgcccctaacctgtgaataatttntnttcacatgagctttgagaatatttntccttgaagtttgtattatcacctgccaat

SEQ ID NO: 5752 - DNA, 313 bp, Mus musculus
gtctaaatccccagttgacagctctgttctggaaggagtgaaggagttgtacctggaagctgcccaccaaaatggtgacatgattgacccagacctgcagacaggtctgggagttctgttccacctgagtggagagttcaatagagcaatcgatgcatttaatgctgccttaacagttcggccagaggattactcactgtggaaccgtcttggggcaaccttggcaaatggagaccgcagtgaggaagctgtggaggcctacacgagagcactggagatccagccaggtttcatccgctccagatacaacctg

SEQ ID NO: 5753 - DNA, 533 bp, Mus musculus
  misc_feature (115)..(115): n is a, c, g, or t
  misc_feature (405)..(405): n is a, c, g, or t
  misc_feature (416)..(416): n is a, c, g, or t
  misc_feature (418)..(418): n is a, c, g, or t
  misc_feature (462)..(462): n is a, c, g, or t
  misc_feature (505)..(505): n is a, c, g, or t
gagcgtctgtctccaggaacctggtcacacacctgtgctgggtcccgagtgagccatacatagtccagacctctgaggataagaccatcagattatgggacagtcgggggcttcnagatggctcacatgtttcccacaaaacagcatatccagacccattgtgaagtcagcgtggatggacacacgtgtatttcctgcagcagtggctttgggggtgaaggctgtgaagccacgttgtgggacctaagacagactagagacagaatgtgtgagtataaggggcatttccagacagttgcatcctgtgtctttctaccgaagtccacggccttgatgcctatgattgctacctctgcacatgactccaaggtgaagatttggaaccaggatactggagcttgcctntccaccttgtntntggatggatcaggacccctgacctcactggctgttggtgacatntcctccttgttatgcgcaagtttctacagaggagttcacttantcagagtggaccacagccaaggactgga

SEQ ID NO: 5754 - DNA, 448 bp, Mus musculus
  misc_feature (361)..(361): n is a, c, g, or t
ttggcaggttcttggaggtgcttccttgggagcacctcctattgtacgctgctctctctctctctctctctctctctctctctctctctctctctctctctctctgcatgtttgaatttaaaagaggaaaggacacaaggcaagaatgcccagagcatcctagatgggtgctatatgggactctgacacctcaggttcttaaagataaaaaggccagaggtacctttctgtaattcttttaagagttaggtcataaggaatgaaaagagttacttttctccctccatgaaagtgttttttaagactgacaaggccggtggtggagtgagtgttgttgttttgtttcgcaattttcttaccnaagtgaaattactgaccataattttatttaatagtttttagtttttgaaagcctgtgttttctttgcttttaaactacaggcgacca

SEQ ID NO: 5755 - DNA, 164 bp, Mus musculus
  misc_feature (26)..(26): n is a, c, g, or t
  misc_feature (36)..(36): n is a, c, g, or t
  misc_feature (102)..(102): n is a, c, g, or t
atgcagaatatgtgaccagaccagangcatgtgttnggaagattttggtgaacattaactctaccctgaagtgatggactacaagttgtaatgtgtgttatntacacttcaatcgatattagcaagtctccaactgttagcaacatagttcgtttcccttgtac

SEQ ID NO: 5756 - DNA, 232 bp, Mus musculus
ctgtgatccaagacatgggcgctacttgactgtggctgccgtgttcaggggccgcatgtctatgaaggaggtggacgaacagatgcttaatgtccaaaacaagaacagcagctactttgttgagtggatccccaacaatgtgaagacagctgtctgtgacattccacctcggggcctgaaaatgtcggccaccttcattggcaacagcaccgctattcaggagctgttcaaa

SEQ ID NO: 5757 - DNA, 125 bp, Mus musculus
  misc_feature (36)..(36): n is a, c, g, or t
gtaaccgtatgtgtagccagggcaacatggccactntctttcccacctgctgcttcagaacctctttctaggtgacaaatcgatgtctctttttattgttccaaagctttagtgatgtaagaata

SEQ ID NO: 5758 - DNA, 325 bp, Mus musculus
  misc_feature (224)..(224): n is a, c, g, or t
  misc_feature (257)..(257): n is a, c, g, or t
acctcctcgacgtgctagagtttaaccaggtggtgatctttgtcaagtctgtgcaacgctgcatggccctggcccagctcctagtggagcagaatttcccagctatcgctattcaccgaggcatggcccaggaggagcgcctgtcccgataccagcagttcaaggacttccagcgacgaatcctggtggctactaatctgtttggcagaggtatggacattgancgagtcaacattgtcttcaactatgacatgccngaggactcagacacctaccttcaccgagtggctcgtgctggtcgctttggtaccaagggcctggcagt

SEQ ID NO: 5759 - DNA, 494 bp, Mus musculus
  misc_feature (275)..(275): n is a, c, g, or t
  misc_feature (299)..(299): n is a, c, g, or t
  misc_feature (334)..(334): n is a, c, g, or t
  misc_feature (430)..(430): n is a, c, g, or t
tagagcccgtggttgtggacctgactcacaatgactctgttgtgattgttgaagaaaggagaaggccaaggagaaatgggaggaggttgcgccaagaccatgctgacagctgtgtggtgagcagtgatgatgaggagctgtctagggacaaagatgtgtacgtgactacccatactcctcgaagcaccaaggatgatggagctactggacccaggccctcaggtaccgtcagttgtcctatctgtatggatggatactctgagattgtgcagaantgggcgtctcattgtttctacagnaatgtggccacgtcttctgtagccagtgcctccgngattcccttaagaatgctaacacttgcccaacttgtaggaaaaagatcaaccataagcggtaccaccccatttatatatgaaatgttcacaactgntcaggatagaccaatggacagacagccaggctggccttttctgcatggtatctgcctccagttt

SEQ ID NO: 5760 - DNA, 420 bp, Mus musculus
  misc_feature (148)..(148): n is a, c, g, or t
  misc_feature (349)..(349): n is a, c, g, or t
  misc_feature (378)..(378): n is a, c, g, or t
  misc_feature (386)..(386): n is a, c, g, or t
ctaggaggccaaacagagtctgcaagcaaaacccatgagcccttgaccctgctcctccggacactttgtaccagcccctttgtcctccgacccgttaagctttcttttgcacttgaaaggagacccactgatatttccccacgagaanccgtcccggctgcagcagttccagtgtggagagctccctctgctgaccagagtgaatcccaggctccgactggtctgcctttctctgcaggagccggagctccccaaccctccacaagcatctgctgcttcgtcttgatgacactgcctaaggtggccccagagtttccaggaccccagacactggagtgaggaactcctnccccactgtgatttctagttattctggtntcagcatnccttggagacactgaaaacggcagatcacagcat

SEQ ID NO: 5761 - DNA, 493 bp, Mus musculus
  misc_feature (398)..(398): n is a, c, g, or t
  misc_feature (452)..(452): n is a, c, g, or t
gaggatgtggtctgagcccttccactccaagtccagcagctcccggttcctggaagtatgatgacgcgggagaggtgaccagagcgctgtcctcaccttcctctctcaccgcgcggttttgttccctctacaagctggcctgactcaggcatgcctgctcacggaactgcagtgtgactggagtgtgtgtctgaggggagcgtttgcagagggcactggagccctgcacagcccttctcttctccgctctgggagagtggacccttccagaaggggcaggccggcccttcgcccggtgctcctccttcctcgtgtttttatggatctgcaccagactgttaacttgtggggagatggcgaagttgacttatttaaaaactacaaacagcaagttgttnttctagaactttgaacactaaatggaagaaaatccattagcagaccgaagtctnttcagtgaaccctccgaaactctgggaccagtttcctctgg

SEQ ID NO: 5762 - DNA, 318 bp, Mus musculus
  misc_feature (206)..(206): n is a, c, g, or t
tcatcgagcagtgcttggttctgtggaaaggctgttgggagtgctggcagaaagctgtggggggaaatggcccctgtggctgtccccgctccaggtggtggtcatccctgtgaggacagagcaagaggaatatgccaggcaggtgcaacagtgcctgcaggctgcaggacttgtgagtgatctcgatgcagactctggactgaccntcagccggagagtccgccgggcccagcttgcccactacaactttcagtttgtggttggccagagagagcagagtcaaaggacagtgaacgtacgcacgcgagataaccggca

SEQ ID NO: 5763 - DNA, 412 bp, Mus musculus
  misc_feature (267)..(267): n is a, c, g, or t
  misc_feature (303)..(304): n is a, c, g, or t
  misc_feature (307)..(307): n is a, c, g, or t
  misc_feature (312)..(312): n is a, c, g, or t
  misc_feature (315)..(315): n is a, c, g, or t
  misc_feature (326)..(326): n is a, c, g, or t
  misc_feature (342)..(342): n is a, c, g, or t
  misc_feature (345)..(345): n is a, c, g, or t
  misc_feature (369)..(369): n is a, c, g, or t
ggatgagctgggaacaaacttgtgtagattctaaatgatccaaaatggaagcttgacacagttaacacttggatttacatgatcttttgtgtttgctttttaaaataaagtgcttgtatttgtattctccatattctggagtaattatctacttgatgtttataggtctggctttttcacccaagaaacaatctcattcagtatatttagttttataatagtcatgaagccaaatctctgcgctgtatcagaggcacaaagtctagnaatatgtatattcacaatggtgtatattttgtgccnntgnataanttntggaaagtgtnctcagaaaacctggcnatncccctctatcttcataagaatttnatatgtatttatgaagatggctctgtactctagtcaatctttt

SEQ ID NO: 5764 - DNA, 501 bp, Mus musculus
  misc_feature (316)..(316): n is a, c, g, or t
  misc_feature (321)..(323): n is a, c, g, or t
  misc_feature (431)..(431): n is a, c, g, or t
gagccttagactttactgattctcaagaaaatgaagaaaaaacttctgaatatagaggatctgagattgaccaagttgttcctgctgcacagtcctccccagtaagctgcgagaagagagagaacttgttaccatttgtgggattgaataaccttggcaacacttgttatctgaatagtattcttcaggtgttatacttttgtcctggctttaagactggagtgaagcacttatttaatattatttcaaggaagaaagaagctctgaaggatgactctaatcagaaggataagggaagctgcaaagaagagtcttntggcnnnagttatgagcttatatgtagtttacagtccttaataatttcagttgaacagcttcaggctagttttctcttaaatccagagaaatatacagatgaacttgctacacanccaaggcgactgctgaacacactcagggaactcaaccctatgtatgaaggatttctacagcatgatgcac

SEQ ID NO: 5765 - DNA, 581 bp, Mus musculus
  misc_feature (409)..(409): n is a, c, g, or t
  misc_feature (432)..(432): n is a, c, g, or t
gaagatgagctttccaaggtcgaggagagctctgaaatttctccagagccaaaaacagaaatgaagaccttgagatgggcaatttcacagtttgcttcagtggagagaattgtaggagaggataaatacttctgtgaaaattgccatcattatacggaagcagagcgaagtctcctgtttgataaaatgcctgaagttatcactattcatctgaagtgctttgctgctagtggcttggagtttgactgttacggtggtggactttccaagatcaacactcctttattgacacctcttaaactgtcactagaagaatggagcacaaagccgacgaatgacagctatggattatttgccgttgtgatgcacagtggcattactattagtagtgggcactataccgcatctngttaaagtcactgaccttaacantctagagctcgatgaggggaattttgtggttgaccagatgtgtgaactaggtaagccagagccactgaccgaggagcaagcaagggggacggctgggaactacgacgatgaagtatcaattagagttggtggaaatgcccagccaagta

SEQ ID NO: 5766 - DNA, 83 bp, Mus musculus
aatgaggctggcaagatcacgtgcttgtgccaggttccccagaatgcagccaaccggggactgaaagccagcgagtgggtcca

SEQ ID NO: 5767 - DNA, 492 bp, Mus musculus
gtccagcaggtttcaggcctgatggatggtaaaggcggtggcaaggacatgtccgcccaggccacaggcaagaacgtgggctgccttcaggaagcactgcagctggctacctcctttgcccagctccgtctgggagatgtgaagaactgatgggagggaagccctctcgggaaagcaactcgccatcaaccagacatgtccgaaggcgggaattcagccaggagctctcctcccgccacgaagacattggagtcatgggacctctcagcagccctgtccgtcctgatccagcggtaatgggaacacgcctggagctgtcctgtgattcattgcccccctccattactgctctgagcccattcatgtcagcaccatctgtctaaaatcactacccaggaatgctttttaacgtcatgatcacatctagatgaggtcactctgccagcctgaggctttaggtctgcagaggaaggaagccttttctctgcagaa

SEQ ID NO: 5768 - DNA, 92 bp, Mus musculus
  misc_feature (37)..(37): n is a, c, g, or t
  misc_feature (39)..(39): n is a, c, g, or t
  misc_feature (46)..(46): n is a, c, g, or t
  misc_feature (53)..(53): n is a, c, g, or t
tcccttccaagtgagatccctattgcttgtgcttcantntccaccnaactgantcttgactggatagctttgggagttcctcatttccacct

SEQ ID NO: 5769 - DNA, 336 bp, Mus musculus
tgtgcatctcattgttgctgtcattaactgtggggatggatgcatgagagactgctgtggggtgcttgctccagtccctccctgtcaattccaacttcctgttgtctttatcacagcttttttcccatggtattctcagattagtcacgcgcaagcagtagagtgggacggtttccccgctgatacctgagcagcccccttgtcctcccagcacactcactgtcagtattaaggcacagcagcctgttaataagctagccctgcctcagagtgcacatgtggggacctgccagtggctctgctctgccgcacacagcggagcaccacccttgatgg

SEQ ID NO: 5770 - DNA, 256 bp, Mus musculus
gatgtttatcaaattgtttaccaagtggaaagctagttctgagaaattattatccagagcctgtgttattttaaagactggacttgcttcaaaggtacccatacgaggagcccaccgtccctgtccctcgaggtcacgtcccaccgctgcactaaggactcacggcccagcgtccacaagactgaggccctgtccctgctcagagaacagatccggagcaggtggtctggtcagtcaggatggaacagtgctacaa

SEQ ID NO: 5771 - DNA, 255 bp, Mus musculus
  misc_feature (173)..(173): n is a, c, g, or t
  misc_feature (184)..(184): n is a, c, g, or t
gattctggcaaagatgtaggtgcgaaaaactacaggcatctctgtgctgtttattacaacaagactcccgggtttgagatcatccatggcttgctggacagaattatgcagctgctcgatgtgcctcctggtgaggaaagcgggggctacatgatcaaagcgtctgcaggttnctgcctttttnccctggacggtgtgctgagatctttgttggaggtcaaagcattgggaagctaggcgtccttcatcctgatg

SEQ ID NO: 5772 - DNA, 483 bp, Mus musculus
  misc_feature (56)..(56): n is a, c, g, or t
  misc_feature (119)..(119): n is a, c, g, or t
  misc_feature (285)..(285): n is a, c, g, or t
  misc_feature (388)..(388): n is a, c, g, or t
  misc_feature (447)..(447): n is a, c, g, or t
  misc_feature (458)..(458): n is a, c, g, or t
accaccttctgtgaggcttgcttgggcagtgtctggctagcattggccagaggttnatcactccttccaactctagttcttggggactaggcaaggaagaagtcctagttcgaaggccnagctcaatacaatggctatcctttcagagtgtctaggacattcagtctaactagtactacaaaacgcaaaagtgagctccccaggccaatgagggatgtcaggtactttggtcacagccaccttttcatctcctgactgagcctggctttctgagaggattgcccntaggtaggtatattggaggtcctgcttcatgcattctggccccatagagtcatcagggtttgctttgaccacatgttcattctcatgctatacccaaatactntgggataaaggaggtgtttggcaggctgacctgaaaaactcccattccatccacctctntcctaagcccnttagttcccttgctgctacatgtat

SEQ ID NO: 5773 - DNA, 318 bp, Mus musculus
  misc_feature (194)..(194): n is a, c, g, or t
gtaggcgccattatcaaggaatcaaaggtcaagccagcccaagtagggcaaggctgtttagagactcttcaaagggggacagtccttgtggaagttttgaaagtgggtttcattcactatgtgaccttggctgtcttggaacccactatatagaccaggctcgccttgtacttaggacatccttctgctctgtnttcccagtgttgggattactggtatgtacacacccttacgatgtatctgaatggcatctgtcactcttagtttctggcaacctcaagaatctttcctgggggaaaggacttctgtccatccctg

SEQ ID NO: 5774 - DNA, 271 bp, Mus musculus
caaacttggtgtacgccttgctttacaaacgggacctctttgagcaattccgaactcatccctcattccaggacataatgcaaaacattgacctggtgatctccttctttagctcaagacttctacaagctggagctgagctgtcggtggaaagggtcttggaaatcattaaacaaggggttgtggcgctgcccaaagacagactaaagaagtttccagaactgaagttcaaatacgtggaggaagagcagcctgaggagttcttcatccc

SEQ ID NO: 5775 - DNA, 516 bp, Mus musculus
  misc_feature (286)..(286): n is a, c, g, or t
  misc_feature (289)..(289): n is a, c, g, or t
  misc_feature (293)..(293): n is a, c, g, or t
  misc_feature (299)..(300): n is a, c, g, or t
  misc_feature (302)..(304): n is a, c, g, or t
  misc_feature (307)..(307): n is a, c, g, or t
  misc_feature (327)..(327): n is a, c, g, or t
  misc_feature (338)..(338): n is a, c, g, or t
  misc_feature (365)..(365): n is a, c, g, or t
  misc_feature (370)..(370): n is a, c, g, or t
  misc_feature (419)..(419): n is a, c, g, or t
  misc_feature (445)..(445): n is a, c, g, or t
gctttcacggacaccattccaagaaggggcaagttgcaaagttggacttggagtgcatggtgcctgtcagtgggcaggagaactgctgtctgacctgtgacaaaatgcggcaagcagagctcagtaatgagaagatcctctcccttgtgcactggggcatgtacagtggtcatggaaagctggaattcatatgacagtcatgtctgaactataaatggaacccttgaaggccttctgagttctgctgacaggagcacttttatctggagacaactaactcgcttantcntctnggagannannnaantgacctctgaaaagagaatnttgggtatttncttctgaaggattatttgcacagattntacantcaaatggattaatttgctttaaagttataaaaagcaaagagaggactntgcacactttcccagggttctttgtntcctagggagctgcagctgactgaagtaaaaacactgtgctctctgtaagctcctacatcctcatttattg

SEQ ID NO: 5776 - DNA, 433 bp, Mus musculus
  misc_feature (31)..(32): n is a, c, g, or t
  misc_feature (291)..(291): n is a, c, g, or t
  misc_feature (293)..(294): n is a, c, g, or t
  misc_feature (317)..(317): n is a, c, g, or t
  misc_feature (322)..(322): n is a, c, g, or t
  misc_feature (327)..(327): n is a, c, g, or t
  misc_feature (329)..(329): n is a, c, g, or t
  misc_feature (334)..(334): n is a, c, g, or t
  misc_feature (339)..(339): n is a, c, g, or t
  misc_feature (352)..(352): n is a, c, g, or t
  misc_feature (356)..(356): n is a, c, g, or t
  misc_feature (368)..(368): n is a, c, g, or t
  misc_feature (381)..(381): n is a, c, g, or t
  misc_feature (383)..(383): n is a, c, g, or t
  misc_feature (386)..(386): n is a, c, g, or t
ctctggtgctaggtccggagacggcgggagnncgaggtccggagacggcgggagcgcgggccccgccggcaaggccataacgaaggatgaaaatgagtggaaagaatttgagcaaagagaggttgattacagcggattaagagttcaggcaatgcaaataagtgaaaaggaagatgatgataatgagaagagagaagatccaggagataattgggaagaaggtggaggtggcagtggagcagaaaaatcttcaggtccctggaataaaaccgctccggtacaagcgcctcntnntccagtaacagttacagaaaccnccggnagccnancaatncccantggtgtatacagncctnctggggcaaggntaaccacaacaangnaanacgccacaaggaccaccagaaatatacagtgacacgcagttcccatc

SEQ ID NO: 5777 - DNA, 171 bp, Mus musculus
  misc_feature (75)..(75): n is a, c, g, or t
cctggagctgaagtgcagtgctatgattcttaggttgaggatggaggagctgaaggtcttgtctgacacttacancgctgagaaagtggaaatgcatcgcctcatcagggaccgtttggagggagccatccgcctccaagagcaggacctggagaagtcaagactagtcct

SEQ ID NO: 5778 - DNA, 399 bp, Mus musculus
  misc_feature (346)..(346): n is a, c, g, or t
  misc_feature (348)..(348): n is a, c, g, or t
gaaaaccctcactctgagtacgggctcacagacagcgttgagagaatagtcgaaaatgagaagattaatgcagaaaagtcatcgaaacagaaggtggatctacagtccttgcccacccgtgcctacctggaccagacagttgtgcctatcttattacagggacttgctgtgcttgccaaggaaagaccaccaaatcccatcgagttcctagcatcttatcttttaaaaaacaaggcgcagtttgaagatcgaaattgatttcttgggaagagaagaaacatttggttgctactgtagatttacatgattacgaggcagctttaattgccatgattcccctccccantntggacggctaagaaccttcaggaccacagacctcacttctggagttgcaga

SEQ ID NO: 5779 - DNA, 358 bp, Mus musculus
  misc_feature (266)..(266): n is a, c, g, or t
  misc_feature (296)..(296): n is a, c, g, or t
  misc_feature (308)..(308): n is a, c, g, or t
aatgaatgcagcacgtctgacctctcagactgacctttcagcctggctgtgatgaagatgaaaactgacttgacaggaacaattatcctatgcaccatgacaagatgccctgagctgacaagtttcaagctgactgctattggttgtgagaggtggcctgggtgttttctgcacacgtgggagccgtgagcacacccctttccttgagtcagctgtttcatggatgtcctcagcagacatgggtaagcaaagggaagcctttgcanccctccagctcactatacaaggctttcctnggctagactttnatgtacaaccttgtacagtttttttgacatacacttcagattcttgttta

SEQ ID NO: 5780 - DNA, 500 bp, Mus musculus
  misc_feature (317)..(317): n is a, c, g, or t
  misc_feature (349)..(349): n is a, c, g, or t
  misc_feature (358)..(358): n is a, c, g, or t
  misc_feature (361)..(361): n is a, c, g, or t
  misc_feature (370)..(370): n is a, c, g, or t
  misc_feature (395)..(395): n is a, c, g, or t
  misc_feature (425)..(425): n is a, c, g, or t
  misc_feature (447)..(447): n is a, c, g, or t
  misc_feature (459)..(459): n is a, c, g, or t
  misc_feature (461)..(461): n is a, c, g, or t
  misc_feature (467)..(469): n is a, c, g, or t
ggttcgagagacacctcaggactgggccttgttgcactcgggaccaccagaggaggagttgcccctgatgactgcaaactgtctagacaaggcagctgagcataatcccatgaaacctgaagtggctggagaagggtctcagggtgagacagggaaggaggcatcacacccatcatcagtgagctggcgctgtgccttgtggcaccaagtatggcaggggaggcggcgtgcccggagacgattacagcaacaaaccaaggaagaaggtagaggaggtcccaccacaggagcagagtggctggcaatggaagctcgtntgacccaggaactaaaaggacccaatagtgancaagagagnccnccgggggancccctcctcagctttgtggcatctncctcccaggctgagcagacactcactgtgnccccactccaggactcccaagncctgttccctgntnttcatnnnttttctacagggttttatccctcaagcactt

SEQ ID NO: 5781 - DNA, 194 bp, Mus musculus
tgaagtaattctggtaacatctaaaaatatatatatttttgttcgcggacatttgattaatgctgtagctatggaagctttgatgtcacccagaggcgtgtacctggctggcactatcccagtgagggtttcttgagttccagtatgagatggcctgacctgctgccaaaaagagtagcagtcatttctgtagt

SEQ ID NO: 5782 - DNA, 403 bp, Mus musculus
  misc_feature (256)..(256): n is a, c, g, or t
  misc_feature (350)..(353): n is a, c, g, or t
tggctggcactatcccagtgagggtttcttgagttccagtatgagatggcctgacctgctgccaaaaagagtagcagtcatttctgtagtgcaatttcttgaggtatatgtgtgaacacacatgcttgtctgacctgttgagtttttctccagtctcccaaccctgtgctcattaggcccagtctgttccctgtagatgacaaccacatagagaggctgtctggtgggctgggccattcctgtcatggagtcagcnaactttgcacatctacaagttatctgtgtaatcacgtccacaatgaggctctccaaacccatcactactcttccccaaagcactatatttattnnnnctgtctgtctgtgccagttctgcccacactgactgatcttgaaaacctgt

SEQ ID NO: 5783 - DNA, 278 bp, Mus musculus
agaccactggcagaccaactgtcatttgctctgtgaagaggctcctaagaccctgggggagggaaaacagatacctcatgcactggcccactgtctgacgctccttcatcctctgtgcggtctggagtgagcctggtcccctagccaccccctagccttggtgtcttgagccaattctgagatgtggtctgtgtcctggacctgctgagcctagagagattgtcctatgtatgtctgagatcctggagaaacctaaccgaacttccagggcagggtgt

SEQ ID NO: 5784 - DNA, 378 bp, Mus musculus
gagattgacactttcatcaagctgaacaaggcattccaagctgaggagtctcccgcggtcatctactgtatcagcatgcactggttccgagagtgggaggccttcgtcaaggggaaggacagtgagcctcccgggcccatcgacaacagcaggattgcccaggtcaaaggcagtggccatatccagctaaagcagggggctgactgtggccagatttcggaggagacctggacctatctgagcagtctgtatgggggcggccctgagattgccatccggcagagtgtggcccagctcccagacccagaaagcttgcacggagagcagaagattgaggctgagacccgggctctgtgacttgggccatgctgagttgct

SEQ ID NO: 5785 - DNA, 331 bp, Mus musculus
  misc_feature (105)..(105): n is a, c, g, or t
  misc_feature (245)..(245): n is a, c, g, or t
  misc_feature (263)..(263): n is a, c, g, or t
  misc_feature (290)..(290): n is a, c, g, or t
tgaaggcatccctgcccaagaagaaggccagcctcacccatgagcaacagcagtcagctcgactagccagggaactggaggacagagaggccgagctcagccgcngtgacaccttctacaaggagcagcaggggcgcatccaggaaaagaatgctgagctgtataaactgtcttcccaacaattccatgaggcggcttcaaaagcagagagcacaataaagccccgcagagtggagcctgtgtgnctctggcctacaagcccnagatcctccgctgttaccgggaccatnctgcatgaagtgcttctgtgctcggacctggtcaaggcata

SEQ ID NO: 5786 - DNA, 496 bp, Mus musculus
  misc_feature (318)..(318): n is a, c, g, or t
  misc_feature (325)..(325): n is a, c, g, or t
  misc_feature (360)..(360): n is a, c, g, or t
  misc_feature (471)..(471): n is a, c, g, or t
atgtcgatctttagctgaagagtatggcttggatacagtcaacaaagatgaaattatttctagcatggacaatccggataatgagatagtcctgtacctgatgttgcgggctgttgatcgatttcataaacagcatggcagatacccaggagtatctaactatcaagttgaagaagatatagggaagttgaagtcctgtcttactggcttccttcaggaatatgggctgtctgtaatggtgaaagacgattatgtccatgaattttgccggtacggagctgctgagccacacaccattgctgcgttcctgggaggagnctgctgnctcaagaagttatcaaaataatcaccaaacaattncgtaatttttaataatacttatatttatagtggtatgtcacaaacttctgcaactttccagttgtagaataagcaccatgtgtaatatgttaatggttggaactgtaattntcttcatattgtgctttggtttgta

SEQ ID NO: 5787 - DNA, 339 bp, Mus musculus
  misc_feature (111)..(111): n is a, c, g, or t
gccatggctgagcaagagcgcttcctgctacaccaggagaccctgccagagcagctgctgaccgagagacagctgagtcttagtgcaatgcctgtgttgaccgcaccacanctcatcagtctgtatatctgtgacgaaaacagaagagccaatgagtatgatttcaagaaagccttggacttactggagtacattgatgaggaagaagatgtgagcattgatgacctgaagctggagattctgtgcagagcactgcagagagatgactggtctggttcagatggcaaagatgatccaatcgaagtgtctaaagacagtgtgtttgtaaagatcttgcag

SEQ ID NO: 5788 - DNA, 570 bp, Mus musculus
  misc_feature (26)..(26): n is a, c, g, or t
  misc_feature (45)..(45): n is a, c, g, or t
  misc_feature (110)..(110): n is a, c, g, or t
  misc_feature (141)..(141): n is a, c, g, or t
  misc_feature (191)..(191): n is a, c, g, or t
  misc_feature (232)..(232): n is a, c, g, or t
  misc_feature (306)..(306): n is a, c, g, or t
  misc_feature (352)..(352): n is a, c, g, or t
  misc_feature (380)..(380): n is a, c, g, or t
  misc_feature (382)..(382): n is a, c, g, or t
  misc_feature (406)..(406): n is a, c, g, or t
  misc_feature (412)..(412): n is a, c, g, or t
  misc_feature (425)..(426): n is a, c, g, or t
  misc_feature (447)..(447): n is a, c, g, or t
  misc_feature (450)..(450): n is a, c, g, or t
  misc_feature (456)..(456): n is a, c, g, or t
  misc_feature (481)..(481): n is a, c, g, or t
acaagtggtccatccggtatccgcancagcagtcatgcgccagcnacgggatcatcctgaagatggtataccctcaggctgacagcaaacttcggaacgttgtcatggangcagcttgtggcactaattgactgcttcctnggacagctacgtttcccagctgaagtcgctagagaaatccagtgaccaangaacgatacagcagtctggaagtggagtacctgcagaaaangatccgagctgctctcgccccttctcacactaggtcagtacccatgggcagcttctctggcagagaagtattgngactttgatatcctggttcagatgtgtgaacagacagacaaccaancccgactccagcgctacatgacccagtntnctgaccagaatttttcagattttntctttngttggtacctggnnaaaggaaagcggggaaaattnctntctcancccatttctcagcatggacagttgncaaattttttgcaagcccatgagcatctcagctggttacatgaaattaatagtcaggagttagagaaggctcatacaacactgctaggt

SEQ ID NO: 5789 - DNA, 192 bp, Mus musculus
tctgcccaaggctgcattccagtatggcatcaagatgtctgaaggacggaaaaccagacgattcaaagaaaccaatgataaggcagagcttgatcgacagtggaagaaaataagtgcaatcattgagaagaggaagaggatggaagcagatggggtcgaagtgaaaagaccaaagtactaatctctagttcc

SEQ ID NO: 5790 - DNA, 192 bp, Mus musculus
aagcagctgggcgatttctttggcatgtccaacagttacgcagaatgctatccagccacgatggatgacatggctgtagatagtgatgaagaggtagattatagcaaaatggaccagggtaacaagaagggtcccttaggccgctgggacttcgatactcaggaggaatacagcgagtacatgaacaacaag

SEQ ID NO: 5791 - DNA, 390 bp, Mus musculus
  misc_feature (235)..(235): n is a, c, g, or t
  misc_feature (291)..(291): n is a, c, g, or t
tttaggattgcataacgtacgccagacctcaatgttccctcgtgaccccaaacgactcacgccttaaagccacactttttattctctccaggaacctgctattgattaggttatacctgaggtacttaaaatatgcagtagaattaatgtcttactaaagtgccacaattattttttaagtagctcagtacaaattaatttaagtaaaaaacgttttagaatttcaaatatcctnaaataggaaatacttgaacgttttaatgagaaatttctatggttgaaattcatagnctttcactataggaaatgttaagaaaaatttaaacagtttaagattatataatttttttttcttttctatattgaggtggccaccatactaatattcta

SEQ ID NO: 5792 - DNA, 131 bp, Mus musculus
  misc_feature (90)..(90): n is a, c, g, or t
accgaagtcactcgtacaagcgcagccttcactcgtcccggggctccgcaggctgctctcctccacggaagcggacctcccggacctccngggacaagtgcgacccacggcccagcaggcgatgagacagc

SEQ ID NO: 5793 - DNA, 349 bp, Mus musculus
ggctatatctaagcccgtctgcacatctaaacttagatggagttggtccaatgagggaacatctgggttatgccttttttaaagtagcttttaggaactgtcagcatgttgttgttgaagtgtggagctgtaactctgcgtggactgtggacagtcaacaatatgtacttaaaagttgcactattgcaaaacgggtgttttatccaggtactcggacactatttttttgtactgctggtattgtaccaggaacattttcttttattgttacttgctttttaaactttgtttagccacttaaagaaaacctgctcatggcacaacttgcctcaaatccattccaagttgt

SEQ ID NO: 5794 - DNA, 428 bp, Mus musculus
  misc_feature (325)..(325): n is a, c, g, or t
  misc_feature (377)..(377): n is a, c, g, or t
  misc_feature (403)..(403): n is a, c, g, or t
ctactggctgtacaagctccacggcctgaatatcaactacaactgtgagatctgtgggaactacacctaccgagggcccaaggccttccagcggcactttgcggagtggcgtcatgctcatggcatgaggtgtttgggcatcccaaacactgcccactttgcaaatgtgacacagattgaagatgctgtctccttgtgggccaagctgaaactgcagaaggcttcagaacggtggcagcctgacaccgaggaagaatatgaagactccagtggaaatgttgtgaacaagaagacatacgaggatctgaaaagacaagggctgctntagtgctcggttccctgagaagcctgagaaaagcttccccaaccaaatgttnttaaagactttttgctatgtagtatntaccttgtagaaaccttgcagattg

SEQ ID NO: 5795 - DNA, 555 bp, Mus musculus
  misc_feature (365)..(365): n is a, c, g, or t
  misc_feature (399)..(399): n is a, c, g, or t
  misc_feature (505)..(505): n is a, c, g, or t
tgcaggccgagaagttgacctcctcctctgaaaaagctctagctaaccagttcctggctcctggccgcgtgcccaccacagccaaggagcgggtgcctgccaccaagactgtacatttgcagtctagggcacgttacaccagtgagatgcggagtgagctgttgggcatggaaccatctggagaatgtgaggtggacatgaggaaacgagctgcgaaggggtccagacctgcagatgagaggcagtcagcatccgagctagacctcgtcctccagaggcaccagggcctccaggaaaagctggctgaggagatgctaggcctggcccgcagcctcaagaccaacacactggctgcccagagtgtnatcaagaaggacaatcagaccctgtcacattcantcaagatggcagaccagaacctggagaagctgaagctggagtcggagaggattggagcagcatgcacagaagtcagtgaactggctgctgtgggccatgctcattntcgtgtgcttcgtgttcatcagcatgatcctgtttatccgaatcatgccc

SEQ ID NO: 5796 - DNA, 502 bp, Mus musculus
  misc_feature (358)..(358): n is a, c, g, or t
  misc_feature (418)..(418): n is a, c, g, or t
atgcctgcgaggcagccaatcagtagcaaagtcagggacctgctcctccacagcccccatctggctaccaatccagagacattccagggctaggacagcccgccctctgcagatgggatggatgtgagtgagtagatttcgtggctgcagatgtgactgtagggatggaggcgagcgacactgggtctcaccaagcagcccagggtggcctcatggaaccctgagcctcaggtgactctacaagcctttgagttgctcccatcttcagcccccaccctgcccccacacttcaggctcctgtcttctctggtgacggttcctgacatccaggcaaggaatagctgtgggacctcctgtntcctcagccacctcaccagcaccttgcccttgggacctagactttctgtccttcccagtntcctagtgcttgtggtcgaggctactggccacccaggtcccctggctgggctcggctggggaacaccattttcttggtttgcct

SEQ ID NO: 5797 - DNA, 455 bp, Mus musculus
  misc_feature (147)..(147): n is a, c, g, or t
  misc_feature (329)..(329): n is a, c, g, or t
  misc_feature (331)..(331): n is a, c, g, or t
  misc_feature (349)..(349): n is a, c, g, or t
  misc_feature (364)..(364): n is a, c, g, or t
  misc_feature (367)..(369): n is a, c, g, or t
  misc_feature (372)..(372): n is a, c, g, or t
  misc_feature (375)..(376): n is a, c, g, or t
  misc_feature (419)..(419): n is a, c, g, or t
  misc_feature (426)..(426): n is a, c, g, or t
  misc_feature (428)..(428): n is a, c, g, or t
actctaactgtgagcctggatccagggcccctgaagcaattccctcactccatggagccacagctgaggcagctggggctgcccactgccctcaagaaaggtgtggtgaccctgctgtctgactatgaagtatgcaaagagggtgangtgctgaccccagagcaggcccgtatcctgaagctgtttgggtatgagatggctgaattcaaagtgatcatcaaatacatgtgggacgcccagtcagggacgattccagcagatggacgatgacctgcctgagagcgcgcctgagtctgagggagagtctgaggaggaggatgacagctgantntgagagccaggactatgnccttccagcgagttnttnnnatnttnntgctggacaccccaccccacctcaccctgcccccggactgctntcaccantntagagggaacagctatttattttgcta

SEQ ID NO: 5798 - DNA, 393 bp, Mus musculus
  misc_feature (86)..(86): n is a, c, g, or t
  misc_feature (294)..(294): n is a, c, g, or t
  misc_feature (330)..(330): n is a, c, g, or t
  misc_feature (349)..(349): n is a, c, g, or t
gtgcagatggcagctacacacatagcccgcaaggcagtggagctggacttggttcctggcaggagcccgatctctgtggcggcagncagctatttacatggcttcccaggcttcagctgagaagcgaacacagaaagaaatcggggatattgctggtgttgctgatgttacaatccgacagtcctacagactgatctaccctcgggctccggatctcttcccttcagacttcaagtttgacaccccagtggacaaattaccccagctataagctgaggcaactaagtgtcacantcttaatgtacatggaatatggaactttgtacatanccacacagtgctggttgancctttaatgaggaaaaaggagatggtacccattccagagctaaa

SEQ ID NO: 5799 - DNA, 140 bp, Mus musculus
  misc_feature (73)..(73): n is a, c, g, or t
gtagatatttattccaagtttgatgtaattaatcttgctgctgagaaaacgtacaataacttggacatcacantgacccaggccctgcagcaccgctcgcagtattttgagggtgtggtgaagtgcagtaagctggaaac

SEQ ID NO: 5800 - DNA, 373 bp, Mus musculus
  misc_feature (131)..(131): n is a, c, g, or t
  misc_feature (171)..(171): n is a, c, g, or t
  misc_feature (173)..(173): n is a, c, g, or t
  misc_feature (175)..(175): n is a, c, g, or t
  misc_feature (179)..(179): n is a, c, g, or t
  misc_feature (189)..(189): n is a, c, g, or t
  misc_feature (191)..(191): n is a, c, g, or t
  misc_feature (204)..(204): n is a, c, g, or t
  misc_feature (207)..(207): n is a, c, g, or t
  misc_feature (345)..(345): n is a, c, g, or t
  misc_feature (347)..(347): n is a, c, g, or t
aggtccatcggctggttgtagtgaatgaagcagatagcattgtgggtattatctccctgtcagacatcctgcaagccctgatcctcacaccagcaggtgccaaacagaaggagacagagactgaatgaccnccgtgaatgtagacgcccgcgcaggagaacttgaacaaantntngggntcacggtttncntcatgaacactgnctncaatagaagagagtaaaatggctaagaatgtataccagggtttagcgatgggtatttttccagtgatttgtaagtataggaaaagattttatgtgcttgaagattcaggcttgcgttcaaagactgccctcagacctntntgaaggattttcaatgctgtatgtca

SEQ ID NO: 5801 - DNA, 263 bp, Mus musculus
tgacagagcagtactgctgccgccgctgcctcctcctgaagcgccttgacctcacaacatctgctttccactggggtgaccgggcagaggcccacggagaggtcatgaaggcggtgctgtccccaatccgagggcttctgactccagaatctgatgtctctatcgcacatgttctggctgcccgagctgacctttcccgcctggtcccagctaccagtgtggctgcccgacgagggaccagttgtgcaatcaacaaggtgctt

SEQ ID NO: 5802 - DNA, 440 bp, Mus musculus
  misc_feature (34)..(34): n is a, c, g, or t
tgagcgtgaaccttagttccccgcgcggcgccantttccactccgacaagatgaaagaaacaatcatgaaccaggagaaactcgccaaactgcaggcacaagtgcgcattggtgggaaaggaactgctcgtaggaagaagaaggtggttcacagaacggccacagcagacgataagaaactgcagttctccttaaagaagttaggggtgaacaacatctctggtattgaagaggtgaacatgtttacaaaccaaggaacagtgatccattttaacaaccctaaagttcaggcatccctggcagcaaacaccttcaccattacaggccacgctgagacaaagcagctgacagaaatgcttcccagcatcctcaaccagcttggtgcagacagcctgactagtttaaggagactggctgaagctctgcccaaacaatctgtg

SEQ ID NO: 5803 - DNA, 545 bp, Mus musculus
  misc_feature (481)..(481): n is a, c, g, or t
  misc_feature (518)..(518): n is a, c, g, or t
  misc_feature (520)..(520): n is a, c, g, or t
gatatggttccggaacttccagattatagaagaagacgctgctctagtggaaataggacctcgttttgttttaaatctcataaagatttttcagggaagctttggaggaccaaccttatatgaaaatcctcattaccagtctccaaacatgcatcggcgtgtcataagatccatcacagctgccaagtatagagagagacagcaagtcaaagatgttcagaaactgaggaagaaagaaccaaagactatccttccacatgaccccactgcagacgtgtttgttataccagcggaggagaagccagtagaaatacagtgggtgaaaccagagcctaaagtagatctgaaagcaaggaagagacggatttacaaaaggcatcggaaactgcaacagaagatgagcagagggagtgcaaagtgaatcagaggataactgtatttattttgtattccatgtgtaaatacttttagtatacagaancgagctatgcctaattagggcaccattttaaaaaacntngaaatctttaagtcggtgttggtct

SEQ ID NO: 5804 - DNA, 419 bp, Mus musculus
agtcccagcaggcaggcttgctgaagtcacgcagcattgagagctgctctgaggagccagcacctggcagaagggctgagggtgtggcccaaaccctctaaccagtgaggccaaagcctggtcctcacgcgcatccctgtccaggccgctgtgaaggtgcaggccttgatgggtgcgcagggtggcccctgtgagggtgcacagggtgggttgttgaaatgttgctgaactctttcctacacgtttcataattaggaagggaaggaaggggtgggcgtgagagcactggtgttcgtacactcagcaggaagctgctgtctggctctgctgatccagaacggcactgcctcaagagggtgtctgtgttgcctcggtggcccctcttcagccctgtgattgcagttagcttgatttccttt

SEQ ID NO: 5805 - DNA, 283 bp, Mus musculus
  misc_feature (69)..(69): n is a, c, g, or t
tccctcgtggaaagtggctgcccggcctccatcgtcaacgagctgattgaaaatgcccatgaacgcagntggccccagggtctggccacactagagacaagacagatgaaccggcgctactatgagaactacgtggccaagcgcatccctggcaagcaggctgtagtggtgatggcctgtgagaaccagcacatgggggacgacatggtgcaggagccagggctcgtcatgatatttgcgcatggtgtggaggagatataagagcgtaactggctgtcaggaa

SEQ ID NO: 5806 - DNA, 551 bp, Mus musculus
  misc_feature (43)..(43): n is a, c, g, or t
  misc_feature (181)..(181): n is a, c, g, or t
  misc_feature (272)..(272): n is a, c, g, or t
  misc_feature (304)..(304): n is a, c, g, or t
  misc_feature (320)..(320): n is a, c, g, or t
  misc_feature (366)..(366): n is a, c, g, or t
  misc_feature (373)..(373): n is a, c, g, or t
  misc_feature (375)..(377): n is a, c, g, or t
  misc_feature (425)..(425): n is a, c, g, or t
  misc_feature (457)..(457): n is a, c, g, or t
  misc_feature (474)..(474): n is a, c, g, or t
  misc_feature (482)..(482): n is a, c, g, or t
  misc_feature (506)..(506): n is a, c, g, or t
agctcttcttttcaggtttcctgttcttctcccatagacccanatttgatctgtccctccaggcttctccctaacctcgtttccttcttacctgaggcccttgcttcagaattgggcagtggactatccggcctagaattttacccttggggtccattttaatgcaggccaggcatttccnccttctctggggaggagaacagggatgtcagagtggagactagcctctggcatgctctggagtgggcgatgtagtgatttgaataagaatntcccccataggctgacatatttgaagatttgntctccagttggtagtnctgtttggggaggttttgaaggtttgaccttgatggaggaagtacntcagtgngnnncaggctttaagattttaaaacctcgaaccactcccaattcactctttntgcgttctgtttacgaggaaggctgtgagctntcagcttcctgctctgnccaccatncctgctggcatccacatctccctncctcccaccatgatggacttttattcctctggaaccctaagccaa

SEQ ID NO: 5807 - DNA, 225 bp, Mus musculus
  misc_feature (101)..(101): n is a, c, g, or t
ggatgccaagcagacagcacaagacccctgcgtcccagactccgtccctggctgtgatgcagctgcagctgagccatcccggtgaaggagtcttcacacantgaattggtaccatccgttgttggagatcaaacctagaatgtccttagccagggacctggaaatgagtggtggccacagtctgttaggagtcgcttttgcagagtggatacatgtttctgctgt

SEQ ID NO: 5808 - DNA, 215 bp, Mus musculus
cacctcaagtccaagctggtagatgaggagccccagctcaccaagaggacccacaatgtgtgagccctcagccaggcttgggtcaggaatgccacctggagactgccagctgacacctgaccagccactcaggacaggaccctggggctgcactcctgcactgctgcaatactgccctcagcctctcccctcagcctgccttcgctgcatcatat

SEQ ID NO: 5809 - DNA, 102 bp, Mus musculus
  misc_feature (58)..(60): n is a, c, g, or t
ggaccagtgccggactttctcctggcatagagacgagaaggcggcagaggaccagcannngcagcagcagcatctggagtctcagctgacggcatgcagcag

SEQ ID NO: 5810 - DNA, 447 bp, Mus musculus
  misc_feature (209)..(210): n is a, c, g, or t
  misc_feature (212)..(213): n is a, c, g, or t
  misc_feature (237)..(237): n is a, c, g, or t
  misc_feature (280)..(280): n is a, c, g, or t
  misc_feature (300)..(300): n is a, c, g, or t
  misc_feature (304)..(304): n is a, c, g, or t
  misc_feature (311)..(311): n is a, c, g, or t
  misc_feature (325)..(325): n is a, c, g, or t
  misc_feature (341)..(341): n is a, c, g, or t
  misc_feature (364)..(364): n is a, c, g, or t
  misc_feature (370)..(370): n is a, c, g, or t
  misc_feature (386)..(386): n is a, c, g, or t
  misc_feature (421)..(421): n is a, c, g, or t
agccaggctgcttccttgacaccttggctcggaacctgcagaggtgagccaaggccgacttctgcacgtcagcctcgacttcaccccacgaggccttagatggcacagtgagcccacctccctttcccagttgctagtgctttgacccctcactttgtttccatgaagagattatctttcagttgtggacttgactgtaaagaggcttnntnncccagagtgtagcacttatggatntgtggtgtttggggagccaggttagagcaattggctgcactgncctcccactaatataacctngctntcagaancctgactcaagccntcactccttgcatagnctcctgaggggagaaccgtgganccattntcctcccagcctctantctaacggagcatcacaaagaagagaaaaaaaatntccttgtattgctattggttttccat

SEQ ID NO: 5811 - DNA, 362 bp, Mus musculus
gcaattcagccggatgcaggttattataatgatctggtcccaccaataggaatgttgaataatcctatgaatgcagtaacaacaaaatttgttaggacatcaacaaacaaagttaaatgcccagtatttgttgtgaggtggaccccggaaggaagacgattggtcactggagcttctagtggggagttcaccttgtggaatgggctgactttcaactttgaaaccatattgcaggctcatgatagccctgtgagggccatgacttggtcacataatgacatgtggatgttgacagcagatcatggaggatatgtgaaatattggcaatccaacatgaacaacgtcaagatgttccaggcaca

SEQ ID NO: 5812 - DNA, 562 bp, Mus musculus
  misc_feature (171)..(171): n is a, c, g, or t
  misc_feature (286)..(286): n is a, c, g, or t
  misc_feature (292)..(292): n is a, c, g, or t
  misc_feature (294)..(295): n is a, c, g, or t
  misc_feature (297)..(300): n is a, c, g, or t
  misc_feature (309)..(309): n is a, c, g, or t
  misc_feature (331)..(331): n is a, c, g, or t
  misc_feature (348)..(348): n is a, c, g, or t
  misc_feature (365)..(365): n is a, c, g, or t
  misc_feature (369)..(369): n is a, c, g, or t
  misc_feature (384)..(384): n is a, c, g, or t
  misc_feature (393)..(393): n is a, c, g, or t
  misc_feature (438)..(438): n is a, c, g, or t
  misc_feature (459)..(459): n is a, c, g, or t
  misc_feature (473)..(473): n is a, c, g, or t
  misc_feature (508)..(508): n is a, c, g, or t
  misc_feature (521)..(521): n is a, c, g, or t
ttgtcagggttgttggtgacctcatggttcgaatccagcgcattcaagacttcacccccaagcttctcctggtcagaaagcggctgcttggcttggagcctgaaggccccatcgttgaccacatcacactgctggagggtgtgattgtgttagaggagttctgcaaggagnctggcggccattgcctttgttaagtaccacgcttccgccacgccgtgaaggccccgggtcactgcacatttcctccgctcagccacgagaggctaaaacgccttgcaaatgaagnatcgantnnannnncacagaatnttaagaatccactgcgtgactnctctcagtgaggcctgntgttgcttcctctcgcntctnccataatgattcccngtatggttncacgttgttcaaacccaggaaacaatcagacctgaggagactggntctccagtgaccgagaagctncaaagcttgtgatntcaggaacttggctggcatttttgttcttttaatntccttttaagcancaaagcattttgacattctctgggactcgaatgcttatatt

SEQ ID NO: 5813 - DNA, 406 bp, Mus musculus
  misc_feature (214)..(214): n is a, c, g, or t
  misc_feature (275)..(278): n is a, c, g, or t
  misc_feature (286)..(286): n is a, c, g, or t
  misc_feature (301)..(301): n is a, c, g, or t
  misc_feature (307)..(307): n is a, c, g, or t
  misc_feature (311)..(311): n is a, c, g, or t
  misc_feature (321)..(322): n is a, c, g, or t
  misc_feature (327)..(327): n is a, c, g, or t
ttgaaagctaaccttgttttacaagagtgtaaacttaaactagtgagaacttccatttgggtagcgtgttttacctttcgctatttgctgtttattaacagcataggcgatgaatctagccaaacaatggatagagaacagtaggaagcagacacctgcccctcctgccttttctgaggtgaaagaaatgatctggtcagcttactgattttgntctgaggacattttttatatagtttatattactttagacctgtagttctcaacactgatannnncactttanccatttctgctcganccctgntccntagagagatnnctcantcaattatttgaaggtggttttacacataggtttttgttttattttggttttttgcaccgattctttatccctgtgttg

SEQ ID NO: 5814 - DNA, 440 bp, Mus musculus
  misc_feature (148)..(149): n is a, c, g, or t
  misc_feature (151)..(151): n is a, c, g, or t
  misc_feature (154)..(158): n is a, c, g, or t
  misc_feature (160)..(161): n is a, c, g, or t
  misc_feature (163)..(164): n is a, c, g, or t
  misc_feature (166)..(184): n is a, c, g, or t
ccccaggtgcttttgatagagtgatgcttaagagtagctgcctgggcctggagcttcgatttcaggataggattcaaattaaatagaattcaactaactaaagcagatggccacaataaaagctgtgcgtgtcaggttagtctggggnnanggnnnnngnntnngnnnnnnnnnnnnnnnnnnngacatttaaggctgactggggatttgctaccacagaagctaagctaaataccaagccttgccgtggcaatttgcatttccacaataaatttggattggggtgggggagtgccaggacctcaacctggttaaggtttttgctctaccactgagctgtattagaagcccaaatctgtgatttggaagcagattcacagtatggaccgattgaccaaagacaaccttattgcaagaaacttcatctctaaacctgggct

SEQ ID NO: 5815 - DNA, 530 bp, Mus musculus
  misc_feature (267)..(267): n is a, c, g, or t
  misc_feature (291)..(291): n is a, c, g, or t
  misc_feature (323)..(323): n is a, c, g, or t
aatcgactgagctgctcatccggaagctgccattccagagattggtgagggagatcgcccaggatttcaaaaccgacttgaggtttcaaagtgcagccatcggtgcccttcaggaggctagcgaagcatacctggtggggttgtttgaagataccaatctgtgtgccatccacgccaagagagtcaccatcatgcccaaagacatccagttggctcgccggatacggggggagagagcttaagttgaagcggtttttatggcatttngtagtaaattctgtaaaatacttnggtttaatttgtgactttttttgtaagaaatntgtttataatatgttgcatttgtacttaagtcattccatctttcactcaggatgaatgggaagagtgactgactgttcacagacctcagtgatgtgagcactgtggctcaggagtgacaagttgctaatacgcagaagggatgggtgatacttcttgcttttcatgatgcatgtttctgtatgttaatgacttgttgggtagctatt

SEQ ID NO: 5816 - DNA, 214 bp, Mus musculus
  misc_feature (184)..(184): n is a, c, g, or t
gggcccagtttgatcgacatacgtctagcaaacactgcaggcggtgtttgaagatggcccagaactcggtgtcgctgtccgccggcgatcaagccaacaggatggcccaccgatcctcccaaggagatctcaacccgtcggccatggcttgggcaatggtctccggagatagcttcctggttantaggctggatccgaatcagccgggacctcg

SEQ ID NO: 5817 - DNA, 169 bp, Mus musculus
ccatctcaacaaagggcacaaagagcgggacttttgtcatgtataactgtgcccgccttgccacactcttcgagggctacaaacatggaacggagcaaggtctgtatcccacttttccgcttgtgagcagtctggacttctcactactccatgatgagggtgagtggct

SEQ ID NO: 5818 - DNA, 264 bp, Mus musculus
gccggactactcgagcattgacataatgcgggacaaactcttgatagcagcaagagaaggccaacagtcgttccatctttcctgatcacaacaagaaatcagtgtctgcctgttacagcaaaagaaaaaaatcatgatttcttttctgtgtcacctgagtcaaggaaacatgttcctccctcttgttgtaggaaaacggcttgcagattataattcgtaatggccctgtggacttaagtgatcaggccctaaagcattgttgtg

SEQ ID NO: 5819 - DNA, 589 bp, Mus musculus
attgcttcaatgctatccagccaagacctgaagatagtagttggagctcttcagatggcagaaatcctaatgcaaaagttacctgatatttttagtgtttacttcaggagagaaggtgtgatgcatcaagtcaaacatttagcagaatcagagtctttgttgacaagtccccccaaggcatgtacaaatgggtcaggatccctgggatctacaacaccagccagcagtgggactgcaacggcagcaaccaacgcctctgctgatctggggtcacctagcttgcagcatagcagagatgattctttggatctgagccctcaaggtcgattaagtgatgttctcaagagaaaacgactgccaaaacgagggccaagaaggccaaaatattcccctccaagagatgatgacaaagtagacaatcaagctaaaagccccaccactactcagtcacctaaatcttccttcctggcaagcttgaatccaaaaacatggggaaggttaagcgcacagtccaacagcaacaatatcgaaccagcacgaactgcaggagttagtggtcttgccagggcagcctcaaaagacaccatat

SEQ ID NO: 5820 - DNA, 320 bp, Mus musculus
cagaagccgttcgtgagccgtgagtgtgtagggttctttgattttcagtgcaaagtgactgttgagccgcccgccactggagtgtcagaagtacttctccagatggcccaggacatttaatagttgtttgtgccgaagcgtctctcagagttttgcatgagattctagtagcgttggtaggacctgccatgctcatccggcagggtatcagagcccagtgaccctgtcctcccttcaagctactgactgaaagggaagagaccaaaagacccaagtgagcccagccctgtcagcaaggctgaaaaatgccctttgacttg

SEQ ID NO: 5821 - DNA, 415 bp, Mus musculus
  misc_feature (289)..(289): n is a, c, g, or t
  misc_feature (291)..(292): n is a, c, g, or t
  misc_feature (294)..(294): n is a, c, g, or t
  misc_feature (296)..(297): n is a, c, g, or t
  misc_feature (299)..(302): n is a, c, g, or t
  misc_feature (304)..(307): n is a, c, g, or t
  misc_feature (309)..(317): n is a, c, g, or t
  misc_feature (319)..(321): n is a, c, g, or t
  misc_feature (355)..(355): n is a, c, g, or t
taggtgacggttccgagacatcgccgccaagctgggcaccggggagatggccgagacggaccccaagaccatgcaggacatcaccttggtggtggagacgctcttgcagcagatgcaagacaagtttcagatcatgtcagaccagatcatcggaaggatagatgacatgagcagtcggattgacgacctggagaagaatatcgctgacctcatgacccaggctggagtagaagaactggaccctgaaaacaagattcctactgcccagaagagttgaaggctgccggtncnnantnnannnngnnnntnnnnnnnnngnnncaagacaaaaaccaagtggctttctgcaactaantcctatgtgtggacaggtttataaacgtgcattcttatcacagcctgcatagcctagagt

SEQ ID NO: 5822 - DNA, 434 bp, Mus musculus
  misc_feature (222)..(222): n is a, c, g, or t
  misc_feature (279)..(279): n is a, c, g, or t
  misc_feature (318)..(318): n is a, c, g, or t
  misc_feature (323)..(323): n is a, c, g, or t
  misc_feature (338)..(338): n is a, c, g, or t
  misc_feature (358)..(358): n is a, c, g, or t
gggcattagaggagaccccacctgactcaccggctgcagagcaggagaacagtgtgaattgcgtggatcctctaagacactcatcaccgcctcttacagtcaagaaaccagtgctgtccccaaaccccgtgtagctctgttattaccataggggacttggttttggactctgatgaggaagaaaataaccagaaggaagggaaggagtttttgaaaaactanccagaagacgaagtttgacacctatatccccatgttttgtgactacatcccgtagtntcctgcctattcctttctggctacctaaacggttctcantcagntcctctggaatattntctgcactctgtccatcttntgctgcagctctgcatgcaatttagtggaaaagaagaggaagtccagacttgagttgcctggctacattgctgaaa

SEQ ID NO: 5823 - DNA, 538 bp, Mus musculus
  misc_feature (312)..(312): n is a, c, g, or t
  misc_feature (331)..(331): n is a, c, g, or t
  misc_feature (373)..(373): n is a, c, g, or t
  misc_feature (412)..(412): n is a, c, g, or t
  misc_feature (440)..(440): n is a, c, g, or t
aaaggtggctctgcgggtcctattccctgaccgctacatcctgcagggcttcttccgccccagtgagacagtgggggatcttcgagactttgttaggagccacctggggaaccccgagctctccttttacctattcatcgctccacccaaaatggtcctggatgaccacacgctgactctctttcaggcaaacctcttccctgctgcgcttgtgcactttggagctgaagaaccaacaggtctctatctggaacctgggctgctagaacacaccgtctccccatctacagctgatgtgctggtggccaggtntatgtcccgggcttccggntccccacctctgctgccagcccctgaccctgtatccctggantctgagccaatcgctgaggatggggcactggggcccccnagagcccatccaagggacagcccagccntgtgaagagaagcctgggcaaagtacccaagtggctgaagctgccagccagcaagaggtgagagctaccagcctggagatgcctatcaccagccacag

SEQ ID NO: 5824 - DNA, 516 bp, Mus musculus
  misc_feature (318)..(318): n is a, c, g, or t
  misc_feature (327)..(327): n is a, c, g, or t
  misc_feature (484)..(484): n is a, c, g, or t
ggtcagtactattctgctgtgctacaagacaaggacattgacgcatagggaatctcgtggacctttccaagtccgatgccaccttaccagaaagagcttgagctaggatttgaacccaggcaccctgggtttaaaatttgtcccaccctggtgatctgcgtgtgtccatggacacaccgctgaagcgaagacatgtcccttcacagaaaccggtaatgagttcaagtgccaggaactgggggtggggggagtggtgagggcagaggaaccctaaagatgcaaagcacctggaagacaggctttcctcaagaagcaatngccagaggnccctggaactggtcagcttggttctttaaagaaatcagctgtctggagttaggtgataaactgatcattccgggtagagttaaaggacctggggaccctgctagatcccaggaaggaccatcagcagcttctgagactgcctcatggggctcacttngtctctcaagctctgaatttctcctttgtgca

SEQ ID NO: 5825 - DNA, 122 bp, Mus musculus
  misc_feature (68)..(68): n is a, c, g, or t
  misc_feature (74)..(74): n is a, c, g, or t
cccagaggtacgtggtggcttgtaaggagcccaagaaaaagtgaatcgggctggtaggcttgaatctnccactnccaacctcatgggagaaggctacaaaggagttcctatgatcaaataaa

SEQ ID NO: 5826 - DNA, 304 bp, Mus musculus
  misc_feature (273)..(273): n is a, c, g, or t
  misc_feature (277)..(277): n is a, c, g, or t
ctctggatcgggaaacctggtgacaagcccccacccctctgtggagccattccagcctcaggggactatgtggccaaacctggagacaaggtggctgctagggtgaaggctgtggaaggggatgaacagtggatcctagctgaagtagtcagttacagccatgctaccaacaagtatgaggtagacgacattgatgaagaaggcaaagagagacacaccctgagccgtcggcgcatcatcccactgccccagtggaaagctaaccctgagacnaganccctgaggccttgttccagaaggagca

SEQ ID NO: 5827 - DNA, 479 bp, Mus musculus
  misc_feature (141)..(141): n is a, c, g, or t
  misc_feature (146)..(146): n is a, c, g, or t
  misc_feature (148)..(149): n is a, c, g, or t
  misc_feature (323)..(325): n is a, c, g, or t
  misc_feature (342)..(343): n is a, c, g, or t
  misc_feature (361)..(361): n is a, c, g, or t
actcttcccaatggtgctatgaaaactttgtacagttcagatccatgcgccgagcccgggatgtgcgggaacaactggaggggctcttggagcgtgtggaagttggcttgacttcttgccaaggtgactacgttcgtgtgngaaangnncatcacttcgggttatttttaccacactgcgaggctgactcggagcggctaccgcacagtgaagcagcagcagacagtgtttattcatcccaactcctctctctttgaacaacagccacgctggttgctctaccatgagcttgtcttgaccacaaaggaattcatgagacaagnnnctggagattgaaagcannctggcttttggaagtggntccccactactataaggccaaggagctagaagatccccatgctaagaaaatgcccaaaaaagtcggcaagacacgagaagagctgggctagagagtgacatggaccaaatccttgcag

SEQ ID NO: 5828 - DNA, 236 bp, Mus musculus
  misc_feature (80)..(80): n is a, c, g, or t
  misc_feature (165)..(165): n is a, c, g, or t
  misc_feature (176)..(176): n is a, c, g, or t
  misc_feature (184)..(184): n is a, c, g, or t
  misc_feature (189)..(189): n is a, c, g, or t
  misc_feature (192)..(192): n is a, c, g, or t
  misc_feature (195)..(195): n is a, c, g, or t
  misc_feature (208)..(208): n is a, c, g, or t
agctgtggccacagatgttcatcgagcttgtgagagacgctgtcatagagatccgcagcaaggattcctacatgaaactnctgcctgcagcagatcactgaccagaaatagggatggctgctacttcagacttgggcaattggagctttttcgaagtttggtaanatgcaggttanacatgatnagacnccnccnctaccgcacagtntagaaagagtggcatcaaagcctgcccc

SEQ ID NO: 5829 - DNA, 467 bp, Mus musculus
  misc_feature (390)..(390): n is a, c, g, or t
ggctggtaccagaatgcattgatgtgtgtgctttaccgttgtgacttctcaatattctgcagcgtttcttaagagcatggttgtaatgttcgtaaagcagacctcatcataagaagaaaatgaatgacattttctctcctgtggaagtcccaatagccagagctcctgatattttagaaacagatggtttttaagtggccacatgtaattttatgcagttgactatatatcttaaacttaataagctcattttgtggttcattagtttaaggtatttgtttactaacatgtttttagagaaaatactgttacttggcattaattgtccatttacagtgttctgttaagttcctcatgctatgcaccttacataatttccctaaagaacantcatctatcactgtggtgttaaaccgcaatctggatataacaaacaccatcactgcttgtgggtaatgtgctgtcat

SEQ ID NO: 5830 - DNA, 549 bp, Mus musculus
  misc_feature (338)..(338): n is a, c, g, or t
  misc_feature (346)..(346): n is a, c, g, or t
  misc_feature (348)..(348): n is a, c, g, or t
  misc_feature (352)..(352): n is a, c, g, or t
  misc_feature (384)..(384): n is a, c, g, or t
  misc_feature (396)..(396): n is a, c, g, or t
  misc_feature (418)..(418): n is a, c, g, or t
  misc_feature (423)..(423): n is a, c, g, or t
gttctcagtattatcactctattgaatttttttttcttattaaagtatgtagtttaaaagtaagacttttttccctgacagtattatgtaatttttagcgtgggtagatgggagtgtcgcttgtatgttaccatacagctgacatgtattttttgtctattctttattatcttagtagtttcatgctgtgtatgtaccataaccaacctattgcctatgagaaacatgtaagataatgtatttacagccattgttacaagtttataatgtatttttctatcttgttttatatgtatgttatataacattcaaaagaatttttttcttgattgagaaanaggatacnanaatngcaaaatccacaattttgataactgaaaattnccaattgttttncagtactttattatattgggtntcttntctttcttgggcttttagttagctgatgaatgaatacattagacacttctgggttttagttgggattttacatagcttgcattttagttctttggttctttgctgtttctattaacccatagcatt

SEQ ID NO: 5831 - DNA, 310 bp, Mus musculus
tgagaaccaccctcttcataacagtgggctgctaagcctggatcctgtgcaggacaaaaccccactctacagccagcttctgcaagcatacaaatggtccaacaagctgcagtaccatgcaggtctagcgtctggccttttgaaccaacagtccttgaagcgctctgcaaatcagatgggtgtgtctgccaagcggagaccgaaggcccagcccaccactctggttctaccacctcagtatgtcgatgacgtgatcagccgcattgacagaatgtttccagagatgtccattcacttatcgagacccaat

SEQ ID NO: 5832 - DNA, 340 bp, Mus musculus
agcatggagggcttgtccaagaataagctgaagaaacaactgaggaaccctcacaaaacctttgacccttccctgaaacccaaatatgccaagtgtgaccagtgtggaaatccaaagggcaataggtgtgtgtttaatctgtgccgtggctgctgcaagaagcgagctttcagagagacagcagattgcccaggtcatggattgctttttaagaccaaattagagaagtctttggcctggaaagggacccagcctggactgcaggaagcccagcaggtgaggcctgtgacaccaagtggtttctctgaagtcgtgggtagtgccctagcctgaaagccag

SEQ ID NO: 5833 - DNA, 462 bp, Mus musculus
ttgagtgagcgcttttccagggcagcagccgatcttgagcgcttttttaacttctgtggcctggacccagaggaagcgcgaggattgggggtggcccacttaacaagggccagctcggacatcgtgtctctagccgggccaagtgctggaccttgcagctctgaagggggctctcacgccgcagctctgctacagtggaagagcggtccctggatcgtgtcccctatggggtgtctgtgatcgagcgaaacgctcgtgtgatcaagtggctatatgggttgcggcaggctcgtgaccctcccaccactgagggttaggcctcctggactggggtttcccgggaagacatcgtgaagagacagttggcactttgtcctttcctgtatccattggctgccttcctgcagacccagagactcttgggtgaatttaatgtagaggccaagacttagaccagcatcc

SEQ ID NO: 5834 - DNA, 143 bp, Mus musculus
  misc_feature (46)..(47): n is a, c, g, or t
  misc_feature (57)..(57): n is a, c, g, or t
  misc_feature (59)..(59): n is a, c, g, or t
  misc_feature (66)..(66): n is a, c, g, or t
gcaatcactgaaacactacgaatgggcgtccgttttgcagcccagnnttctcagtgnanttgatangtgggtcatgggctcaggtccttatcccaggatcctctaagccttaggtgttgtggcaagagtctgtacagatatat

SEQ ID NO: 5835 - DNA, 285 bp, Mus musculus
gacagaattgaaatgcctgtggccacacagaagactgacacaggcctgacccagggactcctgaaagtcctgcacaagcagtgtagccacaagcaatatgtggagttagcagatcttgagaagaagtggaaaaatttgtgcctgccagtagaaaagctcagaacgatcctggagctggatccatgtgaggacaaaatagagtggatcaagtttttagcgctcggatgcagctccctgggcaggaccctgaacacggccatgaagaacgtgtgtgagatcctcacc

SEQ ID NO: 5836 - DNA, 518 bp, Mus musculus
  misc_feature (231)..(231): n is a, c, g, or t
  misc_feature (325)..(325): n is a, c, g, or t
  misc_feature (394)..(394): n is a, c, g, or t
  misc_feature (401)..(401): n is a, c, g, or t
  misc_feature (430)..(430): n is a, c, g, or t
  misc_feature (472)..(472): n is a, c, g, or t
atccactggctgttcatgggttactctatgactgccttctgcctcttcacatgggacaaatggcttaaggtgtacagatccatctatttccttggacatgtcttcttcttgagcctactattcatattgccttatatccacaaagcaatggtgccaagaaaagaaaagttaaaaaagagggaatgatctctgtctttccctggtggccgagagctggactggtgcagaaanctacttgtctcccttctcacagcactcctcaccccagcagagacgccaggagctggaagtcacagcactcccagctgtgcctctgcgacagccnaaaggggaagctcttgtgggaggagcagaggggctgcaccccctttggactcccccatgcacgttgccnttatctnctcccctctagccaggaatctgttgtttnctcttctgccaatctactacgattgtatatgtgccgataccnccaccccccccatggggggagggaagggtacaaggccctgcctgct

SEQ ID NO: 5837 - DNA, 369 bp, Mus musculus
gcaggcaattttatctcttcagtcagagcagacacccttaatgtcagcacactggtgcttaaaaaacaccttcaaagttggtgctgtggcaggaaatgattggattatttgggatatcactcggtccagttatcctcaagaaacaagacctgttcacatggaccgagcacacttatttaggtggtcggccattagtgaaaacttgtttgcaaccactggatatcctggcaaaatggccagtcagtttcagattcatcatttagggcactctcagcccgtcctcattggttctgtagctgtcggttctggtctttcctggcatagaacacttccactgtgtgcagttggaggcgaccacaagctcttgtt

SEQ ID NO: 5838 - DNA, 532 bp, Mus musculus
  misc_feature (353)..(354): n is a, c, g, or t
  misc_feature (375)..(375): n is a, c, g, or t
  misc_feature (398)..(398): n is a, c, g, or t
  misc_feature (437)..(437): n is a, c, g, or t
  misc_feature (439)..(439): n is a, c, g, or t
gcgtcttctcctcatggattagttatggttggagttgcagggactgtccaccgaggaaattcttgtttgggcatatttgagcaaatttttggacttatccgtagcccttttgtggaaaatacttggaaaatcaaatttatcaacctgagaatcattggaggaagttcccttgctcctgaatcagtactgaagccatctgtaacatttgaaccaagtgatctggaggccttttataacgtaatcaccttgtgtaatagccctgaagtaagacctaacgtaaggcagataatagatagtggcactggagaccaggttttacatagtggagatgaggcattgttgaacaaaagggnnaaatgaatttgctaacccctntaaagcattgagcactgtacctntgcttgaagaagctgcagaaacaacactgaccatctatntntaagccactgccgatgtgagaattgacatattttagttgaaatacctttttggactacagactaatgtgaatacttgcctatttctacctgag

SEQ ID NO: 5839 - DNA, 96 bp, Mus musculus
tggccttggtaactccctagcccagagactgtcgcaggatgcagtgacagtcttaacctttgtggcatcgggcacatacagaaggcacaactccaa

SEQ ID NO: 5840 - DNA, 167 bp, Mus musculus
tggccttggtaactccctagcccagagactgtcgcaggatgcagtgacagtcttaacctttgtggcatcgggcacatacagaaggcacaactccaaggcaataaaccagccctgcacatactctaaggccttaaggcttgaaagactggctcagttgcttcaccagc

SEQ ID NO: 5841 - DNA, 535 bp, Mus musculus
  misc_feature (338)..(338): n is a, c, g, or t
  misc_feature (360)..(361): n is a, c, g, or t
  misc_feature (495)..(495): n is a, c, g, or t
gaagcagtacaagcagacgataggactggatttctttttgagaaggattaccttaccaggaaatttgaatgttactcttcaagtttgggatataggagggcagacaataggtggcaagatgttggataaatacatctatggagcacagggaatcctcttggtatatgatattacaaactaccaaagctttgagaatttggaagattggtattctgtggtgaagacagtaagtgaagagtcagaaactcagcccctggttgctttagtgggcaataaaattgacttggagcatatgcgaacagtaaaagctgataagcacttacgattttgccaggaanaatggttttagtagccactttnnttcagccaagacaggagactctgtcttcctgtgttttcagaaagttgcagcagaaatcctgggaatcaaattaaacaaagcagaaatagaacagtcacagactgtatgagagtgcttccagatgagtcatgatntccttggatcattggggatcgatcacactggacctgttgt

SEQ ID NO: 5842 - DNA, 537 bp, Mus musculus
  misc_feature (404)..(404): n is a, c, g, or t
  misc_feature (407)..(407): n is a, c, g, or t
  misc_feature (409)..(409): n is a, c, g, or t
  misc_feature (455)..(455): n is a, c, g, or t
ggcaaatagactgagcaccctgacagcgactgaggcaaatcacaccaggctgtcctgcgtagcctcgtgtttgagcctgatgaagcactgcgtgctcatgtaccaggcactgccgtccttccacgccatcttcaggccccatcaagccctcctgtcgaagcatcttgcagattgtagcctcccccaagaacttcaggagctggctcaaagcatactgtcagcaatggaaggccagaagcagcactgccgcccgctggtgtgtgagaagagcaagcccgtcccactgaagcagttcaccccccggctagtcaaagtgcttgagtttggacggaaacaaggcagcagtaaagaagaacaggaaaggaaaagactaatccacaaacacaagcgggaatttaaaggcnccntnccgagagatccgaaaggacaatcagttcctggccaggatgcagctntcagaaatcatggaaagggatgcagaaagaaagcgtaaagtaaaacagctttttaatagcctggccacgcaagaaggtgaat

SEQ ID NO: 5843 - DNA, 573 bp, Mus musculus
gaacaagggtctcagcctgcagcacataggccggccccacagcggcattgatgactgcaagaacattgccaacatcatgaagacattggcataccgaggcttcatcttcaagcagacatcaaagcccttctgattggcagaggacgggatggggcaggacagggtagctgcttggcccaaaccagaatcctcctctccctcaccagagggaaaagggagagtggcacagctctgcgcccagagtgtcccccagctgccctacaggcttgtgccctgtgtgagggcatggccacttggcccctctggagcagacactttgtgccccaccccactcccattcctcagtctcagcccagtattagcccctgccattatgggcctgggctagggggaacccaggtactcaactgccttctccctagtacacaggcttctgctggggccaccaagccctccctgtgcccctcccatccatagtgcatggtgtgtggtgcccccagggctccaggacagatcaggccccaccttgtgtccaccctcccctcatccctgctgtgaacgtgccacttgaat

SEQ ID NO: 5844 - DNA, 250 bp, Mus musculus
gaattttcacactctttacatgttatgcattgtctgatttaactgtttattcagttagatatagcttttcttgatgagaaccttcattcaatgagatagcaaatgaacccagaagcatttatttaaaataactgaatggaggaagtaccatccgataaagtttacaacgtccacatcttttcgttgctgtttcatactgtgctttgttgtttgtgaacaacatcattttacccatggaggacacgtatct

SEQ ID NO: 5845 - DNA, 177 bp, Mus musculus
aggtatcttgcggtaccgagtagatttccagggaatggagtaccaaggaggagatgatgaattttttgaccttgatgactactaggtagtcgacatgggtccggcaaccgtgcctcaccctccagcattcaacccaaggagcatacccgtggtggagtccaacagatccctgcctta

SEQ ID NO: 5846 - DNA, 283 bp, Mus musculus
tcctgtctcatgtggagcagctgcttcgagccttcatccttaagattagtgtgtgtgatgctgtcctggatcacaaccctccaggctgcacatttacagtcctcgtgcacacaagagaagctgctactcgaaacatggagaagatacaggtcatcaaggacttcccatggatcctggcagatgaacaggatgtccacatgcacgacccccgcttgatacccctaaaaaccatgacgtcggacattttaaagatgcagctctacgttgaagagcgagcgcataa

SEQ ID NO: 5847 - DNA, 138 bp, Mus musculus
  misc_feature (39)..(39): n is a, c, g, or t
  misc_feature (47)..(47): n is a, c, g, or t
  misc_feature (49)..(50): n is a, c, g, or t
ttttcctgctctaaccttgacagttcggagcacctaagntaaaaaananngtgttgagtgttttctggtgttttgtgtttctctaaggcctttgagccttagctttctggtttttcttgcctcccaatttagggatcg

SEQ ID NO: 5848 - DNA, 531 bp, Mus musculus
  misc_feature (303)..(303): n is a, c, g, or t
  misc_feature (357)..(357): n is a, c, g, or t
  misc_feature (365)..(365): n is a, c, g, or t
  misc_feature (394)..(394): n is a, c, g, or t
tctttgacattttgtagaagctacataaatcagagtttttgataatcagtagaatgcatatgtgcatttatatttttgtggagtgtacctgggtgtcttatagatttttataatactgcatttgtgttttaaatgattacatttatacctatatggctgtaaattttatttcttagctggtgtagacctgtcctttagtattttgtctcttcaaaaagaattaaagtacattgacttgagtttaagattaagtaaatatattttttaacaaaaacatactacaaattcagggtaaactatttngttgttataatgttaagaaatttgagacttttagccatttctattttctacaanttgaaagntatttattttgatgtatatattagggtancaaacttgtactatttcatttttagtaaatgaaaacctaaaaattttgtatgtagaaatgtttgaacttgtttatttttaatctcgagtatttagttgccaaagtagaaaaggtattttgatactctgtatgtgtac

SEQ ID NO: 5849 - DNA, 559 bp, Mus musculus
  misc_feature (26)..(26): n is a, c, g, or t
  misc_feature (37)..(37): n is a, c, g, or t
  misc_feature (44)..(44): n is a, c, g, or t
  misc_feature (130)..(131): n is a, c, g, or t
  misc_feature (138)..(138): n is a, c, g, or t
  misc_feature (170)..(170): n is a, c, g, or t
  misc_feature (278)..(278): n is a, c, g, or t
  misc_feature (358)..(358): n is a, c, g, or t
  misc_feature (363)..(363): n is a, c, g, or t
  misc_feature (409)..(409): n is a, c, g, or t
  misc_feature (448)..(448): n is a, c, g, or t
  misc_feature (463)..(463): n is a, c, g, or t
ctccccagggcaggtgctgacttggntcatagacccnagatcangccactgagtcccaagaggaaccccattgacgtggaccccttcacccatgagagcactcaccaggagggcctgtatgccctggggnncgttggnctggggacaactttgtgagatttgtccagggncggggccctggctgctgccagctccctgctgaagaaggagaccaggaagccaccttaacattagcctggcaccctgacacccaggccctgaagaggaagagggcttancacagcccagcgggacgtgagcccatctaaagatttcccatttgggaaccagtctccccagcagaaggggaagacttganccatntggatggactatctgccccagaggcatggggaacacaggctgcccntaccctcaggcgagatgaggccccaggtgggagcagtanccatagaccaggggncccccttgaaactgtcagtgtgtgctggagtcacagggccagctgagtgtccaacttggagggccccaggcccaacttttcaccatcagatctgta

SEQ ID NO: 5850 - DNA, 488 bp, Mus musculus
gaagacttagctaccggcttggcattgattgacctgggtcagagtatagatatgaaacttttccctaaaggaactgtatttacaggaaaatgtgaaacatctggttttcagtgtcctgagatgctcagtaacaagccatggaactaccagattgattactttggagttgctgcaacaatatactgtatgctctttggctcttacatgaaagtaaaaaatgaaggaggagtctggaaacctgaaggtctttttagaaggcttcctcatttggatatgtgggaggaattttttcacatcatgttgaatataccggattgtcataatcttccatctttggattttctgagacagaatatgaagaaattacttgaacaacagtattccaacaagattaagaccttgcgtaataggctaattgtgatgctttcagaatataagcgttcaagaaaataaaatgaatatggaccttctccaaaacacacttagta

SEQ ID NO: 5851 - DNA, 298 bp, Mus musculus
agagagtgtggcttcatccgcctcaagcctgacaccaacaaagtggcctttgtcagtgcccagaacacagggattgtggaagtggaggagggtgaagtgaatgggcaggagctgtgtgtctcatcccattccgtctccaggatctcctttgccaaggagccccatgtggagcagatcactcggaaattcaggctgaattctgaaggcaaacttgaacagacggtctctatggcaaccactacacagccaatgactcaacatcttcacattacctacaagaaggtgaccccttaacctg

SEQ ID NO: 5852 - DNA, 444 bp, Mus musculus
  misc_feature (270)..(270): n is a, c, g, or t
  misc_feature (359)..(359): n is a, c, g, or t
  misc_feature (370)..(370): n is a, c, g, or t
  misc_feature (410)..(410): n is a, c, g, or t
tgcacctcatgcagtcagcactgggggcagctccaggctctggagctggacaccttggtggtccgtgatttcttttgagccccaggcttttgttttcattcagactcttgttctgttttctgatgagcaggagacggggaccacttgatggtagactgtggtagttgggtatgttctcatacagaagagcattcgtgtaacttctgagacagggtgatgtttagagaagggctctggctgctgccctgaatggagccagaggaagaagcnccttttcctttgggaaaggctgctcattaaatgaagtgaggatcaggtcaggggagggtcaggcctggctgggcggcaagagtgctaanctccagtccantccctgccagaggctgagcaaaccagtttcaaaagctaantccccaaatggcagcagtttatgttctgatctgt

SEQ ID NO: 5853 - DNA, 125 bp, Mus musculus
accaacgttgctcacatcatctcttacagtgcacgcttccggactctgttacataggccgccaccattgttcatagcatctcttaaacagtgcacgctctctctgtgtatttaagtgtttctcaa

SEQ ID NO: 5854 - DNA, 445 bp, Mus musculus
  misc_feature (29)..(29): n is a, c, g, or t
  misc_feature (280)..(280): n is a, c, g, or t
  misc_feature (282)..(285): n is a, c, g, or t
  misc_feature (297)..(297): n is a, c, g, or t
  misc_feature (389)..(389): n is a, c, g, or t
cggcggtgtcggtagaaaacttcattgcngagctgctgcctgacaagtggtttgacatcggctgcctggtggttgaagaccctgtgcatggcatccgcctggaagcctttacccaagccacgcccgtgcctttggagtttgtgcagcaggcgcaaagcctgactccccaggactacaatctgaggtggtcaggccttctggtgacagtgggggaagtcctggaaaagagcttgctcaatgtcagccggactgattggcacctggctttcactggcatgtntnnnncgacagatgatntacagtgcagccaaggccgtggcgggcatgtataagcagcggctgccacccaggcccatgtgagagcagtgcggggacacggagacctgccntcgtcaccttgggctccatgcagaggaacctgagtggcttccgtgaatccaacagt

SEQ ID NO: 5855 - DNA, 455 bp, Mus musculus
  misc_feature (419)..(419): n is a, c, g, or t
ttcgtggtgttctgggaaaggcttttcgacttgctggctataccattcagtatggctgcatagctcattgtgcttttgaatacgttggtggtgttgtaatgtgttctggaccatcaatggaacccacaattcaaaattcagatattgtctttgcagaaaatcttagccgacatttttatggcatccaaagaggtgacattgtaattgcaaaaagcccaagtgatccaaaatcaaatatctgtaaaagagtaattggtttggaaggagacaaaatcctcagcactagtccatctgatgtatttaagagccgcagttacgtgccaacaggtcatgtttggttagaaggtgataacttacagaattctaccgattccaggtattatggacctataccatatggactaataagaggacgtatnttctttaagatttggcctttcagtgacttcggattt

SEQ ID NO: 5856 - DNA, 224 bp, Mus musculus
ttgctccctcctagggaggtactaagtagttagtgcaatgacttcactgtgccctgttaccttgtcacttcccatcttgacaagggcctagtcctgagagtccaccagcctcatttcagcctctaggaatagcagtaagagcaagccacaagccagatagctctgggcccttcaccatgggtcagaagaggttccaaggtggtgggtagccagtgtccccatga

SEQ ID NO: 5857 - DNA, 519 bp, Mus musculus
caaacttcaagctcaggtccggatagggggcaagggtacagctcgcaggaagaagaaggtggtacataggacagctactgctgatgacaaaaagcttcagagttcactaaagaaactggctgtgaacaatatagctggtattgaagaggtgaatatgattaaagacgatggcacggttattcatttcaacaatcccaaagtccaagcttccctctccgctaacacctttgcaattactggtcatgcagaagccaaaccaatcacagaaatgcttcctgggatattaagtcagcttggtgctgacagcttaacgagccttagaaagttagctgaacagttcccacggcaagtattggatagtaaagcgcccaaaccagaagacatcgatgaagaggatgatgatgttccagatcttgtagaaaattttgatgaagcatcgaaaaatgaagctaactaaaatcctctgggttttggaagctggcatggactagatttaacaatcagctctgttgttccaaa

SEQ ID NO: 5858 - DNA, 498 bp, Mus musculus
agtgtttgaggccttccctgagacccccattaacatcgacatcaaagtgaacaacaatgtgctgatcaagaaggtctcagaactggtgaagcagtataagcgagaacatctgacagtgtggggcaatgccaactctgagattgtagacaagtgttacaaagagaactcagacattcctatactcttcagcctgcagcgtgttctgctcatcctgggcttgttcttcaccggcctcttgcccttcgtgcccattcgagaacagttctttgaaatcccaatgccctccatcatactgaagctaaaagaaccacacactatatccaaaggtcataagtttctcatctggctttctgataccttattgatgcggaaagctctatttgaccacctcaccgcccggggcattcaagtgtacgtttgggttttaaatgaggaatacgagtacaaaagagcctttgatttgggagcaactggagtgatgacggactacccaaccaa

SEQ ID NO: 5859 - DNA, 388 bp, Mus musculus
  misc_feature (139)..(139): n is a, c, g, or t
  misc_feature (336)..(336): n is a, c, g, or t
  misc_feature (358)..(358): n is a, c, g, or t
aactactggccacttacaagttcctgtcctattctgaacttcaaacaaaattccactgataccactaaagccctgttcctcagctctgaggctgagactgtctcctgttagaaatggctcttcttaactaacatccctnaaacaaatatgaggtgcttctttctgatgggacactgggtcaggtgtcacaaaattccctcagtgtggctgtgaatgatggcactgcttctaacagtagcaacaaatttcaggtgaatgaccagaagtttacagaacccttattgttcctcagtcacttaaatgatctggttccatgttaatgtttctgttttcttnccatttggataaagaatgagantctttgagaaccttgctttcacagagactt

SEQ ID NO: 5860 - DNA, 396 bp, Mus musculus
  misc_feature (348)..(348): n is a, c, g, or t
cgaaccttagacacggtggcactgtggatgagtatctacaagaccagctgattattttcatggcgctagccaatggaatttccagaataaaaacaggatcagtcacactccacacgcagactgctatacattttgctgaacagctagcaaaggccaaatttaccgtgaagaaatcagaagaggaagaagatgccactaaggacacttacgtcatcgagtgtgaaggaattgggatggcaaatccacacctctagggtgttcacgtacgctctacctccttgttgcactgacttagcccatgcatgctgcaacacagtgagtgagacgtcagctaccacaggacttgantctttggagatggaggttggcactgtcagttgctgagaatgctccatc

SEQ ID NO: 5861 - DNA, 506 bp, Mus musculus
aagcactgcaggttgtgtgaccgctgtgtgcaccggttcgaccatcactgtgtttgggtgaacaactgcatcggggcctggaacaccaggtacttcctcatttacctcctgacgctgacggcttctgctgccaccatagccaccgtgactgctgccattctgtccgcctagtgacagtgtctgatctctaccaggaaacttacctagatgacgtggggcatttccaggctgtggacactgtctttcttattcagcatctgttcctggcatttccaaggattgtcttcctactgggctttgtcatcgttttgagcatgctcctggctggctacttgtgctttgctctgtacctggctgccaccaaccagaccacaaatgaatggtataaaggcgactgggcctggtgccagcgctggcctctggtggcttggtccccatcagctgagccccggatccaccagaacattcactcccacgggtttaggagcaaccttcgagagatcttt

SEQ ID NO: 5862 - DNA, 241 bp, Mus musculus
taagtaaccaggccgggttcaccagtctctagtaagttcctggcacagcacagaccctgccaaagaccgaattgaaatcacaagcttgcttcccagcaggactctgtctgtaaacagtttggatgttttaggtccctgtcttgtttgtggaactgatgcagaagccatttatgttaccagacaactattttcatgaaagtgaaaaaacctagttatcaaatttttatcaccagtaaagtgg

SEQ ID NO: 5863 - DNA, 197 bp, Mus musculus
gaagaatcaatgtccttgtgtggtatttatgcctttagaaatgtatttcaagtctgggaaagaaggccatcttttgctcaaatattttcagcaagcaaaatgaaacttcttttgtatttaaaataaatatcaaattacaacagggtatttttcccatttctcaaatatttggtatgcttgaaaatctctaagtcacc

SEQ ID NO: 5864 - DNA, 255 bp, Mus musculus
  misc_feature (65)..(65): n is a, c, g, or t
  misc_feature (198)..(198): n is a, c, g, or t
  misc_feature (217)..(217): n is a, c, g, or t
aggaatctgaatttttgtgtctggaatttgatgaagttaaagtcaagcaaatcctgaagaagctntcagaggtagaagagagtatcaacaggctgatgcaggcagcctaactgaagagagtatcaataggctgatgcaggcagcctaactgaaggctggaggaaggggcgtttgaagtgaagctgctcacagactttntccactgaccctttgaaantcctgtttgcccactggtgttaccaaaagacattgtat

SEQ ID NO: 5865 - DNA, 540 bp, Mus musculus
  misc_feature (294)..(294): n is a, c, g, or t
  misc_feature (302)..(302): n is a, c, g, or t
  misc_feature (362)..(363): n is a, c, g, or t
  misc_feature (400)..(400): n is a, c, g, or t
agacatgtctgctccagttaaacatgaggccatgcatgttgaggactatttgaacaaccaaaccccctccctgtccctgctggcgagaatctttgtcagttattttacatttaaaaggattatttttaaaccaatctcagttgacctttttacccacccagtctgctggttatactcatgggctttcatagtgtcttccccaaagagaaactggcagctaattgttcctatgccttgagcaactctggtcatggactgttgggttgtctggccttagcataccagattaccccntttgcctncagtactggggtatcgggccagatatgtgtgtgtttgtgcagtggatgggagggaagcannccgcctggtggagggagtgttagggatggaagagatnccttactttctgtcaagagaaaggtgttttttctttaattgttcaaagtggacgtgtttactcaattcatttctttattaattcatttctttatttaaaaaaaacaacataatttgtatttcctgtgtgcaataccagat

SEQ ID NO: 5866 - DNA, 502 bp, Mus musculus
  misc_feature (307)..(307): n is a, c, g, or t
gaaggaggttcctgatttacctgaagaaccatcagaaacagctgaagaggtagttactgttgcccttcgatgcccaaatggacgtgttctgaggagaagatttttcaagtcgtggaattcacaggtcttacttgactggatgatgaaagttgggtaccacaaatccctatatagactttccaattcctttcccagaagggccctggaagtggagggaggctcgtcactggaggacataggaataactgtggacactgtacttaacgtggaagagaaagagcagagcagccagtagagaggctggaancacctgctgcccttccacagggcggtgttcattcaagccccatgcacctggagctcctctcgtccacaggtgtaccccgcccacaccccgcccacaccccatggatgaggaccgctttgcactgatggtctgtggcctgtcattataatgtgaaaggaggtaaaaagagtaagacagacctggatgcaagcctca

SEQ ID NO: 5867 - DNA, 534 bp, Mus musculus
  misc_feature (410)..(410): n is a, c, g, or t
cactgcatgccgtgattgtggagttcagggacctgtggcggatccggagtccttgcggtgactgcgaaggttttgatgtgcacatcatggatgatatgatcaagcactccctggatttccgagagagcagagaggcagagccacacccactgtgggaatacccctgcagaagcctctccaagcctcaagagatcctgacttttgatttccagcagcccatcccccaacagcctatgcaatccaagggcacaatggagctgacaagacccgggaagagccatggggctgtcctgtggatggagtatcagctcactccagacagcacgatcagcactggcctcataaaccctgcagaagacaagggggactgctgctggaacccccactgcaagcaagctgtgtacttcctnagcaccacgctggatctcagagtgcctctgaatggccctcggtcagtcagctatgttgtggagtttcaccccctcactggagacatcaccatggagtttaggcttgcagacaccttgagctgat

SEQ ID NO: 5868 - DNA, 573 bp, Mus musculus
  misc_feature (318)..(318): n is a, c, g, or t
  misc_feature (333)..(333): n is a, c, g, or t
  misc_feature (413)..(413): n is a, c, g, or t
  misc_feature (447)..(447): n is a, c, g, or t
tgccggcagctgatttggtacaatgccagaagtaagcctcatgtgcacccgtgctggaaggaaggagacacagtagggttcctgttagacttgaatgaaaagcaaatgatcttctttttaaatggcaaccagctgcctcctgagaagcaagtcttttcatccaccgtatctggattttttgctgcagctagtttcatgtcataccaacaatgcgagttcaattttggagcaagaccattcaaatacccaccatctatgaaatttagcacttttaatgattacgccttcctaacagctgaagaaaagataattttgccnaaggcacaggcgccnttgctctgctgaagcaagtcagtattcgcgagaactgctgttcgctctgttgtgatgaggtggcagacacacagctgaanccttgtggacacagcgacctgtgcatggattgtnccttgcaactggagacctgcccattgtgtcgtaaagaaatagtgtctagaatcagacagatttctcatatttcatgacacatgtgaagagatatcatggacctatttctactcaattccagccaat

SEQ ID NO: 5869 - DNA, 283 bp, Mus musculus
  misc_feature (65)..(65): n is a, c, g, or t
gagattttgttaatggcgatggcactggagtcgccagtatttaccggggtccatttgcggatganaattttaaacttagacactctgctccaggcctgctttccatggcaaacagtggtcccagtacaaatggctgccagttctttatcacgtgttctaagtgtgattggctggatggaaagcatgtagtgtttggaaaaatcattgacggacttctagtgatgaggaagatcgagaatgttcccacaggccccaacaataagcccaaactgccagtggtgat

SEQ ID NO: 5870 - DNA, 499 bp, Mus musculus
atgctgagaaactgtacctgcggtcgatagccattgggaagaaactgtttggtgaaggctacagtggactagaatatgattaccggggcctcattaaactttacaactccattgggaattatgagaaagtgttcgagtatcacaacgttctgtctaactggaaccggttgcgagatcgacagtattcagtgaccgatgcccttgaagacgtcagcagcagcccccagtccactgaagaagtggtgcagtcctttctgatggctcagaatgttgagggaccaagctgctgagggacagcctcagctaacaattacctttcccagattccggggaattcatactgtgaaatcaaaccatgttgtttttagggctggcatttgcattgaaacactggtccagtccacccaagaccctatttcgggtagtcctgtattgcagttcctgtagaataagcatatattgagttatatcagcatgtgccgcgtgtataagtagtccc

SEQ ID NO: 5871 - DNA, 317 bp, Mus musculus
aatgacctcattacagtgtgactgcacagaaaagttacagagcaggtttgattttctgcgctctcagctgaatgacatctcatcttttaagaatatctacagatatgcctttgattttgcaagggataaagatcagagaagccttgatattgatactgcgaagtctatgttagctctgctgcttgggagaacatggccactcttttcagtattttaccagtacctggagggcctgttcttcttgatgaatttgttgagtggcaaaaaatccgtcaaacatcatagcaagaactgtcgtgaagacaatgcaaaccttg

SEQ ID NO: 5872 - DNA, 411 bp, Mus musculus
  misc_feature (322)..(322): n is a, c, g, or t
  misc_feature (336)..(336): n is a, c, g, or t
  misc_feature (362)..(362): n is a, c, g, or t
gggacctatcaggaactctgcatgaaaaaggaattgaagaaagccattctggatgacatggtgatgctggggaaagaaagcggactgcattcttttgaacaggttaaagccatttacatccattgtgacatgttctctgttcaaaatggtctgctgacaccaacactaaaggctaagagaccggagctgagagagtacttcaaaaagcaaatagaagagctttacttagtctccgtgtgaagctccaggagggcccgtctcagtccgatgaactttgcagcaatattatagttattcgtgagagaaaggaatcagaatgccnacagctcaaagtgnacaagcacctgatttttgcaactgancctttcctgacccaagaagtctctaacaatattttctctaccatcacca

SEQ ID NO: 5873 - DNA, 492 bp, Mus musculus
  misc_feature (206)..(206): n is a, c, g, or t
gttcgtgcagttcaagcaacagctgagggagctgaagaagcaatatggtattcatgcagacagagagaatgatctgacagaaggagttgacgaagatatgattgtgacccagagccaaaccaatttcatctgccccataacacagctggaaatgaagaagccagtgaaaaataaaatgtgtggccatacatacgaagaggaagccnattgttcgcatgattgaatccaagcataagaggaagaagaaggcctgttgccccaaaattggctgtagccacacagacatgagaatgtcagatctcattccggatgaagccctgagaagggcaatcgagagccacaacaagaagaaaaaacgccactccgaataggagcaagccacctgcccacagggatgtcagcagcctacctccccgccagccaccagagagtgagggatgccagcgataggcctggccaagcagcgctgtttgcggtaacccttgaaggcta

SEQ ID NO: 5874 - DNA, 397 bp, Mus musculus
  misc_feature (331)..(331): n is a, c, g, or t
ggttgactctgatagcttggccttcgttaagggagcccaggtggacttcagccaagaactgatccgaagctcattccaagtgttgaataaccctcaagcccagcaaggctgctcctgtgggtcatccttctctgtcaaagtctgacacaatgacggatgaccctgagattgccaccactgcaccagtgtgaacaacctagaatagtagaattctagaggtttctttctcatcatgtccggctctcatcttatttaatttaatccagaagtgtcttattctaccactgtaaattatggaatgtgaagcttttaactcttggccgaaatactntcccctcccccagtacaatgtcaaggccacatccaaaggctgttacctcacctgtaatcactggtt

SEQ ID NO: 5875 - DNA, 465 bp, Mus musculus
tgtggccacgtcatctccagagatgcactcaacaaactcatcaatggaggaaagctaaagtgtccctactgtcccatggaacagaatccagcagatgggaaacgcatcatattctgattccaaggaacattctagaaggtgtaatccacccatgggcctttgtggagggactggcttcagcagactgtgatgcctctcagaccagcattaccaagagacccaacctgcctaggcagaggccagggaaggctgtgaaccagcagcctatgcttccttaccttctagggggactggctactctgttcctgcattctgtttacacttgcccctgacggagcagcaaaggtcttggtcatcaaatgcagacatctttctactcctggcatcaaaggggtttccagctgtggcccacttcctactgtacagtctcaactgtatctacccattcattctccactgtaaata

SEQ ID NO: 5876 - DNA, 462 bp, Mus musculus
  misc_feature (26)..(26): n is a, c, g, or t
  misc_feature (208)..(208): n is a, c, g, or t
  misc_feature (333)..(333): n is a, c, g, or t
  misc_feature (337)..(337): n is a, c, g, or t
  misc_feature (344)..(345): n is a, c, g, or t
  misc_feature (349)..(349): n is a, c, g, or t
  misc_feature (352)..(352): n is a, c, g, or t
  misc_feature (354)..(354): n is a, c, g, or t
  misc_feature (357)..(357): n is a, c, g, or t
  misc_feature (359)..(359): n is a, c, g, or t
  misc_feature (361)..(361): n is a, c, g, or t
  misc_feature (368)..(368): n is a, c, g, or t
  misc_feature (370)..(370): n is a, c, g, or t
  misc_feature (377)..(377): n is a, c, g, or t
  misc_feature (380)..(380): n is a, c, g, or t
  misc_feature (395)..(395): n is a, c, g, or t
  misc_feature (405)..(405): n is a, c, g, or t
aatacagacttctctcccacattaanaatgaaaactgcatttttggagtaaaatacagagaactgaagattcaaactgtacaaaacaactctgtggcaacagccgtctctgtggtcttccttttgagatggcttctgctctgtgaagggagcttttcaggctcttgtcctcctgctttcagaagaaaaagacaatggagtgtaaaggncctcaattttcctaggcagtacatttcataccaaagcgggttcttctaagtaaaacctaaaacggaggttcttggtgcctacattatcagaggggcagtgcctatttaggttcagacaattgacnaacnaggctanntctnacnanganancntactttntntgagaantanaagaactttataatnccagggtttnctcaccaaacacataaacgtttttatgagaaggagaatcgcgaagcttctagaagcc

SEQ ID NO: 5877 - DNA, 294 bp, Mus musculus
  misc_feature (27)..(27): n is a, c, g, or t
  misc_feature (211)..(233): n is a, c, g, or t
  misc_feature (235)..(248): n is a, c, g, or t
  misc_feature (251)..(255): n is a, c, g, or t
  misc_feature (257)..(258): n is a, c, g, or t
tcagaaagtacatcagtcaagctaganaactccagccttgagatgacgacaacctttaaaaatggtggcaagaatttaagcaactactggctgatgaagtcagagccagaaagccggctagagaaaggtatagacatgaagttcagcatcgaggatctcaaagcacagcccaagcagacagcttgctgggatggtgttcgcaactatcagnnnnnnnnnnnnnnnnnnnnnnngnnnnnnnnnnnnnnagnnnnntnnaattggaggatgaagccttcttctaccatagcaact

SEQ ID NO: 5878 - DNA, 515 bp, Mus musculus
aagactggcacctattctgtggagacatggtagaaatcttagaaggcaaggatgctgggaagcaaggcaaagtagtccaagtcgttcggcagcgaaactgggttgtcctggaggggttgaacacgcattaccgatacattggcagaaccaaggaccaccgagggaccatgatcgctagtgaagcccccttgcttcatcaccaggtcaagctagtggatcctgtggacaggaaacccactgagatccagtggagatttactgaggcaggagaacgtgttcgagtctctacaagatctgggagaattatccccaaacctgaatttcctagagcagatggcattgtccctgaaacatggactgatggccccaaggacacatcagtggaagatgctcttgaaagaacttatgtgccccgactaaagacattagaagaagatgtgatggaggccatggggatccaggagactcgaagattcaagaaagtttattggtattgagcctcagagtgctgcttc

SEQ ID NO: 5879 - DNA, 187 bp, Mus musculus
ccctttatcattgagtggatcccagatatcctcccacagtccaagattggtgagcttcgaatcaagtttgagtatggtcaccaccggaatggacatgtggctgactaccaggacccaaggccacccatggaccaacctttggagctggcccctctgactactatcactttcccttgaggcaaatcaa

SEQ ID NO: 5880 - DNA, 523 bp, Mus musculus
  misc_feature (373)..(373): n is a, c, g, or t
  misc_feature (382)..(382): n is a, c, g, or t
  misc_feature (389)..(389): n is a, c, g, or t
  misc_feature (453)..(453): n is a, c, g, or t
ggtgacgtttgctatccagatctttgcactgtggcccatgttacagaagaaactgaaggcgtacaccccgcgaagctatgtaggggtcactttgctttttgccttttctgcctttggaggtcttctgtccattagtgctgtgggagccatactctttgctctcctgctgttttccatctcctgtctctgcccttactacctcattcatctgcagctttttaaggaaaatattcacgggccttgggatgaagctgaaatcaaggaagacttgtctaggttccttagctaatctagggaccttcatttcattattaagaccagcggaaagacttcgagcctaaccggtgcaacatttaaaggcaggggtccactnttgaagcanccgactnatctagatggtagagctgagatcagaagaaagcatttaaccaagggcttaggggagggtgcttntccttcagttattttgtgactgaaaaagctttctggtgctgttatgaattattgtcctttattccctgta

SEQ ID NO: 5881 - DNA, 407 bp, Mus musculus
  misc_feature (342)..(342): n is a, c, g, or t
  misc_feature (355)..(355): n is a, c, g, or t
tatgagctctcgctactcacagaaacagcattccccctgtactgcatggagacaccatctggagagagaggactctctgagcattgcagctggagcacctgaaatgatcatacattccctttggcgacccctgagacacaaagaagggttaaaaattgggtatgcatctaaaacaagatgcaagtccctgaagatttttagaagaccaggcagactgttcttgttaccagttccttctaatgattctcagtcatgcccgagtgaagaaacacaggaggaggatctgctgaataagtgcatgcagtccatgtccatccaagaacaaggcccagctcacgccancctgacggtctantcctccacaccaagctcagccatcagctaacatccacatgctgagtgcacag

SEQ ID NO: 5882 - DNA, 434 bp, Mus musculus
  misc_feature (212)..(212): n is a, c, g, or t
aggatcgttttctcatttgtatgctgcacaagcttggcttcgacaaggaaaatgtgtatgatgaattacgacaatgcatccgaaactcccctcagtttagatttgattggtttctcaagtccagaactgcgatggagctccagaggaggtgtaataccttaattactttgattgaaagagaaaatatggaactagaagaaaaggagaaggcnagagaaaaagaaaagaggaccaaaaccttccacacagaaacgtaagatggacggtgcccctgatggccgtggaagaaaaaagaagctgaaactatgaatgcatttttgtcttataatcactaactggtagttctttaatttacgggtcttcataagatgtgctgtacagtgctcaactgttatgtcattcagacatcaggtccatctgcttactgagctaga

SEQ ID NO: 5883 - DNA, 535 bp, Mus musculus
  misc_feature (98)..(98): n is a, c, g, or t
  misc_feature (437)..(437): n is a, c, g, or t
  misc_feature (469)..(469): n is a, c, g, or t
gagagacaagactccatcaatgcatacaatgaaccaaatagcacaaagtttgtatttatgctaagcacacgtgctggtggtctgggcatcaatcttgncaactgctgatgtagtcattttatatgactcagattggaatccgcaagttgatcttcaggctatggaccgtgcccatagaattggacaaacgaagactgtccgagtgtttcgctttataactgataacactgtggaagaaagaatagtggaacgtgctgagatgaaacttagactggattcgatagtaattcaacaagggaggcttgtagatcagaacctgaacaaaattgggaaagatgaaatgcttcaaatgattcgacatggtgctacacatgtgtttgcttcaaaagaaagtgaaatcactgatgaggatattgatggtattttagaaagaggtncaaagaagactgcagaaatgaacgaaaagctntccaagatgggtgaaagttcacttagaaactttacgatggacacagagtccagtgtttataacttt

SEQ ID NO: 5884 - DNA, 397 bp, Mus musculus
ttttccctaggccttatagtatagaggcatttgtaatatggagaaaataatttttctcatttaattatagaaattaccttcaaacagattttgtgttctttggcccttcaaatactggtgttacattgttgctgcagataaatgatgattgtcgtgggatatctggatcactgagctctgtgctttcattcctagagatgtttctcattcccatttagtgaaatgctgttgccccaaagtgatggttgtgggatttcttaccggtcataggccccggtgaggagcagggaagcgccattgtgaaagattaaagaaagcacttccacttgagctccttatggagtgagcttccctgtgcccactcagtgaactaagtctgaccatccttcagggacgt

SEQ ID NO: 5885 - DNA, 419 bp, Mus musculus
  misc_feature (393)..(393): n is a, c, g, or t
agctgagaaaagttcctctggcttctttggactcatggcagctgctgctgtttctaagggatgtgcctcctgcatcgcttacccacacgaggtcatcaggacgcggctccgcgaggaaggcagcaagtacaggtcgttcgtgcagaccgcgcgcctggtgttccgggaggaaggctacctcgccttctaccgaggactgtttgctcagctcatccggcagatccccaacactgccattgtcctgtccacctacgagttcatcgtgtacctgctgggagagcgtgcttagtgacagggccacatggttgtgctctagaagaataaaacctgaaaaccctagagattttcttttccgttgatgtttagtgttcaaaactgaaacagcgaaggccnatagaatacctggctcatgtcacctg

SEQ ID NO: 5886 - DNA, 445 bp, Mus musculus
  misc_feature (100)..(100): n is a, c, g, or t
  misc_feature (372)..(372): n is a, c, g, or t
  misc_feature (374)..(374): n is a, c, g, or t
  misc_feature (412)..(412): n is a, c, g, or t
atttggatcttacagactaggagtccacacgaaaggtgctgatattgatgcgttgtgtgttgcaccaagacatgttgatcgaagtgactttttcacctcnttctatgataaattgaaattacaagaagaagtgaaagatttaagagctgttgaagaggcatttgtaccagttatcaaactctgttttgatggaatagagattgatattttgtttgcaagattagcactgcagactattccagaagatttggacctacgagatgacagtctgcttaaaaacctagatataagatgcataagaagccttaatggttgcagggtaaccgatgaaattttacatctagtaccaaacattgacaacttcaggttaantntgagagccatcaaactgtgggccaaacggcacaacatntattccaatatattaggtttcctcggtggtgtt

SEQ ID NO: 5887 - DNA, 276 bp, Mus musculus
ggagaggcagaacatcttcttgatggaacaggtccgccagttacagaagctcactgctcagacctccagcagagctgcccagaccagcacctgtgttctgattcttcttttttcactggctctcatcatcctgcccagtttcagcccctttcagggtcaatcagaagctaggcccgaggattatcagcttcatggagtgatttccagaaatatcttgactcacgagaacgtaacagaaaacctggagagtccagtgctaaagtccaaactggagga

SEQ ID NO: 5888 - DNA, 494 bp, Mus musculus
  misc_feature (118)..(118): n is a, c, g, or t
  misc_feature (172)..(172): n is a, c, g, or t
  misc_feature (226)..(226): n is a, c, g, or t
  misc_feature (241)..(241): n is a, c, g, or t
  misc_feature (302)..(302): n is a, c, g, or t
  misc_feature (448)..(451): n is a, c, g, or t
  misc_feature (453)..(453): n is a, c, g, or t
aactgactgtgttgtgctcagcaccagggacgcttaaaaccctcgcccgctatgctgtgcgccgtagcctcggtctccagtacctgcccgacgcagtgaagggtctcccactgccagntgtctttgaaggactacctgttactcttggagtagcttggaggaggcattgctnccgtcatgcggacggctttgggtgaggcttccttgccatcctgtctctttgttntcaacacagaaaagnaggtgttcctgctgtgtggtttatagatttgaggcaacacataacagtgacttatgcatcncctcccctcccatcccaagcaaccaaaccaaaaccatttacctcacttgtttgccgtgttattgcttagttgcttttttatattcagccctgcaaaagaagtcttccccggatcccttaggcacttcagtcaccagtgtaacccannnncnaggaagatgtcacgttctcagagtgcacagttccctttggg

SEQ ID NO: 5889 - DNA, 362 bp, Mus musculus
  misc_feature (333)..(333): n is a, c, g, or t
ggtaaaaagcgaggcccgccaggcagcaaagactgggcaaccgcactgaagggctgtggtgactacttgttcatagagtttctgaaacgatgcctccagtgggacccctctgcccgcctcaccccggctcaagcattaagacatccttggattagcaagtctacacccaaacctctcaccatggacaaggtgccagggaagcgggtagttaaccctacaaatgctttccagggactgggttccaagctgcctccagtcgttgggatagccagtaagcttaaagctaacctaatgtccgaaaccagtggtagtatacctctgtgcagtgtattnccaaagctgattagctagtggaccactca

SEQ ID NO: 5890 - DNA, 551 bp, Mus musculus
  misc_feature (379)..(379): n is a, c, g, or t
  misc_feature (455)..(455): n is a, c, g, or t
acttccaggagcatagccgtgatgagcagtacctgtgccagttctgtgagcacgagacaggggaccctgaggacttgcacagccacgttgtcaacgagcacgctcgcagactgattgagctgagtgacaagtgtggcagtggtggccatgggcagtgcagccttttaagcaagatcacctttgacaaatgtaaaaatttcttcgtgtgtcaagtatgtggctttcggagcagacttcacacaaatgtcaacagacacgtggctatcgagcatactaaaatattccctcatgtttgtgatgactgtgggaagggcttttccagcatgttggaatattgcaagcatctaaattcacatctatctgaagggatttacttatnccaatattgtgaatattcaacaggacaaattgacgatcttaaaattcatctagatttcaagcattcagctgacttncctcataaatgtagtgagtgcttgatgaggtttgggaacgaaagggacttactcggtcaccttcaagtccatgagactacctgaccgtgatcttta

SEQ ID NO: 5891 - DNA, 517 bp, Mus musculus
ggatgcacagcagtgtcacccaagccacccagacgagcccagaggttcctttgccttcacagtcagccaactttctcgacattacaagggaacagctcatggaggaaaacgaatgtctcaggcagagactagctcaagctaaaatggagctcgcggaggctcactcggccagagatgagcttctccatcaaatgaagaggatgggcctgtagctgccgtggccgtgagaaccggggctagagcgctggagaaggacggctaggtttaacagaaggatgtaaccagttagtgggaagttttcctttacatgaaataaagcgagtggtgaagtggcggctgttccaaaccctgtggaggaaaccttgggcgcaagcggtacagtcatctgggtggccccgtgaaggctgcgcacactgtaacacagttacatgcctaatgagaaatgtcagttcctaacttcagtgtctcatcaaaagcattttttacaagaaaaacgaagacctgttgtgctcatgca

SEQ ID NO: 5892 - DNA, 265 bp, Mus musculus
gctatgacactcatggtgctttgcatgttggccggaattacagccatccctgtatctgaggacttggcagaaatcacatccttcattacatcacacgttggagtgatttaaattttattgtgaacagtatttgccttccttctcctcacatcattcttttcgggtgacatcatttgataaaaacaggcactgtttgggagccaacatacagccaagaacaaattaaatcgttactatattacctcagagtatttacaacaccatg

SEQ ID NO: 5893 - DNA, 320 bp, Mus musculus
gtgatcctggacgatgtggacagcagtgtgtgccgggaccttgaggtggtccgccggatcatccgcactgcaggcctcagcctcctggccgaggagcgccaggagaacctgccagatgagatctaccatgtctacagctttgccctgagatgaagccagggccagagctgggggccagcagctggcaggccaagagacacaccattgactccagtgggaagggtcaagccctaggggaggtgtgccctggattggggcactgcagccctgtcactctaaagcaccctggcaacttcccacagggctatggaaagcagagt

SEQ ID NO: 5894 - DNA, 435 bp, Mus musculus
  misc_feature (290)..(290): n is a, c, g, or t
tgaacgccttttttaacaacaccatctcctcggcagtgaagcagagcatcttagccaagctgcaggaagcagtggaagtgaatctcggcacggccatgacctacacgttgttcgagtacgctaaggaccataaagagcagttcatggagaaccaccatcctgggaattctgcaacgcctgtagccaatatcatctcggttgaaactcccaccacagccccatcaagtaagaaaaaagagaagaaagaacaactttccaaagctcagaaacgcaagctggcagataaaacnagatcacaaaggggagctgcctcgcggctggaactgggttgacgtcgtgaagcatttaagcaaaactggctctaaagatgatgagtagcaagcacctgccgcccaagcaagagcagcctttgaaaagcggcctggttcagcatct

SEQ ID NO: 5895 - DNA, 555 bp, Mus musculus
  misc_feature (273)..(273): n is a, c, g, or t
  misc_feature (296)..(296): n is a, c, g, or t
  misc_feature (305)..(305): n is a, c, g, or t
  misc_feature (307)..(307): n is a, c, g, or t
  misc_feature (316)..(316): n is a, c, g, or t
  misc_feature (357)..(357): n is a, c, g, or t
  misc_feature (405)..(405): n is a, c, g, or t
  misc_feature (407)..(407): n is a, c, g, or t
  misc_feature (411)..(411): n is a, c, g, or t
  misc_feature (437)..(437): n is a, c, g, or t
  misc_feature (444)..(444): n is a, c, g, or t
  misc_feature (446)..(446): n is a, c, g, or t
  misc_feature (480)..(480): n is a, c, g, or t
  misc_feature (530)..(530): n is a, c, g, or t
ttgtttataactcatctcttgctacccatcaggaaacccatcacaaggagaaacccttcactcaaagtggtcctattcagcagcagaggaaccacaccaaggagaagccctacaaatgcagtgtatgtggaaaagcatttattcaaaaaataagtcttatagaacacgaacaaattcataccggagagagaccgtataaatgtgctgagggcgggaaggcctttattcagatgtcagaactcacagaacattagggaacccacactgggaagnccctacaagtgtgatgaatgtgncaagacctntnagacaggantcagagcttgctgagcactagagaattcattatagaagtgntccctaaaagtgtaatgggcgtggggaattgttcacgtagaactcagntnttantcatcatcagactagtcacaaaagancaagtantntgtgtgatgactacagggaagctacctcacggtntcggctgatgaagagtattgtatttgtaatgctttgtggtgacatttcancctttgctgttacgagaccataaat

SEQ ID NO: 5896 - DNA, 458 bp, Mus musculus
agatgactgacctgagtgtggcacagaaaccagaaaaacttctggagcgctgcaagtactggcctgcctgtaaaaatggggatgagtgtgtataccatcatcccatttcaccttgcaaagcctttcccaactgtaaatttgctgagaaatgtttgtttgtgcatccaaattgtaaatatgacacaaagtgtactaaagcagattgtcccttcactcacatgagtagaagagcctcgatactgactccaaaaccagtgtcgtcaccagcaccgtcttctaatggccagctctgccgttacttccctgcttgtaagaaaatggaatgtcccttctaccacccaaaacactgtaggtttaacactcagtgtacgagacctgactgcacattttatcaccccaccattactgtgccaccaagacacgccttgaaatggattcgacctcagagcagtgagtga

SEQ ID NO: 5897 - DNA, 371 bp, Mus musculus
gtggttatcaatctgctaagctccaggcagatcatgaacacctccttcaacccgctcaggatcgtcaacacctatggggcctttggaagtgtcaccaaagagcggactgaggtgatcctgcagggcacagtgagccccaacgccagcgcacctgatgcagtgtgggaagactatgagttcaagtgcaaaccgggcgacccctggaggcagccatgcctcatctcgccataccactaccgcctggactggctgatgtggttcgcagctttccagacctatgagcagaacgagtggatccttcatctggcgggtaagctcctagctggtgactctgaagccctggccctacttgctgttaacccctttgaggg

SEQ ID NO: 5898 - DNA, 204 bp, Mus musculus
acccttggagatgcctagaatatctttacggggcactgtgtcccagctgtccttagacatagcctgggagaatggaattttttgttttttcaggacaaggctggtcaggacactgtcctttttctttcttcttcaggagagggatgtcacctgagtgactgttgctcgtcattctgaggcgccagatgccattggtaaagttgt

SEQ ID NO: 5899 - DNA, 412 bp, Mus musculus
  misc_feature (61)..(61): n is a, c, g, or t
  misc_feature (195)..(195): n is a, c, g, or t
actgccgccccgcacagagaaggtgcaggcaatggctgtcccaagcccccctacgccctcnactctgtcagctctgcaactgagaccagccagcacctgctgagctacacagaggagacagaagtccagggccagactaccacagaccagtctccttccttctcaccaagggacacgatgaggagtcacaagaantaggaacatcctgactgccatattgctactgctgcgggagctggatacggaggggctggagactgtccagcagaccgtgggcagccggctacaggcgctgcacaggccggagccccaggaagacatggagtgatttcagacgccccagtatctggacccttttatatcctgaggaaacacagccctacctggaaagccttcaaagcaggcccagtgg

SEQ ID NO: 5900 - DNA, 406 bp, Mus musculus
  misc_feature (259)..(259): n is a, c, g, or t
  misc_feature (378)..(378): n is a, c, g, or t
agcacagcatggtgagcgtctccacacccatcgctgacatctatgaacaggagaaggatgaagacggattcctctacatggtctacgcctcccaagaaaccttcggcttctgagtcaagaggaggggaggggggtggctgggagttctggtcaggttctccccagggaggtcctggctcctaaactaagctatttcagtccccagtggattaggcagagatgtgacacccactcccccccccccccccaggtaggggcnaccagccagcctaccacatcctgggtaggtcctgggccagtcatgttcgggttgctcttttgggtgctggctgggttgggagtgggtggggagcagcatccctgctctgtggggtttgntcattttgttaggcccttgcctgtctgc

SEQ ID NO: 5901 - DNA, 164 bp, Mus musculus
  misc_feature (58)..(58): n is a, c, g, or t
  misc_feature (130)..(130): n is a, c, g, or t
tgcatcttatgtaggagcctaagtcttcttctctgtcaggctcttattcagaagtttnctggcctctccatgccttttatttccacttggtaagccctgttagggagcttgagacaggggtctggatccntcgggagaccactgggtataatctatttttctag

SEQ ID NO: 5902 - DNA, 385 bp, Mus musculus
  misc_feature (29)..(29): n is a, c, g, or t
  misc_feature (271)..(271): n is a, c, g, or t
  misc_feature (276)..(276): n is a, c, g, or t
  misc_feature (278)..(278): n is a, c, g, or t
  misc_feature (280)..(280): n is a, c, g, or t
  misc_feature (285)..(285): n is a, c, g, or t
  misc_feature (287)..(287): n is a, c, g, or t
  misc_feature (296)..(296): n is a, c, g, or t
  misc_feature (301)..(301): n is a, c, g, or t
  misc_feature (315)..(315): n is a, c, g, or t
  misc_feature (317)..(317): n is a, c, g, or t
  misc_feature (322)..(322): n is a, c, g, or t
  misc_feature (334)..(334): n is a, c, g, or t
  misc_feature (339)..(339): n is a, c, g, or t
  misc_feature (344)..(344): n is a, c, g, or t
  misc_feature (352)..(352): n is a, c, g, or t
  misc_feature (355)..(355): n is a, c, g, or t
tctggcccgctacatagatgatgaagatntggatcggatgctgagagaacaagaaagagaaggggacccgatggccaactttattaagaagaataaagctaaggagaacaagaataagaaagtgaagccccgctacagtggtcctgctcctcctcccaatagattcaacatttggcctgggtatcgctgggatggagtggacagatccaatggctttgaacagaagcgctttgccaggctcgccagcaagaaggctgtggaggagcttgcnctacnantngagtntngaggatatntgacnccaccccccccccngnccatntgacccctgagnccatntgatnctgtggtnctnttagcaccagctcacatccagctctaaagg

SEQ ID NO: 5903 - DNA, 257 bp, Mus musculus
gggatattctgatccgaaagtaatagagaacaagaacacagaagacaagcacacaggacaaagcctcaaagatgtgtttgtctcccaccaacaggagcctcagcaggcaggactgccagggtccaggaggaactccagggactaattccaatttcacctcaagagccctgtccactggttccttgtttgaagcaattgatttctcttcacacagtgaagaatgtgcccagccacagcgttacccatgaggcccaact

SEQ ID NO: 5904 - DNA, 245 bp, Mus musculus
gcttccagcgtcctgtgtacttgttccacaaggctcgatcccccagccactaagtggccttctgagaagttgtaaagaggctgcccttgctgctcctgaggacctggggggaaaggaaattattccaaggtctttcctaactccaaaaagtttctccttttcttggatctgtcaagagagcttttcctaagttgctaccccacatctcctccctgtcacctctggcacttgagcaagcccagctg

SEQ ID NO: 5905 - DNA, 466 bp, Mus musculus
aattggcagagcattttcccttcgggaaggatgaggttcccagagacctgcgttgctttcttctggttttatttaacggctgataaatgacattcttacggccagaaggtggatgtgcaccggacaggaaaggccttcagtattagcctaagcatttcttctaggtgctgagcctgttcagctccttggctgccctgcccagcccagccctaagtgtgaatagttcttggcgtgtataaatgacaaaggagtttttcctctcctaagggcttgatgttaacactaaatagaatctgattttgactcctaatgcagcacattgctgtacacatttacagaatgtttgcagaatctctcctgatatttttcatgctggtcatgacctgaaggaaatttcttagcacgaatattgtgtcaggtatttttaacttgatcatggtcagctctgaggtgcaactgtgtcttc

SEQ ID NO: 5906 - DNA, 508 bp, Mus musculus
  misc_feature (195)..(195): n is a, c, g, or t
  misc_feature (363)..(363): n is a, c, g, or t
  misc_feature (374)..(374): n is a, c, g, or t
  misc_feature (411)..(411): n is a, c, g, or t
ggatgcggcagagccctttgatttcccgtcagattagcagactaggggagagcattaacaggccctggctcccttgggcaggggatagggaggagacacaggatggaagaacccaaggtgccaggccagggccatagccaagcaagcaccccaggtccacccagggtgtcaatctaaaacataccccaggaaggntctagaaataatgagccttggatgctgtcggcaagtgacagcatgtaactgcctgtgtctcagaatcaccatattcagacagctggcagctcacctcttgacactggtgtctggggtttggcactcctcccagagagcacctcgcgtgaagggtgcccagtaagtggntctgggttgtnctgcaccccagcccccggaacccccagccgtaatctntctgcctttaaagagccctcatcctcaaatccacagcctcttctggcatcagcttcccagcagcaagctccagccttccacagcacactgtaattta

SEQ ID NO: 5907 - DNA, 297 bp, Mus musculus
cggtcatgatcgtttatcccatggggctgccaccatacgatcctatccggatggaatttgaaaataaagaagatttgtcaggaactcaggcagccctcgaagtcatccaggagtcggaggcacagctgtggtgggccgccaaggagctgagaagaacaaagaagctttctgactatgtggggaaaaatgagaaaaccaaaatcatcgtcaagatccagcagagagggcagggtgccccagcccgggagcctgtcatcagcagtgaagaacacaagcagctgatgctgttctaccaca

SEQ ID NO: 5908 - DNA, 165 bp, Mus musculus
ccctcacttctagatgttcaaaattccgcttcaagcctctgtcagataagattcaacaggagcgattactggatattgctgagaaggaaaatgtcaaaattggcaatgaggaaatagcgtatcttgttaagatatcagaaggagatttacggaaagccatcacat

SEQ ID NO: 5909 - DNA, 72 bp, Mus musculus
ggaaggcaacgaacaggatcaggaccagtggatgatctaggtagacaagccaaggtggcctcagtgattcca

SEQ ID NO: 5910 - DNA, 467 bp, Mus musculus
  misc_feature (326)..(326): n is a, c, g, or t
  misc_feature (352)..(352): n is a, c, g, or t
  misc_feature (357)..(357): n is a, c, g, or t
  misc_feature (360)..(360): n is a, c, g, or t
  misc_feature (369)..(369): n is a, c, g, or t
  misc_feature (400)..(400): n is a, c, g, or t
  misc_feature (428)..(429): n is a, c, g, or t
acacactcatgatcctggagatgcagctggtggaacagctggaggagaccataaacatatttgaaagaaatatcactgacttggtgggactatttattgaaaatgtccaaagtctgattgctcagtgccgggacctggagaaccatcaccatgagaagctcctggagatcgccatcaacaccctggagaagatcctcaagggcgagatggacgaggacttacccgatgacgtgcgggcgctttttgttgacaaagacacaattgttaatgccgttggggcatcacatgacatccacctcctgaagattgacaaccgagaagatganctggtgactggaatcaactcttggtntgcanatntagtagacnagattcacaaagatgagatcatgaggaaccntaagcgagtgaaggagatcaatcaattnntcgaccacatgcagagtgaactggacaacctggaatgt

SEQ ID NO: 5911 - DNA, 393 bp, Mus musculus
gcagggaatatacctatctgttcttaaagatttcatggttggcccatacaaagcaattctctgttgacttctttgactcctcctgaagcagaaggaagacagaaagacagacattgattatttttatgagcgtgggatttaggatctcatcacttttatccagtttttaggatttgccatggtaaatcttaaacttgagaaataagagtacacctctgtgttgtcacttacccatttatgtatgtgttggcgtgacaaggacagctgcctttctgtcattactggtgttttctaaactgtaggagaattttggttttgacttttgaggcttatggaaatatttagaacttggttcatttttcagttattgttagcttaaactccctaagttct

SEQ ID NO: 5912 - DNA, 216 bp, Mus musculus
cagaggtattagtaattccatttttggaaaatcttaaaaatcgcccaaatgttgacactaagtacattgaaaaacagtgtctttggtatagtaaatgtttgttcttcattcatctgtaacttaatatttgttcaaattttgcctttgatacaactaagttaaaactcttgagtgctgacctgttgtatatacacaaaacaatctgctttgttggag

SEQ ID NO: 5913 - DNA, 325 bp, Mus musculus
  misc_feature (224)..(224): n is a, c, g, or t
gggtcatgttttgagcctcatgtcttataattctcagtggacaataaacgacttcacacataggcagtagttttgtggtatttaatgtgtcaggtgtctaagaattagtaatatccctatatcagcatttgtggtgtgctcagtaaatctactcttccaataattcctatttaattactttgatatggaagttactgaaactcattacaaaaggccaatgtttncagtatacaccgggaagatgattgctaattccagaccccatgtcgaaaaacttacacacagaggagaaagactggtggtcgaatctgtcgtgtatttttaa

SEQ ID NO: 5914 - DNA, 224 bp, Mus musculus
aggtgcccctggagtctgactctgtggagttcaacaatgctatcagctatgtgaacaagatcaagacccgctttctggaccaccctgagatctacaggtccttcctggagatcctacacacctaccagaaggaacagctgcacactaagggccgtccattccgtggcatgtctgaggaggaggttttcacagaggtggccaatcttttccgtggtcaggaggac

SEQ ID NO: 5915 - DNA, 270 bp, Mus musculus
gcagatccaagaacataagctagaagaagcgcaggagcaagaagagcaggaagaagaggaagaggaggaggaagccaagcaggaagaggggcaggggacagaggcgggtctggagtcagtgtccaggctgcagtcagactcagagcccaagtttcaatcccagtcactgtcttccaacccgtccttcttcactccccgggtccgagaggtggagtctgctccattgatgatgaagaatatccaggagctcattcggtctgcccaggaaat

SEQ ID NO: 5916 - DNA, 411 bp, Mus musculus
  misc_feature (208)..(208): n is a, c, g, or t
catgaacaatgtgaccctgggcaatgcccgtatgggctactatgagacagtagctggtggtgcgggtgcaggccctggctggcatgggcgcagtggtgtacacagtcacatgaccaacacgcgcattacggacccagagattttggagagccggtatccagttatcctgcgccgctttgagctgaggccaggctctggaggccgaggnccgcttccggggaggtgatggcgtagtccgagagctggtctttcgggaagaggcgctactgtctgtcctcacggagcgccgcgccttccagccttatggcctccacgggggagagcctggtacacgtggcttaaacctcctgatcagaaaagatgggcgcacagtgaatctgggcggcaagacatccgtgactgtgtatcccg

SEQ ID NO: 5917 - DNA, 218 bp, Mus musculus
  misc_feature (121)..(121): n is a, c, g, or t
  misc_feature (133)..(133): n is a, c, g, or t
gcgagacgtgattgacagcctggtaagccagtccctgtggctaagaaatcttctgggcctgcctgagaaggagacggtttatttggatcttccagatgaacaaggtcaaaaatcccctccnagtcacagagtngaaggtgacaagtgggaaagctgggaaggaggatcggagagggggcgcacaggagaagaaacaactgggtaccaaagacaaagat

SEQ ID NO: 5918 - DNA, 254 bp, Mus musculus
tcctcaggcgcagctatgcatggagacaagggctttgaataagcagcacggccaggccagcattgcagctggtagggctgtgtattctaccaaaagagaggtgagatgctaagggtgtgcgtgttagggaggttgggtgagaggggtcacctcctccctacatcagctctggtctttcttcctctttatccacccctgctggtctctgaacctcagaactcaagcccttgacagaacgaggctcccagggactc

SEQ ID NO: 5919 - DNA, 483 bp, Mus musculus
  misc_feature (95)..(96): n is a, c, g, or t
  misc_feature (268)..(268): n is a, c, g, or t
  misc_feature (287)..(288): n is a, c, g, or t
  misc_feature (292)..(295): n is a, c, g, or t
  misc_feature (300)..(300): n is a, c, g, or t
  misc_feature (302)..(303): n is a, c, g, or t
  misc_feature (305)..(305): n is a, c, g, or t
  misc_feature (317)..(317): n is a, c, g, or t
  misc_feature (323)..(323): n is a, c, g, or t
  misc_feature (340)..(340): n is a, c, g, or t
  misc_feature (348)..(348): n is a, c, g, or t
  misc_feature (366)..(366): n is a, c, g, or t
  misc_feature (437)..(437): n is a, c, g, or t
  misc_feature (442)..(442): n is a, c, g, or t
  misc_feature (448)..(448): n is a, c, g, or t
atgactcagacatagacatccaagaggatgatgaatcagacagcgagttggaggacagacggatgtctaagcctcggacagcgatggaggtgctnntgcaaggaaggcccagcaaacggatcgtgggtgcaatgcaaggtggagactcggatgaagacgaagactcggaggacagtgaaattgacatggaagatgatgaagaagatgatgacgatttggaagatgaaagcattgctctctcaccagctaagcccagtcgaaggatccntaaaccggagcccttggannaaannnncaatnanntnctgaccttgccnaagggncccaggcagattaagancctcagangtataggtacacagggantcggcaggctggaaaggtaacatgtgttttgttcactacaccatctgggcttaaccccaacaaagatgttnttttntctatntcctaacacttgggatccccatacctgtgttctaa

SEQ ID NO: 5920 - DNA, 515 bp, Mus musculus
  misc_feature (269)..(269): n is a, c, g, or t
  misc_feature (322)..(322): n is a, c, g, or t
  misc_feature (340)..(340): n is a, c, g, or t
  misc_feature (342)..(342): n is a, c, g, or t
  misc_feature (346)..(346): n is a, c, g, or t
  misc_feature (348)..(348): n is a, c, g, or t
  misc_feature (350)..(351): n is a, c, g, or t
  misc_feature (353)..(353): n is a, c, g, or t
  misc_feature (358)..(365): n is a, c, g, or t
  misc_feature (367)..(369): n is a, c, g, or t
  misc_feature (372)..(372): n is a, c, g, or t
  misc_feature (395)..(395): n is a, c, g, or t
  misc_feature (441)..(441): n is a, c, g, or t
  misc_feature (446)..(446): n is a, c, g, or t
  misc_feature (479)..(479): n is a, c, g, or t
ggaggacaactccttcaattgaagagacctccagctggaaacaaaagaggaaagagataaacatacgggtcgatgtgttggccgtgcttagctggctgccgctcattctatgattctatttttctaacgatgtagtaattgaactgcatctcgggagatttataacattttgatattcctcactctggaacttgaactttgtttaccttaccaaacatctttcttgtgaattcaaaatccagttgcagttttggttgctcttttttttngattctccatgtaagaaatgttgtgattaaattaccaattgatagtggtgggnaaaaaatccatcaacctnancctntnanntntcctnnnnnnnnannncantgtttctgttgctgaggtttatnctgtgaatacatgcacattggtttcttatgcagatggtataaactntaggncctgtgctagaagtagtttgttccttgacaagnccttttgaactgtgctgcagggcatcttgtggatat

SEQ ID NO: 5921 - DNA, 522 bp, Mus musculus
  misc_feature (310)..(310): n is a, c, g, or t
  misc_feature (316)..(316): n is a, c, g, or t
  misc_feature (323)..(323): n is a, c, g, or t
  misc_feature (328)..(328): n is a, c, g, or t
  misc_feature (330)..(331): n is a, c, g, or t
  misc_feature (338)..(338): n is a, c, g, or t
aatgaagtggcttctgagcctcttaatgtgctgagtcttaatctggactagagaaactacattttagggaaactctttgtacccactataaacgtgctggtttgaagagtggtggagctccagggagtgctcagaggtgtgtcaggttgtctgtgtgacctctgtctgtactgccgatcctggtgttgagtgagtaaacaccactgtgaagagaattcattgccttaggaccgtgacagcgtgaaagtagttttcaggtggaatgaacacatggaattgcacggaaatagtttaatttttttacataganggtttngtatatnatgtntnntcagtgnatactttcaggatcattttcactaaggcaccttttttttattttattcaaaacaggtctggtgtacatacatacgaacatacatacatacatattttagtataatgttacttgggtttgattataaaaattgttggtctgttttatttatctgcatataacagtgattggcattcctgaattta

SEQ ID NO: 5922 - DNA, 377 bp, Mus musculus
caacctgtaggaacacatctggaattctaggattttctgtaactgttgggactcaggcaaccaaatacaactccgaaactgttgacaagaagatagaggaatttctttccagctttgaggagaagattgagaacctcacagaagatgcattcaatactcaggtcacagcactgatcaagttgaaagagtgtgaggacacccaccttggggaggaggtggacaggaactggaatgaagtggtgacacagcagtatctctttgaccgccttgcccatgagattgaagccctgaagtctttctcaaagtcagacctggtcagctggttcaaggctcacagaggacctggaagtaaaatgctcagcgttcatgttgttgga

SEQ ID NO: 5923 - DNA, 547 bp, Mus musculus
  misc_feature (405)..(405): n is a, c, g, or t
  misc_feature (407)..(407): n is a, c, g, or t
  misc_feature (458)..(458): n is a, c, g, or t
  misc_feature (472)..(472): n is a, c, g, or t
  misc_feature (474)..(474): n is a, c, g, or t
  misc_feature (477)..(477): n is a, c, g, or t
  misc_feature (508)..(508): n is a, c, g, or t
  misc_feature (510)..(510): n is a, c, g, or t
acagagttcattcttagtcacaggaacactggacaagatgttcaagaaggttctctttgtctgtgaggggggagtggatctttatccaaaaagctcaaacttctccaacacatatctgggcacttgaagagtctcccttgctgcccgagctgtagactattggagtttcttaatgtctgggatttttcttggctcccaaaagccagccccacctgaaccagccccagttgtcctcattggggcttgatagggcacatgacatttccagcctctccaacagcgggggtggcagatggctggagagatgacaccgtgagtcactaaggagtagctgccagcgctttaggacagtcccaagcgcagtgaatcaaatgttcagggtggtgagcatgacgcagaaagcantntcctcggtggagagcactctgtgcacctgtcagcactcaggaaatggcatntctgccgtgatgtntntgntcagcttcttagtctagcagggatccccttntntctgggaagaaactgattacctttaacgtgccactaa

SEQ ID NO: 5924 - DNA, 135 bp, Mus musculus
  misc_feature (46)..(46): n is a, c, g, or t
  misc_feature (48)..(48): n is a, c, g, or t
ccctgggcagcggtgaagaatggcaagctgcaggccggcattgacntntgtgagaccaggacaagggacctaccttgctagcctggacgtgaagctgagctacctggtgtgaagacctaacttaatcaattagat

SEQ ID NO: 5925 - DNA, 296 bp, Mus musculus
  misc_feature (108)..(108): n is a, c, g, or t
agcacagaatgctgactgccctaaaaactcaggaactgtgggtgctgttgccttggactgcagaggaaacttggcttacgcaacctctactggggggattgtcaatanaaatggttggccgagttggagactcgccttgcataggagctggaggttacgcagataataaccttggagccgtttcaaccacaggacatggggaaagtatcctgaaggtgaatctggccagacttgccctcttccatgtagagcaaggaaagaccgtagaggaggctgctcagttggcattggattac

SEQ ID NO: 5926 - DNA, 218 bp, Mus musculus
cactaagtcaagagactgtgcagtactgtcagctattctagacttgatcaaaactcaagaaaaggctactccaaggaacttgccaccacggtcacaggacggatattatagctgacagctttctgtgatggcctaaaacctatcctggtgtccataatttccaatttttttcttttttttagtttttggcaaaatgccaagccctgggttatgacttg

SEQ ID NO: 5927 - DNA, 437 bp, Mus musculus
gagcgagcggctgtctattaacctgcccaacagggtagtgtccatccctcctggttggttttggctagtagctggactttatatttatactctctctgtatttatgcacctgctgctctggtgaaggtgggataagccgcgcccccagcccttctttcttacctcagatgcctgaagagaaccaggcagcccagtagcagcttcccaggagctgacaagccttccatcagaggcttgtgctatcaagtgagcttatcacccacaacctgcggtgcccactccgtgcttctgatgtgcacacctcacacgggttaaacactatggccaggccacctccaataccctctcctcctcctagaacaggcgagggggggctggtgcccaggcctgggcaaggagagtctgggcacctacaggctcaggcttgaagttcattt

SEQ ID NO: 5928 - DNA, 546 bp, Mus musculus
  misc_feature (349)..(349): n is a, c, g, or t
  misc_feature (366)..(366): n is a, c, g, or t
  misc_feature (381)..(381): n is a, c, g, or t
  misc_feature (388)..(388): n is a, c, g, or t
  misc_feature (409)..(409): n is a, c, g, or t
  misc_feature (414)..(414): n is a, c, g, or t
  misc_feature (461)..(461): n is a, c, g, or t
  misc_feature (470)..(470): n is a, c, g, or t
  misc_feature (472)..(472): n is a, c, g, or t
  misc_feature (479)..(479): n is a, c, g, or t
  misc_feature (481)..(481): n is a, c, g, or t
  misc_feature (506)..(506): n is a, c, g, or t
gcctaccccggaaactcaagatgtcggttggaccccctgactgccccgtgggtgggccgctggctttcccagccaggggttctggtgccagtgttggggcagccctgacccccctgcctcctcccaagatgcctccacatacaatcctgagcaccgtccctcagcagatgttcagcgatgcaggcagtggggatgacgccctggacggagatgacgacctggtgatcgacattccagagtagccacccagtgccacctgccaggcacctcacagcactcctcctgtgccagcaaactcaagcccacttcctcaagagatgtttattgatgcccagttgccatgcttcgnccactgacacaatcagnaaaggcgtaaacatncacaatntccccgaggaaggtggcaggntcctncccttacatcccagccccatccagggaacagttatttaaacgagtgnccaaaaggntntgctacntnttcgggaggtagagacctacggtgnccgcccctttagaagagcagctacgcagggctgggattta

SEQ ID NO: 5929 - DNA, 480 bp, Mus musculus
  misc_feature (286)..(286): n is a, c, g, or t
  misc_feature (288)..(289): n is a, c, g, or t
  misc_feature (293)..(297): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (312)..(314): n is a, c, g, or t
  misc_feature (354)..(354): n is a, c, g, or t
  misc_feature (361)..(361): n is a, c, g, or t
  misc_feature (404)..(404): n is a, c, g, or t
gcatatttcaggatgggactcacacatctagacatagtcaggacgaatttcttacagtattcaataaccaagatcaagcagagacacatttacctggagcgccttggacggtaccagacccctgataagaaggggcagacacagatccctaatccctcactgaggaacattctcagagtttctgaagctgagtttttggccaggacagcctgttcctctgtcgaggagtttcaagtttttaaaaaactcttggatcaagaggaggaggaggagtctgagagccatncnnctgnnnnngaggangangangannnggaggaagaggaggagctactgtgacacagcactggggtntcagagntcattctcatattctcgaagtgctggggaccttcacctggatncttctcaagcacttttgatcccaacactggtattttgatgggggaaaaaaccaacctgtaatgatccactggagat

SEQ ID NO: 5930 - DNA, 399 bp, Mus musculus
ttgtacagatgtcggcacagacctcctggccatgtgccaacgaaacgttgccctcaacagccacctgactgccactggaggtggcgtggttaaggtcaaggagctggactggctgaaggacaacctctgcacagatcccaaagcccccttcagctggtcagaagaagaaatcgctgacctgtatgaccacaccactgtgctgcttgcagccgaagtgttctacgatgatgacttaaccaacgctctgtttaacacactttcccgactggtccacagactgaaaaatgcctgcaccgccatcttctcagtggaaaaaaggttcaacttcacactgagacacttggacgtcacgtgtgaagcctacgatcacttccgtgcctccctggactcattggagaa

SEQ ID NO: 5931 - DNA, 497 bp, Mus musculus
tggagctgacagaggcatgcccatttgtcatcaacatctacgctgaaagatgcaagccaagaatcaaagttgtccatatggaggcatgcagtgggcaacttgaaaaggccatttgcaaatctgtccttgatagaagcgatgctaaagtcatggatggctatgaaaatataatcgtacatacttgcaattatgacacatggataacatcaattattgaaaataagtcagataataaagtgattattcacatcaataacgaactgagtaaaaactgtgtcaacaacagaggactcaacatctttgcagtagaagtggcaccaagatctacaatggtgtgtcaacatgtaatgcccctgaatgaacaagaagaatggatatattgttgtgtgtattctcttgtagcttaaataattccatttggagctatcaaactaagaagtattttagatcgactattttatttattaactacatacttttccatgtaactggtgtac

SEQ ID NO: 5932 - DNA, 501 bp, Mus musculus
  misc_feature (82)..(82): n is a, c, g, or t
  misc_feature (310)..(311): n is a, c, g, or t
  misc_feature (355)..(355): n is a, c, g, or t
  misc_feature (375)..(375): n is a, c, g, or t
  misc_feature (412)..(412): n is a, c, g, or t
  misc_feature (426)..(426): n is a, c, g, or t
  misc_feature (473)..(473): n is a, c, g, or t
actacatggttctctcctgcagtccctggatggggactcatttcactaccataccttggaggaagcaaaagagtacatcagntgccacaggcctgcacccctgaccatggaggctgccctgcaggaggtgagggaggagctccaagtcccagcaagtgaggcttgcctgggtacctgtccacctcggaatcaatgacatccatatggaggcaggcaaggttggggttctccctgctcaataacaatcatatatggactctacgctcccatctgcccagctggctgctctgaggatacagcatgagaacannctgagaacccatcacaggacagtggtgtggtatggggccatganccagttggacagacaacatntgttaggcattccaatcatccaagatgggaccagctnccccatgggaacantccatgccaggtgctgaaacaggtatgagcctggtgcctgggcacancctgcatctatccagagcagcctgcaca

SEQ ID NO: 5933 - DNA, 460 bp, Mus musculus
  misc_feature (355)..(355): n is a, c, g, or t
gagtggacctccacggcgattttaacgcaagcttcctgctgtggcttcaagataatttattgagatctcctgtaaacgttccctgactgcttactaggagaacctctgactgcttgagagttctagctgactgttgtttttctttataaaaaaatttaacacgatttcttttctcaactttagagaagatgtttaaatagttctgttgaaacttttcatagttttgtgtaccattcaaccttttcttgcagcactgagacccatttgaaaggattggcacaaggctgttctgtttggcactgtgtgaacatgagtggtttgcagctgaatggtagtggtttcatttgcagcgtanctctgtggtgtcaccagtgttggctgcctccattttgaaggctatttgagcttcaaaagcctgctgtctaatttttagagaataagattgttccctgcatttcgg

SEQ ID NO: 5934 - DNA, 493 bp, Mus musculus
agggacacgctagccttccttatgatccacctacagagagtgtctcagagtccagacactaagatggatattgccaatctagctaaagtctttggccctacaatagttgcccatactgtgcccaatccagatccagtgacaatgttccaggacatcaaacgtcagctcaaggtggtggagcgcctactctctctccccttggagtactggaatcagttcatgatggtggaccaagagaacatagacagccagcgaggcaatggaaactcaacaccacgcacaccagacgttaaagtgagcttactggggcctgtgaccactcctgaattccagcttgtcaagactcctttatcaagttccctgtcacagaggttgtacaacctctccaagagcacacccagatttgggaacaagagcaagtctgccaccaacttaggtcaacagggcaaatttttccctgctccgtacctcaagtaaagctgtgtctgcctgt

SEQ ID NO: 5935 - DNA, 590 bp, Mus musculus
tctatgagaccatccagcgctggagcccagtcgcctccaccctccctgaactggtacagcgacttgtcaccatcaagcagctgcatgagcaagctatgcagtttggtcagctcctgacacacttggataccacccagcagatgatggccagttcccttaaggataatactgctctcctgacccaggtgcagacaacgatgcgtgaaaacttggccacagttgaggggaactttgccagcattgatgctcggatgaagaggctgggaaagtgagcatcactgggagctggggagcggggatgacccttgcccctgaactttgtcagacccttccacagggtcactcacagccccagcccacctgacaagggcaagggttcttgcatgtggggtacacaccctcccgacaaacagagtgggagctgggggctcttattggatgaggttgtgggcccagccacatgcagttcccgtccagtaagtgctttgcctgctgtgggagagggactggatcccgtcctctaacgtctgtctctggccgagtctaacactgtacaactgtctctgaccattaaatgctgttgtaccgtg

SEQ ID NO: 5936 - DNA, 332 bp, Mus musculus
gaagatgattcatcactgactccagatgcgtgcagaatccatggtcatctctatgtcaataaagtagcagggaattttcacataactgtgggcaaggcaatcccacatcctcgagggcatgcacatttggcagcacttgtcaaccatgattcttacaacttttctcacagaatagatcatttgtcttttggagagcttgttccgggaattattaatcctttggatggaactgaaaagattgctgtagatcacaaccagatgttccaatatttcattacagttgtgccaacaaagctacacacatacaagatctcagcagatacccatcagtt

SEQ ID NO: 5937 - DNA, 241 bp, Mus musculus
gttacatggagctctatgaccttaataaagatttgctgaatggatacaagattcgctgtaacaaccacacagaactgctaggaaacctgaaggcggtgaaccaagcaatccaaagagcaggccgtctgcgcgttggaaagccaaagaaccaggtgatcagtgcttgtcgggatgcgattcgaagcaacaacatcaacaccctcttcagaatcatgcgagtgggcactgctccttcatagga

SEQ ID NO: 5938 - DNA, 440 bp, Mus musculus
  misc_feature (258)..(258): n is a, c, g, or t
  misc_feature (294)..(294): n is a, c, g, or t
  misc_feature (302)..(302): n is a, c, g, or t
  misc_feature (348)..(348): n is a, c, g, or t
  misc_feature (396)..(396): n is a, c, g, or t
ggacatcttttgtaccttttgactgagggaccatggcaaaacccttgtggctctccttgatcctcttcatcattccagtggccctggcagttggtgtggatcagtccaagaatgaagtgaaggcacagaactactttggatccattaatatctctaatgccaatgtgaagcagtgtgtttggtttgccatgaaagaatacaacaaggaaagtgaggacaaatatgtcttccttgtggacaagatactccatgccaaanttcagatcacagaccgaatggaataccaaattgatnttcagatntcccgcagtaattgcaaaaaacctttaaacaatactgaaaactgcntccctcaaaaaaaacccgaactggaaaaaaaaatgagttgcagctttntggtaggagcacttccctggaatggcgagttcaacctgttgagc

SEQ ID NO: 5939 - DNA, 547 bp, Mus musculus
  misc_feature (55)..(55): n is a, c, g, or t
  misc_feature (123)..(123): n is a, c, g, or t
caatgtgaatgatcctgaggctgaaaaatttcatgatattgatgatgttaagaangttcaaaccaggttacctggaagccactctcaattggtttagactctataaggtaccagatggaaaanccagaaaacaagtttgcttttaatggagaattcaaaaacaaggctttcgccctcgacgttattaactctgcacatgaacgttggaaagagatggttatgaagaagtgtgacaagggagccatcagttgtgtaaatgtgcacatctgcgatagccctttccactgcactatggaggaagcaagatcattggttgaatcggttccaacaccttcgatgaataaggaaagcaatgtagaggaagaagtgtggcacttcctccgcaactgatggggacacagggcttctgcaccgagatgtcaacctctggggacacggggcttctgcactgacgtcagcctccagggactcccggggttccttctcctttagtgctcttgccgggcacctggatggccatctgatgacttcctgtcagacatcactg

SEQ ID NO: 5940 - DNA, 212 bp, Mus musculus
tccacggccggtcgtaagccgtcggcccttctgctgtactctgaaatgctttgtgaagttcctgcggttggtggtaactgtgacatctatgatctttttcatcgtgggacaagcccctgaaccatatatcgtcatcactgggtttgaagtcaccgttattttctgtttcctagtcttatacacgtgtggacttgacaagataatgagatctt

SEQ ID NO: 5941 - DNA, 476 bp, Mus musculus
  misc_feature (313)..(314): n is a, c, g, or t
  misc_feature (319)..(319): n is a, c, g, or t
  misc_feature (357)..(357): n is a, c, g, or t
  misc_feature (440)..(440): n is a, c, g, or t
cgcgagtcctggaaagagccattaatcgagaaggcttgaaagagaggcgtgactgttgggtctgtgggcaagatggagactccacggccggtcgtaagccgtcggcccttctgctgtactctgaaatgctttgtgaagttcctgcggttggtggtaactgtgacatctatgatctttttcatcgtgggacaagcccctgaaccatatatcgtcatcactgggtttgaagtcaccgttattttctgtttcctagtcttatacacgtgtggacttgacaagataatgagatctttcttttggcctttgcttgatnnttatnaactcaatggtaacagcattatgcatgctcattgtgtntgtgttggctctaataccagaaacctcaacaaagacaatccttggaggggtgtttggtttcctgacagtaacatgtactattnccgactgtgcccttatgtgccagaaacttcggtttc

SEQ ID NO: 5942 - DNA, 407 bp, Mus musculus
  misc_feature (254)..(254): n is a, c, g, or t
  misc_feature (283)..(283): n is a, c, g, or t
  misc_feature (289)..(289): n is a, c, g, or t
  misc_feature (356)..(356): n is a, c, g, or t
  misc_feature (374)..(374): n is a, c, g, or t
aagaatgtcttcagcaccttccgaacccctgcagttctgttcacaggcatagcagcattgtacatagcctcgggcttcacgggcttcattgggcttgaggttgtggcccagctgttcaactgtatggttggactgctcttaatagcactccttacctgggggtacatcagatattccgggcagtatcgtgagctgggtggagccattgactccggtgcagcatatgtgttagagcaggcttcttcgcatattgntaattctactcaggctgcagtaagggatnccgttnttgggagaccacctgctgataaaaaatctcaatagcatcttaatgggaagatccaacaagagcccantcagcttctggatttctnccaatgccatcacgggtccaattccagaggaat

SEQ ID NO: 5943 - DNA, 508 bp, Mus musculus
  misc_feature (72)..(72): n is a, c, g, or t
gaggtgcaaagtcagcaaccatcgtagcagatctttctgagacaacaattcagaccccagatggagaggagngactcgggggagaggcccactccatggtgtgggacccaagtggtgaacgtctggctgtgctcatgaaaggaaacccacaggttcaggacgggaatcctgtcatcctcctttttcgaactcgaaacagccccgtgtttgaactgcttccctgtggtattattcagggggaaccaggagcccaagctcagctcatcactttccatccttccttcaacaaaggggccttgcttagtgtgtgctggtccacaggccgaatcacccacatacctctgtactttgtcaatgctcagtttccacgctttagcccagtacttggtcgagcccaggagcctccagctggagggggaggctctattcatgaagtgccactatttactgagacatcaccaacctctgctccttgggaccctcttccaggacaatcatctgctcaacc

SEQ ID NO: 5944 - DNA, 498 bp, Mus musculus
  misc_feature (373)..(373): n is a, c, g, or t
  misc_feature (411)..(411): n is a, c, g, or t
ggttcaccttgggtttgcttctgaccttgtatgtgtcagaacccacgcacattagttatggtcacctttctacagaagctctcatgctccaggcgatggggtacagaagctacctggagccagttgagttgcatgtgtctaaactgacgggcagtggcttaggagaggagaggaaaggagaggacaaagcaaatgaatcttttggtgagattgttttttgtttatggtttgttttggtttttttgttttttgcccagtttgttttggtgggaaaaacaactgtgagctgcctagcatatgtaaatttgtagtctatatttatgagaccattgcttaaaaattataaattatgtaaatacattaataacttctngaattcctttcagtattcacttagtcctgtgcccagtntcctgtgtgcccacccagttttcagcctgtccacaggaacctctgaagcccatttatcttgtgcaggagcacggagcgcttagctca

SEQ ID NO: 5945 - DNA, 264 bp, Mus musculus
tctttgccctcaggcaccgaataaacctgagctcagatttcttgatcacccctgacttctactgggacagagcaaacctggaagagctttatgacaagacctgccagttccttagcatcacgcgaagagttaaggtcatgaatgaaaaactgcagcactgcatggaactaacagacctaatgcggaatcacctcaatgagaagcgagcactccgcttggagtggatgatcgtcatcctcatcaccattgaggtaatgtttgagc

SEQ ID NO: 5946 - DNA, 526 bp, Mus musculus
  misc_feature (376)..(376): n is a, c, g, or t
tcgggttgaattcactttccctgactttgtgacagagggagccagggacctcatttcaagactgttaaaacacaacgcaagccaaaggctaacactagcggaagtccttgagcacccttggatcaaagctaattcttccaaacctccaactggccacactagcaaagagccaaccagcaaatcatcttagggaatcctgaaccacggccaccgtgcaactgtgagaaacaccctattgaagccaccctcctggaccctcatggctgccctcagggtgccttgctgagcaactagtccttggccatgcatccaggaaaccccaagaaccatgctgcttttcctgatttagtaatctggagggaaggttccactgcangctgtcccctaccctcaccctgggcctgtgccccaaggtgtccttgtggggggggggggtctcactgtgggaaacttaccagagatcacctgtgtcgtagccttcaagtgccagagtgtgtgtataacttattgggtcaccaggcctagg

SEQ ID NO: 5947 - DNA, 296 bp, Mus musculus
gcaattctggccaaaaagcatcttgaaaccaagtttttgaagctgaatgtggaaaaggcaccattcctctgtgagagactgcggatcaaggtcatccccacgctagctctcttaagagatggcaagacgcaagattatgttgttggattcaccgacctaggaaatacagatgacttcactacagaaactttagaatggagacttggttgttctgatgttatcaattacagtggaaatttaatggagccaccatttcagagccaaaagaaatttgggacaaactttacaaagctgga

SEQ ID NO: 5948 - DNA, 313 bp, Mus musculus
aggcttggacttggccatggccgctcctgtttggaggtgtgcacgtgggtcccatgtccccagcaggcaggcaccttcagtccgtcttaacctcaccctccaaatgttcaacggcagaagggtttttatgattttaaattattactgctttgaaataaatggacgtttgagccacgtgcggccatgcatggtctgtggagagtcagcagaactgtcgccaggcccagcccgccacacgccctgggaggccgggcccagcacccaaccagcgccggcctcgggaccacaagggtgaccagcagacccaggaaca

SEQ ID NO: 5949 - DNA, 298 bp, Mus musculus
atttctacatcagcagagcacattcaggcagctagaattacccccccatgccgtcctccaagcacggagtcttctgtccttcccagctggactccacttcacagggttggactcctgatatctcagtggaactgaacagagcacagggccagacagccctatcagaattgcctacacgtctgcacctagaggcagagaccctggaagcaacagccaagattctgactcccaacagctgtccccagtgtctgtggttggaattggaaggacagagacagcaatatcttcagccatcagg

SEQ ID NO: 5950 - DNA, 328 bp, Mus musculus
gagattagcgtggacagtttggacttcaatagaagatcctccacacagcctggcaccccatggagagcattattgctgtagctgccaccaataacttgtatatattccaggacaaaattaattaagaaaactgactggaggaccaagtgttgtcttgcatatgtacgccggtcaattagttttcctgtcaaaaaaggcattgtcctctccattgagaatagtggcgcacttctacttccctaatagatacaggagaagaagggctctcagctggagtcggaagagatgagtgccgctgctgaagggaaaacctgctcgaagctgaatt

SEQ ID NO: 5951 - DNA, 199 bp, Mus musculus
  misc_feature (120)..(120): n is a, c, g, or t
aagcactcagggacagaccgaactgtgtgaggcctgcggcctgccaccgcagtcatccacgcactgtgagcgccacagggaacctcctcgcccacaccttcctcgcctacccatgccaanatgtctcctcctgtcgaaacctggctcctggctccatagtgacacaatgctacaatggtgtccccgctgaagatattac

SEQ ID NO: 5952 - DNA, 339 bp, Mus musculus
aaaggcaacgttggccagtctgcatacagtgccaccaaaggaggactcgttgggttttcacgctcgcttgctaaagaggttgcacggaagaaaatcagagtgaatgtggtggcaccaggatttattcgcacggatatgacaagacacttgaaagaagaacacttcaagaaaaacattcctcttgggaggtttggagaaactcttgaggtagcacatgccgttgtgtttcttttagagtcaccatacatcacaggccatgttcttatcgtggatggaggattgcagctcaccgtctaattagagatgatgttactgtgatggcgctttgggtcaagtaca

SEQ ID NO: 5953 - DNA, 558 bp, Mus musculus
  misc_feature (118)..(118): n is a, c, g, or t
  misc_feature (269)..(269): n is a, c, g, or t
  misc_feature (306)..(306): n is a, c, g, or t
  misc_feature (328)..(328): n is a, c, g, or t
  misc_feature (360)..(360): n is a, c, g, or t
  misc_feature (368)..(368): n is a, c, g, or t
  misc_feature (400)..(400): n is a, c, g, or t
  misc_feature (448)..(448): n is a, c, g, or t
  misc_feature (451)..(451): n is a, c, g, or t
  misc_feature (520)..(520): n is a, c, g, or t
  misc_feature (522)..(522): n is a, c, g, or t
  misc_feature (531)..(531): n is a, c, g, or t
ttgccacaaccatatccgaaatgtcatattcagaataactttggtgtgttttgattccaacaaaagagtaactttcagaaagacaacaggttataaaatcctcacctttgaatataangaggagcaaattgtaatgaaattggatagtgatgttctaaccttccctatgtgtatattctgcaatttcctttttgtaaacctaggaaatgcagaaaacaagtaatcttatcaattattagactgtaagcattttacaagtattgaatggntcatttaatatgaaggctgtgtaatgactacagtgangaagaccaaaaacaaattcaanattctttggagtctagtaccaccagaagtgantgcttccntccatcaccttatttccatgtatttctgaagnaaacctttacttccaacaaagtatttgtcaaatcaaataaacctaatnttntgatttaaatttaccatcgagatccaagcttggaatggaaataagagactatatttgcaaggtaaaacntntcaatcaanttgttaagtagatttggccctagctaa

SEQ ID NO: 5954 - DNA, 422 bp, Mus musculus
  misc_feature (329)..(330): n is a, c, g, or t
  misc_feature (333)..(333): n is a, c, g, or t
  misc_feature (336)..(338): n is a, c, g, or t
  misc_feature (344)..(344): n is a, c, g, or t
ggatcctctctggagccacagctaacaaggcttcccagaacaggaccagagcactgcagagccacagctcaccagaatgcaaggaggagcccgagcccctctcccctgagctagaatacattcccagaaagaggggcaagaaccccatgaaagccgtggggctagcctgggccatcggcttcccctgtggtatcctcttcttcgtcctcaccaagcaggaagtggacaaggaccgattgaagcagatgaaagctcgtcagaacatgcgggtgtccaacacgggcgagtatgagagccagaggttcagggcttcaccccaacaagcccannttnccnnntgaggnttgggtctggggcccagacctgagtgaggatcactgcaaccttgtgctagactattgactgccgtcttgtgtggccat

SEQ ID NO: 5955 - DNA, 328 bp, Mus musculus
gtcaagcacggcatggttttcagataagactacatgcatcactaggctttgagggggccactggcagtttatggatctaattgacccttggggaaagcagaaccctcgacctggccacctgagttcattttagtggtccccctcaaagcccatgtgtagacgtacagatgtgtgtctgctgactagaggcagaaccggataaagagagccaaatgagagcttagggattctagaagtcctgccaggtagtttgataagaatgcctacccagtgcccccaggcttacatacttgaattgctgagtcatcagggattacgggagaggctt

SEQ ID NO: 5956 - DNA, 368 bp, Mus musculus
  misc_feature (249)..(249): n is a, c, g, or t
  misc_feature (282)..(282): n is a, c, g, or t
  misc_feature (287)..(287): n is a, c, g, or t
  misc_feature (290)..(290): n is a, c, g, or t
  misc_feature (293)..(293): n is a, c, g, or t
  misc_feature (297)..(297): n is a, c, g, or t
  misc_feature (332)..(332): n is a, c, g, or t
  misc_feature (334)..(334): n is a, c, g, or t
  misc_feature (338)..(338): n is a, c, g, or t
  misc_feature (342)..(342): n is a, c, g, or t
gcaaccctgtatttacctaatcctaaggagccacagtttctgcagaacccaccgaaagtcacgtctccaacttatgtgatgatggatgacagcaagaagaccaatgccccaccttttatattagtaggctcaaatgttcaggaagcgcaggattggaaccctcttcctggacatgctgttgtgtcacaagcagaggccttgaagagatatgctgcagtgcaagtgcccattgctgttcctgcagatcanacattccagagacctgccccaaatccccagaangctantcntcntacnaagtggacaagatggccccagaccgaaaagcccantntttntttntgttgctttcccagtagaagatgtag

SEQ ID NO: 5957 - DNA, 480 bp, Mus musculus
ggtcttgctgttactattgacaccgattcttggcattcagaagcattctccgaaaaatgtggtttttacacagtttatagccaccctgctgacagaattgcatttaaaattcgaagatcttgaaaaattaaccatgatatttagaaccagctgctagctaacaagaatgatgtaactgaggaagacagaagaggaatgctcctcaccaggcctggtgttttcgccagtgagagtccatgggtgactgatgactaagtgtgtaacttcctcagacacagacaagccattaccccagcaagaaggaagctcttacatccagaacctcagaacacaggatttgaggggaaaatgaagtcttaaactgaaatttgaatggatattggggaaaatgtaattacctttattctttttgattggttaccaccaacacaaccaaaacttaagaaaatggtaattgtggcctattgtaaactctgtcat

SEQ ID NO: 5958 - DNA, 182 bp, Mus musculus
ttagaaattaatgacttcccacagactgcgaggtggaaagtcacctcaaaggaagccctgcagaggatcagcgagtactctgaggccgccatcaccatcaggggcacctacttccctcccggcaaggagcccaaggaaggagagcgcaagatctacctggccatcgaaagtgccaacgagct

SEQ ID NO: 5959 - DNA, 581 bp, Mus musculus
  misc_feature (27)..(27): n is a, c, g, or t
  misc_feature (53)..(53): n is a, c, g, or t
  misc_feature (71)..(71): n is a, c, g, or t
  misc_feature (98)..(98): n is a, c, g, or t
  misc_feature (270)..(270): n is a, c, g, or t
  misc_feature (298)..(298): n is a, c, g, or t
  misc_feature (304)..(304): n is a, c, g, or t
  misc_feature (307)..(307): n is a, c, g, or t
  misc_feature (316)..(316): n is a, c, g, or t
  misc_feature (328)..(328): n is a, c, g, or t
  misc_feature (349)..(350): n is a, c, g, or t
  misc_feature (364)..(364): n is a, c, g, or t
  misc_feature (379)..(379): n is a, c, g, or t
  misc_feature (385)..(385): n is a, c, g, or t
  misc_feature (389)..(389): n is a, c, g, or t
  misc_feature (392)..(392): n is a, c, g, or t
  misc_feature (460)..(460): n is a, c, g, or t
  misc_feature (525)..(525): n is a, c, g, or t
  misc_feature (535)..(535): n is a, c, g, or t
  misc_feature (540)..(540): n is a, c, g, or t
tatggaggctttggcccgcaggatccntgagcaaacctattgaagtgcaggtnggaggcaggagtgtggtntgctccgatgtggaacagcaggtgatngtgattgaagaagaaaagaaattcttgaaattgctggagcttttaggccattatcaggagtcaggatctgtcattatatttgtggataagcaggaacacgcagatggtcttctgaaggacttgatgagagcatcgtacccttgcatgtctcttcacggaggtattgatcaantatgacagggacagtatcataaatgacnttaagnatngaacctgcnagctcctcgttnccacatctgttgcagctcgtnntctcgatgtgaaanatctaattcttgtantgaatnacanctnccccaatcattatgaagattatgtgcacagagctgggcggactggaagagcgggcaacaagggttatncctacaccttcatcacagaggatcaagctcgatatgctggtgacatcattaaagctcttgaattntcagggaccncagtncctcctgacctagaaaaactctggagtgacttcaaagatca

SEQ ID NO: 5960 - DNA, 577 bp, Mus musculus
  misc_feature (379)..(379): n is a, c, g, or t
  misc_feature (543)..(543): n is a, c, g, or t
gtggtgatcgtcttcaatgctgatattccaagccacttaaaggaaattgaaatgtggtattcctgctttgtccagcaacagttcctccaagacagtcactgcatgcttgtggcccaccacaaaccgggctccggaggagaaaggggcagcctggctttgtctccccccttgaacaagctgaagctggtgcactcaaacctggaggaagaccctgaggaggtccgggtggagttcatcaagtatttaaaaagcatcatcaactccatgtcagagagcagagaccgcgaggagatgctcatcatcacctagtgtcccagtgccaccgcctcccaaaggacgctgactaaccccacccagccgctgacgcacccttctcctntagaaggctccaggaagatcaggcatggtgccacacacctgtgatcccagctctcaggaggctgaggtgggaggagggttgagagttcaaggccagccctggctgcataggagcgcttatctcctcccttctccagaagcaaaaagctgccctgcttgcctgtntcagttgtcatgcataaacatgtccttccttccg

SEQ ID NO: 5961 - DNA, 501 bp, Mus musculus
attctgctggacatcggtgctttgcccagtctgtggtgctcagaggcatagacagagctagccacaccagtaagctcaacccagggacacctctgccctctgctctccacgcatgcgcctctggagaagaagtcttggcccagtacttacagcagcagcatcctagagtcttgagttcgtcacatctgctgctgactccctgcaaagtggctcctccatacccacacttcttctcaagcttcagtcagaaagggctggccatggacagtacccccaagggcgcagcagtacagagcatccctgtgtttggggccttgcgttcaacttcatccttgcaccgtacgctgggagacttggctgaagagctcagcagacttgacctgcggcgctgggctagcttcatggacgctggcgtggagcaggatgacatggaagagatgctgcacgagttacacaggttggcccagtgttaccaggagggtgacagtctctcgaactgaa

SEQ ID NO: 5962 - DNA, 399 bp, Mus musculus
  misc_feature (112)..(112): n is a, c, g, or t
caatcccgcagtatgtatgtgacactgttacttaaatctcatagttagatcttagtctgtgtattgacgaagctgtgttccatttgccagtgggattttctgcagttgtttncaattcacataaagataataaagttcctctctgctctcctcagaggatggccctgtaaggtagcctgagacaaacctggggtttgaaaggtgacctgggagaacagctctgttcaatgtgcagcagtttacaaagacagctcatcagctgatgatgcaccatcttatactctgaataattatttattacatcttgcttggttcctactttttgttggggctcaacattggctcaagaatgctgttaatatttattctgtattgataaaagtctgtcttggcactaca

SEQ ID NO: 5963 - DNA, 530 bp, Mus musculus
gcagagcgcctgaatgactatgtgaatgcggaccatggcctgtacttcaaccaccgtaggtcactggaacccccatctgagaagccctgggagcggcgccaagcagagatgaagcgcttatatggcaacagtgctcccaagatcctggccatggagactgctgtacagctgagctttgacaagcactgtgacagaaagcaaccaaagtactggcctgtcattcccctgaagttctgagtcctgggcaccgggaccctagggaatgcatcacagttcctagcctctccctcttcatctcttctggacatttttcagagaaagaggcctgtataccaacatggtggatacagtctgtcaacaggagagaggtatactgttgccaacacaaggaatgttcactgacaaagtgataatttatgtattgtactggctcttggttttctctttaacagtccagttcattgaaattattgcctagcaatactgcctattgttttgcatttttaatgtccttctttaaaccatccaga

SEQ ID NO: 5964 - DNA, 248 bp, Mus musculus
  misc_feature (78)..(78): n is a, c, g, or t
  misc_feature (88)..(88): n is a, c, g, or t
  misc_feature (146)..(146): n is a, c, g, or t
  misc_feature (198)..(198): n is a, c, g, or t
tctgtcggcgggagatcaccagggtgatacccttgtataacagctaggggtctgtggtcacactgcaagtgacctttntcagggtctntctgaggcctttggtggggtggctgtaccttcacatatgatggaggggcactggcgancctcacagctccaacagctggatgtggcttttgaacctggacctggtgtggnccgtggtgagggccccttcttgggagctagatccatgtgtatgactgaat

SEQ ID NO: 5965 - DNA, 509 bp, Mus musculus
  misc_feature (353)..(353): n is a, c, g, or t
  misc_feature (415)..(415): n is a, c, g, or t
  misc_feature (419)..(419): n is a, c, g, or t
  misc_feature (452)..(452): n is a, c, g, or t
aagctttaccgtgatgcctgacatgcctgctgtccaaatgaaccatgtctcccctctgccttagctccagttaatggacagagggacgagggtgagagagcagatctttgtctttttgagcggctagcttttgccaacgtaagaaatagctttccctacaagactgctgttgctcagtatgtttttcccattccaattcttcaacttaagaacagcctactgagtgtaagttattgtaatattccctgagggcatgcctctcctgcttttttgtttgtttatttgtttgtttctttcttttggtttgggttttgtatgtgtgtatgtgtttagttcattttgctatctgacancagtagctgctaagtatgcgtagaaattatcaagatatggctagtgagatgactggttattncagntccagttcctaaaggtaggagaaaactagctancctcagggagttgtccttagacctcagtagtggggcaatggtgcatagtcacacaca

SEQ ID NO: 5966 - DNA, 106 bp, Mus musculus
agaacctaaaatggctccacaggagttgccgctacaggagaaggaaaggcttgcctcttcactaccccagaccttgaaagaggagagcacctctgctgaaaacatg

SEQ ID NO: 5967 - DNA, 459 bp, Mus musculus
  misc_feature (86)..(86): n is a, c, g, or t
gaaaacatgtctttagaaaccctgagaaacagcagcccagaagatctctttgattagatataaaccctagaaaacagcactggtgnttcaatgaactatattctttatccagttcctttggatgagaagacaggctttcaacttagcagccatggttactatgtcttgcaactttactatatgtacccaatgaatcatactagtatgtgacagtcagatggaatgtcagagggacacttttctccctttcttaattaaatctgagttttgttgcaaaaggcacatatatcatatttgtttatacatttttgtaactttctaattgactcttggaagattttggaaatagaacaaaatatctttaacacttttttagttgcactttaaattatctttgttgaagcatttaatttatgatgtgacacatataaaatacatctttatcttgtgtgtaaacag

SEQ ID NO: 5968 - DNA, 532 bp, Mus musculus
  misc_feature (100)..(100): n is a, c, g, or t
  misc_feature (120)..(120): n is a, c, g, or t
  misc_feature (432)..(432): n is a, c, g, or t
agcctgttctactccaagagggtctgccttccctgtgtccaggagaacatgagtgctttccctcaggaaatccagcaggatgtagagaagagaaagagcngccagcaagaagcactccanccgtccctgactggcaggggcacagccctcctgcgaagcattgggctgggctcagccaggattcaggctgggagctgtggacccggtcttctttgaactgggtggatacctccagcctcggaagctgaggaactggccagggctgaggacagacatcaggggtgtatccagctggagctctaggtctggcctctggaggccaggagagatggagagggacctcctttgattgacagctggtagacactccctgtagatgcacacgtgggaagacacctagcttctctccagacttccaaacaacacaatgtnatctgtctagggaattcagcctccgagggccagagggtaagcaagggtgacgtcacatccctgtaactccttggagatgatttaaaccttgactctgtat

SEQ ID NO: 5969 - DNA, 475 bp, Mus musculus
ggatgaactttctgacagtcttggacaaaggccgcctgatccagatgagaacaaaccactggatgacaaagtgaaggagaaaatcaaaccagagcatagcgagaaactgggagaaagagacgacaccatcccccctgaatacaggcatctcttggataatgatgggaaggacaaaccagagaagccaccgactaagaaaacagagaaacctgatcaggaccgggaccccattgatgccctctcagaagatttggatagctgcccctcaactacagagacctcaaagaatacagcaaaggggaagagcaagaagacttcaagttccaaagcatccaaggacggagagaaaacaaaggactcttccaagaagacagaggaagtgtccaagccaaaggctaaagaagatgcaagacacagttaatgaatttgggtatctgaatagaaattcttcagctggtggatggtgacttttgaa

SEQ ID NO: 5970 - DNA, 182 bp, Mus musculus
  misc_feature (120)..(120): n is a, c, g, or t
ggattttgaggctccttagatctcctgaggctccactgaaataacagtcaaggagcttggttttatgtgcattcatattcatgtcacttgcatatgtggacagaagtttcaacttctaancaaagtgaacatgaaatatttagtgtgctttccaacatggagattacttttctattttctaa

SEQ ID NO: 5971 - DNA, 495 bp, Mus musculus
gtaaccccgactcaggaaagcagctggtgcactacacggctcagcctctgttcctgctggatcctgatgctgtggacacagggagcagtgagctgcctgtgctctttgagctgggggagagctcctacttctctgagggggatgactacacggatgatcccaccatctctcttctgacaggcactgaaccccataaagccaaggaccccactgtctcctagagctctcaggagttgtcaggctggcttgtgcctggcccccaacctatccctaggacatggctggtcctagggagacaaaacagttgggtagtccaggggaccctaggtcaagtcaccacaaccccagtggagcacagatggaacttggtcctgggcagtaccttggatcaggaggaagatcctgagggctgcatacctgctgcctttaccccagccccaggtctactctctggtcacagcttcacagccacacttggactgaccctgcaggttg

SEQ ID NO: 5972 - DNA, 426 bp, Mus musculus
  misc_feature (366)..(366): n is a, c, g, or t
acagccatgttgtggaagtcggtcctgtccgtggcactcattgtgctgggaattcatgattgcagcttcaagtttctagagatcgacaagaatgaagaggagtttgccatttctgtggagcatgtcgtgttccacttcaacgaaaaccaggatgacgattttgcctacaagttcctgagagtccggagaagtcttcgtcagaaatatacgctgaaatatttagtagacctggagatgggccgtacgctttgcgggaaatatgatgaagacattgacaattgtccattgcaggaaggtccaggagagagaaaggtacgctgcacttacattgtggagactgaagcatgggttactaagttcaccatnttgaacagcacctgtgtgcagacttaagtggggcagaggtcattctgtgcctatagctaa

SEQ ID NO: 5973 - DNA, 172 bp, Mus musculus
ctgataacctgattagtgcactaaacaagtctggattaagtgaccttgcagaaagtctaactaatgacactgaaacaaacagttagctttcttcctttcttttcttttttattaaacagtgataagattttgttaccaagcagcatttgataaaaggttcactggttttggt

SEQ ID NO: 5974 - DNA, 396 bp, Mus musculus
ggagaagccctcacttctttcagccaaccaaccagcagtttaagagtctaccagagtatctggaaaacatggtgataaagctggccaaggaactaccacccccttctgaagaaataaagacaggtgaggatgaagacgaggaagataatgatgctttactaaaggaaaatgaaagtccagatgttcggcgagataaacctataacaggggagcagatagagtcatttgccaacaaacttggtgagcagtggaagattttggctccttacctggaaattaaagactctgatattaggcagattgagtgtgacagtgaagacatgaagatgagagccaagcagctccttgttgcctggcaagatcaagaaggagttcatgcaacaactgataacctga

SEQ ID NO: 5975 - DNA, 379 bp, Mus musculus
agacagtgccagttcttgacacaaatgacagtgtggaactcttcatttttgactcagccggcaaggagctgttctctgaaatgctggataagttgtgggagaatcccaacgtcctgtgccttgtctatgatgtgaccaatgaacagtccttcatcagctgcaccaagtggttggagaaggtccggtctcagacttcaggcatctccctcccaggtgttttagtgggaactaagacagacctggctggccgacaaacagtggattcagctcaggcccaggtatgggcactgagtcaaggcctggaattctttgagacatctgtgaaggagatggataattacgaggccccgttccactgtctggccaagcagttctacca

SEQ ID NO: 5976 - DNA, 505 bp, Mus musculus
  misc_feature (231)..(231): n is a, c, g, or t
  misc_feature (234)..(234): n is a, c, g, or t
  misc_feature (237)..(237): n is a, c, g, or t
  misc_feature (285)..(285): n is a, c, g, or t
  misc_feature (313)..(313): n is a, c, g, or t
  misc_feature (322)..(322): n is a, c, g, or t
  misc_feature (328)..(328): n is a, c, g, or t
  misc_feature (332)..(332): n is a, c, g, or t
  misc_feature (357)..(357): n is a, c, g, or t
  misc_feature (361)..(361): n is a, c, g, or t
  misc_feature (364)..(364): n is a, c, g, or t
  misc_feature (373)..(373): n is a, c, g, or t
  misc_feature (378)..(378): n is a, c, g, or t
atgtgaaccccaacttctcggtctactataccacctcccagaaccctgtggtcattaacaaggtctttaaggactggagacctggaggaaccatcaggtgcagtaactgtggggaggtctggggcttccagatgatctacaaatcagtgaccttgccagtgctcaaaatcggaagcatgctactggaaacacctcgagggaagatccaggccaaaaagtggtcccgggtgnccnttnctccataccagtcttcgatatcctgcaggactgcacacaaagcctgtntgagctctccctggactgacccccttgngactgcagnacctangtcnaactgcagggggcaggagagtccancaanccntcctccttnccccnggctagcactctggtcagggtacccctttattctgctgcagagatcttaaacacattggatggagttggaagatgaacgcaggagaattattatgccatgatgttctaagaactacaacatccctcc

SEQ ID NO: 5977 - DNA, 563 bp, Mus musculus
  misc_feature (54)..(54): n is a, c, g, or t
  misc_feature (86)..(86): n is a, c, g, or t
  misc_feature (100)..(100): n is a, c, g, or t
  misc_feature (137)..(137): n is a, c, g, or t
  misc_feature (150)..(150): n is a, c, g, or t
  misc_feature (165)..(165): n is a, c, g, or t
  misc_feature (204)..(204): n is a, c, g, or t
  misc_feature (221)..(221): n is a, c, g, or t
  misc_feature (227)..(227): n is a, c, g, or t
  misc_feature (232)..(232): n is a, c, g, or t
  misc_feature (273)..(273): n is a, c, g, or t
  misc_feature (287)..(292): n is a, c, g, or t
  misc_feature (294)..(294): n is a, c, g, or t
  misc_feature (319)..(319): n is a, c, g, or t
  misc_feature (323)..(323): n is a, c, g, or t
  misc_feature (335)..(335): n is a, c, g, or t
  misc_feature (339)..(339): n is a, c, g, or t
  misc_feature (351)..(351): n is a, c, g, or t
  misc_feature (355)..(355): n is a, c, g, or t
  misc_feature (358)..(358): n is a, c, g, or t
  misc_feature (360)..(360): n is a, c, g, or t
  misc_feature (374)..(374): n is a, c, g, or t
  misc_feature (377)..(377): n is a, c, g, or t
  misc_feature (419)..(419): n is a, c, g, or t
gggtctccggcctagactggcctcagactctgtttccagccaaggatgactttnaactccggatcctcctgcctctacctcttgantgctgggattgccngcgtgcaccatcatatgcaatttttgtctgtgctggnatggcagcaagcnttctgccagctgagntaccccacccccctagcctgttgggggtttttgagacanggcctcacatgggctanactggncctgnaactccccatcctcctgcctcagcctcccagtcgctgaggntgacagtgtactgnnnnnngnttttaggaggagccatctgaccctngacntcatgagcatcntatntcctgcccgganctgnttntnctgggcctgggctncgnccattcctcagctcactgagtgtcatatgtggagggattgantcttttagaacttcagtacttgggacgagtaaggtggctcagtagctaaaggtgctgccaccaagcctgatgttcagtctctgcaatccacgtggtaaaaggagtgtcccctgatctccacacgcacatcacccattttgataa

SEQ ID NO: 5978 - DNA, 544 bp, Mus musculus
  misc_feature (316)..(316): n is a, c, g, or t
  misc_feature (320)..(320): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (367)..(367): n is a, c, g, or t
  misc_feature (369)..(369): n is a, c, g, or t
  misc_feature (380)..(380): n is a, c, g, or t
  misc_feature (400)..(400): n is a, c, g, or t
  misc_feature (402)..(402): n is a, c, g, or t
  misc_feature (465)..(465): n is a, c, g, or t
  misc_feature (481)..(481): n is a, c, g, or t
  misc_feature (483)..(483): n is a, c, g, or t
  misc_feature (506)..(506): n is a, c, g, or t
actggcctcagactctgtttccagccaaggatgactttgaactccggatcctcctgcctctacctcttgaatgctgggattgccagcgtgcaccatcatatgcaatttttgtctgtgctgggatggcagcaagcgttctgccagctgagctaccccacccccctagcctgttgggggtttttgagacaaggcctcacatgggctagactggcctggaactccccatcctcctgcctcagcctcccagtcgctgaggtgacagtgtactggtgaggttttaggaggagccatctgacccttgacgtcatgagcatcntatntcctgcccggagctgnttntnctgggcctggnctncgnccattcctnanctcactgagtntcatatgtggagggattgantnttttagaacttcagtacttgggacgagtaaggtggctcagtagctaaaggtgctgccaccaancctgatgttcagtctntncaatccacgtggtaaaaggagtntcccctgatctccacacgcacatcacccattttgataa

SEQ ID NO: 5979 - DNA, 150 bp, Mus musculus
atgagatgcgccgggctgcggaggagcgcaggagggaaaaggctgaagagttagctgccagacaaagggttcgagaaaaaattgaaagggacaaagcagagagagccaagaagtatggtggtagtgtgggttctcggtcatccccaccag

SEQ ID NO: 5980 - DNA, 344 bp, Mus musculus
aaatggctatgagccttatcatataagttccattttccttaacttaagcatagttttaggaagacatatgattggcttctgtcttgcacacaatcttttttacttcattatctgaatctgctttgtcattcaaaccagaaaccgtacttgagttgtaaactagacagtgagaaaacacttggcttctgctgtatgttgttgtcatcgttacccagtaacttgaatattgtttaatgtgctgtaagacattatagagattatctccagctgtttaaaatggtaatgtacaaatgtgaatagacacttatctataacatgggtaagttttgttttgcctataatag

SEQ ID NO: 5981 - DNA, 480 bp, Mus musculus
  misc_feature (239)..(239): n is a, c, g, or t
  misc_feature (275)..(275): n is a, c, g, or t
  misc_feature (419)..(419): n is a, c, g, or t
  misc_feature (449)..(449): n is a, c, g, or t
gggcatgtttagttccgagtacgtgcgtggacatctgtcaaattgttatgttcctgtgaaacaagtgaacactctgatacacttcatctgcttgtacatctgtatgatagagaaatgtaaatatgttaatccaagcaatgtgtcacttggctgagaaatgaggcatttaaatctgtgtgtggagatgggccaaatgagtaactagtgtgtcaccagaagacttggttttcaccatggtntcttatgcctgaagttatgtgaacattctagttgtntaggcttccaagtggcaagtattaaaactttagcccatgagaggatgttaagacctgttctgaaaatattttgacttcttggattcaaaaagcacttagctctctttctctctcagtgctttaaaatgtcattgtgaacaactntcctttgatgtatgacactgtagatacatnggggctgtctgtagcactgtctggatgtttc

SEQ ID NO: 5982 - DNA, 308 bp, Mus musculus
aagaagtgctgctatgctgcgctgctgcccgaggaggagatgagcctgggcctagacgagctgcatgtggactacgagctcccagatgggaagatcatcaccatcggccaggagcgcttccgctgctctgagatgctcttcaagccctccctggtgggttgcacccaacctggcctccccgagctcacggcgacctgcctggcccgctgccagggcactggcttcaaggaggagatggctgctaacgtgctgctgtgcggtggctgcaccatgctggatggtttccccgagcgtttccagagggagtt

SEQ ID NO: 5983 - DNA, 448 bp, Mus musculus
actgccagtatacacgagtgaagctgaaaaaatgagtaattcccaaggggatggtgaacactttgtacagccaccctcagaagttaaagtgcattttgctaatcagtcagtacaacccttggcaagaaagatggagttgttgcctgaaacttcctccctcacacaaaaaggtttgaagatacctggcttagagcatgcaagcatggaaggaccaatagcaaatttgtcagcacttggaacagaagagttacgtcaacgagagcattatctcaagcagaagagagataagctgctgtccatgagaaaggatacgaggacaaagcagatccagaatactgagcaaaaaggaaagcctaccagggaggcagaggaaatgacagagaagccagaaatgacagcagaggagaaacaaacattactaaagaggcgattgcttgcagagaaactt

SEQ ID NO: 5984 - DNA, 337 bp, Mus musculus
  misc_feature (72)..(72): n is a, c, g, or t
gattcctctctggattatttgtccgagtctaccacggagatcacctgtaaatggccacagtatagtcaccangctgcgttgccccagacactgctggcttttgccacatctggcatactagcaccacccttgcacacatgtgggccacaagaccgagagacccctgcccaaggagccacatgaaacactagaccacctgagcaccgtacaagagcctcaccgaataactgcccgtcatcaaaacaagtcaaacatctgccgcagtgccacatgaaacacccaccaggcaggcctccacacgtcagacctgcccgtggactcccaagtgagacacctt

SEQ ID NO: 5985 - DNA, 549 bp, Mus musculus
  misc_feature (206)..(206): n is a, c, g, or t
  misc_feature (208)..(214): n is a, c, g, or t
  misc_feature (218)..(220): n is a, c, g, or t
  misc_feature (222)..(226): n is a, c, g, or t
  misc_feature (228)..(229): n is a, c, g, or t
  misc_feature (231)..(232): n is a, c, g, or t
  misc_feature (234)..(237): n is a, c, g, or t
  misc_feature (239)..(245): n is a, c, g, or t
  misc_feature (247)..(255): n is a, c, g, or t
  misc_feature (257)..(257): n is a, c, g, or t
  misc_feature (396)..(396): n is a, c, g, or t
  misc_feature (431)..(431): n is a, c, g, or t
  misc_feature (467)..(467): n is a, c, g, or t
  misc_feature (473)..(473): n is a, c, g, or t
tgatgaggacccagctgagcctgaagacttggagcactttgaggaaacagtggccaaggtgctgaccaagttgcaggcagtgaaggccctgtaccaagtgagccaggaagagcactgccagctgcagcaacggatgcacaggctgctggccaagcagaaggagctcacagaggagctgcagtgctgcgagaaggagctgagggagngnnnnnnnagcnnngnnnnngnncnngnnnncnnnnnnntnnnnnnnnncnagaacatgtttgggatgtggaagcctatggttttcttggctattgcagcagtagctctgtatgtgttacccaatatgcgaccgcaggaatcagaatactacatgaagtgatggcagacctggaccagcccagagggcanatccccagaggctaccaccctcacctttgggcagnatacactgtgccagagccccaacccacctatgtttntccatntcctttgcctcagccactcagactggaaaggcttatgggagttgctggctctcaacctcctgccttgtgtaagaac

SEQ ID NO: 5986 - DNA, 487 bp, Mus musculus
gagagacctttcagatgtacagaatgtgacaaatcttttattaggtcttctcaccttagagaacatcagaaaattcatagtggagagaaaccttacaaatgcagagactgtgacatatcatttagccagatttcaaatctcagaagacatcagaaacttcatactggtgagaaaccttacaaatgtatggaatgtgacaagtcctttactcataactcaaattttagaacacatcagagagttcatactggagagaaaccttatagatgtgccgaatgtgacaaatcttttactaggtgctcctaccttagagcccatcagaaaattcatactggagagaaaccttacaaatgtatggaatatgacaaacccaatacccaggactcaaatcttaaaagacatcaaagagttcatactggagtgaaacatacctttttaaataatgtaacatagtatttatccagtattctatctgcttataagtcat

SEQ ID NO: 5987 - DNA, 486 bp, Mus musculus
gtatatccaatacttccaagcttctaggtgaactggagagtgaccctaaaccattagagatcatagaacaaaaaccaaaaagaagcaggactgtgaagacaagagcaagcagaaacacaggaaaaggaagttcttggtcacctcctcctgtagaaattaagctggtttctcccttggcgagtccagtggatgaaataaagaccggcaagccaagaaaaactgcagaaatagcaggaaaaactcttggaaggggcagaaagaagccatcttcttttccaaagcaaattttacgcaggaaaatgctgtaatttttagcccaagattttaacacgcacctgtttgtaaaagtcaacagtatttgtgtggattattaaagtcaccaatttggatggaaatactttatataaattgtacaattttgtaagcagtaaatgagtaactccacatggagtgcagttcttgtagtgcaggcgttttatacgactt

SEQ ID NO: 5988 - DNA, 538 bp, Mus musculus
  misc_feature (195)..(195): n is a, c, g, or t
  misc_feature (318)..(318): n is a, c, g, or t
  misc_feature (378)..(378): n is a, c, g, or t
  misc_feature (423)..(423): n is a, c, g, or t
gatgacgaggacgactttcacccaagcactcggtctacgccctctagcagtacacctagctcccgccccgcctccctgggatacagtggagctgcagggccccgccccatcacccagagtgagctggccactgccctggccctggccagtactccagagagcagttctcatacaccaactcctggcacccagggnccattcttcaggcacctcgccaatgtcctctggtgtccagtcagggacacccatcaccaacgatctttttagccaagctctccagcatgccctgcaggcctctgggcagcccagccttcaganccagtggcagcctcagctgcagcagttgcgtgacatgggcatccaggatgacgaactaancctccgggccctacaggccactggaggtgatatccaagcagcccntggaactcatctttgctggaggagccccatgaacttcttgtacctgaacacctagcaaattgcagaggctgttcctggcaagaagcacttgtgaagttgcttctagattccccac

SEQ ID NO: 5989 - DNA, 156 bp, Mus musculus
ggtttattggaagacgcggatgcattgtggactcacagtcacagccaggcacagaaaacagaagagacaagctctggtccggaggggactatccagacccagaatccacattacagccgtgaagaattgaattcgatgactcttgctgaagtagta

SEQ ID NO: 5990 - DNA, 450 bp, Mus musculus
  misc_feature (385)..(385): n is a, c, g, or t
  misc_feature (413)..(413): n is a, c, g, or t
  misc_feature (415)..(415): n is a, c, g, or t
agtggttagaaagcgactcctgtcagaagtgtgagcagcccttcttctggaatataaaacagatgtgggacacaaagaccctgggcttgaggcagcatcactgcaggaagtgtgggcaggccgtctgtgggaagtgcagcagcaagcggtccagttaccccgtcatgggttttgagttccaggttcgagtttgtgattcctgttacgactccatcaaagatgaggaccggacttctctagcaacatttcatgaaggaaaacataacatttcccatatgtccatggacattgcaaggggactgatggtgacctgtgggacagatcgtgttgtgaagatatgggatatgactcctgtggtgggctgcagcctggcaactggattttntccacactgatcccagagctgggtgatntntgctacacgtgatgcatagcatcctccatgaatgg

SEQ ID NO: 5991 - DNA, 515 bp, Mus musculus
  misc_feature (436)..(436): n is a, c, g, or t
  misc_feature (472)..(472): n is a, c, g, or t
gggcgacccttcacacgagtatgaacacacagagttgcagaaggttaacgaaggagagaaggtctttgatgaagaagtggtggtccagatcaaggaagagactcgcttggtgtccatcattgaccagattgacaaggctgtagctatcatccctcgaggtgccctcttcaagaccccttttggagtcacccatgtcaatcggacctttgaaggcctgcccctgtccgaggtcaggaagcttagctcgtacttccacttcagggaggctattgatctgaagaacaagaccttgctggagaagtcggacttggagccctcgctggatttcctggactccctggaatatgacatccccagagggtcttggagcatccagatggaaaggggcaacgcactggtggtgctgcgcagcctgctctggccaggcctcaccttntaccacgctcctcgcaccaagaactatggctacatntacgtaggcacaggagagaagaacatggacttgcccttcatgc

SEQ ID NO: 5992 - DNA, 425 bp, Mus musculus
aggagccaaggacaggtctacgaccggtgaggcactcaaagtcaggaaagtcactgacccagtccctgtggctcaacaacaatgtcctcaatgatctgaaagacttcaaccaggtggtttcacagcttctacagcatccagagaatctggcctggattgacctctccttcaatgacctgactaccattgaccctgtcctaacaacattcttcaacctaagtgtcctctaccttcacggcaacggcatccatcgcctaggggaggtgaataagctagctgtcctccctcgtctccggagcctgaccctccatgggaaccccatagaggaagaaaaggggtacaggcagtatgtgctgtgcaacctgccccgtatcaccacgtttgacttcagtggagtcaccagggccgatcgcagcacagctgaa

SEQ ID NO: 5993 - DNA, 338 bp, Mus musculus
gaaacttttcaattatatcgaaggtatgaatcctttactcttggcctatttcctagaatgttaacagtgaatacttacaggatacaaacttaactcatgcattgtatgaagaaatatctttgacttcatttcaggtcaaagagaatatctaataactttttaggcaaagtatttctgttggggaaagtgtggcctgtgttttattcacgttctattcttgacaacaattgaggctccacactagagaattagtatgattatgaaaatcatgtgaaaactttcatgcaatgttcaaatcttaaataatgtcaactattttttgcttgaagaaactctga

SEQ ID NO: 5994 - DNA, 88 bp, Mus musculus
gaatgagttcttctctggtaaaattccaggtggaagaaggggaaatgcaaacttggtgttctgagactcccttagagaccctgggaga

SEQ ID NO: 5995 - DNA, 537 bp, Mus musculus
  misc_feature (326)..(326): n is a, c, g, or t
  misc_feature (351)..(351): n is a, c, g, or t
  misc_feature (354)..(354): n is a, c, g, or t
  misc_feature (373)..(373): n is a, c, g, or t
  misc_feature (377)..(377): n is a, c, g, or t
  misc_feature (451)..(451): n is a, c, g, or t
  misc_feature (456)..(456): n is a, c, g, or t
  misc_feature (464)..(464): n is a, c, g, or t
  misc_feature (483)..(483): n is a, c, g, or t
atgagattgagcgggagcctctgctcttccacgtcttcagcaatgccggcgtcatgctctaccgctacgtgctggagctcctacagacccaccagcgcttccgccatttgcatgtggtgggcaccatctttgacagtggtcctggcgatagcaacctgataggggccctgagggctctggcaaccatcctggagcgccgacctgcggtgctgcgcctgttgctcctggcagcatttgccctggtggtgatcctgtttcacttcctgcttgctccattcactgccctcttccacacccacttctacgacaggctgcaggactcaggnctcctgctggcctgaactctacctntantctagagctgataaggtgntctncggccagggatgtggaacgtatggtagaggcacgcctggctcaccaggtcatggtgcgtggagtggactttgtntcatntgcgcatntcagccacctccgagactntcctacttactatacaagtctgtgtgttgacttcatgcataattgtgtccaatg

SEQ ID NO: 5996 - DNA, 470 bp, Mus musculus
  misc_feature (268)..(268): n is a, c, g, or t
  misc_feature (272)..(272): n is a, c, g, or t
  misc_feature (298)..(298): n is a, c, g, or t
  misc_feature (304)..(304): n is a, c, g, or t
  misc_feature (309)..(309): n is a, c, g, or t
  misc_feature (311)..(311): n is a, c, g, or t
  misc_feature (333)..(333): n is a, c, g, or t
  misc_feature (336)..(336): n is a, c, g, or t
  misc_feature (341)..(341): n is a, c, g, or t
  misc_feature (355)..(355): n is a, c, g, or t
  misc_feature (379)..(379): n is a, c, g, or t
  misc_feature (381)..(381): n is a, c, g, or t
  misc_feature (388)..(388): n is a, c, g, or t
  misc_feature (406)..(406): n is a, c, g, or t
  misc_feature (408)..(408): n is a, c, g, or t
  misc_feature (434)..(434): n is a, c, g, or t
  misc_feature (436)..(436): n is a, c, g, or t
  misc_feature (443)..(443): n is a, c, g, or t
acctgcccaagggattcttgagctgttgtagggaggtagtttaggatgactttttctcaccctaaagattccaaatagttgcacccagttggttttgatcaaacttaagctccatctggtggagatttggcactgtgatggactcgttatattggtaataaaagaacagtaactctgaaagtaaagaaggcaaaatccaagggaaaagaccaggcctacaggaagaaagcaaggactggcctctgcctctgttctgaatcaggagctntgcncagtggttccagttctcagagttgtntgaagntcctntntcccacctgcacaaccagaganttngtatntgggtgatcctagncatacagctggacaagtatctgtntnttatgcntccattaaagagcagagntntgttaagaagcaatcaggaagacacntntgctgtntgctggcttggcatgagcccggatgca

SEQ ID NO: 5997 - DNA, 322 bp, Mus musculus
  misc_feature (271)..(271): n is a, c, g, or t
ggacacagcactccggtactgggaacgcaaccgtgcagtccggcagaatatctttccgagtgagcagacggctttgccagctgtatctgtgtcagaacgggtgctcgggagtgttgggagatggttggacagtctgcccagagccctttatcccagggtccaagacactgtggccggctcctcattctggacctgcccccgcgtgtcagctcaggaacctcagctctacctttctgaggactcctccgtgagcagccacctacccttcatntccagggccaccatcccaaggccacggggaggcctcagaaccttcctggac

SEQ ID NO: 5998 - DNA, 379 bp, Mus musculus
actagatttcacatggattcttccaagtgtgattcaactagagattgcaacgaccatggggtttgcaacaatttacagcattgccactgtgatataggatataaccctcctttttgtgaggaacataagggacagtttggaagcgttgatgatggacataaatatcatgttgaagatggtaaaagctataagcagcaaagtcatagtaatcttaaaaaaaatcagcttcagctcattctctacatatctctgcccttacttgtgatgatttcagctgtagttataaagcaaagcaaactgagtcgtgtatgtgacagagaaagaagtgaaagcgacagctctacaacagaagatagcgggagtaacaccaatgtgacca

SEQ ID NO: 5999 - DNA, 327 bp, Mus musculus
gtggcaaatcaatctcctacagctgttcctctgtgcctcatcagggcagagggtttagtcagtatggtgtgagtggctcaccaacaaaatccaaagtcacaagctgccctggctgtcggaaaccccttcctcgatgtgcactttgcctcattaatatgggaacacctgtttctagctgtcctggtggatccaaatcagatgaaaaggtggacttgagcaaggacaaaaagttagctcagtttaacaactggtttacctggtgtcacaactgtcggcatggtgggcatgccggacatatgctgagttggttcagggaccatgcagagt

SEQ ID NO: 6000 - DNA, 237 bp, Mus musculus
acatggaagtcctccgtctcctcggcatggccatgtgatggtggcagcgggcacaaaactcttcatccacggaggattggcaggggacaagttctttgatgatctccattgcattgatataggtgacatgagctggcagaagcttggtcccaccggggctgttccagtcggctgtgctgcccatgccgccgttgctgtgggacaccatgtatatatgtttggaggtatgacagccac

SEQ ID NO: 6001 - DNA, 249 bp, Mus musculus
aaggctgcccttgcaatagacgccatcgccaagctcacggccatcgacaaccacccaatgaatagaatgctgggcttcgggaccaagtacctaagagagtacttctccccctgggttcagcagaatggcggatgggaaaaaatacttgggatctcacatgaagaagtagactgaaatagccaaagacctgtcgcctggaaggtcccttgtgcaacagtggttctgtgtgcccaccactcttaccataga

SEQ ID NO: 6002 - DNA, 567 bp, Mus musculus
  misc_feature (47)..(47): n is a, c, g, or t
gcagaccacgcagagaaacaggcatcaagattgcgtgaagaagcccnataatatgggaagtgtacatatgtcagaaatatgtactgagttaaaaaatttgagatcattagttcgagtatgtgaaattcaagcaactttgcgagagcagaggatactatttttgagacaacaaattaaggaactcgaaaagctgaaaaatcagaattccttcatggtttgaagatgtgaataattgcacatgatctcttagaggaactgtaaatctattgcccagtcataacattttgagctgcatttaagtagactatggaccgttaagctgggcaaatgaaatgacaaggggacggggtctgtgagagtcaattcaggggaaagatacaagattgatttgtaaaacccttgaaatgtagatttcttgtagatgtatcttcacgttgtaaatatgttttgtagagtgaagccatgggaagccatgtgtaacagagcttagacatctgaaactaatcaatgctgaggtggctaaatacctagccttttacatggaaacctgtctgcaaaattagcttt

SEQ ID NO: 6003 - DNA, 153 bp, Mus musculus
  misc_feature (58)..(58): n is a, c, g, or t
gcagcagggcgccttgtatatgctagacagttgcagtgtgggagggctgggccctggncatgaactgtgtgccctgggcagtgcctgctgtggtgtgatcacatccagtccccgctgccgtctgtgtcctgcacggggctactttaatactag

SEQ ID NO: 6004 - DNA, 562 bp, Mus musculus
  misc_feature (122)..(127): n is a, c, g, or t
  misc_feature (129)..(131): n is a, c, g, or t
  misc_feature (133)..(140): n is a, c, g, or t
  misc_feature (158)..(158): n is a, c, g, or t
  misc_feature (498)..(498): n is a, c, g, or t
  misc_feature (530)..(530): n is a, c, g, or t
gcctccacatagcttcaactcagaagatctgctggcccagagatgaggggattgactgaggctgcagttaggcatggtggagcagcagttacacccttcccttgagttgaaagccagagacnnnnnngnnntnnnnnnnntgctgctgctgctgctgnctgctgctgcgttgctgactctcagcttcccatgctcaggtctgggggacgtcttttcttatgtgtgtcttatttttaagttttgttatctgggtactggacatctgcctgtctgagccccaggcccatctgtctgtccacagcccacttttcaccgtcactctctgggcacctcctgagatggttccacaaccgtgccctgttggttctcagaacaggggccaatgattgttccccctgccaggaaatgcaggttcaactgctaaaggaggcagagggtcagagcttggtggtttatcttttccttgtttctccttgtttctgttttagaaatgaagtntgggggtttaaatggcacttaaactgcacccntggagccggcagaaccaggcaacgtttttcca

SEQ ID NO: 6005 - DNA, 571 bp, Mus musculus
  misc_feature (26)..(26): n is a, c, g, or t
  misc_feature (428)..(428): n is a, c, g, or t
atgtttctcccaaagacctcagcctntgggcccctaacccctcctgcccacctccaacttctagagaccaggtctagggtgcctggcagcactgctgctctcctggagcccacccccgatgcatcaggtgtgatcgcagacagccctggacactgggacacagaagtccctaccccagaactcctaggcagtgtggaatcagtcttgcacaggctgcagactgccttccaagaagctcttgacctttaccgcatgctggtctccagcagccagctgggtcctgagcagcagcaggcacagaccgagctggcctccaccttccactggatcctcaaccagctagaagccagcaactgtatggctgcagctaacttggccccaccccagacactgcctagcccagaccctctgtccctacctacactttntcccctggccagcccaaacctgcaggccctgctggaacactactcagagttgctggtgcaagcagtgaggaggaaggcaaggggtgactgagaacctgaagcccctctaccaaagccccgctgccctggagaaatagatttgt

SEQ ID NO: 6006 - DNA, 348 bp, Mus musculus
tatgaatatcatccagtctgtgcagatctgcagaccaaaatcctccagtgttaccgtcagaacacccagcagactctcagctgctctgctctggctagccaatacatgcactgtgtcaaccatgccaaacagagcatgctggagaagggaggctaaagttaccctgagaacatgcaagctccttcaacgttaattccagaggtggaacatttttcttttcctagtatgaaaatgacccatttaaagagaagaccactaaagacagacaggcactggaaaatggactcaactgaatcataacgtgttttgatcaacagtttaaaaagccatgttctagatcagcgatca

SEQ ID NO: 6007 - DNA, 444 bp, Mus musculus
gtgatgatctactgatgctcttggatgtcatatgatcggaatatacagtggagtaggtgactccctgaaataccatgtaaatatgagagcaaatcgtgctgcagaagtgagagtgaccatactgtcttctgtgcaagaatgtctacgcccacccccttgtggagaaggttgggccagcctgcagtggagaaaaccacctttacgataatgatgtgagacagaccagaggactgcggttactgtaggagcctctcctttctatgtcattagcttaggctgcacgggctacttcattcatggtgggaaagttaattgttatcattggggaaatactgcaaattttatcttttgtttccaggcatttatactttgcccagatcaataaagcagaaaaagagaggattgagtagcatttccaaaattgttaggtcctttgctatctga

SEQ ID NO: 6008 - DNA, 469 bp, Mus musculus
  misc_feature (57)..(57): n is a, c, g, or t
  misc_feature (264)..(264): n is a, c, g, or t
  misc_feature (373)..(373): n is a, c, g, or t
  misc_feature (417)..(417): n is a, c, g, or t
aatttctatatgttttggcaagcacatagtgagacaatgcttattacagtaagtacncatttcagttaactaactgggcactgtaattccaatagggctgtaatgcatggaaactcactcttcagattccttagagctgtaacctgagacagttgaagggcccatagttcatttgggaggtgtagatagtagtgaagctgaggaagcctggaaaggaaaggtgtacagagggtgtgctgtcaagctggctaacactgcaggatnctagaactgtatttcctttgtgctactctggaaaaactagaacacacaattcagacatacctcatgtgaagaattgggatacagaactagtttggggcagtggtagctntcctgtacagtgaacagcagttcttggcaacttgtgatcaagangctgtagctggacatgatggcacatgcttgcagttccagcacctgagaggta

SEQ ID NO: 6009 - DNA, 508 bp, Mus musculus
  misc_feature (32)..(32): n is a, c, g, or t
  misc_feature (136)..(136): n is a, c, g, or t
  misc_feature (324)..(324): n is a, c, g, or t
  misc_feature (455)..(455): n is a, c, g, or t
ggaaggtcaacatcagctgtgccaagactggntactctgccaccgtgacgttccacacgaagcccttctacggcgggaaagtccacagggtcacagctgaagtgaaacacaacccaaccaacaccatcgtctgtanagcacatggggagtggaatggcaccttggagttcacctacagcaacggggagaccaaagtcatcgacacaaccaccctgcctgtgtatcctaagaagcttagacccctggagaagcaggggcccatggagtccaggaacctctggcaggaagtcacccactacctgaggcttggggacattgacgcanccacagagcagaaacgacgcctggaggagaggcagagggtggaggagaggaaacgggagacccttcgcacaccgtggcgacccaagtatttcatcccggagggcgatggctgggtgtacttcaaccccctntggaagacacactgatgggcggaggtgcagtgcttcccgtaataggcctggtt

SEQ ID NO: 6010 - DNA, 387 bp, Mus musculus
  misc_feature (30)..(30): n is a, c, g, or t
  misc_feature (101)..(101): n is a, c, g, or t
gctgctgctggagatgattgagttccgggncagctggctggaagaccactcctgctgcccacaagtattactacagtgaggtctctgactaagcccaggtnctgcacatgccttcccgtgaccctcttttcaagctggcaccagaatccttgcttcagccccttctagacttttttgactgctgtggttctgccgtcttcccttccctcaatctggacttggggagaaaccaaacagacttgtctcctggctgaagactgactgtcttcctctcccctcaagtcctgttatcttcccaccaccttcctcctgggcctgacaggggagaaccaactaacaaacactgaactgtgtagccactggtgcaacatgaccttggtgcctcag

SEQ ID NO: 6011 - DNA, 299 bp, Mus musculus
gttttggcagtcctagcccacattctcaggctgtatttgctaaaccttccactgacgtgtttggaggtagcggcatatctacctctgtcctagcctccggtgccgctgataacgcactgttcacacccagggatcagctgatgaaggaagaactggagcagtttcaatcccagagatttaccctgggaaaaattccactgaagccgccaccggtcgagcttctgactgtataaaggtcaggtttaaatacagaaagaatgccttagccaggcatgtcctgcatgcctacagtctgggaa

SEQ ID NO: 6012 - DNA, 533 bp, Mus musculus
  misc_feature (259)..(259): n is a, c, g, or t
  misc_feature (352)..(352): n is a, c, g, or t
  misc_feature (385)..(385): n is a, c, g, or t
  misc_feature (388)..(388): n is a, c, g, or t
  misc_feature (394)..(394): n is a, c, g, or t
  misc_feature (408)..(408): n is a, c, g, or t
  misc_feature (471)..(471): n is a, c, g, or t
  misc_feature (477)..(478): n is a, c, g, or t
tactgtgccatgtgtctggtgcctgcattactcgttaacctgttctgttatcaacggcagtagtttccttcaaagagggggacaatttacctggctcctgttttaacttggctgaccagagtcgagttcttgtaaccattaaaaacaactagggggccgggtgtggtggtgctcacactcaggaggctgagctctgagatcaaggccagcctggtctacagagagagcctgtcttgaagaaacaagacaaatggggggntagaggtttccctgagacacccctgccttagcaaggggctccagttggatcccgttgaagcacggtggccgcgaaggtagggcagagaaatcntggtatgggagggagagaccttgacctggaaancgncctccntctctccagctctncaaagagctttgggaactgggagttgacgttcccacactcagcctggttttaagggacttctntccccnntggtggaccaggacggcttctaaaggacaatgaaaacctagagctcaccttcatc

SEQ ID NO: 6013 - DNA, 271 bp, Mus musculus
tgcaccaaccaggaaggctacaggaagatggtgataggagccctgccactgctcttggacctggacaagcagcctatcctggagcggtggacctcagatgaggaggataaatcctcagatgatgatgatgagtttccagagctcaatggccccttctgcgcagagcgaggattcttcaaggacttggagcaggaactgcatcagcatcaggaacgcaggcagcaggcagcactgacagagcacttgtcaaggatggagacacagcctgtcc

SEQ ID NO: 6014 - DNA, 306 bp, Mus musculus
  misc_feature (207)..(207): n is a, c, g, or t
  misc_feature (211)..(211): n is a, c, g, or t
  misc_feature (251)..(251): n is a, c, g, or t
  misc_feature (255)..(255): n is a, c, g, or t
agctacttgctgactccgatcggtgcttccatcttggggcgctgcacagtggctaagatgctctatgatgggggcttgaattattttgagggctacagccttgaaaactgggtgtgcctggcttattttgagagcaagttcaacccctcagctgtctatgaggacccacaagatggctccaccggtttcggcctctttcagattcgngacnatgaatggtgcggccacggcaagaacctctgcagtgtgtnctgnactgctttactgaatccaaacttaaaggatacgatccagtgtgccaagaaa

SEQ ID NO: 6015 - DNA, 230 bp, Mus musculus
aaagggcaacgccatctggctcacacactgaccacacactagatctcacctatacaagtaggcaatacttcagattttaacatatagaatggatttaatactgtctggaattgtatttgatgaattgcttttttgatttaagggtcaaagaagccagcatttttggtcactagctggaaggttttgttcatttatacttgaaatagcacagactatctaaaaggcttgag

SEQ ID NO: 6016 - DNA, 273 bp, Mus musculus
agaggcctctgcatggtatgagctcttacgaagcgttatgtaggactgctgcctccccaaggtgagaagttgatttttaactcggatcaacccacaggagtacctttgtattggcaatattgaaacacatttagaaaggttcctggctgagattggctctagaacttgctgtcgtttgtaatttactgttttcttattgattgtggtacctctgacttttcttctctagtatgattccttcagcatacaagttactcttacacacatacggaa

SEQ ID NO: 6017 - DNA, 323 bp, Mus musculus
  misc_feature (30)..(30): n is a, c, g, or t
  misc_feature (65)..(65): n is a, c, g, or t
caccccaccttgatcagagtattgttacantcacatttgaagtaccaggaagtgcaaaggaagantgtctaaatgtatttatccagaatctcctgtgggaaaagaacgtgaaaaacaaggacggccactgcatggaggtcattcggctaaagggactggtgtctatcaaagacaaaccacagcaaatgattgtgcaaggcatccatgagctgtacgacctggaagaaagcctagtgaactggaaggatgatgcggagagagcgtgtcagctggtcttcattggtagaaatttagataaggatgttcttcaacaactcttcctc

SEQ ID NO: 6018 - DNA, 581 bp, Mus musculus
  misc_feature (33)..(33): n is a, c, g, or t
gaggcctaacgtgttctggatgaccgggttctntaacccccaaggcttcctcacagcaatgaggcaagaagtgacccgagctcacaaaggctgggcgctggacactgtgaccatccacaatgaagtcctgcggcagaccaaggaagagatcatcacgcccccagcggaaggcgtgtatatttacgggctgtatatggatggagcatcctgggacaggcggaacgggaagctcacagaatccaccccgaaggttctcttcacgcagcttcctgttctgcatatttttgccattaactccacggcgcccaaggatccgaagctgtacgtgtgtcctatctacaagaaacccaggcggactgacctcaccttcatcaccgtggtgtacctgcgcacggtgctgtccccggatcactggatcctgagaggggtggccctcttgtgtgacatcaagtaagttcatctctatctgccgtgggcaccaggagagccacacagaaaaaagcttgccactgagaaactcagacatgcttatgtctcctgcctgataggtgcttcattaccctccctcaattaaacagttg

SEQ ID NO: 6019 - DNA, 466 bp, Mus musculus
  misc_feature (77)..(77): n is a, c, g, or t
  misc_feature (338)..(338): n is a, c, g, or t
  misc_feature (362)..(362): n is a, c, g, or t
  misc_feature (375)..(375): n is a, c, g, or t
agaatatcattaccgagttgcctgtaaattctcacaagatagtactggagtgggcttctcccagaaattttacttcngtttgtgaagaactggttagtaatgttgaagatttgaatgaagaggtctgcagactgaaggagttgattcagaagatgcagaatgagcgggaaaatgacccaactcatatcccactagtagaagaggtctctacatggaagactcgaattctgaagaggtcagcagttacagtgtgtggattcgggctgctgcttttcatcggcaagctaactttgcagagaaaataatagtactatttatttaagttctgtatgtccatnttcttctgagtgtcctagcatggnttctaatcatttntggtacagcatagctttatttccttgcctgtactccaaaggaacaattatgatactataaagtacagttttcctttagaacatgacttcag

SEQ ID NO: 6020 - DNA, 117 bp, Mus musculus
  misc_feature (34)..(36): n is a, c, g, or t
  misc_feature (44)..(44): n is a, c, g, or t
tccacgcaacctgaaaatggcattctttaataannnatgtctgntaaaaacaggagtactttgtacctttatgagatgttttacattttcttactggcttgctttggtactagaact

SEQ ID NO: 6021 - DNA, 400 bp, Mus musculus
  misc_feature (73)..(73): n is a, c, g, or t
  misc_feature (284)..(284): n is a, c, g, or t
  misc_feature (303)..(303): n is a, c, g, or t
  misc_feature (321)..(321): n is a, c, g, or t
  misc_feature (342)..(342): n is a, c, g, or t
  misc_feature (355)..(355): n is a, c, g, or t
tgagaattctgtggcactgtttcccagttccatgttagtttcctaggacctctgtcaaactaccgtataacancgtgctcaggtctgatagggagcaccgatgataaggggcagagccagtctccatggagtttctggggacactgtaggctggtaccaggtacctgttgacccctgcgtggctcacagttggatccatgagttcagaagtcagaagatagctgctgatcacttgcaggaacatgacctggccctggccctcccccgtgctgtttcctggggtnttatacctatctttctctntgttggatcctcacccancagcctcggggacaagcttcnctctgagtggganggtgggaggacacactgggtgtcccttggtcatctgctgagacaa

SEQ ID NO: 6022 - DNA, 435 bp, Mus musculus
gaggaattccaaagccagagtcagaggccacctcagagccagccctgtttggcccacatatattgaagtctacagggaaaatgaaggctttaattgaaaatgttcccgactcctaatggacaatgaattcagaaagactcctggttcaccagttggcttgcagagctgagtttgtctaggagaaatcaccagtatttagtaaattccttgctgtagtgttcattggtctccttccttctgagcccaactagaggagtaagaagcagtgaaagcagcaggaggtctggcttctgagaggtcagctctggagctctccctaacacacatgtactatgtgcatgttctgttcttaacactaaaatctgtgcacacatttcaccatgaatggcatcagagaggacactgttatcttcctcttcactgagagttcactag

SEQ ID NO: 6023 - DNA, 323 bp, Mus musculus
cctacctgaagggagactgcgtggaatgcatggcatgttcggacaataccgtgcgtgctggcctgacacccaaattcattgatgtgccaaccctgtgtgaaatgctcaactacacacctagccccagcaacaacaggctgtttgccccagcacagagtcaagatgacccctatctctctatctatgatcctcctgtgccagacttcactgttatgaagatggaggtccctagctctgtcactgaatacaaagtctcaacactagactctgccagcatccttctgatggtccaagggacagtgacagctatcataccttcagcc

SEQ ID NO: 6024 - DNA, 528 bp, Mus musculus
  misc_feature (361)..(361): n is a, c, g, or t
  misc_feature (402)..(402): n is a, c, g, or t
  misc_feature (424)..(424): n is a, c, g, or t
  misc_feature (447)..(447): n is a, c, g, or t
  misc_feature (462)..(462): n is a, c, g, or t
  misc_feature (466)..(466): n is a, c, g, or t
  misc_feature (495)..(495): n is a, c, g, or t
gaacctgacggcaacgctggtgttagaaaaatgtctacgagaagatctcaagaaagcagagctgcaactgtctgcagaaaaggccaaggttgacagtcgccttcagaatatggacttcctaaaagcgaaggcagcggagttccggtttggaatcaaagctgcagaggagcaactttcagccagaggcatggatgcgtctctgtctcatcggtcactagcggcactttcagagaaactctcggagttaaaagagcagactatacccctgaagaagaagttggagtcctatttagatttaatgccgagtccatctcttgctcaactgaaaattgaagaggcaaagagagaattagacgccatngaggctgaacttaccaagaaagtagacatgatgggcctgtngaggacagccatgtagacgtgntcaggggaaggaggtgactgttnttagagatgatgatntctntattagtaaaacaacagggttcgcttctncctttaaactttgtggcctgaatacagtttgca

SEQ ID NO: 6025 - DNA, 411 bp, Mus musculus
  misc_feature (54)..(54): n is a, c, g, or t
  misc_feature (244)..(244): n is a, c, g, or t
agaatcatctattcctgtggagtatgcaaaagtgtggaaacctggcgatgaatnttttgcactttattgggaagacaacaagttttaccgagcagaagttgaagccttgcattcttcgggtatgacagcggtcgttaagttcacggactacggcaactatgaagaggtgctactgagcaatatcaagcctgttcagacagaggcatgggaagaagaaggcacctatgatcacaccattgagttncgcagaggaggtgatggacagccacgaaggtctactcggccaacgcagcagttttaccaacctcctcgagctcggaactaatgtgaaagggcttttgtgaaggaagagccactgactgaaacatcctggaagcccactgatagattttccacttcttcagagagaga

SEQ ID NO: 6026 - DNA, 498 bp, Mus musculus
ttgcacgccctctggaaggttcgagctgttcctatcctgcccctgagcctggttccagatacctttgatgatgcctatgtgggctgctctgaggagatggaggagaaagcaggcctgctgctaaaggaagagatggcacgccatgccctgctgcgggaatcctgggaagcagcacaagaggcctgggcacaccggcgtcacaagctcactctacctcctggcttcaaagcccagcacggagtagcgattatggtgtacaccaactcatccaacaccttgtactgggagctgaaccaggccgcgttgtctgtcttccctgaggagcgtgaggtgctgatacccccacacgaagtcttcttggtcactgggttctcccaggatggagcccagagcatagtgactctctcgagttatgatcagacctgcagccactttaactgcgcctatttgggtggggagaagagacatggctgtgtgtcctcaagagcagtcgggcag

SEQ ID NO: 6027 - DNA, 579 bp, Mus musculus
  misc_feature (298)..(298): n is a, c, g, or t
  misc_feature (311)..(311): n is a, c, g, or t
  misc_feature (363)..(363): n is a, c, g, or t
  misc_feature (365)..(365): n is a, c, g, or t
  misc_feature (372)..(372): n is a, c, g, or t
  misc_feature (374)..(374): n is a, c, g, or t
  misc_feature (394)..(394): n is a, c, g, or t
  misc_feature (408)..(408): n is a, c, g, or t
  misc_feature (422)..(422): n is a, c, g, or t
  misc_feature (442)..(442): n is a, c, g, or t
  misc_feature (451)..(451): n is a, c, g, or t
  misc_feature (492)..(492): n is a, c, g, or t
ggctcgcaggtttgggaatgccaccttcttcaatctaaggacttgttttggggctcctatccaggcgttgtctgtcttccctgaggagcgtgaggtgctgatacccccacacgaagtcttcttggtcactgggttctcccaggatggagcccagagcatagtgactctctcgagttatgatcagacctgcagccactttaactgcgcctatttgggtggggagaagagacatggctgtgtgtcctcaagagcagtcgggcagccagaggcaccctccacagaggctctggctctgcantcaggaaagacantgctcttggacccaaggaagctgcagctctccagagctggaccctgaaagcntnttaggantnttgggaactaatgaccttantatgaagaaggggntttgaacggctgcnaggaagcaggagtgtggttntggttccantcctaggagccacctgtccaaccagagttggagatctgagnccatggcagggttgagggaaccccacagtgtggtgggaacttcctaggacatgcaaggtaaagactggatggctactcaattaaaca

SEQ ID NO: 6028 - DNA, 435 bp, Mus musculus
  misc_feature (218)..(218): n is a, c, g, or t
  misc_feature (222)..(222): n is a, c, g, or t
  misc_feature (225)..(225): n is a, c, g, or t
  misc_feature (246)..(246): n is a, c, g, or t
  misc_feature (275)..(275): n is a, c, g, or t
  misc_feature (282)..(282): n is a, c, g, or t
  misc_feature (299)..(299): n is a, c, g, or t
  misc_feature (318)..(318): n is a, c, g, or t
  misc_feature (370)..(370): n is a, c, g, or t
  misc_feature (385)..(385): n is a, c, g, or t
  misc_feature (409)..(409): n is a, c, g, or t
atgcaagcaactcctatataagtaactttgaaacagtacatcacatagttcctgtttattacccacaggtgggtaagccaaaagtaatcttcttctccgatgtacagagatatcttgtacatggaaatgcatcttcaaaatgttcccaagaagataaaactacaattactgaagacatagggaatctgtccttgaaggaatctgaaagctcgctaacnaaanacnatatccatgaacctcaccttntccaaaatccaaaagtaaaggaaaatttntctgagnaaaaggagtaaattcancctcgagtgatttgatttnttcatagaactaggcaacagcatgttttgagggtttgtggacttcacttatntcggtgtgtaagttntttgatttgtttctttatagaatntgagactttgctttatgtgcgtgaat

SEQ ID NO: 6029 - DNA, 448 bp, Mus musculus
  misc_feature (64)..(85): n is a, c, g, or t
  misc_feature (235)..(235): n is a, c, g, or t
  misc_feature (257)..(257): n is a, c, g, or t
  misc_feature (259)..(259): n is a, c, g, or t
  misc_feature (306)..(306): n is a, c, g, or t
  misc_feature (312)..(312): n is a, c, g, or t
  misc_feature (314)..(314): n is a, c, g, or t
  misc_feature (323)..(323): n is a, c, g, or t
  misc_feature (340)..(340): n is a, c, g, or t
  misc_feature (342)..(342): n is a, c, g, or t
  misc_feature (345)..(345): n is a, c, g, or t
  misc_feature (364)..(364): n is a, c, g, or t
  misc_feature (366)..(366): n is a, c, g, or t
  misc_feature (388)..(388): n is a, c, g, or t
  misc_feature (393)..(393): n is a, c, g, or t
  misc_feature (407)..(407): n is a, c, g, or t
  misc_feature (409)..(409): n is a, c, g, or t
tgccctgcttgcagagaatgcctttctttggcctgattggaatcatcctgagcttctgtgaagnnnnnnnnnnnnnnnnnnnnnntcaccttaattttcctcaccctcctgttgttccctgttaacctctggatctacgagctgaggaagaatatatcggttcccatcggctggagctatttcattggttggctggtgctcatcctgtatttcacttgtgggattctttgctacntcaaccataaaaactactggantntgataatgagcagcaccaccatcaacactgcttgcagcagcttaggnccagantntctggtgantccctcccagacccccnancanccaggagaacagccaggantntcctaaggatgaccaaaagccntcaantccagataaagtantntcaccaccccagccagacaccactggctaggactttcct

SEQ ID NO: 6030 - DNA, 373 bp, Mus musculus
  misc_feature (189)..(189): n is a, c, g, or t
  misc_feature (303)..(303): n is a, c, g, or t
tgatcagtcccggaagagagctggagatgagttggcttataacagtccatctgcttgtgcaagttccagggggtatagatagtgacggttgaactatgtttctcccaagagaagacacactggagctacagaaactgttccaggcacagtgaggcctgcaccactcaggagctctgtcaaaggctgttntcagagaggataccggacttctttctttgatttttcagtttttaaaaacaagaactaacaaaaacaattgctgctagactggggggtgattatgaaatgggacaatcttttatntacagagcaagtgtcttggagagtggccgttgataaagtgaagctcaatgtttgaatcagcttcctccag

SEQ ID NO: 6031 - DNA, 344 bp, Mus musculus
  misc_feature (127)..(127): n is a, c, g, or t
tgcttttcctagcagaggtcgtgctgctctgctgggtcaagttcttacctctcaagaggcaagcgggacagccaagccccaccaagcctcccgctgaatcagtcatcgtcgccaaccacagcgacangcagcggcatcaccccgggtgaggcggcagccattgcctccaccgccatcatggttccctgtggcctggtttttatcgtctttgctgttcacttctaccgctccctggtcagccataagacggaccggcagttccaggagctcaatgagctggccgagtttgcccgcttgcaggaccagctggaccacagaggggaccattctctaacaccgggcac

SEQ ID NO: 6032 - DNA, 492 bp, Mus musculus
  misc_feature (304)..(304): n is a, c, g, or t
  misc_feature (412)..(412): n is a, c, g, or t
  misc_feature (441)..(441): n is a, c, g, or t
aaacagcattactgggtgcctgagagagagaagaagcaaatagaaaggcacattcatagaacaagccatgccagagaatttacagacaaaccctggagacagccacgactcttcagtgaaacaacactacccaaaattgtgctagaggaggaaagcatcccacaagcacagaaaagaaggcaggcacacgagagagaactgctccaaattaaagatcaccgggagcgcatgattcgagggagggaacttctacagcaaaggctcaaagacagaatcttgagaaaaagcccgagtcagatcccanttcctgagaagcgtgatcaagtgaagaaacagaaaaaagagtttgagaaggtagttgcatacccactagtccagccatcctgtaccagtaggattaaagtagatgttnttatggaaaaatctcaggatgaagagganttgagcacaattataaaaccttttggaaggagattcttagctgtaccaccc

SEQ ID NO: 6033 - DNA, 398 bp, Mus musculus
  misc_feature (96)..(96): n is a, c, g, or t
  misc_feature (317)..(317): n is a, c, g, or t
gctcatcttgagacctcgaagcaggaagcagacagctggcgggcatcagatcctatttcagcttccatccactcaaagcctttaggaattgggttnacagcccgtaaaaccaagatctcttctatgtaaagctgaaggaagcatggaagtagactctttactctcagtgactcatgggacactggccatttgagatccagagggctctaaggtgacatcagggacctttcacactggtgccagtctttaaatttaccaccgttatcaagatattatctagttagttcctgctcacacaagcctctgactgacccatnctgatgacacctgttggtatcagggtatcagcactgcagatcagctctggacctagtgacatcacatatcgctgacaggaa

SEQ ID NO: 6034 - DNA, 554 bp, Mus musculus
  misc_feature (496)..(496): n is a, c, g, or t
gaatcacagcccgaactgggaacctggggcgatggcaagggtgaagatgagctgtctccagaagagatacagatgtttgaacaagaaaatcagcgactcattggtgaaatgaacagcttgtttgacgaagtgaggcaaatcgaagggaaagtcgttgaaatttccagactccaagagatattcaccgaaaaggttttgcaacaggaaactgagatcgacagcattcaccagttagtcgtgggggcaactgaaaatattaaggaaggcaacgaagacatccgagaggccatcaaaaacaatgcaggtttccgagtgtggatcctcttcttcctcgtgatgtgttccttttccttgctcttcctcgactggtatgacagctagcccaccagggctgagcctgcgcctgcgcctgtgccttggacgcaccacgtgccagcatgtgtctcatcggctgtggagctgtgtaaggtccaagggctgggaaaacaccgccccnaagccaacctttggaacctctcaggacctggaaatacatggattgcaagtgcccttca

SEQ ID NO: 6035 - DNA, 537 bp, Mus musculus
  misc_feature (357)..(357): n is a, c, g, or t
  misc_feature (400)..(400): n is a, c, g, or t
  misc_feature (435)..(435): n is a, c, g, or t
  misc_feature (444)..(444): n is a, c, g, or t
  misc_feature (456)..(456): n is a, c, g, or t
  misc_feature (510)..(510): n is a, c, g, or t
taggccctgtccctttgatgttaagtggaggctttgctgggatctgtctctggcttatcatattcccagtggactgcattaaatccagaatccaggttctttctatgtttgggaagcctgcaggattaatcgaaacctttataagtgttgtgagaaatgaagggatatcagccttgtattctggattgaaagccactctgattcgagccatcccttccaatgctgctctctttttggtttatgagtacagcagaaagatgatgatgaacatggtggaagaatactgaagtgtctattgatgagtccttgtctgagcacatgaatgagaggaccacagctctacatgtcaaagagttnaagaccaacatggagttagctttgactgggaatttcgggtttntcttcccttcctcaaatctcataccttgtggaganatctttatntcatatggtttnttcctgcaatcctactgaaataggaaaatcactagttttgctggtggtgggatntacagggtgaacccaagactctatgta

SEQ ID NO: 6036 - DNA, 485 bp, Mus musculus
  misc_feature (137)..(138): n is a, c, g, or t
  misc_feature (141)..(141): n is a, c, g, or t
  misc_feature (440)..(440): n is a, c, g, or t
gagagccacgattgatgctacccgcacaagtcgtcatttggaggaaactattgacaattttgaaaagcagaaaataaaggacataaagaacatattatctgagttcatcacaattgaaatgttatttcatggaaaannctntagaggtcttcactgctgcctaccaaaatatacaaaacattgatgaggatgaagacctagaggttttccgaaattctctgtatctatcagattatccatctcgcttagatattgtaagagcaaattcaaagtcacctcttcagagatcattgtcaactaagtgcacatctggaactggacagatatccacctgccgaacaaggaaggaccaacaagtagaagatgaagatgatgaagaattagatgttacagaagatgaaaactaatttacacaaagaattcacatttctgtttttatntcatctaacttgcaaatgtagaatcactttaaactcacttgacag

SEQ ID NO: 6037 - DNA, 133 bp, Mus musculus
aggaagaggccaagctccagaacccggaggatatcacagaggaccttgccaagattatgatggactacgcggggatggagaacttctggaagagatacaacaaggtgaaactggaggtcctgagtctccagca

SEQ ID NO: 6038 - DNA, 325 bp, Mus musculus
tacattcgagcccacccagagagagccgctctgctgttcatgtccagtgtctgcatcggcctgctcctcacactgtgtgccctggtcatcagggtgtcctgtacgaaggacttccgggagctgaggcaggggagggagcacctggtgctagggagcgacaaggcggaggaggacagcgaggaagacttggaagaggaggactcctcggattcgcagtttcccgaggagttgtccaggttttgtaggacttcatatccagcctatagctctatagaagccgccgagctggcggaaaggattgaacgcagggagcaagtcattcaag

SEQ ID NO: 6039 - DNA, 452 bp, Mus musculus
ttcagactcgcccaaagtacagcctgaggcagaacctgaacctgggctcttattggaagttgaggagccagggccagaggaggtgcctgggcctgagactgctcctaccctggcccctgaagtgctcccctcccaggaggagggggagcaggaagtgggaagccctgcagcagggccacctcaggagcttgttgaagagtcctctgctccccctgccctgctggaagaggggactgagggtggaggtgacaaagtgccacccccaccggagacacctgcagaagaaatggagacagaagcagaagttccagctcctcaggaaaaggagcaagatgatacagctgccatgctggctgatttcatcgattgtccccctgacgatgagaagccaccacctgctacagagcctgactcgtagccccttctgcaccccgtcactttgtatccaataa

SEQ ID NO: 6040 - DNA, 376 bp, Mus musculus
  misc_feature (93)..(93): n is a, c, g, or t
gaagttgcttcgagaccagctgagccaacatcaggagttgttgctggaacaaatagctaaagggccccaggttcaggcccgcagctggaagangttggagcacctgcagagtgaccagatggacagggttcataccttggaggtttccagtacagaggcccatgatgcccagaaggaagagccctacctcctcagctctgaagtcagtctcccagactgtggccgtagctgggaacttttaaagaaattggatagggaactccagaacaactcccttcctaacctggaacccagcagctctcagttccatgcctggagtctagggcaagaggacctgttccttgagggccccacgatcttccagagtgacctgtaa

SEQ ID NO: 6041 - DNA, 459 bp, Mus musculus
  misc_feature (287)..(287): n is a, c, g, or t
  misc_feature (294)..(294): n is a, c, g, or t
  misc_feature (298)..(298): n is a, c, g, or t
  misc_feature (307)..(307): n is a, c, g, or t
  misc_feature (311)..(311): n is a, c, g, or t
  misc_feature (314)..(314): n is a, c, g, or t
  misc_feature (341)..(341): n is a, c, g, or t
  misc_feature (346)..(346): n is a, c, g, or t
  misc_feature (351)..(351): n is a, c, g, or t
  misc_feature (385)..(385): n is a, c, g, or t
  misc_feature (421)..(421): n is a, c, g, or t
  misc_feature (427)..(427): n is a, c, g, or t
  misc_feature (430)..(430): n is a, c, g, or t
  misc_feature (432)..(432): n is a, c, g, or t
aaggagagattgtgggccttcaccaggcctttgtcccggaaatccagcgagattgccggcccttcatccttctgagcttgggatcagagttgatacaagtaagaaaagagaagttttatgacatggttgacgaggagacaagagcaaagataataaagatggatgtggactatcccagcgatgaagacctgtgccagagtttcctgaaggaaaacgactatattgtctttcggaaggatttgctgcagttactggtggagcccctcaataagtcaccattcatcccngtccagnccangaagaaagngatntanaaccacaagtctttgttcctggatctntgcanccttngaaaagaaggtgaagcagcactatcccatttttntggcgccccagaaatacctgccccccttgagggttntccaanccntntcagcaccccggcacaaaatccaagaa

SEQ ID NO: 6042 - DNA, 250 bp, Mus musculus
tttcagcaagaccattggcaatcttattgcaaggaaaactgaacaggtgatcatgttcctgaagaagaaggagaaattcatcagccagctcctgaagcacataggcacctcagctctcatggacctgctgctgcgcctggtcagctgtgtggagccagttggtctccggcaggaggtcctacattggctgaatgaagagaaaatcatccagaggcttgtggcattgatccatccccaccaggatgaagat

SEQ ID NO: 6043 - DNA, 442 bp, Mus musculus
ttctccagagcctgaggtttatgagattgtgagagcagaagaggatgagtttgtcgtcttggcctgtgatgggatctgggatgtgatgagcaatgaggagctctgtgagtttgttaagtctaggcttgaggtgtcggacgacctggagaatgtgtgcaattgggtagtggacacttgtttacataagggaagtcgagataacatgagtgttgtattagtttgcttttcaaatgcccccaaggtctcagaggaagccgtgaagagagattcagagttggataagcacttggaatcacgggttgaagaaatcatgcagaagtctggggaggaaggaatgcctgatcttgcccatgtgatgcgcattttgtctgcagaaaatatcccgaatttacctcccgggggaggtctcgctggcaagcgccatgttattgaagctgtttat

SEQ ID NO: 6044 - DNA, 439 bp, Mus musculus
  misc_feature (135)..(135): n is a, c, g, or t
gttcgccctggcagccgggagacttcagccaccacactttctcctggggcaggcaaccgtggctgggacgacggtgacaaccgcagcgagcacagctacagtgaatcgggtgccagtggctcgtcctttgagganctggacctggagggcgagggacccttgggagaaccccgactgaaccctgaagccaagcttctggggccccctcgggagctcagcacccctgagaggggtgaggagtaatgataagccctcaaccctcctgtggtgcatttgctaaggaactgagcaaactctctagccctcttcttccttaacctgcctagcttgggctgggagtaccaggagcctgagttgtcctgctccaagcctaaacctccttcctcactgcccttttggctcccagggccgaaggagccagagactgttatctgcacca

SEQ ID NO: 6045 - DNA, 521 bp, Mus musculus
  misc_feature (323)..(323): n is a, c, g, or t
  misc_feature (331)..(331): n is a, c, g, or t
gctgaacacactaaccggctgaaaaacgctttcgttaaagccctacagcaggaacaggaaattgaacagcgattacagcagcaggcagcactctccccaacgacagctccagctgtatccagtgtcagtaaacaggagaccatcatgagacatcatacactgcggcaggctccacagccccagagcagcctccagcgtggtatacccacatctgcccgatccatgctttcaaactttgcacaggcaccccaattgtctgtgccaggtggcctccttggtatgccaggtgtcaacattgcatacttgaacactggcatcggagnacataaanccccaagtttggcagaccggcagcgtgaataccttttagacatgatccctcccaggtctatatcgcagtccatcagtgggcagaaataacgcctgttccacttgtactgcccatccttgaatcctttacccatttctcccattgcccccaacttccgtcgcatgcagtgcctgtactggtgcctaccata

SEQ ID NO: 6046 - DNA, 382 bp, Mus musculus
gacagtcagtattatcgccggcgacaccgccacgagaggacacagacacataagagagaggaagacaaatctcagactccatattcggcatttgttcagctgcttccagttctggtgattgtgactatttctgtcattactcagctgctcgctgctaatcccccatatagtctgttctataaatcgaccttgggctataccatttctagagaaacgcagaacctgcaggtgccttacttcgtggataaaaactttgacaaggcctaccgaggcgcttcccttcgtgacctggagaagacaatagagaaagactacattgattacatccagacgagttgttggaaggagaaacagcaaaagtcggagctgaccaatttggcgg

SEQ ID NO: 6047 - DNA, 545 bp, Mus musculus
  misc_feature (80)..(80): n is a, c, g, or t
  misc_feature (101)..(101): n is a, c, g, or t
  misc_feature (378)..(378): n is a, c, g, or t
  misc_feature (400)..(400): n is a, c, g, or t
gacaaagctttcattcactcatcagctctcattaagcatcaaagaactcatactggagagaagccctataaatgtcaagnctgtgggaaagccttcagccnctgctcatctcttacgaagcaccagagggttcacacgggggaaaggccatatgagtgcagtgagtgtgggaagactttcagtcagagcacgcaccttgttcagcaccagagaatccacactggagaaaagccctacgaatgtaacgaatgtgggaaaacattcagccggagctcaaattttgcaaagcatcaaagaattcacatgggaaagaaaccctataaatgtggagaatgtggcaaagccttcgttcattcgtcagctcttattcaacaccangagaactcacactggggagaancctttcaggtgtaccgagtgtgggaaaagcttcaagagcagcccctccctcatccgacatcaaagaactcacactgaagagcagccctgagaggtgctgagtgttaggtgaaggttggctttattgctgcgtttcatatttgatt

SEQ ID NO: 6048 - DNA, 439 bp, Mus musculus
  misc_feature (64)..(64): n is a, c, g, or t
  misc_feature (203)..(203): n is a, c, g, or t
  misc_feature (227)..(227): n is a, c, g, or t
  misc_feature (230)..(230): n is a, c, g, or t
  misc_feature (268)..(268): n is a, c, g, or t
  misc_feature (279)..(279): n is a, c, g, or t
  misc_feature (311)..(311): n is a, c, g, or t
  misc_feature (364)..(364): n is a, c, g, or t
aagggtactgcttcaaccaacccagtgttcaccagtgaccaggccactgtagagaagcagtccncagactcgggggcctattctattggtcactagggcctcttcccagggtgccatgcttatccttgggctgcagaaccttcaacaggccactctatctcagcagacagaggtgggagggggagaagaggggctcttatttntgatgttcaccccaaagaccaggnatntagaccctcactgttcagcagacaggcagtgcttcccnctaagacctgnatcttgcctttaccccttgcatgcctcccatntgcttccctgggtcccaagcatccatccatttccaaaggatagagaaaatggnagctaaggttacatccatagaacctaccacataccagggactcccatacacattatctctttgcacccttaaaat

SEQ ID NO: 6049 - DNA, 366 bp, Mus musculus
gatggtatgcagctgcttgcagacatgaagaagtcccaggtgagccctaacatccacatctacagcacccttatcaacgcagccctcaagaagttggactacacctatctcatcagcatcctgaaggacatgaggcagaacagcgtcccagtaaacgaggtggtcgtccgccagctggagtttgcagccgagtaccctcccacctttgaccggtacaaaggaaaaaacacctacttggagaagattgatggctttcgggcttattacaagcagtggttgaaagccatgccagcagaggaagccccccacccctggcaggagttccagaacaagcctgttggggaccaagacaccactgacaaggct

SEQ ID NO: 6050 - DNA, 436 bp, Mus musculus
  misc_feature (61)..(61): n is a, c, g, or t
  misc_feature (126)..(126): n is a, c, g, or t
  misc_feature (181)..(181): n is a, c, g, or t
  misc_feature (183)..(183): n is a, c, g, or t
  misc_feature (187)..(187): n is a, c, g, or t
  misc_feature (325)..(325): n is a, c, g, or t
catggtgtttccagcctgagtgtgaaaattagagtgatgccttccagcttctttctgctgntgcggtttttcctgagaattgatggggtgctcatcagaatgaatgacacgaggctttaccatganggctgacaagacctacatgttacgagaatatacatccagagagagcaaaattgcntnaatntaatgcatgttccaccttccctcttcacggaacctaatgaaatatcacaatatttaccaattaaggaagcagtttgtgagaagctcgtatttccagaaagaattgatcctaacccagtggactcacaaagtacgcccntcagaataaaatgtggtacagcagactctctccatgtggaacctgactggaaaccttggctatttgtaggggtatttttattatgagaattaatttccttgcttatgcgca

SEQ ID NO: 6051 - DNA, 343 bp, Mus musculus
  misc_feature (217)..(217): n is a, c, g, or t
  misc_feature (226)..(226): n is a, c, g, or t
gggatggctgttctttcatcgtctcccaagcctggagcctcagctggttaatcgttttgaagtttgagagctactcaagaaactgaacgttaagcccttaattgattgtgagagctggtgtgataccagtgggatttacactgtcagtagccggctccattaatcctgccatcttcaggagcccgagtgtggggaagggagccagatacatcagatnaggactctntggccttattattgcttccttggttggtgagctttggtgagagagagcagatctgtttctatgtaaattatgggagtcttaagctcaggtttcaccacgggcctgttttatgtacta

SEQ ID NO: 6052 - DNA, 588 bp, Mus musculus
  misc_feature (66)..(66): n is a, c, g, or t
  misc_feature (432)..(432): n is a, c, g, or t
  misc_feature (448)..(448): n is a, c, g, or t
caatcgtcagatcctgccccaagaagctggagtggcgagggatctaggaggtggtgatttgttggnctcctctccgccctaaggatggacaacgggggcgctggtgaggtcccctggaccatccagggtgctagggggtggggaggggacacactccctccctgcctttacctcacttccaatgctgccttgatctgtctgggaagagggaggacaggggcccttagcccctgtactccgccatctcagagccatgcggttaattcctgacttagtttatttttgcaaaaacgtagaccccccctccttccccccgccccgcatccgcgaaggcttttaataggaggggagtcaaagttcaaaactgtcttcctctctcctccccgattctagctgtaaatgccacttcccgagggggagggggtgggaaanccctccccctgcatgnttctggctggagcacctccctgggacggagggaatcagggttacaggcaacccccgtggctgcttggagacgctgccaaggcagggggtgcggggcggtgtggcaggcgcacactgtatgtacctataataaaccctttg

SEQ ID NO: 6053 - DNA, 458 bp, Mus musculus
aagatttgctgttgctgccgagccaagtttcccctgttttcctggccacccacctgtctcttctgcaagagagctgtgtgcacttcctgtagcgtaaagatgaagatgccttccaagaagtatggacacatccctgtctacacacttggctttgagagtcttcagagggtgccaactaccaaagccacgccaacactgaggagagatgccttccaatccctgcagggaccaaagtggcggagcgtggaggaggagttcccccacatctatgcccacggctgtgtcctaaaggatgtctgcagtgactgcaccagctttgtggctgatgtcgtgtgctccagccgcaagagcgtggatgtcctcaatgccactccacgacgaagccgtcagacccagtccctctatatccccaacaccaggactctcaacttccaatgactgttgtgatggcctcccca

SEQ ID NO: 6054 - DNA, 276 bp, Mus musculus
  misc_feature (37)..(37): n is a, c, g, or t
gtgctcggagcaaggagctcagccctggggagagganccttgagtagccagtaccctcacacaatcccctgctgcttaccaatgctctcttgctgccacatcttcagaaaggggctgctctagggtggctggatttccagccctgggacaccagcacccccttgtggccatttctcactctgtttccaagtggcctcattagactgccccagtggtagggcaaatgtctccaatctgaacaaggtggagagataactgccccgaagtgctctgaag

SEQ ID NO: 6055 - DNA, 471 bp, Mus musculus
  misc_feature (129)..(129): n is a, c, g, or t
  misc_feature (138)..(138): n is a, c, g, or t
  misc_feature (259)..(259): n is a, c, g, or t
  misc_feature (305)..(305): n is a, c, g, or t
  misc_feature (410)..(410): n is a, c, g, or t
  misc_feature (412)..(412): n is a, c, g, or t
gctagtgagcctttggaatggcagtgcctgacgaatcatctccaaggggaaaatggcctagctctcactgcctttgatcccagtaccgggaaggcagaggtaggcaagtctctatgagcttgaggccanccagagctngacagcatgcaaaacacaaaagaaagccagagaacaggctgtttgagtcctcaatcttggcacagggattggctgggctctgatgttgctgttgaaattgccaggatactactgaggaatntacagaatagaatttccacataaaagattgtgcatataaaatattnttattatattaaatatagtatttcattctaaatgattggctttggtataatatgtaaacaaattttagtcacttatagatacacataaccacatagttttctttntntcatttgtcgtttgaggctagaccagttagagtataatatacattgcataccaaccctg

SEQ ID NO: 6056 - DNA, 61 bp, Mus musculus
tctccagtgtgggttcatcaagcccctgcctaatgaaaattgtgccaaagcctacatacat

SEQ ID NO: 6057 - DNA, 258 bp, Mus musculus
ctcagcagattattcctgtgaataaagctcttccccacccagactataatcctctggatcacaccaatgacatcatgctattaaagctggagagtaaggccaaggggactagagatgtgaggcccctcaagttgcctgggcccaaagacaaggtgaatccaggggatgtgtgcagtgtggctggctgggggaaaacgtccatcaataccactgaaggatctgctctcttagaagaggctgaattgatcatccaggaga

SEQ ID NO: 6058 - DNA, 316 bp, Mus musculus
cctttgttcaggaatgttttccaattgtaccaaacagttctgtttgaataccactagccaaaacctggtcagagccttccctaactgcacagatgggaaatgcagctttcattccaggtagtcctgtgcccaggaaaaagaggaaaaacaaaatacataattgaggtatgtggagctcatagtctatactaaggatggttaatagattgttttgtttttatttctgaagaaagtggctttattttactttttatgaaatagttacaaatgttgaaagtagctcatgagctctcttcccctgatgtcaagtcatgaa

SEQ ID NO: 6059 - DNA, 390 bp, Mus musculus
  misc_feature (156)..(157): n is a, c, g, or t
  misc_feature (161)..(161): n is a, c, g, or t
  misc_feature (316)..(316): n is a, c, g, or t
actgcccttcacctcagggatgatagaacttctcagcttcctgaggatgaataaggacagatttgactgcatcatcatttcggattcaaattccatcttcatagactgggttctagaagctgctgcctttcacgatgtctttgatcacgtgtttanncaantccagcatcctttgatagcagtggtcgtctcacagtgaaaaattaccatgctcattcttgcactaggtgcccaaagaatctttgcaaaaatacagttttgggagaatttatagataaacagttacaaaagggcgtgagatatacacggattgttnatataggtgatggtggaaatgatgtctgcccagtaacttttttaaagaaaaatgatgttgccatgccacgggaa

SEQ ID NO: 6060 - DNA, 529 bp, Mus musculus
  misc_feature (76)..(76): n is a, c, g, or t
  misc_feature (273)..(273): n is a, c, g, or t
  misc_feature (383)..(383): n is a, c, g, or t
  misc_feature (396)..(396): n is a, c, g, or t
tcatgccgtggcttcaggcaacaagctgtatgtggtgggaggctactttgggacccagaggtgtaagaccctggantgctatgaccctacttcagacacatggaactgcatcaccactgtgccctactctctcattcccacggcctttgttagcacctggaagcatctgcctgcatgaaaggcacctttggagcccagccaggtgagccctcaggagggctggaaccctctgacttatctctgctcttggcaatgattatcacatctcccagngagggtctgatgagcatcagggtaatgggatttagggacagacggtctgttcatatcttaccagttatgggtttgtcagtgggagaggtagtgtctgtcttctgtgtgcngtggagggatganggcccatgtaaaccagcagccattctgacgaagtgaggtctaatgaagtgacgtggctgttctgatcctcagacggggcctaccacaggacaggtgtctgtgagccccgctgctgttgtcagtgctgtgagta

SEQ ID NO: 6061 - DNA, 458 bp, Mus musculus
  misc_feature (269)..(269): n is a, c, g, or t
  misc_feature (312)..(312): n is a, c, g, or t
  misc_feature (376)..(376): n is a, c, g, or t
  misc_feature (378)..(378): n is a, c, g, or t
tgcggtgatcgagcgcttccgagaaggcaaagagaaggttctggtgaccaccaacgtgtgtgcccgtggtatcgatgttgaacaggtgtctgtcgtcatcaattttgacctccctgtggacaaggacgggaacccagacaatgagacctacctgcaccgcattgggcgcactggccgctttggcaagaggggtctggcggtcaacatggtggacagcaagcacagcatgaatatcctcaacaggatccaggagcattttaataagaagnatagaaagactggacacagatgatttggacgagattgagaaantcgccaactgaggcgctcgcttctccatgggctggcgccaccctcagcgctccctgcctgggantntagtgctttcatggcataggcctgacgggcccctcagagaccacgggctgagtagagactacctacctcattcggaatta

SEQ ID NO: 6062 - DNA, 221 bp, Mus musculus
  misc_feature (68)..(68): n is a, c, g, or t
  misc_feature (183)..(183): n is a, c, g, or t
caggaaaggtgtactcgggcatctcccagtgcttgcgtgaagagctgcgctctgctgcctgcaccccncacgcagtgagtgcacaggactgcggagaccttaacaacagatggagaatgccacgtttctcgcactatattcacacaaaaaaatggaagaacgtatctctcagttttcaagatntctggctaaagtttcgcagatgaactgtagagtacgtt

SEQ ID NO: 6063 - DNA, 345 bp, Mus musculus
  misc_feature (236)..(236): n is a, c, g, or t
acatccgagctgatgtgtggagcctgggcatctcactggtggagctggcaacaggacagttcccctataagaactgcaagacggactttgaggtcctcaccaaagtcctacaggaagagcccccactcctgcctggtcacatgggcttctcaggggacttccagtcatttgtcaaagactgccttactaaagatcacaggaagagaccaaagtataataagctacttgaacacagnttcatcaagcactatgagatactcgaggtggatgtcgcgtcctggtttaaggatgtcatggcgaagaccgagtccccaaggactagtggagtcctgagtcagcaccatc

SEQ ID NO: 6064 - DNA, 461 bp, Mus musculus
  misc_feature (401)..(401): n is a, c, g, or t
tttcaggcttgcagggcctctctggccagcaaggcatccctgggaaaactggcctacagggaccaaagggcatgagaggactggagggacctgctggcctgccaggaccacctggccccagggggttccagggcttggcaggggccaggggcaccaatggggagcgaggagccccaggagctgtgggtcccacaggtctaccagggtccaaaggtgaacgaggagagaagggagagccacagtcccttgccaccatcttccagctggtgagccaggcctgcgagtcagccatacggagtgagcctgtgactatcagccacacaagcaaccctagactgcaggaggtgcagaccccagaatccctggagtgagcaggatcttccctccgccacttcaaattnccctggccttccccagcaccatcatccataattttgtctcagcactaagaacaactgtgt

SEQ ID NO: 6065 - DNA, 398 bp, Mus musculus
  misc_feature (220)..(220): n is a, c, g, or t
tgtgggtcccacaggtctaccagggtccaaaggtgaacgaggagagaagggagagccacagtcccttgccaccatcttccagctggtgagccaggcctgcgagtcagccatacggagtgagcctgtgactatcagccacacaagcaaccctagactgcaggaggtgcagaccccagaatccctggagtgagcaggatcttccctccgccacttcaaattnccctggccttccccagcaccatcatccataattttgtctcagcactaagaacaactgtgtgctggaggggcagagaaggaaacccagaggaagaccccgaggtggcaggagctggaagggaggagggcggtgctcctccttcaagccccttctttgtagcacttctaggttcagataa

SEQ ID NO: 6066 - DNA, 549 bp, Mus musculus
  misc_feature (219)..(219): n is a, c, g, or t
  misc_feature (275)..(276): n is a, c, g, or t
  misc_feature (281)..(282): n is a, c, g, or t
  misc_feature (288)..(288): n is a, c, g, or t
  misc_feature (298)..(298): n is a, c, g, or t
  misc_feature (300)..(300): n is a, c, g, or t
  misc_feature (302)..(302): n is a, c, g, or t
  misc_feature (310)..(310): n is a, c, g, or t
  misc_feature (312)..(313): n is a, c, g, or t
  misc_feature (319)..(319): n is a, c, g, or t
  misc_feature (323)..(323): n is a, c, g, or t
  misc_feature (334)..(334): n is a, c, g, or t
  misc_feature (347)..(347): n is a, c, g, or t
  misc_feature (377)..(377): n is a, c, g, or t
  misc_feature (387)..(387): n is a, c, g, or t
  misc_feature (399)..(399): n is a, c, g, or t
  misc_feature (421)..(421): n is a, c, g, or t
  misc_feature (437)..(437): n is a, c, g, or t
  misc_feature (444)..(444): n is a, c, g, or t
tgcatggacacccttcttaatacaacctggaagtgatcggaggacttgggagggaccccgcctccattccttttctgcatcccaagcctgttgttggtcctgggtcccagtacagccctctgccttccctgtctcccagaatggtgagaccctgagatgagttgaagggggtcctgcgtgcatctgagtgaaccccaccaggacacacagtggacagtncggacctcaaaaggggtagctcaggcaggatgagtttcgtctgtaattattatttnnttttnnattttntttctttttntnanaattaaancnntctatncttntacatgatggnctgtgtacacacnagaagcctggtgagggctacactgtatcancctaattctnatccattttcantcaaggtcgagaaccaaggaancaagagcagagagagncctgatncccacccacttttttttagactgttttcttactggcttgtactaccttgcactcctctttattcttaaagtagggctggagagattgtccagctgtttaaggcaa

SEQ ID NO: 6067 - DNA, 544 bp, Mus musculus
  misc_feature (107)..(110): n is a, c, g, or t
  misc_feature (112)..(113): n is a, c, g, or t
  misc_feature (115)..(116): n is a, c, g, or t
  misc_feature (118)..(120): n is a, c, g, or t
  misc_feature (122)..(124): n is a, c, g, or t
  misc_feature (167)..(168): n is a, c, g, or t
  misc_feature (187)..(189): n is a, c, g, or t
aataacaggacaacgcccatctggtccatccctcggtccactctggagtaccaagcttctaaccggctgaagcaactggctaccccgaaggttcgcaataacatctnnnncnntnncnnntnnnaggtttcccaagtctccagagcagcccagatggcagtcccgannccacggacgcttcggctgnnngcaaagcccaggcccccagccactctgttggaagagtgggaccctatgccaaaacccaagccttacgtgtcagactataaccgccttcttcagctggcaacacccaaggccctgtcagaaaagtgcgttcctgatcgcagtcctcagtgggaggtcctggatgtcaccaagaacgcggtggccagttcacggatcatctccctggcccagcccaaaattcgaaaggacctcaacgagggctacaacccatactacatctccccagcctctctggtggctcaggcatctcctcgaatttatgagcttgccacccccaaatacatcaccaagaaagtgtgacaaccaagccttctct

SEQ ID NO: 6068 - DNA, 511 bp, Mus musculus
agcactcagttgttcccagtcaaatatttgagctagaggatggtacgagcagctacaaagattttgcaatgagcaaaaataatcgctttacaagtgctggacaagcatctaagaatataatccagccaccgtcatgtgtgctgcattattacaatgttccgctgtgtgtcacagaagagaccttcacaaagttgtgtaacgaccacgaagttcttccgttcatcaaatataaagtgtttgacgcgaaagcttccgcgaaaactctgtctgggctattggagtggaagtgcaaaactgatgccgtggaagctctcactgcgctcaatcactaccagatacgagtcccgaatggatccaacccctatacgttgaagctttgcttttctacatcatcccatttataagaagagaagagcatgttagaatttatgttcatctttattgcagttttaaagctatacttcatccataataatctaaaatggttggtctaatgttgccttgcttacta

SEQ ID NO: 6069 - DNA, 341 bp, Mus musculus
ttgagcatgcgcacagcctcgcagacaacgtgcagcccatcagcacggaaactacagcgacaaattctgataacccagggcagtagatctccttccaggcccagggcttgtgacttgaacatgagaggtgtgaccaccctgcaccccttgcttcagtggctgaactcggtctccttccattggaggttgttttctaggctcaacactgaacagctgattagccatgtaatttatctggtcttaaatgataatggatttttgaagcactaaaaggatttagggtttatcgttaaaacaaaattcctggactttaatattcttaataaatcctcacttcccca

SEQ ID NO: 6070 - DNA, 396 bp, Mus musculus
gacctccacggcctggatgccagtatcgtggccctcactgccaaggtgcagagcttacagcagagctgccgacacatggaggccgagctgaaggaattaacaagtgcgctgaccactcctgagatgcagaaagagattcaggagttaaagaaggagtgtgctcaatacacagagagactgaagaacatcaaagcagctaccaaccatgtcactccagaagagaaggagaaggtgtacagagacagacagaagtactgtaaagagtggaggaagcggaagaggatgaccacagagctgtgtgatgcgatccttgaaggctaccccaagagcaagaagcagttctttgaggaagttggaatagagacagatgaagatcataatgttttgctccccgac

SEQ ID NO: 6071 - DNA, 345 bp, Mus musculus
  misc_feature (116)..(116): n is a, c, g, or t
tggaacaaagtatcagccggcttgaggggcaggtgctgaggtacaaaactgctgctgagaatgcagagaaaattgaagatgagctgaaagcagaaaggaggaagctacagcgaganctacggacggcacaggacaagatagaggagatggagatgaccaacagccacctggctaagcggctagagaagatgaaagccaacaggacagcccttctagcccagcagtaggaggcggcccttctacctgggtgctgctgaggaccttgccgggagatgctgactcttttgtacattgacacaagccccttcaagtactgttttgagtcttgtcattaaacagccacct

SEQ ID NO: 6072 - DNA, 528 bp, Mus musculus
  misc_feature (290)..(290): n is a, c, g, or t
  misc_feature (337)..(337): n is a, c, g, or t
  misc_feature (371)..(371): n is a, c, g, or t
  misc_feature (394)..(394): n is a, c, g, or t
  misc_feature (396)..(396): n is a, c, g, or t
aagattcatatcctggcgggagcattgatagtggcaacaaggaaagggctgaacccatccctgtacggccctacattgcaagtgcttaccgctccaagtctccacggtggccatttttcttgatcatccctttctacgttgtgatccttgtcctgattgggatgctggtaaaagtctattcccaaaggatgaaatggagaatggatgacttctcaagcgaagagcaatttgaaagtgaaagtgaatccaaagactagtctggacagattccacaatgtcacaagtaattntcttcagtggacagaaaaaaaagtggaaaagaaaagcctatgcattntcttgcctgaaagtcaagcctgcatatcgtggtntccatcaggccagaaatcatatntntccattacacatgtatgatacatatgtgtgtatattattccataaatgatttacttgtaagaaatgaatgattatgaatttcatattatactttgatattttaccctatttctggtagtcggtagtcatcaa

SEQ ID NO: 6073 - DNA, 379 bp, Mus musculus
  misc_feature (26)..(26): n is a, c, g, or t
  misc_feature (157)..(157): n is a, c, g, or t
gaagtaccaagccaattgtcctacangcttgcactgtcagactccacccttcccttggtgatcttaagagtgaagaagggggccaagcctggcctttgccccacatgggctgcaggtacaaacgtaaggcctaaggttattaagtgacactgaggangtagggaccaacaggtggcctacaatgcaacatatgtaccatctagcactctggagatacacacttcactgtaactgagattctgagggactcaatgccttaagatatattcgtgtcaaggaccaaagcagggcaggataggaagactgatgtcaaggttggagcgcatacaccaagaaagcagctaggtcaaatgtctgaaatgcttcaaagtggtctgga

SEQ ID NO: 6074 - DNA, 292 bp, Mus musculus
  misc_feature (26)..(26): n is a, c, g, or t
  misc_feature (34)..(34): n is a, c, g, or t
gggcaaggcatatgaggaaagttctngaagggcncagtgaaattagtgtaccgaatagggagcaactgatcctgggaagctaggtaataattcaaaagtcttatgttgccatctcctgtagttgcccttcagttctatgaagtttgactatacgtgtcaaacctcagtgactaagcaaatgtaatttgtgaaagtccagatattttcaaagttgccaaacagtgtttaaaactgttcaagaaatttgtatggaaaattagttggtgaaagtttggagctccagtacttccca

SEQ ID NO: 6075 - DNA, 453 bp, Mus musculus
  misc_feature (205)..(205): n is a, c, g, or t
gttcccaggtacaacaaacgctcattagatgataacaaattaattcccaggaggcccctcccggcagagctttcccaggggccctggcagccttggccagggagagagagtgagggcaagagactggggaagggaaaagaaaggaggcagaaatccggatgggggcagcgagagtggggcgaaatggtctctaagcccgctaggncctttccctggtccatcacctgcacaagggaggctacaaaccttccagcctgacttgaggctaagagcatcaggaagatggggtgtggggtggttgggtcaggggcagccaagctgctagggggtggggggagagactaatatagtgaatgtagttatagctaagacttaactggggaaaggatgcccggctcactgggaacactggggccaggaaggggacaagccctaggcccctgtctatactag

SEQ ID NO: 6076 - DNA, 215 bp, Mus musculus
agggacccagtgctagcagcagcaaagctagcagcgtcctgaagaagctgtgccagggccgcagaccaccccccagcagcacaggcacggtgggggacctgggcatagtgaggagaaagtctcgagacgttccagaaagtcctcagtgtgcagcagacaactccttgtcagaagaacaaagaaggccaccaggaaccacccagggtagcaagaca

SEQ ID NO: 6077 - DNA, 550 bp, Mus musculus
  misc_feature (403)..(403): n is a, c, g, or t
  misc_feature (443)..(443): n is a, c, g, or t
  misc_feature (469)..(469): n is a, c, g, or t
  misc_feature (471)..(471): n is a, c, g, or t
  misc_feature (473)..(474): n is a, c, g, or t
  misc_feature (481)..(481): n is a, c, g, or t
gaaggagcccttctctgaatacagctttctgaaatgcccaatgctttgtgaagagtgttgtcttcacgaatccccttgtgactctgataaaagacagaaactcttggcagacatcagagcagatgaagaaattttgagagaaacacgcaggccgggtcggtctcctaggcgcaagtcaccgggaagaagctcgaacccaaagcccaggcctcatgaatgcagcccaccgatgcccaccgcgtcttcccgagggcgggagcaagccatcagaaggagtgaaaaggccaggatgagagaatattggcaagaactggaggaacaagaggaaaaactgcagaagaggccgatgttgtttgaaagagtcacccaggttgtgtttattggttagggccatcaccagctntctgtttctcagtacttctggcctccacctttgtgctccntcttacggtgtcctacagttgccaananannatgtttntggggcggcttcatccagtccaccaagaaagtaatttcacttaagatgtgacaacgcttgtagctcaat

SEQ ID NO: 6078 - DNA, 478 bp, Mus musculus
  misc_feature (362)..(362): n is a, c, g, or t
gctagttatatcagctctgcacaactagatcagccagaccctggagcagtcgcagctgctgccatcttccgtgccatcctggaggtcttgcagacgcagggagcatgactgcttttctcctcctcagctcatttgttactttgtcttgccttcagatggtcacctccctccctccctccttccctcccccttcccccaccctccccctaacacccaacctctgcatggaacaggacatccttcaccacaccttcagaactgttccatgaagatcgtatctggctaggtgggtcacatgtccgggcagcactgttcttcccctcctcaggatgaggagtccctcagatcttatccaccccagntctctaactgggtatacccatttcgtttcaagatttcaggcctcagcctggcagtggtggcgcacgcctttaatcccagcacttgggaggcaaaaagattctaggcctcttcctct

SEQ ID NO: 6079 - DNA, 390 bp, Mus musculus
  misc_feature (89)..(89): n is a, c, g, or t
  misc_feature (96)..(96): n is a, c, g, or t
  misc_feature (98)..(98): n is a, c, g, or t
  misc_feature (108)..(108): n is a, c, g, or t
  misc_feature (139)..(139): n is a, c, g, or t
  misc_feature (152)..(152): n is a, c, g, or t
gacccacatgtctcaggctacagaggagcctgtgcagaaagaatcagaggtgtgtcctgtgcccacaaactccccctccccaccacctntgccacntncgccaccctngcccaagattcagcccctggagccagacagnccccacaggcctncctgagaacccaaccccagctacagagaagctgtttgcaccccaggagtcagataccctcttttaccacgccccacccctttcagcaatcacatttaaaagacagttcatgtgcaagctctgccataggacattcaagacggccttcagtctttggagtcatgagcagacacacaattaaaggacctacccctttcacctatcacaaagtagcaggcccttggcttgtaaactgtgtc

SEQ ID NO: 6080 - DNA, 506 bp, Mus musculus
aatggagggatcacccctgcgggaaggccaccactcctggccacccagtactgggtcccgaggatccagctcctcttctgtgctgaggatccacgtgtgttcacacagcgcgtggtccaggccaacgctctgcgcaagtacacagaggcgctgttgatgtacaacctgtatgtggattgcatgcccaccgagggccggcgggtcatcaatgagcagagcttgagcaagataaagcagtgggctttgagcacaccgcgcatgcgcaaggggcagagcgtcctggagcatcttagctgcctggccagagaagtgaacctggactacgaacgtagcatgaacaagatcaactttgaccaaattgtctcttctaacccagagacattctcctatgtgactcttcctgaaaaagaggaagagaaggtacccaatcaaggtgagagccactggaccctggctgcccacctggccagctcaccccacctccgcctctcttgattttgttcagt

SEQ ID NO: 6081 - DNA, 469 bp, Mus musculus
  misc_feature (129)..(129): n is a, c, g, or t
  misc_feature (325)..(327): n is a, c, g, or t
  misc_feature (329)..(329): n is a, c, g, or t
  misc_feature (331)..(332): n is a, c, g, or t
  misc_feature (336)..(337): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (345)..(345): n is a, c, g, or t
  misc_feature (347)..(347): n is a, c, g, or t
  misc_feature (352)..(352): n is a, c, g, or t
  misc_feature (359)..(359): n is a, c, g, or t
  misc_feature (378)..(378): n is a, c, g, or t
  misc_feature (380)..(381): n is a, c, g, or t
  misc_feature (409)..(409): n is a, c, g, or t
  misc_feature (417)..(417): n is a, c, g, or t
  misc_feature (420)..(420): n is a, c, g, or t
  misc_feature (422)..(422): n is a, c, g, or t
  misc_feature (426)..(426): n is a, c, g, or t
gcgagagcgagaaaattgatcctgagaaagactatgccaagaaaagctatcctgagaaaagccatcctgagaaaagctatcctgagaaaagccatcctgagaaaagctatcctgagaaaagccatcctnagaaaagctatgatgaacaggctgaagctgaaaaagtaaaagaagagtcaaaagaaaaagcctacccagtttcccattcaatctcgtcccatggctccattgcagccgatactgctttccttgaaaacctggactgggagacccttgtgcatgagaacctgcctgggctaatggacatggatcaggatgaccgcannntntnncccnnanantnantnttccnatatttngagttactggaaaagcttnannataacctagaagagcgcaagaagttacnagaatttncantncagnccctgatgagttttgaagacaagtgaaggtacagtgggtgaca

SEQ ID NO: 6082 - DNA, 298 bp, Mus musculus
aagcccatggtccacggtcagaggaggtggagtctgcctcaggcctgcagctcaagggcacaccctgcaccttaggccaccatgccagcaaagtaagctgtacccgttggagccatcaaaacctagtctgaagcgagggagttggacgttctcctaggtaagggctggctccatggcctcctcagggtattctgtacccagtggtccagtgagctccatcacggtaatgagatgcaggatgcagaaagagcctcctctacctggcttatttccatttatcctgcacatgcccgagatg

SEQ ID NO: 6083 - DNA, 397 bp, Mus musculus
  misc_feature (205)..(205): n is a, c, g, or t
  misc_feature (212)..(213): n is a, c, g, or t
  misc_feature (216)..(217): n is a, c, g, or t
  misc_feature (224)..(225): n is a, c, g, or t
  misc_feature (232)..(232): n is a, c, g, or t
  misc_feature (282)..(282): n is a, c, g, or t
  misc_feature (301)..(301): n is a, c, g, or t
  misc_feature (318)..(318): n is a, c, g, or t
  misc_feature (320)..(320): n is a, c, g, or t
cagttccgaatccagttgcagaggatcagctgctggaaggtgaagatgttgaggatgcagggaatccggaaggaagtgtaaataggactctgttgggagatgtacaaaccgttccaatacagatcatagacagccgtccagtgcttgttgaagaaagtctgtctaagaaccaagttaaacaagaaaccaatgagccaacactgtntacaganncannaactttnntggactntaaaaaaatatctgctacataaatattttaagtttttcagaatttacagntctggccccttctgatttnttagtaggtggagattntntgagatggtgtatcaatcactggaccagaaatgtatgatgggcagttttgacttaaagctccaatatttgttgccaa

SEQ ID NO: 6084 - DNA, 523 bp, Mus musculus
  misc_feature (303)..(303): n is a, c, g, or t
  misc_feature (325)..(325): n is a, c, g, or t
  misc_feature (330)..(330): n is a, c, g, or t
  misc_feature (332)..(332): n is a, c, g, or t
  misc_feature (335)..(335): n is a, c, g, or t
  misc_feature (340)..(340): n is a, c, g, or t
  misc_feature (342)..(344): n is a, c, g, or t
  misc_feature (364)..(364): n is a, c, g, or t
  misc_feature (368)..(368): n is a, c, g, or t
  misc_feature (376)..(376): n is a, c, g, or t
  misc_feature (378)..(378): n is a, c, g, or t
  misc_feature (399)..(399): n is a, c, g, or t
  misc_feature (425)..(425): n is a, c, g, or t
  misc_feature (435)..(435): n is a, c, g, or t
  misc_feature (478)..(478): n is a, c, g, or t
caggcaagccctgatttgaagacaagtccccagaatggtgcctcattcccttcttctggaggttatggcccggggtccctgatagccgatgaagagtcccaggagtttgatgacctgatatttgcattaaaaactggtgctggtctcagtgtcagtgacaacgaatctggtcaaggaagccaggaaggaggcaccctgactgactcccagattgtagaactcagaaggataccaattgctgacacccacctctgagagtcccatttacactctccagtagaaagaggacaagtttcctcattnccttggcttttgtactaaactntgtangnatntacancnnngtagtagagacctgtacatngtantgagtaananagaagtgattattatgttatncattgcttagtgtttgtgcaatttanaaaagactgntataataaaagatccgatcattcctgtaatgtacaaggatatncattatccaaaaatattagttgttttttgatcatccgaacttggc

SEQ ID NO: 6085 - DNA, 327 bp, Mus musculus
aagcagccctggtaggcagtggctccagatgtggccgtgatgctatgatgtcacaaaattattctgaaactcctggccctgaagttattgtcaacaatcagtgctctacaactaacttgcagaagcagctgcaggctgtcctgcaatggattgcagcctctcaattcaatgtgcccatgctctacttcatgggagacgatgatggacaactagagaagctccctgaagtttcagctaaggctgcagagaaggggtacagtgtaggagatcttcttcaggaggtcatgaagtttgccaaagaacgacaactggatgaagccgtgggca

SEQ ID NO: 6086 - DNA, 488 bp, Mus musculus
  misc_feature (364)..(364): n is a, c, g, or t
  misc_feature (386)..(387): n is a, c, g, or t
  misc_feature (399)..(399): n is a, c, g, or t
  misc_feature (401)..(401): n is a, c, g, or t
  misc_feature (405)..(405): n is a, c, g, or t
  misc_feature (436)..(436): n is a, c, g, or t
  misc_feature (447)..(447): n is a, c, g, or t
  misc_feature (453)..(453): n is a, c, g, or t
aagcagccctggtaggcagtggctccagatgtggccgtgatgctatgatgtcacaaaattattctgaaactcctggccctgaagttattgtcaacaatcagtgctctacaactaacttgcagaagcagctgcaggctgtcctgcaatggattgcagcctctcaattcaatgtgcccatgctctacttcatgggagacgatgatggacaactagagaagctccctgaagtttcagctaaggctgcagagaaggggtacagtgtaggagatcttcttcaggaggtcatgaagtttgccaaagaacgacaactggatgaagccgtgggcaacatggctagaaagcagctgctagactggcttctcgntaacctgtaagctgagaattcnnttgactcccctncntccntcctcccccccagcagcaattccaccccagntggagccaccntcaccntcaggctggtgaactgcacaattgggatcacattt

SEQ ID NO: 6087 - DNA, 515 bp, Mus musculus
tttaaaagtcatgaaaggtgttgccgaaggactgcatacattgcatagtgctaacataattcatggatcacttcatcagaacaatgtatttgccttaaatcgtgaacaagggattgttggagattatgacttcaccaaatctgagctttctgttcaaaatcaagagtttgagacaaatgaagatggaattccaaaagtagatcagtttcatttggatgataatgtcaagtccctcctttgtagcttgatatattttagaagttcaatgactgctgagcaggttttgaatgctgaatgtttcttgcttccaaaggggaaatcagttccaatcccagaaaaagagattgaatgtactcagcatagcagagaagatgaatcaaagatggagagtctggatagatatagtgaaaagacaagaaatggtgaagccaacccttgactaacaaattaatcctttattgttgctgtatatgtcccttttaaaaactttgttctgtttgcttagtagacaaaaa

SEQ ID NO: 6088 - DNA, 527 bp, Mus musculus
  misc_feature (323)..(323): n is a, c, g, or t
  misc_feature (331)..(331): n is a, c, g, or t
  misc_feature (360)..(360): n is a, c, g, or t
  misc_feature (440)..(440): n is a, c, g, or t
  misc_feature (463)..(463): n is a, c, g, or t
  misc_feature (485)..(485): n is a, c, g, or t
  misc_feature (495)..(495): n is a, c, g, or t
  misc_feature (497)..(497): n is a, c, g, or t
gattgttggagattatgacttcaccaaatctgagagccagcgagcttcagtcaacgcgatggttggtggattgagtttgctctcacctgaattgaaaactggaaaacctccttctgcaagttcagacttatatgcttatggttgccttttcttatggctttctgttcaaaatcaagagtttgagacaaatgaagatggaattccaaaagtagatcagtttcatttggatgataatgtcaagtccctcctttgtagcttgatatattttagaagttcaatgactgctgagcaggttttgaatgctgaatgtttcttgcttccanaggggaantcagttccaatcccagaaaaagagattgnatgtactcagcatagcagagaagatgaatcaaagatggagagtctggatagatatagtgaaaagacaagaaatggtgaanccaacccttgactaacaaattantcctttattgttgctgtatatntcccttttananactttgttctgtttgcttagtagacaaaaa

SEQ ID NO: 6089 - DNA, 515 bp, Mus musculus
  misc_feature (428)..(428): n is a, c, g, or t
gaagtgtgcttcctacaaaatctctatattttcttaccttaccctctttgttcggatgcagtgggctgaaaggaactcctggtctgtgccctgttatggctgcatgctgagcggttagggtcccagacctcctcctttcctcctcccactccccgcccccgtggccccccctctctctgttttagtactctgttttccatagtggtcactgctcagtgtcacgtgcagagtgtctgtccaccatcacacctgccatccccgtgagcaagcagtctgtcgtcagctgtacatcactgccgctcccaacctcgaaaactgccacctggagactctgtgcagtgagggaggctttttctcaccaataaaccttttgcttcagggtatactcttgggttttttccaggtatattatgtatgacctttgtacnatgtatagacagagttttatttattttttaaaaaggaaaccttttcttgataaaggaatgatggtagcctagctagttcttgtaaaa

SEQ ID NO: 6090 - DNA, 543 bp, Mus musculus
  misc_feature (320)..(320): n is a, c, g, or t
agcggtccgcactcgagtggctcttcccgacaggagattcgaaggactgtgtttttgtaacactggtcgggagtgcaattttcccttctaagcagggaaagctgctgtgctaaatcattttgtaactttccgaatgagagacttcggtaaagataaactcgttcagtatttttcaaatgcatttgcattggctgtggggaaaagatggtaggaaaagaataacagtcatggtttcgtcaatgaaaagtaagactgagaaattgttggtgtggtgtgacaatatacaaaggcttacttagttttatactaaaccttttttnaaggtcttagcatttaatattcagcaaatccacacattttctaaactaccacaagctcctgaaagatagaggaacctcagtcctgaaatggtgattttttttttaaatcatgacagcattttaccatgtaattgagtaacttttggtaacaccttctgcttctttgtatgtttgtaataatggacattttaaaacataggaatgtttgctttgtacagacttt

SEQ ID NO: 6091 - DNA, 525 bp, Mus musculus
agtccctgttgaagaaggcttgccaggtgacccagtctcgaaatgccaaaaccatgaccacgtcccacctgaagcagtgcattgaactcgagcagcagtttgacttcttgaaagacttggtggcatcagtgcctgacatgcagggggatggggaggacaaccacgtggatggggacaagggtcctcgaaggggccggaaaccgggcagcagcggcaggaagaacggaggcacgggaagcaaaggcaaagacaagaagctgtccgggacagactctgagcaggaggatgagtctgaggatacagatactgatggggaagaagagacaccacagcttccaccccaagccagtcaccctcctgcccactttcagagccctccaactcccttcatacccttcacatctcccctgcctttgccaccagcaccccccggcccctcagcagccgatgcagaggatgaagaggattatgactcctagcgccctgtgcccctgtaccccagccatgctctcttctagttagtat

SEQ ID NO: 6092 - DNA, 503 bp, Mus musculus
  misc_feature (56)..(56): n is a, c, g, or t
  misc_feature (58)..(58): n is a, c, g, or t
  misc_feature (325)..(325): n is a, c, g, or t
  misc_feature (335)..(335): n is a, c, g, or t
  misc_feature (364)..(364): n is a, c, g, or t
  misc_feature (394)..(394): n is a, c, g, or t
  misc_feature (429)..(429): n is a, c, g, or t
  misc_feature (464)..(464): n is a, c, g, or t
  misc_feature (467)..(467): n is a, c, g, or t
tatctgaccctcataggctattaccagtaaccaaacaagctgctcgtagtcgtccnantctccgggtgatccctactgtgactcctgcaaagcccaaacaagaaataccagtactaggctcaatttctgtaaagcgaattcctgttcgggtgtccattccatcactcataaaatataatccaaagaagatctctgatgagaagaaccgtgcctcccagaagcagaaggttattgaagagagagaaaaactgaaaactgaacaggaagcccggcaaaagaaaatgttttatctcacgactgagttggagcggctccataaacagcnaggggagatnttgcgtaagaagcgaagggagaaggatgntcacaaagatccacttctgatggaggtgantcgacttcaggatagtattatgaaggacattcccnagctacataaagagacagaagaagcagaaaagaancantctgaactggacaaagtggctcagatcttgggaatt

SEQ ID NO: 6093 - DNA, 413 bp, Mus musculus
  misc_feature (218)..(218): n is a, c, g, or t
tctaccattccatctttccacataacactattaaaaaatatcaaactccacaaccccttattctattatttccaataattccaatttcatatagaactgataaagtagcaagtcctaagtataacactaggcagaccacccccaactttcggtctagtttccagccattaaaatgaactgctaagaacagaaataaaattgaaatgttgagagagatngttatatatgtgagtcccttgctattcacttctataggagcagatgcattcgtaaatgcagtcttaataaaccagggaagacctaggcatagcatatcaaacacattggatcccacgatgttagatatagccatgtctcctttacctgcagaagaatagcatgttgttaaaatgtgcacatcaatactatatttt

SEQ ID NO: 6094 - DNA, 503 bp, Mus musculus
  misc_feature (87)..(87): n is a, c, g, or t
  misc_feature (243)..(243): n is a, c, g, or t
  misc_feature (266)..(266): n is a, c, g, or t
  misc_feature (277)..(277): n is a, c, g, or t
  misc_feature (337)..(337): n is a, c, g, or t
  misc_feature (347)..(347): n is a, c, g, or t
agttcaaaccgcctgagtcaaatcagaaaattaatgcccgttggaccacagaggagcagcttctagcagtgcaaggtgtccgcaaanatggtaaagattttcaagctattgcagatgtaattggcaacaagactgttggccaagtgaagaacttctttgtaaactacaggcgtcggtttaacttagaggaggtattgcaggagtgggaagcagaacaaggaacccaggcttctaatgctgatncttctgctttaggggaggagacncaaagtgcttntaaggtgccgtcagggaagagcactgacgaagaagcggaggtgtgtttgtgtctggaatntgagctaatntgagctgaggagccgccccgcccttctggtggtgtgctgtgagggtgtgtgaggactagctaaatgagcataaggctgacaatacacttcctcgtgaggcgtctctgactgcttagtcataaggacatgccagcttctggtcctagcagagcgaaa

SEQ ID NO: 6095 - DNA, 176 bp, Mus musculus
cactgaacatgtgtaagattggttatttctatactgattgcctggtgccaatggttggaaacaatccatatgcaactgaagaagaaaattcaaatgaactcagtataaatactgaagtgtattccttaccgtcaaagaagctagtggtgcttcagttaaggtccatctttattaag

SEQ ID NO: 6096 - DNA, 550 bp, Mus musculus
  misc_feature (118)..(118): n is a, c, g, or t
  misc_feature (330)..(330): n is a, c, g, or t
  misc_feature (332)..(332): n is a, c, g, or t
  misc_feature (335)..(335): n is a, c, g, or t
  misc_feature (345)..(345): n is a, c, g, or t
  misc_feature (365)..(365): n is a, c, g, or t
  misc_feature (414)..(414): n is a, c, g, or t
  misc_feature (422)..(422): n is a, c, g, or t
  misc_feature (445)..(445): n is a, c, g, or t
  misc_feature (494)..(494): n is a, c, g, or t
gggaactgtggcaatgatagctctacatatagaacatgccaaattgctgatgtactctgtgggcaaattcagtgtgagaatgtgatacaacttccccaaaggagaaaccatgaaacantgcattatactcacttcagtaatatcacctgctggactatggactatcattttgggatcaccatagatgatattggagctgtgagcgatggcacagcttatgctccagaccatatatgtgttgacagaaagtgtgtcagcaagtctgttctggtaagtaactgttcaccacagttataccatatgcaaggaatctgcaataataaacaacantnccnttgtggtgtnacatggaaaccaccagactntcaaaaacgtggccatggaggtagtatagacagtggaccacctccattncctttatntcattccaaatggattgtgtacntccttattgttttagatgtgtgtattgttatcataatttatttattttntttttataagttaagcaaataattcctaaaagaaattgtgccagattcagaattgg

SEQ ID NO: 6097 - DNA, 209 bp, Mus musculus
  misc_feature (86)..(87): n is a, c, g, or t
  misc_feature (90)..(92): n is a, c, g, or t
  misc_feature (95)..(95): n is a, c, g, or t
  misc_feature (97)..(98): n is a, c, g, or t
  misc_feature (100)..(100): n is a, c, g, or t
  misc_feature (102)..(103): n is a, c, g, or t
  misc_feature (105)..(118): n is a, c, g, or t
tttggttcccactgctacttggttcccacagtttcttcatcagcatcttggaacaagagtgaggagaactgctcccgcatgggtgnncannnagngnngntnnannnnnnnnnnnnnnaggatttcatcactgggatcttggacactcatgctgcttattttatagggttgtgggatacaggccatcggcaatggcaatgggttgatca

SEQ ID NO: 6098 - DNA, 292 bp, Mus musculus
ccaacactactgcatcctgaaggatggctgcttgtacttctatgctagcattcgctctactcaggcgtcaggtggcctataccttcaaggatacagtgtgagtgaacagacccatggctttgagcaaccagtgattgaactcaagccttcatcagaagagttcaagactttctatttctgtgcagaaaataaaacagagaatcagcgctggattgcagctttgaaaacatctatcaaaaaatggcttcccctggaccaagccattcaggagttcatgagtcgacctctagag

SEQ ID NO: 6099 - DNA, 365 bp, Mus musculus
taaatgctgtatctcccggaaatctggataaagatgaaggcagcgaagtcgaaagtgagacggatgaagatctggatgattcttcagagcctcgggccaaaagggagaaaacggagctgagccaggcgttcccagtaggctgcatgcagcctgttctggagagtgctgtgcagcccagcctcctgaaccccctacacagcgagcacatcgtcacaagtacacagaccatcaggcagtgcagcgccacaggcaacacctacactgcagtctaacagcaggaaagcagagttttccagcttactctaaccccattgatactgggcttaagctgaaattttaacaagcctgaaggttgactgttgtca

SEQ ID NO: 6100 - DNA, 571 bp, Mus musculus
  misc_feature (26)..(28): n is a, c, g, or t
  misc_feature (41)..(41): n is a, c, g, or t
  misc_feature (54)..(54): n is a, c, g, or t
  misc_feature (75)..(75): n is a, c, g, or t
  misc_feature (92)..(92): n is a, c, g, or t
  misc_feature (104)..(104): n is a, c, g, or t
  misc_feature (106)..(106): n is a, c, g, or t
  misc_feature (112)..(112): n is a, c, g, or t
  misc_feature (125)..(125): n is a, c, g, or t
  misc_feature (128)..(128): n is a, c, g, or t
  misc_feature (135)..(135): n is a, c, g, or t
  misc_feature (142)..(142): n is a, c, g, or t
  misc_feature (150)..(151): n is a, c, g, or t
  misc_feature (154)..(154): n is a, c, g, or t
  misc_feature (159)..(160): n is a, c, g, or t
  misc_feature (314)..(314): n is a, c, g, or t
  misc_feature (325)..(325): n is a, c, g, or t
  misc_feature (332)..(332): n is a, c, g, or t
  misc_feature (335)..(335): n is a, c, g, or t
  misc_feature (337)..(338): n is a, c, g, or t
  misc_feature (343)..(343): n is a, c, g, or t
  misc_feature (351)..(351): n is a, c, g, or t
  misc_feature (354)..(354): n is a, c, g, or t
  misc_feature (364)..(364): n is a, c, g, or t
  misc_feature (376)..(376): n is a, c, g, or t
  misc_feature (402)..(402): n is a, c, g, or t
  misc_feature (437)..(437): n is a, c, g, or t
  misc_feature (458)..(458): n is a, c, g, or t
  misc_feature (527)..(527): n is a, c, g, or t
acacagaagcatccatccatcgaggnnngggccgccctttngttcagcccctgntcaatttcatctggtttctgntgctggccgtggacggntggcaagctggntngtcttncacggtgctgtgngancagtacnagccgtncctgcggnnggnacccnntgtacaacgagtacctcgacaggatcggacaactcttcttcggtgtgccgccaaagcagacatcctcctatggaggcttgctagggaacctgctgagcagcctcatgggctcctcagagcaggaagagggggaagagagccaggatgacagcanccccatcgagntggactnaancnncctgnccagcttnganatgtccatgnccggcaccgctnggacggattcagtgccaggctgggcncaaggccccttaccagtgggctgctgctctgtggntgaggggccatctatgcagantctgtccctatttatgtatggtggttgagggctgtgtggccaggaccaagagcaaggcccagcttctgntggccaatcgtgttccttcagatcacccacaataaagcgcagcc

SEQ ID NO: 6101 - DNA, 285 bp, Mus musculus
  misc_feature (94)..(94): n is a, c, g, or t
  misc_feature (118)..(118): n is a, c, g, or t
  misc_feature (239)..(239): n is a, c, g, or t
gcagggagaggctaggacctataccattcttctctctcctccagtatgactgaggagctggctagatggtcacacccctgctcccagcagcacnaggaactgcttggtggctcagccnaggcgcctaagtgacctttgtgagctaccggccgcccttttgtgagtgttatcactcattcctttggtcagctgatccgccgtgcctgtggacccctggatccttgtactttgtacacgtnccacacaccctggagcatagcagagctgtgctactggagatcaata

SEQ ID NO: 6102 - DNA, 280 bp, Mus musculus
cacctgggtgaccattctttgcatggcccgtctgaagacaatcctgaaacaggtactacttgtcctcggcacactcgtcatcgccatgtccttgcagatggatcgcaggggcatctggaacttgatgggaccttgcgtctttgcttttgtgatcatggcctccatgtggatataccgctgtgggcaccggggacagtgctacccaacctcctggcagcgctgggtcttctacctcctgcctggcatctccatggcttccgttggcatcgccatgtatact

SEQ ID NO: 6103 - DNA, 348 bp, Mus musculus
cacaccttgactctcaagttggcagcccagcctgaagtagagctctgacattaggagctctgcttgcaagtgtgtgagtatgtatgccatggatgtatgcctggactctgtgtgtctgtgtgtgtgtgtgtgtgtgtgtgtgtgtgtgtgtgtgtgtgtagggcaggctgttctaacctgaagatgctgaggaaggagcctgttggtgcaacctgggttggtgatccattgggtggatcaggacggaactctgtgtccccaggtctcaggagtgccatccccgggctcagctccagttccctgggctcatgctactagtgctttgggcccagtgaccatgcaccttca

SEQ ID NO: 6104 - DNA, 549 bp, Mus musculus
ttcacccctgctgataggcttcaagctgctaaacacctgcgagggcagtggcctcatcagtctgccagggagacaagtacacaccttgactctcaagttggcagcccagcctgaagtagagctctgacattaggagctctgcttgcaagtgtgtgagtatgtatgccatggatgtatgcctggactctgtgtgtctgtgtgtgtgtgtgtgtgtgtgtgtgtgtgtgtgtgtgtgtgtagggcaggctgttctaacctgaagatgctgaggaaggagcctgttggtgcaacctgggttggtgatccattgggtggatcaggacggaactctgtgtccccaggtctcaggagtgccatccccgggctcagctccagttccctgggctcatgctactagtgctttgggcccagtgaccatgcaccttcaccccaggcaggccctgtatacccctcctctatactccagcatttaatcttgtggctgctttctttttatttcccactttctctgttttataacagaaccttcagtataggttctggtaatca

SEQ ID NO: 6105 - DNA, 411 bp, Mus musculus
  misc_feature (118)..(121): n is a, c, g, or t
  misc_feature (147)..(148): n is a, c, g, or t
  misc_feature (178)..(178): n is a, c, g, or t
  misc_feature (225)..(225): n is a, c, g, or t
  misc_feature (275)..(275): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (288)..(289): n is a, c, g, or t
  misc_feature (292)..(292): n is a, c, g, or t
  misc_feature (294)..(294): n is a, c, g, or t
  misc_feature (299)..(299): n is a, c, g, or t
  misc_feature (309)..(309): n is a, c, g, or t
  misc_feature (314)..(314): n is a, c, g, or t
  misc_feature (328)..(328): n is a, c, g, or t
  misc_feature (334)..(334): n is a, c, g, or t
  misc_feature (345)..(345): n is a, c, g, or t
  misc_feature (347)..(347): n is a, c, g, or t
gtgtcagatccaaatattcctttctcagtttccccaagttttgtgatatttaatatagtaaaaagcattgtcttgagattattatggcatagtaggtttttttttttttttttttttnnnngctgctgacattgtaattagcatatnntcaacagcaattaggaaacaatgccttatntatgtgctttggggggttgaagggacaaagtagtagctgtcatctantccatttgtgtattgatcacaaacatcacagaagacatcttaaaaccttncntntnactctannttntnctaantgctatttgncaagnttttaagacagtanttttanaaacttagaantnctgactttatgtgctgtgtaaatctcacatggacactttaccaaagagcactctgcatgagtta

SEQ ID NO: 6106 - DNA, 71 bp, Mus musculus
taatgctggagtgcgaactgccgacatacagttaaggttctctcttttaaggcttgaaaatgccagaagaa

SEQ ID NO: 6107 - DNA, 186 bp, Mus musculus
aaatgacgatgctctgttgtaggatctggctgccttttagagagtctgatgctatgacacgggcacagttcgtggaaatgtggccaaggaactcgatctgtgcatcctcagaacggggcgtgcgcatcttagagactttcttttctagaaccgaagtagcttggcttcctcttgaaactggattca

SEQ ID NO: 6108 - DNA, 506 bp, Mus musculus
  misc_feature (72)..(72): n is a, c, g, or t
  misc_feature (81)..(81): n is a, c, g, or t
gatctctcctttaatcagccttatttcatatgaagaactaactgcactctgattacttgggggccgcacacntgcagtgcntccaccatggaaagttgtagacatactctgctagtttgtaattagccagctccacccgtatttaaaatcagtgttaccgaaggctttgttctcgttgtcatttgttccaagctgcagctgacagttcattattcacagcttagaggactcatttcttaggctagtataagcacatttggcatttactttcggcttactgcagtctattaattcttactctgtggttggctttaatcctttgataactgtacatttaaagtggcaaagctctaaagcgttctgagtactaaatacatttttaacttgactgtagctgcctataaactttcaggtaaaggaaaaagggaagtgcgggtagtggagattttgcttggttacgaattctaaagcaatcatttttgtgtggagcatatttccttactctt

SEQ ID NO: 6109 - DNA, 109 bp, Mus musculus
aggtacagttcaggggcactacaaaatctgtgtacattgtcttatatacctcctgaccacacctatatctgtagtatttcttgtgttagttttgaacatatgtatcttt

SEQ ID NO: 6110 - DNA, 264 bp, Mus musculus
aattcacttctgtaagaccttatgtaataaaaacactgcattttaaaaagtaacagaaatatactaaaaattacaatgtataatgaacagtgtttagacattgagaaaggaaacttaatctctgtgtccacaacaggagggttttgtgccttggttccagtcaagttgtggttttagacttctgtggcagacttcctagtcatcttctgggttccttatgctaattttcaacttcacatgtatatatgtgtttacatgctcaca

SEQ ID NO: 6111 - DNA, 239 bp, Mus musculus
  misc_feature (35)..(35): n is a, c, g, or t
  misc_feature (73)..(73): n is a, c, g, or t
cagatgaagtgagctacgctggagataactttgtncgatacacaggagataccatctccatggctcaaacacnaactgtttgcttgggaagcctacgacaaggggtctgaagtgcatctccaggcagatccgacaaaactagagctgctgtataagtccttcaaagtcaaaaaagaagacttcaaagagcagcagaaggaaagcatcctggaaaagtacggtggccaagaacacctgga

SEQ ID NO: 6112 - DNA, 531 bp, Mus musculus
ctttctctttgacatggccacaggaaagctgaccaaagccaagcgactagtagtgcatgaaggcagccctgtaaccagcatttctgcccggtcctgggtcagccgtgaagcacgggacccctctctgctcatcaatgcctgcctcaacaagctgctactctacagagtggtggacaacgaaggggcgctacagctgaagagaagcttccccattgaacagagttcccaccctgtacgcagtatcttctgccccctcatgtccttccgccagggggcctgtgtggtgacaggcagtgaagatatgtgcgttcacttctttgacgtggagcgggcagccaaggctgctgttaacaagctgcagggccacagcgcgcccgtgcttgacgtcagcttcaactgtgacgagagtctgctggcctccagtgatgccagtggcatggtcatcgtctggagacgagagcaaaagtagggttctgtcaccctgtgctgcccactgatccctcctccttcactccagtcttgcgttataaa

SEQ ID NO: 6113 - DNA, 529 bp, Mus musculus
gaagtcgttcagctacagctcacttctttcccaacacaagaggatccacacaggggagaaaccttatgtatgtgattggtgtgggaaggcattcaggaacagctcaggcctcacagtacataaaaggatccacacaggagagaaaccctatgggtgtgatgaatgtgaaaaggcatacatttcacactcaagtcttattaatcataaaagtgtccaccgtggaaagcagccctataattgtgagtgtgggaaatctttcaattacagatctgtccttgaccaacataaaagaatccacactggaaaaaagccatatcgatgtaatgattgtgggaaggcatttaatatcaggtcaaaccttaccaagcacaaaagaatccatacaggagaggaatctttaaatatggcaaatatggaaagtcatagtggcacattccagaagatgatctactatgagggagggaattctctggatgggaccagaatgcagatgcctgtgtgggaggcagagcatgccaagtctcaaaga

SEQ ID NO: 6114 - DNA, 563 bp, Mus musculus
ggctggctacgataagctctggcacccggcgtgttttatctgcagcacctgtggtgaactcctggtcgacatgatttacttctggaagaatgggaagctgtactgtggcagacattactgtgacagtgagaagccccgctgtgctggctgtgacgagctgatattcagcaatgaatatacccaagcagaaaaccagaattggcacctgaagcacttctgctgctttgactgcgaccacatcctagcagggaaaatctacgtgatggtcactgacaagcctgtgtgcaagccctgctatgtgaagaaccatgctgtggtgtgtcaaggatgccacaatgccatcgacccggaagtgcagcgagtaacgtacaacaacttcagctggcacgcatccacagagtgtttcctgtgctcttgctgcagcaagtgtcttatcgggcagaagttcatgcccgtagaagggatggttttctgttccgtggagtgtaagaggatgatgtcctaagaggagtgtaccaagccgtatggagccatagctgtccacagtggcctgcatttcatga

SEQ ID NO: 6115 - DNA, 380 bp, Mus musculus
  misc_feature (36)..(36): n is a, c, g, or t
tactaaagttcctctgggctcagatagaattttatnagaacataatggatggagaggagaagacctatggtggctgtgaaggccctgatgctatgtatgtgaaattaatatcttctgatggccatgaatttattgtaaaaagagaacatgcactaacatcaggaacaataaaggctatgttgagtggtccaggtcagtttgctgagaatgaaaccaacgaggtcaattttagagagatcccctcacatgtgctatcaaaagtgtgcatgtattttacctacaaggtccgctatactaacagctccactgaaattcctgaattcccaattgcacctgaaattgcactggaactgctgatggctgcaaacttcctagattgt

SEQ ID NO: 6116 - DNA, 213 bp, Mus musculus
  misc_feature (149)..(149): n is a, c, g, or t
tgaagtggaccgtgtaaacctggcatcagggagagaaagtacccccacccttcccaacccaccccagctcattcacaaaggacagagagagggagaaactacccattcacccagcaaagctgtgccctgccgaccaaggaaggccacanggacccaggactgttgtgggggtggtccatccacagagtgctgtgataataaacggcctggtga

SEQ ID NO: 6117 - DNA, 370 bp, Mus musculus
ggatcaaccgacagctggaggcattggagaatgacaacttccaggatgacccccatgccggcctcccccagctgggcaagaggctacctcagtttgatgatgatgcagacacaggaaagaaaaagaagaaaactcgaggtgaccactttaaacttcgcttccggaaaaacttccaggctttgctggaggagcagaacctgagtgcatctgagggccccaactacttgacagcctgtgccggccccccatctcggccccagcgtcccttctgtgctgtgtgtggcttcccatccccgtatacctgtgtgagctgtggtgcccggtactgcaccgtgcgctgcctgggtacccatcaggagaccaggtgtct

SEQ ID NO: 6118 - DNA, 162 bp, Mus musculus
atgctccatcagagcttgcttggttgcagttcccaggtctggatgcttaagtctcagtgaacttgggtctcttgcttttcagtgaggctatgctttccttcgaagcttgtttgcttccctccttttttcttcccattttggcttctgcagtacttcatttga

SEQ ID NO: 6119 - DNA, 480 bp, Mus musculus
tgggagcgtctcacagtagccgatgcattggagcctgtccagtttgaagatggacagaagatcgtggtgcaaggagagccgggggatgagttcttcatcattttagagggcacagctgctgtgctgcagcgtcggtcagaaaacgaagaatttgttgaagtgggacgactggggccttctgattattttggtgaaattgccctgctgatgaatcgtcctcgggctgccactgtggttgcccggggccctttgaagtgcgttaagttggaccggcctcggtttgaacgcgtccttggcccgtgctcagacatcctcaagcggaacatccagcagtacaacagcttcgtgtccctgtccgtctgacccgcgcctcctgtgcctcctccccagtccatgcttcactcacgcagactgctttctctccctagccgcagcgcccagtggccactgcttcacagcttcttgtctctttatactaaa

SEQ ID NO: 6120 - DNA, 398 bp, Mus musculus
  misc_feature (340)..(340): n is a, c, g, or t
agcaggcgatacacagcagcaggtcctgcgcaggagcagttccttctctaagctccgggaatccatcaggcgaggaagcgagaagctggtctcccgcctccgaggagagggcatggcaggggctgccgggatgaagagagccatgtcactcaatatgctgaacgtggatggtcccagggctgcccggacgcagctctcccagctctcaacccggcacctgagtgaggcccctcggaccctgagcatcagcacacaagatctgagcccgcgctaagtggactggctgcagaggccacagcttctcaaggatcaggaagggtgggtggtcaccctgcacccntgcctgggcagctcttgtagatcgctccctgcaattaaaggcggtgcactggtactgg

SEQ ID NO: 6121 - DNA, 572 bp, Mus musculus
  misc_feature (368)..(368): n is a, c, g, or t
  misc_feature (373)..(374): n is a, c, g, or t
agctatgacactgctcactgaacgggggaagctgcaccagctctgagctgctggccatcctctcctgagcagactgtggcaggttgcttagaagccaggaatagaggggcaggtcatcttcagtgttcttgggagtagtttccctgcagtggtggagttattcaaaagaacaaagagttggaagggagagtgatccaggcaggcctgacacagaagggtcagtgtcagaaggttcataagccattgtgtaagacaatcagtgctggccatggctcctcaccttcagtccaagggcacacaagcagctcaatatccactccaggggagaagcagggttctaagagacagagcttggggttggagcttgntctgnnccagcctctgtggacacaaagcaaaaaagcattggttttgcctgtaaaactaaggaatttaagggagcgtcacatttgtaacaacacctgtatgaaaaaaacaccttcacatcaaagctaagacaccaaagggctcaagttcaccctgcaggtgaacaccaccatctccaaggtgttcttaaaccagcccttttgttg

SEQ ID NO: 6122 - DNA, 170 bp, Mus musculus
aaattggtgacgttgtttctgtgattgatgagcaagatgggaagccgtactatgctcagatcaggggctttattcaggaccagtactgtgagaagagtgccgcgctgacatggctcattcctaccctcgccagtcccagagaccagtttgatcctgcatcatatataata

SEQ ID NO: 6123 - DNA, 449 bp, Mus musculus
  misc_feature (219)..(219): n is a, c, g, or t
  misc_feature (233)..(233): n is a, c, g, or t
  misc_feature (237)..(238): n is a, c, g, or t
  misc_feature (272)..(272): n is a, c, g, or t
gatacctgcatttcaaagagccactttccagtaactgggctaaacatttcgttgtggttcgtcgcccttacgtcttcatctataacagtgacaaagacccagtagagcgtggcatcattaacctgtctacagcacaggtggagtacagcgaggaccagcaggccatggtgaagacacctaatacttttgctgtatgcacaaagcaccgtggggtccttnctgcaagctctcantggnnaagacatgaatgactggttatatgcctttaaccnacttctggctggcacaataaggtcaaaactctctcgcagatgcccgagccagccaaagtactgagcgttctcctgagccttgctcaccttcgacagataaagaaagtgttacctctcattctctttgtgattcttgacagttattcttgtatgtaatcctgtggcttaacgactttt

SEQ ID NO: 6124 - DNA, 500 bp, Mus musculus
  misc_feature (74)..(74): n is a, c, g, or t
  misc_feature (79)..(79): n is a, c, g, or t
  misc_feature (134)..(134): n is a, c, g, or t
  misc_feature (150)..(150): n is a, c, g, or t
  misc_feature (165)..(175): n is a, c, g, or t
  misc_feature (325)..(325): n is a, c, g, or t
atatccccaagtgggaactgtttcttttaggaagagcaccatatccaattggtgctgaaaatcaaaatgagcancaacntcagtttgagagccctctgaaaggtctcaggttagatccttgcacagtcatagancttgccaagaaaagtntaaaaattaatggtnnnnnnnnnnnatcctaaagttgcgatttttcatcattcactttgggaacagaagcaggaacaaggtgctgccttccttacatgaaagtctgccacgcttagctgctcttgttcaatactagttatcagaaaatagattcctggggttgtgtgcttcctanagactcctccaagtccttaactcgaaagcattcaatatgtggccagtttgggacagcgcgagtggttttgaaaaaaaaaaatctatgagagctgggaatggctactgaattctgacaggcttatttgaagattaccaacgttgtgaaaacaaataccccttcctaaatgtcatct

SEQ ID NO: 6125 - DNA, 348 bp, Mus musculus
  misc_feature (147)..(147): n is a, c, g, or t
  misc_feature (163)..(163): n is a, c, g, or t
  misc_feature (169)..(169): n is a, c, g, or t
  misc_feature (176)..(176): n is a, c, g, or t
  misc_feature (206)..(206): n is a, c, g, or t
  misc_feature (219)..(219): n is a, c, g, or t
  misc_feature (224)..(224): n is a, c, g, or t
  misc_feature (237)..(237): n is a, c, g, or t
  misc_feature (263)..(263): n is a, c, g, or t
  misc_feature (280)..(280): n is a, c, g, or t
  misc_feature (291)..(291): n is a, c, g, or t
tggcgctactctgcctcgctaagagcaggcatgcacagctctgtgcacctggaggaggctggcattctacgggctggtccaggagggcctgatcagcagtggccaacagtatccagtgcaacaccagaacctgaggcaggagaggtntcccctccggtgggcnccggtntcaacancaacagctggacctttaaatacggaccagncaaccccaaacantccgntcccggtgagttnccagacaaattcattatcccaggatntcctgcaatcatctccntccggcaggancctgctaacaaccaaattgacaaaagcgattttataaccttcggcaaaaaggaggag

SEQ ID NO: 6126 - DNA, 408 bp, Mus musculus
atggatccacctgcccggaaagaaaaatccaaagttaaagaaccagccttcagagtggagaaggctaagcagaaatctgcccagcaggagctgaagcaaagacagagagcagagatctatgctctcaacagagtcatgacggagctggagcagcagcagtttgatgagttctgtaagcagatgcagccgcctggggagtgagccagcctgcatccccggcagaggaactggtgcctgcctttgtctgtgagctcattcccactgttaccctgagctggcccaatggagccttacagaactaatcaggacttgtggagacctctgcactgaacttcctataagtaacttccaccacactggtttctactctcagaactgccccagtgcttgctgggtagacttttcatc

SEQ ID NO: 6127 - DNA, 236 bp, Mus musculus
tggtgaagcttacccaattatcaaaggggttgcctataaggtggcatccttatttgatagtaaccagatctgtgataaggcttttgcatatttaactcgaaaccagcacacattgagccagccactgacggatgagcatctccaagcactgtttcgagttgccacaactgaaatggatcctcgttgggatgatcttgtgagagaaagaaatgattcgtaagccgttgtggtccaag

SEQ ID NO: 6128 - DNA, 460 bp, Mus musculus
  misc_feature (202)..(202): n is a, c, g, or t
gtttcagctggaaatcaagcagtctctgtgttatagaatttacagctcaaaatattgtattttttttgtttaaaaaaatcatatttagttttaacttgttagaaaagtatatttttgaagacttcattaatttatgactatacagtgcacaatgagctatgataaatattactattttcataataacttaaattttcaaaangcataaaggtaagcttatatcaatttactatttaaaattgattattttatatttatttttgtgttaagatagtcaaatcctaacgatgatttctataaatacctagaaacatgtttagaagttgacaggttttgccaaacagctagcaaaattaaatgcaaactattcagtcttagaaaatcacaataatctcaacaattagttccattttatacatcaagtattatgtctttgagtctctcaaatttctgtttatct

SEQ ID NO: 6129 - DNA, 565 bp, Mus musculus
  misc_feature (348)..(348): n is a, c, g, or t
  misc_feature (501)..(501): n is a, c, g, or t
ggcagtgtattgttacgatcccgttgaagactactggatgcatgtacaaaacacattcagccggcaggaaaactgtggtatgtctgtttgtaatggtaaaatctatatcctgggtggaagacgggaaaatggagaagccacagatactattctctgttacgatcctgcgacaagtatcatcacaggagtggctgcaatgcccaggccagtgtcctaccacggctgtgtaactattcatagatacaatgagaagtgctttaagctctaactaaacccaggatacctcacacaagaagccaacgtcaatccaagaggaaagtttttaaaacgaccacgtgagaactcaantcctttgcataaagaaataaataatcctgatgcctttctgacccaaaattccaatatttcaagcagtcataaatcctttcctgtactgggggtgggaggttggttgagtgagaccagtgctcacctttaccccagcactcagaaggcttctanacttctatacgtttgaacccagcctggtctacataacaagttctaggccagcaaaggttacaca

SEQ ID NO: 6130 - DNA, 502 bp, Mus musculus
  misc_feature (105)..(105): n is a, c, g, or t
gaggacgacattagtcacctgaatctgaatgtgtgcacaagtcacttgggttcagagaggacaggcatggtccttatggaagtgaaccttctcagtggctttagntgcatcttcagattcaattcctctgagtgagaccctgaagaaagtggaatatgataacgggaaactcaacctttatttagattctgtaaatgaatcccagttttgtgttaatattcccactgtgagagactacaaagtttcaaatattcgagatggttcagtatctgtaatggactactatgaaccaaggagacaggcagtgcgaagctacaacacccaggtgaagctgtcctcatgttacctcagtccagacaccaactgcaagtcacacacggacggagccacggactcccttcgacgttcttcgagccttctcgtcttttgctccgtccttctgtactttgtgcaacattgattatgatttatttttcaaggactccgtctaaaactagcattt

SEQ ID NO: 6131 - DNA, 505 bp, Mus musculus
  misc_feature (254)..(254): n is a, c, g, or t
  misc_feature (287)..(287): n is a, c, g, or t
aagccctactactgtaagattcgaggctgtgataaatcgtacacccacccaagctctctgaggaagcacatgaagattcactgcaagtcccccccaccttcgcctggagctcttggctactcgtcggtggggactcccgtgggtgaccctttgtcccctgtgctggacccaaccaggagtcgatccagcactctgtcccctcaggtgaccaacctcaatgagtggtatgtttgccaggccagtggggcccccanccatctccacacaccttccagcaatggaaccanctctgagtctgaagatgaggaaatgtatgggaaccctgaagtcatgcggacgatacattagaattattattaataagtgaggtagtaagtggcagtccttggaccatgtcctaacctgaaacaatgctgagcctgagacaaactggtgactcagacttgccaccgggtctaattagccctatttattcagtatgaaaccctatggtgtttgtacattt

SEQ ID NO: 6132 - DNA, 538 bp, Mus musculus
  misc_feature (55)..(55): n is a, c, g, or t
  misc_feature (140)..(140): n is a, c, g, or t
  misc_feature (503)..(504): n is a, c, g, or t
taggtgactttggtctagccacagtgaaatctcggtggagtgggtcccatcagtntgaacagttgtctggatctattttgtggatggcaccagaagtaatcagaatgcaagataaaaacccgtatagctttcagtcagangtgtatgcgtttgggattgttctgtacgaactgatgaccggccagctaccttattcaaacatcaacaacagggatcagataatttttatggtgggacgaggatacctatctccagatctcagtaaggtacggagtaactgtccaaaagccatgaagagattaatggcagagtgcctcaaaaagaaaagagacgagagaccactctttccccaaattctcgcctccattgagctgctggcccgctcattgccaaaaattcaccgcagtgcatcagaaccttccttgaatcgggctggtttccaaacagaagattttagtctgtatgcttgtgcttctccgaaaacacccatccaagcagggggnnatatggagaatttgcagccttcaagtagccagtc

SEQ ID NO: 6133 - DNA, 416 bp, Mus musculus
  misc_feature (347)..(347): n is a, c, g, or t
gaactcagccccttcagaggaggtgagcacagaggcaggccgagtggagttgctggagagagtgttccaggacctacaggtgcagaatactgtgttggtgagcccctcgctgagtggcagctatgccctgcccttcttgatgcaaaaccaccaccagctacgtggattcgtgcccatcgcacccacctacaccaggaattatgcacaggaacaattcagggctgtgaagaccccaactcttatcctgtatggggaactggaccacaccttggctcgagagtcacttcagcagctccgccacctgcccaaccactccatggtgaagctgcgtgatgcaggtcacgccngctacctccataagccagaagccttccacctcgcccttcttgccttccttgaccatttgccttgagtgg

SEQ ID NO: 6134 - DNA, 520 bp, Mus musculus
  misc_feature (173)..(173): n is a, c, g, or t
  misc_feature (218)..(218): n is a, c, g, or t
  misc_feature (417)..(418): n is a, c, g, or t
  misc_feature (478)..(480): n is a, c, g, or t
ttagaacattcatcctccatacataggaatgtttcaaacccatcagctgtaatgtcggagacagaagaaattgatgaagcactgaagatagcaggctgtaattttgaacaattaagtaatgctataaaaatgcttgatagcacacaagatcaaacaagacaagagacacacantctaacagaggctgtggagaaacagtttgatacacttcttgcttntcttgattccaggaaaaagagcttgtgtgaagaacttataaggcgtacagatgattatttatcaaaattagtaacagttaaaagctacattgaagagaaaaaaagtgatttggatgcagctatgaagatagcaaaagaactcagatctgctccttctctgaggacctactgtgacctgactcagattatccggactttnnagttaacatttgaaagtgaattgtcacaagttagttccataattccaaggaacacccctnnnttggatataaattgcagtgaggccatctgcatgttcagca

SEQ ID NO: 6135 - DNA, 427 bp, Mus musculus
aaccatgtagtccaaccaaattctcagtctgtgaaatttcactaatacagatattcatggtagattttggaaattctgaagtcctgatcatcacaggagttggtgacacacatgagggaccagagcatgatggtgaacagcatattacactaagtgacttctgtctgcttctaatgaagtctgaaccatacagtgaggaactgttgaaagacatcccacatttagcacacctgtgctccttgaaagacatcgtcccatacaattcagtaagtgagagagaaagtgattctccctcaaaggctgtggagttttagttgtgttgccagtgaagttgctgagttggtctgaaagaaccagttagccttgacaaacacattctgattatgaactattagtgccaataaaagttgccataagcctcagcttc

SEQ ID NO: 6136 - DNA, 383 bp, Mus musculus
ccccattcttggcatttgatttctaaacactgtttcttatgccttcaacaaaaagccagcaattattccatgggccctacttgaatttctctgaggcagctacacattgccctgcatggtgagttgtttttggaaattaatgaagtaactggactcacacccaagtaacaatccgggaggtcctggggtgctacagggtgtgtttgtgtcagatccacacataactcgatagagcaatttattcttgatgtatgcaattgcacattgtaattatattaacagagcacactaataaataatttgtataaattataaatattagatcttgggcacagttcttacattcttttgtgggacatttccttccccatgtagaattgtac

SEQ ID NO: 6137 - DNA, 301 bp, Mus musculus
  misc_feature (91)..(91): n is a, c, g, or t
  misc_feature (104)..(107): n is a, c, g, or t
  misc_feature (171)..(171): n is a, c, g, or t
  misc_feature (188)..(188): n is a, c, g, or t
  misc_feature (200)..(200): n is a, c, g, or t
  misc_feature (220)..(220): n is a, c, g, or t
  misc_feature (225)..(225): n is a, c, g, or t
  misc_feature (232)..(232): n is a, c, g, or t
  misc_feature (235)..(236): n is a, c, g, or t
  misc_feature (252)..(252): n is a, c, g, or t
  misc_feature (266)..(268): n is a, c, g, or t
  misc_feature (270)..(270): n is a, c, g, or t
  misc_feature (272)..(273): n is a, c, g, or t
agtcagagctgtaggaaagcaccctgactgtcaccttctcgtacccagtagaccctgtggtcctctgaaatagggattctgtggtaggtancaccgatgctgtnnnnaaatcaaacgcacatggtaaaaggtgtctcctccctttacaaccctgacgctgtccccacgctntgctgtgccagccgccngtggtggttggnttaggtctctcagagatggnctccntcgcttnccnngttctagctgcctgcncgggaaagaggccnnntnanngcgctggggccgtccacagtgtttcttt

SEQ ID NO: 6138 - DNA, 550 bp, Mus musculus
  misc_feature (147)..(148): n is a, c, g, or t
  misc_feature (172)..(172): n is a, c, g, or t
  misc_feature (174)..(174): n is a, c, g, or t
  misc_feature (234)..(234): n is a, c, g, or t
  misc_feature (249)..(249): n is a, c, g, or t
  misc_feature (251)..(251): n is a, c, g, or t
  misc_feature (262)..(262): n is a, c, g, or t
  misc_feature (264)..(264): n is a, c, g, or t
  misc_feature (268)..(268): n is a, c, g, or t
  misc_feature (274)..(274): n is a, c, g, or t
  misc_feature (290)..(290): n is a, c, g, or t
  misc_feature (323)..(323): n is a, c, g, or t
  misc_feature (328)..(328): n is a, c, g, or t
  misc_feature (338)..(338): n is a, c, g, or t
  misc_feature (446)..(446): n is a, c, g, or t
  misc_feature (469)..(469): n is a, c, g, or t
cgttttccatgtacagggcccgccactacccaccttatgcaggaggcggcggctacgtcatgtcccaggctactgtgaggcatcttcacagggccatggaggaggcagagctctttcctattgacgatgtctttgtggggatgtgcnngaggaagctgggggtgactcccananaccatgctggcttcaagacatttggaatccaacagcccctcaatcccagggacccttgtntgtacaaagggctcntnctggtgcaccntntcancccccnggagatgtggaccatntgggcgctggtgacagatgagaggcttaagtgngcagntacccacaanccctagccccgaggggtgggtggagcaacagctttagagtgactcaactcctatcaccaggagaaacaattctgaaaactggtccctggtggtcagcaggaaatgatntttatttttatgctaacaacctnatttaattaaaagtgctgaaacctggcaaacttctctagcatgtgctgaatgggagtgtcagctgccagggagccttagga

SEQ ID NO: 6139 - DNA, 391 bp, Mus musculus
gaatgtgtggtgtgctccgacaagaaagcagctgttctctttcaaccttgtgggcacatgtgtgcttgtgagaactgtgccagcctgatgaaaaagtgtgtgcagtgtcgggcagtggttgagcggagggtgcctttcatcacgtgctgtggtggcaagagctcagaagacccctctgatgaaatctcaagtgggaatatcccagtgctgcagaaggacaaagacaacaccaatgttaacgcagatgtgcagaaactgcagcagcagcttcaggacattaaggagcagaccatgtgccctgtgtgcttggatcgcctgaagaacatgattttcctctgtggccatggaacatgccagctctgtggagaccggatgagtgaatgcccaattt

SEQ ID NO: 6140 - DNA, 167 bp, Mus musculus
taactacctttcctgccttaggaagacaccttagtcaactacttggatctcctaaatatttaaggtgatctctgctcactgctaatcaatccaagcttgggggatgctctcagggattcaggatacccacagaacataaattctctttattgtttgtaccagtaggt

SEQ ID NO: 6141 - DNA, 432 bp, Mus musculus
atggagactccacggccggtcgtaagccgtcggcccttctgctgtactctgaaatgctttgtgaagttcctgcggttggtggtaactgtgacatctatgatctttttcatcgtgggacaagcccctgaaccatatatcgtcatcactgggtttgaagtcaccgttattttctgtttcctagtcttatacacgtgtggacttgacaagataatgagatctttcttttggcctttgcttgtaagtgatgaacttcaaccttaaaccttaactacctttcctgccttaggaagacaccttagtcaactacttggatctcctaaatatttaaggtgatctctgctcactgctaatcaatccaagcttgggggatgctctcagggattcaggatacccacagaacataaattctctttattgtttgtaccagtaggt

SEQ ID NO: 6142 - DNA, 425 bp, Mus musculus
  misc_feature (27)..(27): n is a, c, g, or t
  misc_feature (100)..(100): n is a, c, g, or t
  misc_feature (136)..(137): n is a, c, g, or t
  misc_feature (170)..(170): n is a, c, g, or t
  misc_feature (174)..(174): n is a, c, g, or t
  misc_feature (258)..(258): n is a, c, g, or t
gatggaggacatcacgcaaatcgtggncaactttgggctcatctgtatcactcgggctggcagtgacgctcagaaattcatctacgagtccgatgtgctntggagacatcagagcaacatccacctggtgaacgannggatcaccaatgacatctcgtccaccaagatcngganggcgctcaggaggggccagagcatccgctacttggtaccggacctggtccaagagtacattgagaagcatgagctgtacaacanggagagcgaaggcaggaatgctggggtcaccctggctcctctgcagaggaacgccgcagaggccaagcacaaccattccactctgtgacacagggcacggcgtccgcagaggctcgtctggagactcgaaactcagggaaggacttgccatcatcctgtttcatcaa

SEQ ID NO: 6143 - DNA, 390 bp, Mus musculus
gggaacatgccagtgtgcacgagtaccccggggaattgggccagcccccaggcctttaccccagcaaccacccacttggccgggcaggcaccctgcgggcgctatcccgccaagacacctttgatgctgacacccccggcagccgaaattctgcctacacggagccgggagactcgtgtgtggacatggagacagacccctcagagggcccagggcctggagaccctgcagggggaggcacaccaccagcccggcagggctcctgggaagacgaggaagactatgaggaggagatgaccgacaacaggaaccggggccggaataaggcccgctactgtgcggagggtggtgggccggttctggggcgcaataagaatgagctggagggct

SEQ ID NO: 6144 - DNA, 251 bp, Mus musculus
  misc_feature (142)..(142): n is a, c, g, or t
  misc_feature (148)..(148): n is a, c, g, or t
  misc_feature (199)..(199): n is a, c, g, or t
  misc_feature (219)..(219): n is a, c, g, or t
tctccaagctgtgagacttgcatttaagattcaaacccagactcccaagaagaaaaccattggagagtgttctctttcactcagaactcttagtacccaggaaatggagtactcgttggaaataatagcaccttcaaaaatntctgtnttgccaagcagaacttgaactggggacttgttttcaagcagtaaatagcangattcagctgcaaattcttnaggcacaataccttccaagttcatcaacacct

SEQ ID NO: 6145 - DNA, 443 bp, Mus musculus
gacaaggcacttcatgattctctgggaccgttacgttttaaaatatgcaaagacctttttttaagagaagacaaaccattataacagttcatgagtgttagctttttggcgtgttctgaatgccaaatgcctctctttgctgcatttgttatgtcagttacctttcttcttatggtggatataaaatccactgtcgtgttgcagcagatgatggcacctgtggcttgggaaggcgagcgtgctcagcttcaggggcacatgaagtgaacctggctgtatgtgcatgctcctggagtgagctacctaacaggagggggtagcacactggctactgtgtgcaggcatcatcctttctctgtagtaaaaggtgggacctcaagaattttcttcaaagtgctcatctcaaaaatctgatttttttcccagtagatggtatgctccaa

SEQ ID NO: 6146 - DNA, 331 bp, Mus musculus
gctgaaggcctgaatgaaaagctgacccccctgaagctgattgatacttggatgggaaagggagcacccaagttgagagtggctggcgttgttgccccggcccttccccgggaagacctggagagaatcgtcgcccacgccctcttgcagcagtatctcaaagaagactacagcttcacggcttacgccaccatctcctatctgaaggtgggacccagagcttgtcttctcagcaacgaagcccatgctgtcactatgcaagtgaagaagtcagcacagagcagcgttaggggtgcaccgtctgaagctcgtcaggtggaacaagtggatt

SEQ ID NO: 6147 - DNA, 482 bp, Mus musculus
atgacatcttcgaagtgcctgaaagtgttgttagtgacatggaggaagagcggagcccttcacacctcaggaagttttcctgcatgttctttggagctgtatcttgtgaacagcaagagtatgccggccaccccttggacagcctggcagtagcaagcgacagtgaggaggacgtgagtggctgagcacccatgctaacgctcagtgatagccgcgctgggcacttggctgcctgaaggccaagtggaaatggagcagactgtcccaggatgccccagactatcagtgtcactaaaatccgtgtgctactcgggggacagagctggcagcataggaatgagccatcagggcttagatgccactgtttactctgctgcagccttgacacgtcctgtgctggtccctaaagcagactttcctcagcatggggcgaggtggggcttctgtgcccgactgcagacagcaggcattccagtgtatgt

SEQ ID NO: 6148 - DNA, 246 bp, Mus musculus
aagaggatggactgcccggccctcccccccggatggaagaaggaggaagtgatccgaaaatcagggctcagtgctggcaagagcgatgtctactacttcagtccaagtggtaagaagttcagaagtaaacctcagctggcaagatacctgggaaatgctgttgaccttagcagttttgacttcaggaccggcaagatgatgcctagtaaattacagaagaacaagcagagactccggaatgacccc

SEQ ID NO: 6149 - DNA, 562 bp, Mus musculus
  misc_feature (334)..(335): n is a, c, g, or t
  misc_feature (396)..(396): n is a, c, g, or t
  misc_feature (430)..(430): n is a, c, g, or t
  misc_feature (443)..(443): n is a, c, g, or t
  misc_feature (474)..(475): n is a, c, g, or t
  misc_feature (490)..(491): n is a, c, g, or t
  misc_feature (516)..(516): n is a, c, g, or t
  misc_feature (534)..(534): n is a, c, g, or t
gaaaccaggtgtcttacttgtgaaactataagcagcaaagatgaagattttttagacctttctgttgacgtggaacaaaacacatcaattactcactgcttaagagggttcagtaacacagaaactctgtgcagtgaatataagtactactgtgaagagtgccggagcaagcaggaagcacacaagcggatgaaggttaagaaactgcccctgatcctggctctgcacctgaagaggtttaagtatatggaccagcttcaccggtacacgaagctttcttatcgcgtggtctttcctttagagctccgtctgttcaacacgtcaggagatgcgnncaaccctgacagaatgtatgacctggtcgccgttgtggttcactgtggaagtggtcccaancgaggccattatattgcaatagttaagagtcatngatttctggctgnttgtttgatgatgacattgtagaaaaaatcnntgcccaagctattgnnagaattctacggattgacatctganatctccaagaactcggangtctggctacatccttttctatcagtct

SEQ ID NO: 6150 - DNA, 559 bp, Mus musculus
  misc_feature (37)..(37): n is a, c, g, or t
  misc_feature (87)..(87): n is a, c, g, or t
  misc_feature (97)..(97): n is a, c, g, or t
  misc_feature (161)..(161): n is a, c, g, or t
  misc_feature (495)..(495): n is a, c, g, or t
agtgaccgaaggacaggccagctgtcaccctcctgtnacacctgctgcagcagcctgagcagcgactacactgcctgtcccctgtcncttgtgttgngagagctccagagcccctccaaggcttgccacctctggtggccccccagctaccagtcttgggncatggtgctggctctgctggccagggcctttgggaggcccctcggcttgaggaaggcccacctgccccaggctagataccccagtgcccaaaaccatgcatgcacagatccctggaggctggagagccagagatgcctggctgtcaggacagaaggccggtaccccaaggtcctgctctcaggctggaagagaagcctgccccagaaggccagggcagagcagctgcatgggtcaggtgacagcccaccgctcagcctcagctgctcccagtggaagagatgtgtccttactcattttggagcaggtacagtgggcaagaggtcagaccacagncaccaatcatctgccccttccctgtctccaagccatccatagccccatgtctaacctcatagtt

SEQ ID NO: 6151 - DNA, 358 bp, Mus musculus
atttccgagcagtggcagtaattcagtgctcaataccccacctaccacaccagagtcgccttcttcagtcactataacagaagctagtcagcagcagtcttctgtcacagtgtcagtgcccctgcctccaaaccaggaagaggttcgaagcattaagagtgaaactgacagcacaattgaggtggacagtgttgtgggggagctccaggacctccagtcggaggggaatagctcaccagcaggctttgatgcgagcgtgagttccagcagtagcactcagccagaaccagataacccagaaaaagcctgtacaggtcagaaaagagtgaaagatactcagggagtaggaagttcatca

SEQ ID NO: 6152 - DNA, 402 bp, Mus musculus
  misc_feature (158)..(158): n is a, c, g, or t
ccacgggtgttgtgaacatcgacgaggtggacccagagggcaggttcgtgcgccttaagaactcttcagacaaggaccagtctttggggaactggaggatcaagagacaggttctggagggtgaggacattgcctacaagttcacacccaagtatgtnctgcgggccggccagactgtcacggtgtgggcagctggcgcaggggctacccacagtcccccatcaacccttgtgtggaaaagccagaccaactggggccctggggagagcttccgcactgccctggtcagtgccgacggtgaggaggtggccgtgaaggctgcaaagcactcatctgtccaggggagggagaacggggaagaggaggaagaggaagaggcagaattcggtgaagaggacctct

SEQ ID NO: 6153 - DNA, 524 bp, Mus musculus
gctggattctagactgctgtggattcttctctcccccaacaggtaaaaactgcagcatcgactgggctacatacatcgctgatgagaggaacctgctgttgttagtgaaaattgactctgggcaattttacctagtcaactttaatacagagttcaagactctgaatatcctctacaaaataccagagtttataccagaaggtaggaccaaagggcaagggtgatttccagggtggacagtgatcagaaagagaccaggtgagcactcttctcctctcccctgcctcctcatctcctctgttgtggtcagctaaggaactagacttcttggtgctccttgatacagtgacatacaccaacactcctatgacacccaagggcttgttcttcaacacattgaacaacatgttgtacatctggggcaacttcatcctgcaaaggtaggtgtaagccatctccccagggacccaggcatacagatgcgcctggaaacacacacacacaccagtgcctgtagttcagtt

SEQ ID NO: 6154 - DNA, 371 bp, Mus musculus
  misc_feature (321)..(321): n is a, c, g, or t
aggcagagtatgtgcgggccctctttgactttaatgggaatgatgaagaagatcttccctttaagaaaggagacatcctgagaatccgggataagcctgaagagcagtggtggaatgcagaggacagcgaaggaaagagggggatgattcctgtcccttacgtggagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatttatnccagggttatccagaagcgagtccctaatgcctacgacaagacagccttg

SEQ ID NO: 6155 - DNA, 388 bp, Mus musculus
cctgagctgtggtacagcccttaaagtgaggagtcttatgtgactgttgtacctgctcccacagggctgggtatggtcgctagcagcgcaggaccaccgtgtgtgctccggctcttgggacagcactgtgaagctgtgggacatggcggctgatgggcagcagtttggagagatcaagtgtgagggggcccgggcagggggcctgggtgggtagagccctgcccagccatcaccccagccttgtgtgccgtgtgtccccaggggcaaggcggcagtgctgtgcctttcctaccaacctgatatcctggtgactggtacctatgacaagaaggtgaccatctatgatcccagaggtgagcctttaatcccagtgcgtagaaggcaaagg

SEQ ID NO: 6156 - DNA, 323 bp, Mus musculus
  misc_feature (32)..(32): n is a, c, g, or t
ccttctgctgtactctgaaatgctttgtgaanttcctgcggttggtggtaactgtgacatctatgatctttttcatcgtgggacaagcccctgaaccatatatcgtcatcactgggtttgaagtcaccgttattttctgtttcctagtcttatacacgtgtggacttgacaagataatgagatctttcttttggcctttgcttgtgtttggtttcctgacagtaacatgtactattgccgactgtgcccttatgtgccagaaacttcggtttcgtccacgtcaaccttatcagaaaaagtctactaatgacatcgatgacaga

SEQ ID NO: 6157 - DNA, 415 bp, Mus musculus
aggcacacactgctgatggcatctccatccgatttcctcgatgcacccgaatccgggacgacaaggactggaaatctgccactaacctcccccaactcaaggaactgtaccagctgtccaaagacaaggcagactttgctgtggtggctggagatgaggcaagccccactactggaggcagcagtggcgagaacgagggcactgctgggtctgctgggccctgcaagggcccccccagtaagtcctctgccagtgccaagaccaccgaacagaagctcaatagccccagtagcagaggtggcatcaaaccgattccaaagcattcccccatgaaaccaggagagaagctggctgtgaagtcttctccagtcaaagtgggaatgaagaggaaagctactgatgagaccccatgcct

SEQ ID NO: 6158 - DNA, 463 bp, Mus musculus
gatgaccgggttcttgagcttcctcctccgagctcacctccttctgctgctcaccgggatcctctttctctttggagccatggtgaccctcactggaatcagcatctacattgcgtactcagcagttgccttccgagaggcagtatgcctcctggaggagagggccctgctggatcaggtggatatacgctttggctggtctctggccctcggctggattagctttgtatctgagctgctcactggggtggtcttcctggcagcggcgcgtgcgctcagcctgagccagaggcaggaccaagccatctgagtttggccaacccaggaggcgcagggccttttggacccatctcagtggatggcaaccttttcttactcaaataccattgacagaagccagaaagccagtggtggctcgctgaggatgagtgccccctggctgctgtctttgtgctatctgggc

SEQ ID NO: 6159 - DNA, 541 bp, Mus musculus
tgcctattcaccagaatgtacactggagcctggtggtaattgatttaagaaaaagaagtattgtatacctcgattccgtgggagagacagggaagtctatctgtgagaccatcttccaatatttacaaaacgagagcaagacacgcaggaacattgagctggaccctttggagtggaagcagtacagtgtgacatcagaggagattcctctgcaacagaatgggagtgactgtggaatgtttacctgtaaatatgcagattacattgctagggaccagcctgtgaccttttctcagcaacgcatgcccaccttcaggaagaggatggtatgggcaatcctacatagtcacttactgtaacaacacccacctggttgctatggtcccctatccctgttcttttccgtctttgtttctaatatacctcaggtaggatgagttgaagagatataaaacaggtactgagctgtctcactagaggaagcccactctcttcaatatagtcctaacgtgggatttcggactgatgcactaatgccatc

SEQ ID NO: 6160 - DNA, 416 bp, Mus musculus
aggccagtacctagtcaccattgatgccctgaccccatccttggtgaacaagatgttacttctggtggtgctccttgttggggtgaccctcttcatcgcagtcctggtgatgtttgccctgcaagcctatgagagctacaagaagaaggactacacgcaggtggactacctgatcaatggcatgtatgccgactcagagatgtgagggcttctcgggaggccagcctctaccatggccgcctgttttgcctcagaccaaactaagtgcttccagatcctttcggtgcaatttcagagctgtgccagatgctagacacatttaatagctgtcagatcagctcatgatcatatcatgagaaaaccgccttttcatatttatttttctaactgatcacatacgcaggagtggccatggt

SEQ ID NO: 6161 - DNA, 376 bp, Mus musculus
ggagctgcactcattgcactatggactctactctgggcccttataggtcaagaagttctccctggtggaaatttgtttggacttgtagttattttttacagtgctttccttgggggtaaaattttagaattcattagaatacctgtagtgcctcccctcccacctctcattgggatgttactggctggtttcaccatcaggaatgttccgattatttatgaatttgtccatattcctaccacatggtcttcagctttaagaaacactgcccttactattatcctagtacgagcagggcttggactggatccacaggccttgaagcatctgaggggagtctgtctgcgcttgtcatttggtccatgcttcctagaag

SEQ ID NO: 6162 - DNA, 521 bp, Mus musculus
  misc_feature (362)..(362): n is a, c, g, or t
  misc_feature (412)..(412): n is a, c, g, or t
  misc_feature (433)..(433): n is a, c, g, or t
  misc_feature (449)..(449): n is a, c, g, or t
  misc_feature (474)..(474): n is a, c, g, or t
atatttctacaggtgggtcaggtttggtagcagtttgatgtgctgggttctgtcatctgttctgatgagaagatttttatcttctgcagtgctgatggccgggaggaaccattcaaagccactggttattttgtttttcatcaggcgattttcaagattttcatttgtttcagtattgttggttttctcttttctcttttttacactgtggtacatataagcaacttgactagtgacaaatgtacagtagttagatatcacctacatatacatttttccattttatgctctatgatctgaagaacaaaaaaaaaagctttttgacttgtataagatttatgtctactgtaaacattgcggantttttttttgttcttgttttattgacaatgctattgagtattacagtgtntagaataccatggatggcttntcttgtccacccgatntcccgtgttaccaatgtgtatggtntccttctcccgaaagtgtacttaatctttgctttctttgcacaatgt

SEQ ID NO: 6163 - DNA, 566 bp, Mus musculus
ttcagaaccataaaaccactcatacaggtacaaaagcatttgaatgtgaggagtgtgggaagatcttcaaccgtgtctccaaccttgttgcacacaggattattcatgctgacgtaaaaccatataaatgtaatgagtgtgggaaagcctttaaacgtcgctcatactatatgcaacatcagaaaattcattctggtgagagaccctttcagtgtaaggagtgtgggaaggccttcatttttctggctcacctcaatggacaccagatgattcatactggagagatggctcagcagttggagcactgactgctcttccagaggtcctgagttcaatttccagcaaccacttggtggcttgaaattatgtgtaatgggatccgatgccctctcctggtatgtctgaggacagtgacagtgtactcacacacataaaataaataaaatctttaagaaaaaaaaaaaaaaaaaagaatggctggtttggccatgcatgttgtcacagtagacaggaggctgaagcaggaaagttgcaagtacaaggctgggctccatatcaagattctc

SEQ ID NO: 6164 - DNA, 278 bp, Mus musculus
gaagacaccatcgaagaaaaacagtacatactaaaggaagccagaacactgttccagaaaaacaaaaatctcacagacccagagctgattaaacaatgcatagttgaatgcacggcccggattgagattggactgcattaccagatcccttatccacgccctatccatctgcctccaatgggtctcaccgcacgacgaggtcggggacttcaaacccaggaaaaactgagaaaactttccaaaccagtgtatctgaagtctcatgatgaagtttccta

SEQ ID NO: 6165 - DNA, 490 bp, Mus musculus
  misc_feature (118)..(118): n is a, c, g, or t
  misc_feature (151)..(151): n is a, c, g, or t
  misc_feature (182)..(182): n is a, c, g, or t
  misc_feature (220)..(220): n is a, c, g, or t
  misc_feature (223)..(223): n is a, c, g, or t
  misc_feature (240)..(240): n is a, c, g, or t
  misc_feature (256)..(258): n is a, c, g, or t
  misc_feature (334)..(335): n is a, c, g, or t
  misc_feature (346)..(346): n is a, c, g, or t
  misc_feature (353)..(353): n is a, c, g, or t
  misc_feature (417)..(417): n is a, c, g, or t
  misc_feature (419)..(419): n is a, c, g, or t
  misc_feature (447)..(447): n is a, c, g, or t
aacacgggaaaggaacacaggtctggaagaagagtggtgcggtctatgaaggggattggaagtttgggaagcgagatggttatggatccctcagtcatcctgacccagagaccggaanactcaggagagtgtattcaggctggtggaaagncgataagaaatcgggctatgggatccagttnttcggacccaaggagtattacgagggtgagtggtgtancanccagcgcagcgggtggngacgcatgtactacannnacggcgacatctacgagggccagtggcagaacgacaagcctgaaggggagggcatgttgcggctgagtggagattnntagacccaganggtgtgntgaaggaagcgttggataagctgatgaagcccgaggaagaggagggctgaggtcagccgaagcntntccgtgcccctgaacaatgctgaccttntggtatcactaacgggcgccgggcatgaccagagagggcaaat

SEQ ID NO: 6166 - DNA, 536 bp, Mus musculus
aacaggtgcttgcagatattgctaagcaggtggacttctggtttggagatgcaaaccttcacaaggacaagtttctgcgagagcaaattgaaaagtctagagatggatatgtggacatttctctcctggtgtcttttaacaaaatgaagaagctgacaactgatgggaagctaatagccagagcattgaaaagctcatctgttgtagagttggacttagaagggaccagaatcaggaggaaaaaacccctaggtgagagaccaaaggacgaggaggaacgcacggtatatgtggagttgctccccaaaaatgttactcatagctggattgagagagtatttgggaaatgtggcaatgtggtttacataagtattccacattacaagtctactggggatcctaagggatttgcctttgtggaatttgaaacaaaagagcaagcagcaaaagccattgagtttctgaacaacccaccagaagaagcacctagaaagcctggtatatttcccaagacagtgaaaaacaagcccatccct

SEQ ID NO: 6167 - DNA, 479 bp, Mus musculus
agcgccccttgtggacagtgtgagtcatcaggagtggattcaccaggagtggattcaccagctaccatgcacgaagttcccccagcccctgatgacatcagaggagagcccagaggctcaacaggactcgcaaacagcagacagaggagctgtgaccactcaaggcaccacaatgggagcagcattgctggaggactggtgaagggggctttgtctgttgctgcctctgcgtacaaggccctgttttctgggccaccagtcactgcacagcccatcgtttctgaagatcagaccacagccctgatggcccatctctttgaaatgggattctgcgacaggcagctgaacctaaggctgctgagaaaacacaattacaatatcctgcaggttgtgacagagctccttcaagtgaataacaacgactggtacagccaccgctattgaggactgaccttgtattaaataactgcctgccgctc

SEQ ID NO: 6168 - DNA, 500 bp, Mus musculus
tctgaacactagcactgggctcttaagaaatgatgttttaagagcagagatctttttttaatgtctttgatttattttttagttgtaattaggtacatcctcagagatgtactttcctcctcttgtgcaggatgtggaggactcgttccatcatctggggcatctttagagtgtatagaccacactggttatgtggcttcaagttgtaaaaattaaaatgactttaaaagaaactaggggctggtccaggatctcactggtaagactgttcttaagtaacttaagtatctttgaatctgcaagtatgtagggaaaaaaaaaaagatatattattgtgaggaaatccattgtttaaaggtgtgcgtgtgttgttgttgttttttaaagggagggagtttattatttactgtagcttgaaatactgtgtaaatatatatgtatatatatgatgtgctctttgtcaactaaaattaggaggtgtatggtattagctgcatcac

SEQ ID NO: 6169 - DNA, 135 bp, Mus musculus
tttgatggcaaaggtcagctggaacttgactttgaggtggcaggcccatgcaactggccacctcctccacccagtgaccacgacagaagggactggtagcttgaacttggaccctccagtacaggcattccactt

SEQ ID NO: 6170 - DNA, 555 bp, Mus musculus
acaagtcatctgtgtcccttgacggccaaatccccatttggagtcaggaacactgagaccttctgggcactttgtcccccttggagcctgagtaccacatgtcctgggtactgactggtacatgccccccataccctcagtacccagacaaggcagggtttaggagttgttggagcatctcaaagtgtcactacctcagtaacaggggcattttgtgcataggacaacaccagcagttatgggtgttccttctagcacactatcccttggtgacagcagtgatgactctcaacagtgtcatcctaccccagacacctcccactccacacagatcactctggactaggacatttcctgaacatttgcaagatttacagtcctgcctaggttagcggctcctttgatggcaaaggtcagctggaacttgactttgaggtggcaggcccatgcaactggccacctcctccacccagtgaccacgacagaagggactggtagcttgaacttggaccctccagtacaggcattccacttacaattctgcccttgatctag

SEQ ID NO: 6171 - DNA, 499 bp, Mus musculus
tcattttgagtcatccaccgtgagggtagaaagcacgagtgtgggcagtatttctccaggaggagcaaagctagagatctctaccaaggaggtgcccgtagtccacacggaaacgaaaaccatcacgtacgagtcatctcaggtcgatcctggggcagatctggagccaggtgtgctaatgagtgcccagacgatcacgtctgaaaccactagtactaccaccaccacacacatcaccaaaactgtgaaaggaggcatttcggagacgaggattgagaagcgaatagtcattacaggggacgctgacattgaccatgaccaggaataactcaacctgcacatgaacccagtcatgtgaactgttaggaaaaccggagcctacatggaattccctcttctaacccaactgacttctatccgtccgtggaaaattctgatccgggagagccgaccttgaccattggatgaaagactggcagagagatcttccccgaataaa

SEQ ID NO: 6172 - DNA, 382 bp, Mus musculus
ataaccagtctttctacagcaatagagaacaataccgacagcatctgaaggagaaatttaataaatactgccgcttaaatgatcacaagaggcccgtttgtagtggctggctgacaacggctggagcaaattaaataaataaaatagctctgtctttcaatgaaacactcaagatgactactgcgccttctcttttaaaaactcctaatttagtgacttctggcaaaattttaccttaaatcttaaatcaatgtgattccttgttttgggagacggtggaggtaacctcattcgtttgttctttcttcaggcttgtgtctttagtttcgtggctgcgcaggcctgcctatgatttaagccatctcttcattaaacgtttctc

SEQ ID NO: 6173 - DNA, 267 bp, Mus musculus
gaccaggtggccaggcttctacatcctacagtggaaattccacaccatgccagcatgtgctgccaccaacctaccccgagtggacgacgtgctggcctccctgcaggtctcctcccacaagtgcaaagtcatgtactacacagaagtgatcggctctgaagatttcagaggctccatgaccagcctggaatctagccacagcgggttctcacagctcagtgccgccaccacctcctccagccagtcgcaatccagctccatgatttc

SEQ ID NO: 6174 - DNA, 401 bp, Mus musculus
taagctcctggatcatacatgtgtagttaatgaagctctcctgccattcctggcttcttgttgctacagccttctttattttctgcttactctagagaaaggagatgcagaacatctgaaaaagagggacaaactgtgggaggtctgtgtctccatcctggctctcctgcctagagtcctcaggttgatgctgcagagtctacgggtgaacagagcttctcctgaggagctgcctgttgtaggccagctgcttcgcctgctgcttcagcatgtgcctcttaggtcgcacatgctgactaatgccatcctagtgcagcagatcatcaagaatatcacgactttaaagagtggcagtgttcaggagcagtggcttacagacttacattactgcttcagcgtgt

SEQ ID NO: 6175 - DNA, 587 bp, Mus musculus
gaagctgatcacaggccagcctaacatgtcagcctccgccatgatgaattacttcaagccactgacagaatggctcgtcaccgagaacaggagacatggagagacactgggctggccggagtacaactgggcgccaaacaccgctcgcgcagaaggctccaccgcagagtccaaccgcgtcaatttcctgggcctgtacctggagccacagcaggcccgcgtgggccagtgggtgctgctcttcctgggcgtcgccctgctcgtggccaccgtgggtctcgcccatcggctctacaacatccgtaaccatcacagcctccgccggccccaccgtgggccccagtttgggtctgaggtggagctcagacactcctgaggtgaccctgctggcaaggccagcagaggagtgtcccataagaaactggatgggggacatggtgtttgagtggaacataccctagctgagccttcctcctttgctgtccccatccactctgccccacccccaccccccaggcccagcccccattctctggatacccagtgtctaacaccgacttccctgcccagtctctgtgaatacaatt

SEQ ID NO: 6176 - DNA, 425 bp, Mus musculus
aaaacttcctgatgtcttccagagagactaaattatattagggattaaaagttatttatagctgggtgtggtgacatatacctgtaatcctagtacctgggaggctgagacaagtccgtgacagggcaccatttgcctaggctggatatatagcaagaccttgactcaaaataaataagtaaactatagacaaagagagacacaaagacagaatagagaaagtttgaaaagaatttttttaattctcttggtaacctggctgtcctggaactggaactcagagatccccctttgctgcctccgagtgctgggattaacggtgcgcgccaccactgcctggcaagaaaaattacaaccctgtccctggtttttttgatagtcttactggtttttaaaaccagaggtgaatgtttctattctgaact

SEQ ID NO: 6177 - DNA, 440 bp, Mus musculus
aggagcttcaccaagatgtcgtctttgaatgagaaggcttcggtgaatgagaaggagaccagtaccctctgaacctcacctgggaatgtcccccaaaggtgccacggcccagggacgcctagggacttgtctccggaagtgggagacatgccgggagcctttgggaatgctccaacgcccactgaattttgcacaaggcggctcatgttttaagtggggttcccaagtgtggacactcttccagtaaaatggcaggcaagcaacccgagcttctacaacaggagcaggggaccgactgtgactgactcagaaaagggagcatttctgaagccaagacttgagctgtgaccaacatacaggccaacatacacgatgtcgccgtgcatgccctgaacatgctgcgcagttttcgtgggtgaggaagttaccgcaaacccatt

SEQ ID NO: 6178 - DNA, 401 bp, Mus musculus
ggtttgatgagccttcttcgtgaaatgggaaaaggttatttagctttgtgttcatacaactgcaaagaagctatcaatattttgagccatctaccttctcatcactacagtactggttgggtcctatgccagattggacgggcttattttgaactttcagaatacatgcaggtaagtatacaaagatacatatatccttctagaattaatttaactttcatgcttaaggctggatcataaaggctaatatttactaatttattatataatgtttatataattattttcctagtatgtataattgtcttagttaggattactattgctgtggtgaaacaccacaaccagaagcaagctggggaggaaagaaagcctttatgttgctcacagttcatcatcaa

SEQ ID NO: 6179 - DNA, 495 bp, Mus musculus
tagtgtccgtgccatccggattgacggggcaggtaaagctgctcaggacagtgacctcgttaagcatgaagtcgatcaggagctgactgatggatttaaaaatggccagaatgcagctgtggtacaccgcttcgaatccctgcctgctggctcaaccttgatcttctataaatactgtgaccatgaaaatgcagccttcaaagatgtagccctcgtcctgactgtactgttggaggagaagacgctggaagccagtttaggcctaaaggaaattgaagagaaagtgagggatttccttaaagtcaagttcaccagctctagcactgccagctcctacaaccacatggacccagacaagctgaatgggctctggagccgcatctcccacctcgtgctgcctgtgcagcctgagaacactctgaaagcaggcagctgcttatgagggagagaagcggaaagccatctcgggtttgagcggttttgagaccttgtaac

SEQ ID NO: 6180 - DNA, 334 bp, Mus musculus
  misc_feature (189)..(189): n is a, c, g, or t
  misc_feature (288)..(288): n is a, c, g, or t
  misc_feature (302)..(303): n is a, c, g, or t
acatagttatcccttttactgatcatgatcaagttgcttgtgttaaagaaattgagcagtcaccaccaggtagtcccaaagctgtagaacccaagactaaaatatctatagagtctctgaaaactgtccaggtggaggagaattcccaacacaagtcctcagtacacgtggaggcagaagctacagttntgctctctaacactgctttagatggtcagcccgaggtacctgcagaacccctggatgcagagggctttttcaaagtagcctctgaaaattctctgcacnttgaaacggagatnnttatcataaaccctgatgatcctggccagga

SEQ ID NO: 6181 - DNA, 509 bp, Mus musculus
  misc_feature (66)..(66): n is a, c, g, or t
  misc_feature (68)..(68): n is a, c, g, or t
  misc_feature (73)..(73): n is a, c, g, or t
  misc_feature (318)..(322): n is a, c, g, or t
  misc_feature (324)..(325): n is a, c, g, or t
  misc_feature (328)..(329): n is a, c, g, or t
  misc_feature (331)..(331): n is a, c, g, or t
  misc_feature (333)..(340): n is a, c, g, or t
  misc_feature (342)..(344): n is a, c, g, or t
  misc_feature (357)..(357): n is a, c, g, or t
  misc_feature (361)..(361): n is a, c, g, or t
  misc_feature (364)..(364): n is a, c, g, or t
  misc_feature (376)..(376): n is a, c, g, or t
  misc_feature (389)..(389): n is a, c, g, or t
  misc_feature (393)..(393): n is a, c, g, or t
  misc_feature (395)..(395): n is a, c, g, or t
  misc_feature (420)..(420): n is a, c, g, or t
attctcatggcatattgcaccgggacctcacactctctaacatcttacttacgcggaatatgaacnanaaaanattgctgactttggactagcaacgcagttgaatatgccacatgaaaagcactatacactctgtgggactcctaattatatttcaccagaaattgcaactcgaagtgcacatggacttgaatctgatatttggtcattgggctgtatgttttatacgttacttattggaagaccaccttttgacactgacacagtcaagaacacattgaacaaagtagtcctggcagattatgaaatgccagcctnnnnntnncgnnangnnnnnnnnannnccttatccaccanttanttngtagaaaccctncagatcggttaantctntnttctgtgttggaccatcctttcatntcacgaaatccttcaccaaagagtaaagacgtagggactgtagaggactcaatggatagtgggcatgctacactttccacaacaattac

SEQ ID NO: 6182 - DNA, 363 bp, Mus musculus
gatgggaaagaaccacctcctgtggtgaattacgaagaagacgcgcggtcagtcacatccatggaaagaaaggagaggctatccaaatttgagtctattcgtcattcaattgctgggataattaagtctccaaagtcggtactcggatcttcaacacaggtgtgtgatgtgatctctgtgggtgagaggcccctggcggagcatgactggtaccatggtgccatccccaggatagaggcacaggaactgctgaagcagcaaggagacttcctggtgcgggagagccatgggaaacctgaatctgtatcgattcgagggcaccgggttttcaaacattccccagcttatagatcaccacttcaa

SEQ ID NO: 6183 - DNA, 465 bp, Mus musculus
tataatgcccagtgcgatgctttgcatcctaaatcaggtcatggtttttacaaagaaccaaacagagaaggaaattgaggaagttcacagtgaatatcgtaaaaagcaccagaatgcattccagcttctggtggatcaggccaaaaaagggtataagaaaactggcagagtttcacaagctgcagcgatgagaacagatgaacctacagagacactgccgtcgatgagagcagatgaacctgcagagacactgccgtcgatgagaacagatgaacctgcagagacactgccgtctgagtgtatcgcacaagaagataatgtgagcttctcagatactgtctcagtaacaaaccactttcctcagccccagctggactcgccaggcccgtcggagcctgagaggccggatgattcttctagttgtactgatattcttttctcctcggactcagactcatgcaatag

SEQ ID NO: 6184 - DNA, 272 bp, Mus musculus
ctgccacaaggtccagcctggaaagctccgagttcagtgtggcacctgcaaacaagcaaccctcaccttggcccagggcccatcttgctgggacgatgtcttaattccaaaccggatgagtggtgagtgccagtctccagactgccctggaaccagagctgaatttttctttaaatgtggagcacacccaacctcagacaaggacacgtcggtagctttgaacctgatcaccagcaacaggcgcagcatcccttgcatagcgtgcacagatg

SEQ ID NO: 6185 - DNA, 446 bp, Mus musculus
  misc_feature (201)..(201): n is a, c, g, or t
  misc_feature (268)..(268): n is a, c, g, or t
  misc_feature (276)..(276): n is a, c, g, or t
  misc_feature (289)..(289): n is a, c, g, or t
  misc_feature (298)..(298): n is a, c, g, or t
  misc_feature (302)..(302): n is a, c, g, or t
  misc_feature (315)..(315): n is a, c, g, or t
  misc_feature (317)..(317): n is a, c, g, or t
  misc_feature (330)..(330): n is a, c, g, or t
  misc_feature (332)..(332): n is a, c, g, or t
  misc_feature (346)..(346): n is a, c, g, or t
  misc_feature (358)..(358): n is a, c, g, or t
  misc_feature (360)..(360): n is a, c, g, or t
  misc_feature (373)..(373): n is a, c, g, or t
  misc_feature (375)..(375): n is a, c, g, or t
  misc_feature (382)..(382): n is a, c, g, or t
aagtggtaaagagtcccagctccctgcctgcaaagccactcgtgccaaggtcattaagctttgaaaatgttatctagatgacagcactccgtcctctccagaaaaaaacaaaacaaaacaaaactgcaaaacaaacaaaacctcaccattctgagcagaaatgaaaacttctgtcaaagactgaatgtaaatgtctccccnccagacccacatgtttgcatccagacagagaagttcaggctcaagggctttcagggtacaatgactnttggggantgggatacagccnattcagacnttcngactaagaatctntntatgcccatcctntntccggtaatgatgnatgaggctgtgntnatagacagtggantnatttgtntgatgaagaaatttttgacaaagcacagcatttggctgtggcacagccatgttcgctgttttta

SEQ ID NO: 6186 - DNA, 555 bp, Mus musculus
gattaaacagtttcaccagatgaaagtagagaaatgggcagaaggagtgacagtggagaagaaagaatgtatcaaggaacccataaaaccacctccagttccctgcaaacccacacatatggaaaaatccacagacacagaggaggacaatgtagctggaccactatttagcaacaaaaccactcagtttccatcagttcatgctgaagtacagtctgaggagacaagtgaaggagctcggggtccctctgacaaaccgactactcctaagaccgactacaccccaccctcgtcaccacctccagcgcctgtctctgccgagtacgcttatgtcccagctgacccagctcagtttgccgctcagatgttagaagatgtagctaaaaagagttcaggatctggtgacaaacgtactccctttggaagttatggtattgctggcgaaattactgtgactactgcccatgtccgcagagcagaaccttaaaagaatgctgatgctgtttgattcagcattcaaggtggagtttgtcaccatgtgaactgtatcaataa

SEQ ID NO: 6187 - DNA, 162 bp, Mus musculus
ctgctaccgctgctgttcacaccgcccgccggggatgccgcggtcatcaccggggcttgcgacaaggactctcagtgcggaggaggcatgtgctgtgccgtcagtatctgggttaagagcataaggatctgcacacctatgggccaagtgggcgacagctgc

SEQ ID NO: 6188 - DNA, 342 bp, Mus musculus
actcggaaagttagtgtctgcacggggatactgggggtaccttcccactgagcaaggcctgtatgacaaaaaacttggctagctcacttgagacagaaaccggaggacggtacagtggggatgcacctatttctttcttctctccccttccactccagtggtcatttctagaccattgctctcctgacattaaagataaccttacaccaacatgatttctaacctgtggacaaagtagatattttactggaacatgctctgtaaaatcaaagagttcttttaaaagactctatgctcaaccagctgatggagcaggaatcagtcatctttgtggattttgtt

SEQ ID NO: 6189 - DNA, 331 bp, Mus musculus
aggacaccactcagaaatgccagggcaactgaactgtggaccagggtgggctgagaaggaaatgctaaccttgtgagtctacacacccctccctgtctagcaatgaagccccgtgctctcacagaactttctgaggatgctctagttccattatctcttagagagaggagcacgcgcactgcacggggtcatactccactgagcttgttgctgtgctcaggtagttcagggaataagtaaatgctgctctctgctctcagccgatgcccctggtgggaaagaagtgggcttcaaatttccacttcacatcctcctggagcacgaagagtta

SEQ ID NO: 6190 - DNA, 256 bp, Mus musculus
agaaaatgcagacttcaaagacagaaaaagccacaacccaaaccaaaatttaaatgcttgaaattggcatcataaacaagctctctcctgacttgtattgtggcagtcggaatgcccccagaaaactgtgccaaagagtttagaaaacaaatgtacaataaaagtaaatacactcaaaaccgcaaacttcaggtaactattttgaattgcaaatgacgaaaatttaatgttgaacgatctgataaaataaccattt

SEQ ID NO: 6191 - DNA, 223 bp, Mus musculus
aaccacagctttattggcaatgagcgtccgcttatggaaggtcccgctgctttcctctaattgaatagcttcttgaacctagcccatgtttctgatcccaaaataggtgttgatgggtttgatggggagagaaacattcaggctgttgtcccttcctgcttactttcatgcctggtgcaggtttgtatgtatttaaatagacacttagctgataggtcggaag

SEQ ID NO: 6192 - DNA, 110 bp, Mus musculus
aaaagtggtaggtcgagctaacctgggaaaggtttgtgtggtttttcctcagtgcggacatttgggcgctgagcacctacctgaggccagtggcaccatctttaaagcgg

SEQ ID NO: 6193 - DNA, 57 bp, Mus musculus
cattattttctgtttcgtagtcttgtatatgtgcagacgtgacaagataatgaaatc

SEQ ID NO: 6194 - DNA, 576 bp, Mus musculus
  misc_feature (35)..(35): n is a, c, g, or t
  misc_feature (54)..(54): n is a, c, g, or t
  misc_feature (74)..(74): n is a, c, g, or t
  misc_feature (83)..(83): n is a, c, g, or t
  misc_feature (89)..(89): n is a, c, g, or t
  misc_feature (96)..(96): n is a, c, g, or t
  misc_feature (118)..(118): n is a, c, g, or t
  misc_feature (157)..(157): n is a, c, g, or t
  misc_feature (293)..(293): n is a, c, g, or t
  misc_feature (324)..(324): n is a, c, g, or t
  misc_feature (335)..(335): n is a, c, g, or t
  misc_feature (354)..(354): n is a, c, g, or t
  misc_feature (356)..(356): n is a, c, g, or t
  misc_feature (369)..(369): n is a, c, g, or t
  misc_feature (378)..(378): n is a, c, g, or t
  misc_feature (382)..(383): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (415)..(415): n is a, c, g, or t
  misc_feature (417)..(417): n is a, c, g, or t
  misc_feature (451)..(451): n is a, c, g, or t
  misc_feature (453)..(453): n is a, c, g, or t
  misc_feature (458)..(458): n is a, c, g, or t
  misc_feature (460)..(460): n is a, c, g, or t
  misc_feature (464)..(464): n is a, c, g, or t
  misc_feature (489)..(489): n is a, c, g, or t
  misc_feature (491)..(491): n is a, c, g, or t
  misc_feature (519)..(519): n is a, c, g, or t
ttgctttcaaggctagaagattattgccaaagccntacttaactgctatgatcntcatgggcgctgctgcgatntgttctttnatcganatgttanttcaattccaacacttcagagnccttaggttaaggaagtggtaactgtgacatctatgatntttttcatcgtgggacaagcccctgaaccatatatcgtcattactgggtttgaagtcaccattattttctgtttcgtagtcttgtatatgtgcagacgtgacaagataatgaaatctttcttttggcctttgcttntaagtgatgaacttcaaccttaaaccttaantaactttcctnccttaggaagacaccttantnaactacttgaatntcctaaatntttnnaggtgatntntngctcactgcttgggggatgntntcagggattcaggatacccacagaacataagttntntttantntatntaccagtaggtatggctgacctttntnttaactataaatgttatgaaatataatntggtggccggccggggtacctggaggacccatgccaagctgtgcaactgagaaataa

SEQ ID NO: 6195 - DNA, 429 bp, Mus musculus
  misc_feature (108)..(108): n is a, c, g, or t
  misc_feature (251)..(251): n is a, c, g, or t
  misc_feature (277)..(277): n is a, c, g, or t
  misc_feature (280)..(280): n is a, c, g, or t
  misc_feature (289)..(289): n is a, c, g, or t
  misc_feature (323)..(323): n is a, c, g, or t
ggatcatccagaatatttgtacagagttcaactcacagcctcgaaactgagctgggaccagacagaggatggcaaacactgtcttacggatccttgggaccatccctngccttgtgcctatgggtgggggtggaggtggggggtagggggagtttctgacagagcttgggaaaaggcgtttggtgttactattctttgccattggtggtgtgcatgcttcaaaacctaccaggtaaaaggctggctagganctctcaggttgggttcaaatactgcntcnctttgtgtncactgaagaatccacattttgacagttgttttcnaaatagttaatccagaggagagtccagctcttaggacaggaaagacctgagaggttataggaagtttgtttacatttcccattagaactctgtaattgtccataag

SEQ ID NO: 6196 - DNA, 245 bp, Mus musculus
agcaaggagccagcatatcgcctctagcaatgacagtgatcccttccaggtcagctcagtaggttctctcatgctgcctcccatggagctaagtccccagcgtttttgtaaaccttttgaagatgaatttagttgcaaaatcaagctaagcaatttccacttcaggctttgcaagcaaagagctattgctccttctcatcctggtgctgagcacagttttagacctggttagtgcccttggacat

SEQ ID NO: 6197 - DNA, 592 bp, Mus musculus
  misc_feature (248)..(248): n is a, c, g, or t
  misc_feature (270)..(270): n is a, c, g, or t
  misc_feature (282)..(282): n is a, c, g, or t
  misc_feature (288)..(288): n is a, c, g, or t
  misc_feature (318)..(318): n is a, c, g, or t
  misc_feature (346)..(346): n is a, c, g, or t
  misc_feature (348)..(348): n is a, c, g, or t
  misc_feature (353)..(353): n is a, c, g, or t
  misc_feature (358)..(358): n is a, c, g, or t
  misc_feature (361)..(362): n is a, c, g, or t
  misc_feature (367)..(367): n is a, c, g, or t
  misc_feature (372)..(373): n is a, c, g, or t
  misc_feature (384)..(384): n is a, c, g, or t
  misc_feature (492)..(492): n is a, c, g, or t
tggattccaacaggcaacagtgagcttttcttttatctttgtccctccacttcctcctcccctgccttcttagctaaagaagcctcccttgtgaggccacagtgactggggaggagccttgcctgtctgcccctccctactctgctttttagccccttggcttcccagactctcatgcagttggttgtaaattcttccaggagctgtttttctgtctacttttcaggatttaaaaaaaatttttttcnaaaactttaaaaaaaaaaaaangtttaagaagcnaattgncagagggaggaagcattgactttttttggntaattatgcttttttttttttttttttnanttttnagaanttnntctgnttttnnctgtgggtcanccgttgatacttcatcaaataaccatttctttgctgagttcaggtaaccgaggaagagccacaccctcgaaacaacaaaatcacctttaacctaactttttatatgantgtctcagttccccgtaactttgcacacaagcgtctgttcagttggattgtaactgctttttgtacttggagagagtgtgactattgaacttgaaacctt

SEQ ID NO: 6198 - DNA, 190 bp, Mus musculus
tgcagcccaagcacatgagggaggccgtccggaggttgaagtccaaggggcaaatccccaactcaaagcacaagaagatcaccttcttctaaatctaagggagactgttccagacttctcagagtcgggcttctgtcctggggctttggtggtggtgagctcgggacgcaggatgccgattttaatgttt

SEQ ID NO: 6199 - DNA, 365 bp, Mus musculus
attcattcattaactcggctacggggaccgtgccaagttcggaagaatcatcatacaggatgcttgtcaacaaaaagttaattaaagtaatgtgcgtaaaaacgttgagtgctgtaggggtttctcatccatcatacctatgcattttccaatgcatttctcctcccaggccatctgcaggtgactctgtagcagtgccttattttctaggttggctttggccatttcttggtttttatatttatcaagactgaaaaagttttacgatagcaagtaaacatttgtgactgaactattagccggaatgtggaaatgtgtattttataatgtgggaaactttgggaatatcatttttgtcctgaata

SEQ ID NO: 6200 - DNA, 516 bp, Mus musculus
ggactgttttccacgattgactgcagtatggttcaaatacgaggcaaagaagacccctggaactccatcactagcggtgccttaacaggagccatcctggcagcaagaaatggaccggtagccatggttgggtccgctgcgatgggcggcattctcctagctttaattgaaggagctggtatcttgctgacaagatttgcctctgcacagtttcccaatggccctcagttcactgaagatcactcccagttgccttccagccagttgccatcctcgccgtttggagactaccgacagtatcagtaggacttggttcccaggattcctggaaccgggtggactgtagttcggtaggatttcagaagatcaagttacagtctgtttaaagccttaggtgggacatcagcggccaagcgggccataaagagacatttagcacatttttctatttaaaagagactcagagggtgaaaaatatattgagtttatttattcttgcttggattgcatctgtga

SEQ ID NO: 6201 - DNA, 304 bp, Mus musculus
  misc_feature (54)..(54): n is a, c, g, or t
  misc_feature (124)..(124): n is a, c, g, or t
  misc_feature (139)..(139): n is a, c, g, or t
  misc_feature (145)..(145): n is a, c, g, or t
  misc_feature (170)..(170): n is a, c, g, or t
  misc_feature (216)..(216): n is a, c, g, or t
gagcccagtggcttgctgaattcaaaaagtaccttgaaaagcctataactatgnttgttataatttacccaagaacttctactctttctctgctgacattatatttatatgttattaaagaggntggttcttttaaagntttcanctagttaattttattattcagtccnagataatttatttgtaatagacataaagaatcttttgtaaatgccnagttacacccaaatattgtaccctttaataattaaacatcagtttaaagctggacactcctagtgcaggggacatgtggcctaactct

SEQ ID NO: 6202 - DNA, 180 bp, Mus musculus
ggacaagtatcctccagtcaatcgaaaatatgaatatttggatcatacggctgatgtccagttacacgcatggggagacactctggaggaagcatttgaacagtgtgccatggccatgtttggttacatgacagatactgggactgtggagcccctccgcaccgtggaagtagaaaccca

SEQ ID NO: 6203 - DNA, 453 bp, Mus musculus
  misc_feature (350)..(350): n is a, c, g, or t
  misc_feature (360)..(360): n is a, c, g, or t
  misc_feature (393)..(393): n is a, c, g, or t
cagcaacttttttagttccatgcagtgtgctggtgaagttgatcttcatacagaaaatgaggaagattatgataaatatggaatccggattagagtaaaatttcgcagtagtactcagctgcatgaattaactcctcatcatcaaagtggaggtgaaagaagtgtttctactatgctatacttgatggcacttcaggagcttaacagatgtccgttcagagtagtcgatgaaattaatcagggtatggacccaattaatgaacggagagtatttgaaatggttgtgaacactgcctgtaaagagaacacatcccagtatttcttcatcacaccgaagcttctacagaatnttccttattntgaaaagatgacagtgttgtttgtctacaatgntcctcatatgctggagccaaaccgatggaatttaaaggcttttcaaaggcgtcggcgaag

SEQ ID NO: 6204 - DNA, 517 bp, Mus musculus
  misc_feature (149)..(149): n is a, c, g, or t
  misc_feature (167)..(168): n is a, c, g, or t
  misc_feature (311)..(311): n is a, c, g, or t
  misc_feature (325)..(325): n is a, c, g, or t
  misc_feature (340)..(340): n is a, c, g, or t
caaggtcctggaaactgttgtacaagtaacaaactacatttttatttaaaaaaccaaaagcagattttctgattcatcttacagaatcttcattagactttgagccagtggaacatactagattctttaaacacctgagccttggtggncagccccaggactatttnnttttgtggtaagctgcagtatgaagcacatgcgattgtagatttggacagtgtgtgtacctgataatacttttcacagcacagtgccagtgttgtacacaccttagactttgccttataggctgtatgtacattcattttttnaaaacctttttttncaaaaactactccanctctgtgcttgttgtatgtgtgtaacccaaagacagaaattgctttttcaggcttcggtgcctctcatacaccaccttaagtctccaccccaggaaggttaccagtgtgatacccagaacttacaggtcagggtctccacagaagggcaggtgcagcaggtgcagctcataactaat

SEQ ID NO: 6205 - DNA, 382 bp, Mus musculus
  misc_feature (286)..(286): n is a, c, g, or t
  misc_feature (342)..(342): n is a, c, g, or t
aattacctgctgactactgctgaaaacgagctgggcgttgtggtggcccacagtgagtcaggtgttcagatggttcccatcagctggtgtgagatgcagtgccccaagacccacactaaagaattccgaaaagtggcccgagtacagcccgagttcctacagacctaagcccacctaccccaaagaggacttcagcacttcagctacttctaaaagtacacatataaaaaaaccatcaagatgcaatggtctttattaaggtacctgcggtcagctggcaaccatntcttgaaacaatgtgccggaaatgtattcatgctgtaatgacacccaaggcccctnccgctgctgagacagggagattgttagtgcccaagtttga

SEQ ID NO: 6206 - DNA, 361 bp, Mus musculus
  misc_feature (52)..(52): n is a, c, g, or t
  misc_feature (318)..(318): n is a, c, g, or t
accttgctctagatatgggtgaactggcactggctgaagtggcaagaagaanggcgcatgatattgatgttgagtcagtatcctctggagtcgagctcctggggcccttggacagaagagacatgctgaatgaaggttttgccagctcagctctcatgcctgaaggagaaaacaagtttccaggccttcttccttccattggttcaacacacatgcaaactcttcaacagaaaataccaaatggcccttcaagcagatgggcaattgagagaaggactgaggaagaagaggaggaggaggaggaggaagaggaggagntatgcactgactcttcaggggccaccacctggaatgcagaagg

SEQ ID NO: 6207 - DNA, 573 bp, Mus musculus
  misc_feature (65)..(66): n is a, c, g, or t
  misc_feature (206)..(206): n is a, c, g, or t
  misc_feature (321)..(321): n is a, c, g, or t
  misc_feature (336)..(336): n is a, c, g, or t
  misc_feature (344)..(348): n is a, c, g, or t
  misc_feature (350)..(351): n is a, c, g, or t
  misc_feature (353)..(358): n is a, c, g, or t
  misc_feature (360)..(361): n is a, c, g, or t
  misc_feature (363)..(363): n is a, c, g, or t
  misc_feature (367)..(368): n is a, c, g, or t
  misc_feature (375)..(375): n is a, c, g, or t
  misc_feature (380)..(380): n is a, c, g, or t
  misc_feature (390)..(390): n is a, c, g, or t
  misc_feature (393)..(394): n is a, c, g, or t
  misc_feature (396)..(396): n is a, c, g, or t
  misc_feature (399)..(399): n is a, c, g, or t
  misc_feature (414)..(414): n is a, c, g, or t
  misc_feature (428)..(428): n is a, c, g, or t
  misc_feature (441)..(441): n is a, c, g, or t
  misc_feature (479)..(479): n is a, c, g, or t
actggtccctcatctacatagacaacagggcccaaggcgcctggtacatcataccgatcctcatnntttacattgtcatccagtacttcatcttcctcaacctggtgattgctgtcctggtagataacttccagatggcgttgctcaaaggcctagagaaagtgaagctggagcaagctgcccgggtccatgagaagttgttggangactctctgacagatctcaacaaagcagacgccaatgcacaaatgaccgaggaggccttgaagatgcagcttattgagggaatgtttggcaacatgacagtgaagcagcgggtgntccacttccagttcntgcagttnnnnncnncnnnnnnannancatnnacagaantttcnttcccaagcntanntnatngatgagcttgtgganatggcatttgaggntggagacgacgantacgggaagtgaccctgaagaatactaacctgagtttntggcaagctacctacctcggtgggttgggacatggccctaatgctgctggtattatccagaaccatgttggactgaggtcccaatagagttttt

SEQ ID NO: 6208 - DNA, 441 bp, Mus musculus
  misc_feature (318)..(319): n is a, c, g, or t
  misc_feature (325)..(327): n is a, c, g, or t
  misc_feature (334)..(334): n is a, c, g, or t
  misc_feature (416)..(416): n is a, c, g, or t
gttatgatgcttttcaggctacttctgttcaaaatgtaaaagacgatattgccctctttgcatcttcataaaatgggcagacccctggttcatagggatctgggttttctgagaacctggtgtcctaggaagtggttggctttttcttttctctttttttcttttgtctggggcgtggggaaaggaacttggactgtatggagagatacagacccttcccttcctcagggaagatggagctgctgatgcatcagcctgtcactcggaatcggcaaactttactgaccactcagagccacatttgttttttgttttttnntttttnnnttttttngtaatgctcagacataaacttaacatcttgatggaagaagaataaggggaacttcaattatgatttttatccagacaatttntattacacccttctttatgacaagt

SEQ ID NO: 6209 - DNA, 305 bp, Mus musculus
  misc_feature (74)..(74): n is a, c, g, or t
aatcacatcccacctgggcaatgaggtaagatactatcagtgggaggagaccttggagaagccagaacaagccngctggcagaagagacttcaaggactccaagcctacagcagtgcaggagaacttttgagcacttcagaccttgccaagactttgaaagatcttacatcaacagacacagttgcgtctgcttcagacactcaagccaccagcattgacatcacatccgtacccacccttgagtcatcttcacatttggcaaatatgattccagaagcaggcccacagatcctttgcaaagaat

SEQ ID NO: 6210 - DNA, 510 bp, Mus musculus
  misc_feature (376)..(376): n is a, c, g, or t
  misc_feature (419)..(419): n is a, c, g, or t
  misc_feature (421)..(421): n is a, c, g, or t
  misc_feature (431)..(431): n is a, c, g, or t
  misc_feature (436)..(436): n is a, c, g, or t
  misc_feature (439)..(439): n is a, c, g, or t
  misc_feature (462)..(462): n is a, c, g, or t
tctcccatccatgaggctgctaaaagaggatatgtgaaatgcattgagtccctcgcagctcatggggccaatattgactataacatcagccatctcggaacacctctgtatgtggcttgtaaaaaccagcaagtagcctgtgccaagaagctcctagaatcaggagtatctgtgaatcaaggcaaaggcttggattctcctcttcacgtagtggccaggatgtccagtgtggagctggtgcatctgctcatggatttcggagcaaacgctcaagccaagaatgctgatggcaaacgtcctgtggacctggtgcctctggagagtcctttgatccagatcttcttgcagaatgaaggaccccagtctttgaggcagntatgccgcctgagaatccggaaatgctttggcattcggcagcntnataagatttntgagntcntcctcccggaagacctgaagcgnttccttttacacctctaattgtggagggactggattcgcaagcaactg

SEQ ID NO: 6211 - DNA, 548 bp, Mus musculus
  misc_feature (166)..(166): n is a, c, g, or t
  misc_feature (421)..(426): n is a, c, g, or t
gggtggcaccacttatgagatttctgtgtgaatcttggcgcctcccttcccccacacctctgcacctacaccaaagggcctcaggtggccaccttccttccttcaaggggctccccttctttgcatggacatttttaaaatcaccgactccatgaggatgaggttntgttttacaaaatgccatgaggttaaggagagttgggaccctgagactggagtggcacctccccctcctttgatcttttaagaccttcccttccttgatccctggaccagactcagtggacatttgtgcaattgctcgccctggagggaaccagatcatttttaaaccagaaataattttttttattattgttacggattctatttttttcctcttctccgttaccaggtgtgtgtgtacatatatatatatatnnnnnntataaatatcaaagaaattatatatctatcctgggatgggaaaacaagggagggatatatagatatatatatatatatatacataaggagggggattttattcttccctttccttagaccag

SEQ ID NO: 6212 - DNA, 375 bp, Mus musculus
  misc_feature (335)..(335): n is a, c, g, or t
  misc_feature (350)..(350): n is a, c, g, or t
catatataggaagccagaggtaccaaaaagaaagtttattttttaaaagttctaagtagagtatacttaagaaaaataagaacacatatctttatctatctatatataaagtttaaagaagagtgacacttgaaaagtgtgtctagatttattttttcatctcatttttgtaaggaaaagcaatgtgcattgtttcttcaacacacatgaccctcactttctgccagcagacataaacatacagttagtccggtgaagcctggggtagctgtggcgggtgtggacacaggacagggaggaaagaagacagacggaagggcatgtgacctttgagncaaatacctccattntcttccaatgttactaacagtgaac

SEQ ID NO: 6213 - DNA, 488 bp, Mus musculus
  misc_feature (280)..(280): n is a, c, g, or t
  misc_feature (348)..(348): n is a, c, g, or t
atgggctcaatttcccctagagactttatcgacttagtacacatcaagcactatgaaaggaacgtggacattatcagtactaaaagtgtggacttcccaggatatgctccaacttcgacttatatccgtggctttaatcatccctctggctatgtgtgttcacctctgaaggaaaacccagcctattccaagctagtgatttttgtccagacagagatgaaaggaaaattgcctgcatcggtaattgaaaagtctatgccttccaacttagtaagcttcntcctcaatgtgaaagatggcgtaaagacgtacagaattccacccatacgtgcccggcacagttcgcantcctctgtgcacaaaaagaaagaaggacattctgccattaaaccgtagcgatttcagacagcacagcctactagtaagtggagtttgttcctgcagagtactcctaagtcaacgtgaataagcctgttcagtgtctctag

SEQ ID NO: 6214 - DNA, 109 bp, Mus musculus
gacagaacgggtgagccttatggctgacgggaagatctttgtgggaagtggcagcagtgggggcactgaagggctggtcatgaactcggatatactcggtgctaccaca

SEQ ID NO: 6215 - DNA, 172 bp, Mus musculus
cctcatcaccagcacagatatcttgggcactaacccagagcccctgacacagcctgcagatggtcaggggcttcctcttcttcctgagcccttgggaaactcaacagctggagagtgcctactgctagaagctgaagggatgtcaaagtcatactgcagtgggacagaacgg

SEQ ID NO: 6216 - DNA, 490 bp, Mus musculus
  misc_feature (134)..(134): n is a, c, g, or t
gtgactatttcacccagcagggagagttccgagtagacaaagctgggtctcctactctgttaaactgccttatgtataaaatgtcatactacagatttggagaaatgcagctagattttcgcactcccccaggntttgaccgaacacgtaatgctgagattggaaataaagacattaaattcaagcatttggaggaagcttttacatcagagcactggcttgtcaggatatataaagtgaaagcacctgacaacagggagacactaggtcacaaacctcgagtcaccaacatcgtccccaaacagaagtatttgtcaaagaagactactaaaaggaagcgtggctacgttaaaaataagctagtgtttaagaaaggcaagaagacctctaagaagactgtttaaatgcgctgttctggcctcacttgcagcagtccttgagagaaccggtctttgccttctgctcatgtcctgtttcacagcaccaaggg

SEQ ID NO: 6217 - DNA, 377 bp, Mus musculus
aactttctaaaacgcatgtctgggatgatccgtctgtatgccgccatcatccagctccagtggccgtatgggaaccggcaggaggctcatcctcatggcttaaatcatggctggcgctggttggcccaggtcttaaacatggagcctctctcagatgtgacagctaccctcctgtttgacttcttggaggtgtgcgggaacgcccttatgaagcagtaccaggtccagttctggaagatgatacttctcatcaaagaggactacttccccagaattgaagccatcacgagctcaggacagatgggctctttcatacgtctgaagcagttcttggagaaatgtctgcaacgaagggagattcctgtgcccagaggctt

SEQ ID NO: 6218 - DNA, 434 bp, Mus musculus
  misc_feature (250)..(250): n is a, c, g, or t
  misc_feature (283)..(283): n is a, c, g, or t
  misc_feature (328)..(328): n is a, c, g, or t
gagctctggagcgttccttcacgttcactttgtctgaaggcaatttagagttaaaaccttctccagctctatcagaaacagcatttgcccgtctgaatgtttctactgcagtctgagaaaggtctgaaggctggttgtctggggctcagtctctaggtccagaaacagcctttgttccatgataggcacagctcctgagaagcttggacagatgaggagcgagcgcaggaagaagcctaggcagccaggnccgtctagcatccagaaagcgactcttcatgtnctcaattacaaggacattcttaaacttctgtgcttggaagaagcnaatccagatgtctagaacttgcctaagtacaaacccgatgccattgagtttcaatttttttcttagaacttgttaaaatacaagtggcaatgctcaggtgcttctg

SEQ ID NO: 6219 - DNA, 364 bp, Mus musculus
  misc_feature (274)..(275): n is a, c, g, or t
atttttgctttatgctctctggcaggattgttctgtaagcagacgaataaatagctgtgtccctcacaaagctggaatgaaccaaagtgaaaaggacggttcccaggcagcatctgtcagtatgtcagagtgctagtgcttccttctaaacaggatgaccaagtcattccagttcatcttttccatcatcctacctgcctagaactcatgtgtaactgtgatatagctaccttcccaggtatattggcaggtgtgtgtgtgtgtgtgtgtgtgnnatctcagaacacacaggtaatgtgatgtgacctatgacaactggtaatggtggattcatttacattgtttacacttctatgaccaggcc

SEQ ID NO: 6220 - DNA, 194 bp, Mus musculus
acagggttgagaggagttagaacttctgtatccccatagggcttggtagtaagtacagcactgcttcaaaatccagcccccaaaagccctgtaccctctgctagatacaggcgatccaagcaggccccttatctgtacatagtgactgtaggggacccctctagtttctgtaaatattgaatcagtgagtgaat

SEQ ID NO: 6221 - DNA, 440 bp, Mus musculus
  misc_feature (326)..(326): n is a, c, g, or t
  misc_feature (341)..(343): n is a, c, g, or t
  misc_feature (353)..(353): n is a, c, g, or t
  misc_feature (361)..(361): n is a, c, g, or t
  misc_feature (382)..(382): n is a, c, g, or t
  misc_feature (400)..(400): n is a, c, g, or t
ggttcatcgccaaccactcactaagcgccgtgatcagcttcccgatcatcactgctggtcctggacttattgctgcactttgggggatactcattttcaaggaaatacagggtctccgaaactacttactgatgatgctcgctttctgcatcatcttagctggggccttgtgcaccgctttttctaaagtgtagctgttcacggcaagagcagcagagggcagcagagggcagcagcggctaggagaaggacctctgctgcgcaagctaacactacagacagctaagctgtggcactgtgggtctctgccactctgggaatgaacngataaatggctgttnnntccaccaacntgagaacncgaagagagaccgtgtttcanttcagcgtgtgtgaaaantcttttcgatgagctattaacgaaggctggacctcgctgg

SEQ ID NO: 6222 - DNA, 474 bp, Mus musculus
  misc_feature (438)..(438): n is a, c, g, or t
aaggccccagcattcctgtatgatatctacctcaggatgactggaagaagcccaaggatgatgaaaacaatcactcgtcttcacaaagccatggtattccttgagtattttacaagtaactcttgggtttggaatactgataatgtcaatatgttaatgaaccaactaaaccctgaagataaaaagacctttaatattgatgtacggcagttacattgggcagaatatatagaaaactactgcatggggactaagaagtacgtgttgaatgaagagatgtctggcctccctgctgctcggaagcatctcaacaagttgcggaatatccgttatggtttcaatacaatccttgtgatacttatctggcgcatttttattgcaagatcacaaatggcaagaaacatctggtattttgtggttagtctgtgttacaaattntctgtcatacttccgagcatccagcactatgagata

SEQ ID NO: 6223 - DNA, 524 bp, Mus musculus
gcagtgcagtgctactccagtggcatgaaaaggccttagctgtaggaggactaggctccattataagagttcttacagcaagaaagactgtttaaaaaaaaatcctgttaccttgagaagaattttggatgcccaggctggtgaagaagggactgacaatggaccatcttcctagaactcccaactaaatacttcaggacacatcttctggaatgtattttacttttgaggtggagggagaaattgtcttattgattcctaaattctttgcaggatcagaatgtctgcctttgtctacagagttaacacagaaccaacacttgactatcaggctgactggccagattatgtcaggtgtacctgtgagcactgtctgtttgaaatggggagggactgtttgggcaggtgcagatccacaggctgtggtgaaaaggagagcttgggttctgaagcggaaaaacctgagagtttgtacagacatcctgtcttctcagagaagacaggctctcttgggttcattgtaa

SEQ ID NO: 6224 - DNA, 457 bp, Mus musculus
  misc_feature (182)..(182): n is a, c, g, or t
  misc_feature (184)..(184): n is a, c, g, or t
  misc_feature (328)..(328): n is a, c, g, or t
aggccagcagctttgcagacatgatgggcatcctgaaggattttcaccggataaaacagagccaagacctgagccggagtttactgaaggaagaagaccctgctgtcctcatctctgaggtcctcaggaggaagtttgccctgaaggaagaagacatcagtagaaaagggaactgacagcantnactgcaaactgtctcttgctcctgaacttcaatagctgccttcctcaccgcagatgtctgtctccgagatctgcaaccgtcttgctgactagggcttgggctagaagagaagagctggattactcgctgtttcctgcacttaanccttggcaggagccaaggtctatggttttttgagatgaagcatttgttacagataattgggtagagtggagtgtatctgcttaaggggtgaagtttgttttttcttgtctctgaaaactaagccctcaa

SEQ ID NO: 6225 - DNA, 559 bp, Mus musculus
  misc_feature (140)..(140): n is a, c, g, or t
  misc_feature (359)..(359): n is a, c, g, or t
  misc_feature (406)..(406): n is a, c, g, or t
  misc_feature (482)..(482): n is a, c, g, or t
atttttactcgtgtgcattctgggcgcatgttgatcgctggttcagtccagtcaaccgacatgcttttattagtcatacagtattaatgcaggtgtcaggaaatgtcaactataattccattttttatttttattttttntaagcttttggaaaagttccaggtcctcgtgtattgtgcaataacagtgacttcctcagtggtttggggacgttcattgccggcaatggacgttgtaaaaggaagagttttcttaactcctgccacttggtgattaatgcatgatagggcctatgaaatgaatttatcagttgttgtgggattataaggaaagtgagggatccaacattacattgaaanccaccccaattgtttatatttggattctatgcactgtgatcctaagnccaacagcatgaaattacatgcatctttaaaggaccgaaagaaagatcattgcatatttatttaattgtttatatnctgctgtcaaattgttttgacatggaaagttttcgaggaacattggcagagaggtacaatatgttatccctatggtg

SEQ ID NO: 6226 - DNA, 526 bp, Mus musculus
  misc_feature (360)..(360): n is a, c, g, or t
  misc_feature (396)..(396): n is a, c, g, or t
  misc_feature (398)..(398): n is a, c, g, or t
  misc_feature (406)..(406): n is a, c, g, or t
  misc_feature (427)..(427): n is a, c, g, or t
  misc_feature (456)..(456): n is a, c, g, or t
  misc_feature (463)..(463): n is a, c, g, or t
  misc_feature (465)..(465): n is a, c, g, or t
  misc_feature (489)..(489): n is a, c, g, or t
ggtggagtcccacttcgaaaaatagaccgtctttttaactacatgtactcaactgctcctcgtcccagcctggagcctacaagagcggcgcccttggctggatttggttatggcttgccaatttctcgtctgtatgccagatattttcagggagatctaaaactgtattccatggaaggagtgggtaccgatgcagtcatttatttgaaggccctttcaagtgaatcctttgagaggctgccagttttcaataagtctgcatggcgccattacaagaccactcctgaagctgatgactggagcaatcccagcagtgaaccaagggatgcatcaaaatacaaggctaaacaggacaagatncaagagtaatagaactttctagaaagctgagtgctntntctgaagntctctgaagaaagaatacctntctgcaagtcaaccagagacgcgtatttntaccaantnttaaccatgacggcactattgttnatcccaatgcttagttgctttctttataatggctcac

SEQ ID NO: 6227 - DNA, 138 bp, Mus musculus
cagtatctgcggcagtccaggcagttcggggcagaggaagaggaactctgacaaggggagcattcgtgggggctacagcagctcctggatatatagctccaggttacggaaccccatatggttacagcacagctgccc

SEQ ID NO: 6228 - DNA, 327 bp, Mus musculus
gaacaacaatacagtacaatgcagaatgttagagaaaaagcctttttatcctgctttctttgaacacatacttacttgatcaaaattatttgtaaagaacatctttcctactttttgattttaacaaatgcaaattcagttctctaaaacttgaaaacaaacaaaagaaaccagttctgtgaaacggtacctcattcctggaaataatttataccagccccttcgttgtagggaagtctagcagctcaaagttgacgttttaagagagtatcagattatgtaaagttaaatttgtgaaggatgtatagagtctcaacactgattaca

SEQ ID NO: 6229 - DNA, 289 bp, Mus musculus
  misc_feature (238)..(238): n is a, c, g, or t
atgcagtgggcacctggtgaccatcagaagcacttaaccctccaagccagtgctcgctctgtgctgggccctgagcagctggttgtcttcgagacaagcttcctagagccacgacaagcaggctgctggtggaaggtggagcccgagatccttggcccttcccattagctacccagacctctgactcctgttcccgatactctttgggtcctggctccttcttggaccccaagcctcntgagagaggagggaagggggagactaaagaagcaatattgccccatacccc

SEQ ID NO: 6230 - DNA, 137 bp, Mus musculus
tagatactactttaggaaaaccctgtttgtagtcgtgaaagatgccaaattggcagaggctcacgtttcttctctttacaccaaacaggggttacaggtagcgatggaggtagatacctagaatcaaatctgacatt

SEQ ID NO: 6231 - DNA, 337 bp, Mus musculus
  misc_feature (112)..(112): n is a, c, g, or t
  misc_feature (154)..(154): n is a, c, g, or t
  misc_feature (159)..(161): n is a, c, g, or t
  misc_feature (284)..(284): n is a, c, g, or t
  misc_feature (286)..(286): n is a, c, g, or t
gtgactacatgagcaagccctctttgtcctgtctggagacgactgttaataatagcatcttgtcatttggtttgctctctatcaatctgaatagatgtttacatggaccgtnatgaccattttatctttacagttctgtacaagtccatctgantccannngtgtatcaaatgtgtgaggtttatgaccttatttagaaatgttttcttcccttcatagcaatttaatttgtaaaacacctttaaggaacaaggccttttagtttccttatgagatgtattatntntcaggcaaactgagagatatgtttgggaaatctataaagccatgagagcat

SEQ ID NO: 6232 - DNA, 513 bp, Mus musculus
  misc_feature (76)..(76): n is a, c, g, or t
  misc_feature (192)..(192): n is a, c, g, or t
  misc_feature (401)..(401): n is a, c, g, or t
tccgcagggagtatgcaagccatctggagcgccagctgcacttctatacagaggctgcccggcgcctgggctacgntggaagcagggaggctgcaaaggaggcattgtatcggcggaacctggtggagagcgagctgcagcgactccgcaggtgaggcccatcctggactacaggccccacagcccgatgcnaggcagagctccagggccaccgaacagacaagcagacaatcagcggacagttggttctggactcgccctgtccaggccctcggccccaggggcatcgggacagcacagtcaccccagcctggctggttgggccttggagagtcctgtttgcacatccaggagcatctggagcaaggagggtagctgggatgtgaacccagagggccctncaagcactttacttcctgcccctcccattgtgaaccccacagccctctccaaagatacctctgaggctgtccagctcagctggcttcttaggaactgtactgacccagctgc

SEQ ID NO: 6233 - DNA, 569 bp, Mus musculus
gaagtctcttgaactcaatccaaataattgtactgctcttctgaggaaagggatatgtgaataccatgaaaaagactacgcttctgccttagaaacatttgcagagggacagaaattagatagtacagataccaattttgacacctggattaaaagatgccaagaaattcagaatggatcagaatctgaagtgtctgcatctcagaggacccagtcaaaaatcaagtatgactggtatcaaaccgagtctcacgtaatcatcacccttatgatcaagagcgttcagaagaatgatgtacgtgtgggattttcagagagagagttgtctgctttggtgaaaattcctgctggagaagactacagtttgaagctgaggctgctccaccctataataccagaacagagtacattcaaagtactttcaacaaagattgaaattaaaatgaaaaagccagaggcggtgagatgggaaaagctagagggacaaggagatgagcccacaccgaaacagttcacagcagatgtaaagaacatgtatccgtcctcatctcactatacccggaactggg

SEQ ID NO: 6234 - DNA, 297 bp, Mus musculus
gaaatccactggatcatcgtgcagtctctcaaggccgtggcgccagtgatgaacaacgacaaacactgctttgaatgctacggctacgacatcatcatcgatgacaagctgaagccctggctgatcgaggtcaacgcgtccccgtctctcacatccagcaccgccaacgatcgaatccttaagtacaacctgattaacgacaccctcaacattgcggtccccaacggcgagattcccgactgcaagtggaacaagtctccccccaaggaagtacttggcaactatgagatcctgtat

SEQ ID NO: 6235 - DNA, 463 bp, Mus musculus
  misc_feature (285)..(285): n is a, c, g, or t
  misc_feature (384)..(384): n is a, c, g, or t
gaggctggaccctggccttaacagccccttctcagatctcctgggccctctaggtgctcaggcggatgaagcgggctgtagcacacagccctcaccagagcagcacccctcccctcttgagccacagcctgcctccccatctgcatacatgttacggctgccacctcctgctggagcctacatccagaatgagcacagctaccaagtggggagcgccttgctctggaagaggcgagctgaagcagctcttgatgctctggacaagacccagcgccagctgcaggncctgcaagcggcgggagcagcggcttaggctgcgactgaccaagctgcagcaggaacgggcacgggagaagcgagcacaggcagatgcccgccagactntgaaggaccatgtacaggactttgctatgcagttgagcagcagtatggcctgagagagggactacatgcccaggctctg

SEQ ID NO: 6236 - DNA, 492 bp, Mus musculus
agaggagtcttgtcatctccatctctagcctttacaacacccatcaggactttaggcactccaacacagtccggaagcactcctagggtttctaccatgaggcctcttgccacagcatacaaggcctccactagtgactaccaggttatttctgacagacagacaccaaagaaggatgagagccttgtgtcaagagcgatggagtacatgttcggttggtagtacagcaggagctggactgagccgctatgctacagtagcagagggctgccatgccatgggttagttgtataaccatcctggcagtgtgggatacccatctcggatacatcttttacaatcctttggttaaggaaacagcccatctgtagcttgcactttaaaagatggccgtgatagacctgaagagaagatgcccacatggcatttgtgcttctgtgatgtagtgcatgcttagtgccgggtacccggcgactactgcggtcaattaaa

SEQ ID NO: 6237 - DNA, 508 bp, Mus musculus
gaagctttgcggaagcaacagccaaagaagggaacttcccgcgaggaccagaccctggcactactgagccagtttaaatctaagctcactcaagcaattactgaaacacctgaaaacagtgttcctgaagcagaagtggaggacgatgaaggctggatgtcacatgtgctccagtttgaagacaaaaccagaaaagtgaaagatgcaagcatgcaggactcagacacatttgaaatctatgatcctcggaacccagtgaacaaaaggagacgggaagagagcaaaaagctgttgagagagaagaaggaaaggcggtgagagccagagcggtgatgccagagtggtggcccctgtggggtgtcctgtcacagccatgtctatggaatcgcagaggcggtgggaaggctgtcagagcctgtgttctgatttttcagaaaacaggtctctccttttgtaaatctggaatgatgtaagaaaatgcttttggttactgatacatttttcccta

SEQ ID NO: 6238 - DNA, 419 bp, Mus musculus
  misc_feature (346)..(346): n is a, c, g, or t
  misc_feature (366)..(366): n is a, c, g, or t
aatgcttcggctaggattgtcagctgaagctaaaccctctgtccacattgtcatgaacttgccagctaaggccatagagtttctcagtgttttcagatcacttttggatgggcagccttgcagcacggagctcctccccacagtgcactgttactgcttctccaaagatagcgatcctgctaaggatgttcgtcagcaggcggaagctgtgctgggcgtttccttggagaccagtagttcagttcatctcgtaaggaatgtggcccctaacaaggagatgctgtgcatcaccttccagattcccactgctacactctacaggaaccaaagcctcagtctacagaangaccaagaaccacctcttanacggcagaagacaggtgacccgttctcaggagaaccacagatcgcatcagatt

SEQ ID NO: 6239 - DNA, 425 bp, Mus musculus
agaaattccagcagttccgcggcctctgtgagcagaacttgaaccctgatgccaacccccgtccgacagcccaggacctggcagggttctgggacctgctgcagctgtccattgaggacatcagcatgaagttcgatgagctctaccacctcaaggccaacagctggcagctggtggagacccccgagaagaggaaggaagagaagaagccaccccctccagtcccgaagaagccagccaaatccaaggcggcagtgagccgcgacaaggcctcagacgcgggggacaagcagcgtcaggaggccagaaagagactcctggccgccaagcgagcagcgtctgtgcggcagaactcggccacagagagtgcggacagcatcgagatttatgtccccgaggcccagaccaggctctaaggccgtgaa

SEQ ID NO: 6240 - DNA, 437 bp, Mus musculus
ccggtggtacctgaagatgaaatgtggcaactgtggtgagatttcagagaagtggcaatacatccggctgatggacagcgtggcgctgaaaggaggccgaggcagtgcctccatggtccagaagtgcaagctatgtgcacgggaaaactctattgacattttgagcagcaccatcaaggcttacaacgctgaagacaatgagaagttcaagacgatagtggagtttgagtgccggggccttgaaccagttgacttccagccccaggctgggtttgctgctgacggtgtggagtcagggacagtcttcagtgacattaatctgcaagaaaaggactggacagactatgatgaaaaggctcaggagtctgtggggattttcgaggtcacccatcagtttgtgaagtgctgaactgtctgcccgcaaacttgcctgtaag

SEQ ID NO: 6241 - DNA, 467 bp, Mus musculus
  misc_feature (345)..(345): n is a, c, g, or t
  misc_feature (347)..(347): n is a, c, g, or t
ggaacaagctgtgcttctgtcacgcctggaggaagagtaccagatccagaagtggggcaacattgagtgggcccacgactatgagctccaggagctgcgggctcgcactgctgctggcaccctttttgtccacctctgctcagaaagctctacagtcaagcacaagctccttcaagagtgaggcccggggtgcacacgctgtctggaaggaattgcacagacacaggctccctgatgtgggcctccttggctgttggacctctggatcctgtgatactctgttggccggtacctactgggctccctcagccctatacctgtggggctccccagcctgtacctggntnttccctgacctgtgtggtttgaccttataaagaagcatcctgagaagccctgaagacacagtgtgcctgacttgaggtcagatagcttccgatgcaggcgcccttggtctgaccagaagt

SEQ ID NO: 6242 - DNA, 488 bp, Mus musculus
  misc_feature (107)..(107): n is a, c, g, or t
  misc_feature (109)..(109): n is a, c, g, or t
  misc_feature (114)..(114): n is a, c, g, or t
  misc_feature (116)..(116): n is a, c, g, or t
aatattgcgcactttttccacatggaatctctaccaaactctgagccttggtgtacccttaacaacaacaaaaatgctatgactgactgtgtcttgaactttgaaanantatantnttcagtatatccaattgccaaagttttgctgtctcttggaaaaggaactatgaaatcaactgacaaggaaacgcattctatagacaacagaatttaactggatcgcagacagttattactgtaatttcttctttatgaacatgaccatttgactgttcactgactttctttgtatttacagtttccagagtttgacattataataggaacaatcttgctgtatactttttaaaaatactgtgctattctttctggaactgttgaaagacaatatataaaatcgatgaatctattgctcatcagctttattttttaaacataccacttattttgttggaattgtcaaagactgtatttagatctcatgctttt

SEQ ID NO: 6243 - DNA, 530 bp, Mus musculus
ttacaccgttatcctcatcgagagagccatgaaggacatccactactccgtgaaacccaacaagagcacaaagcaacaggctttggaagtgataaagcagctgaaagagaagatgaagatagagcgggcccacatgcgattgcgcttcatcctgccagtgaacgaagggaagaagctgaaggagaagctgaagccactgatgaaggtggtggagagtgaggactacagccagcagctggagatcgtgtgcctcatcgacccaggctgcttcagagaaattgatgagctaataaaaaaggaaacgaaaggcaggggttctctggaagtgctcagtctgaaggacgtggaggaaggcgatgagaagtttgaatgacaccgcccggctcctcaactggagcacgaccgaggacgcttgttcctcacagcagcagctcgttctgtgacctgccaaacgccctgctcacgcgacgtgccactttccatcttgtgttaaacatttacccaggtacctgggtatttttgttgtcaat

SEQ ID NO: 6244 - DNA, 506 bp, Mus musculus
agcacaagaagcacgcaggcgccgacggcgacgtggagaagagccagaaacacaaacacaagaagaagaaggccaagaagaacaaagacaaggagaaggagaaagatgaccaaaaagtgagatctgtcactgtgtgaaggacggatgtgttaattgacttaattactaagtcatctgtattaaattctgttataatgtaaagagattccagccttgtaaataatgaatggaagaccctgtgctgcacttaaaagtatttgctgcttgattatttcatttttacatcagagctttataacgaacttttgtacagaattgtgagttgtgaccatggaacagtgagaggttttgctagggcctattatttttaaccaccattaattagttggggtggagtttactgtactgtgaaattttcacatttgaatttttttaattgcctggcaaatgctgatatcagttcaaaaatatcagcagaatgattgctgaactcattacagccccgt

SEQ ID NO: 6245 - DNA, 227 bp, Mus musculus
ttccctatagcatccagacggctgaaaagcagaggtggctgcactcctacttccacaagtggtcagcagagacatccggccgaagtaatgccatgccacacattaagacgtacatgaggccctcgccagacttcagtaaactggcttggttcctggtcacaagtgcgaatctgtccaaggctgcctggggggcactggagaagaacggcacccagctgatgatacgc

SEQ ID NO: 6246 - DNA, 526 bp, Mus musculus
  misc_feature (402)..(402): n is a, c, g, or t
  misc_feature (453)..(453): n is a, c, g, or t
tgctttagcctttttcctctggaaacccttgtgtacctgactcctgactccgaacactcccttgaagacattgatcagagcacagtttacgttattggtggacttgtagatgagagcattcagaagaaggtgacatttcaaaaagcccgagaatactctgtcaagacagcccgcttgccaatccaggaatacatgatcaagcgccagaatgagaaaaactaccattcggaaatattggccatcaaccaagtgttcgatatcctgtctacttactttgaaactcgtaactggcctgaagcactgaagaaaggagtttctccaggaaaaggctacgttcttcagaattcagcagaaggatgagcagcctaagattccagctgcagggggtgaagtgccagaggntgtcttgaccaaaggaccaggcaaagtgtggcaatggcacacacttgcctntacatgctatctcggatctttgaaagccattagtggcaaggaccacattttatgttgtcacccacaatgccta

SEQ ID NO: 6247 - DNA, 291 bp, Mus musculus
  misc_feature (63)..(63): n is a, c, g, or t
  misc_feature (67)..(68): n is a, c, g, or t
  misc_feature (95)..(95): n is a, c, g, or t
  misc_feature (135)..(135): n is a, c, g, or t
gatatggtcaccaaggtcctgctgtagcatgactgaccgctccatgtgtaaacctaaccatangctnncaggcgcggcagcgcccccaagtccantagcctggattaggtacacagacaggatagtcctcacagntacctctttgtagtcctgaaggcattttaagccagaaggttctctaaacaccagagactcatcacaccgcgagccttttgtggggaaggggcatggtttttatccaggaacctggtccactcttttccaaatgtataatcttgacttggcaccacc

SEQ ID NO: 6248 - DNA, 357 bp, Mus musculus
gattaagctgatgtttgcaggactgttctttttattctttgtgaagtttagcattggaagacaacttctcataaaattcccatggctcttttcctttggctatttttcaaaacaaggtccaacacaaaaacagatggatgagacatcatttacaatgacattctttggtcaaggatacagccatggcacttgtgttgaaaagaacaaaccaaatatccgaatctgcactcaagtgaagggaccagaggctggctacgtggctactcccatagccatggttcaggctgccatgacttttctgagtgacgcctctgaccttccaaaagggggcggtgtctttacacctggagcagcttt

SEQ ID NO: 6249 - DNA, 533 bp, Mus musculus
  misc_feature (49)..(49): n is a, c, g, or t
  misc_feature (96)..(96): n is a, c, g, or t
  misc_feature (118)..(118): n is a, c, g, or t
tcctctggcacatcttctgatgaagaaagctgcagcagggaggcccagntcatccccaaagtgaacaacccaaagagcgtctaccaggttgaaaantttcaaacagtcattgcagccngtggttctgcctcccccgtagaaagcatttggcagatggtcgtgggttcctcccgggggctgcttgccacccagtgcccaagagctctaagtggtgccggccagcttcgcgcagggtggacagatatcactgggtcaacgcacaactgttcagtggtcagacagcaccaggagagcctggagaagaggccttgtcttccctaaagcaaaaatgaggctaaagccaagaaatgcccccagtagaaaaaaatgcctgcttcaggaatgtgagcacagaaggctgtccttgcacacagaccagcacttgacttttagctacttttaattcttatttaactttatgtaaaattttatgaacactagtgaatataggtgcctagaaaagtgatagaacagagatgttgccggtgataaaa

SEQ ID NO: 6250 - DNA, 469 bp, Mus musculus
  misc_feature (302)..(302): n is a, c, g, or t
  misc_feature (379)..(381): n is a, c, g, or t
gaccacggtgtgttaaacattccatatttagaatatgtctgttttacactaggttctagaagtaattggatcccaaagttctttggctattataaagtatagacactatatagctacctataaacagtatagcagtgaaatgtgtgcattttaagagatctgcactcttgggtcttgtcagtggcataatctctgacttgtttgaagacactccaagcctttccaatgtcatcctgctctcattacaaaccttcacttttggaatggatattttttgtgcatcatacacatgctttttgccngtagttgccttagtcatctttctgcagtagcatctggacatcacaagtcctgctattcattaatcaaggaaatctgnnnagagatgacagtgccctaaagtagtttacatcctttcagaaagtatgtgtaagtgcatgcttctatgcaccttcttatgtagtacttt

SEQ ID NO: 6251 - DNA, 468 bp, Mus musculus
agtgctgcactcatggctctgcggagaggctcaaggaacctcgtcttccgggacttcacagatgaaaaagagggaccaataactaaacacatccgactaacagctgccttaatattaaaaaatattggtaaatactcagagtgtgggcgcagattgttaaagagacatgaaaacaacttatcagtgctcgccattagtaacatggaagcttcctctacccttgccaaatgcctttatgaacttaattttacagttcagagtaaagaacaagaaaaagactcagaaatgctgtagtgaatcctaccccactgacacagtggggtctcaaagtcaaatacatttcacatactgttactgaagaaagcaccaagtcttaatggagcagagaccatagaatgaattattttgtgtcctccatgatgctgagaggaaacttcgtattctgatctctgaacgaatccctttctt

SEQ ID NO: 6252 - DNA, 506 bp, Mus musculus
  misc_feature (195)..(195): n is a, c, g, or t
  misc_feature (446)..(446): n is a, c, g, or t
agggacttcaactctgcagctctgaaccttggcttcctgaatgtcacaacaaggtatatctaagtggcaaaactgtacccctcacagtgaccaagagccagttttcccgtccatccaaagcccacaaccagaaaatgaagctggcttggggcagcagctgactccaacatctgcctggtaactaggcccaggganagaagcgaagagtaggagaagagatgtttggcagagtgtagtggcttgtgttggtcattccaggaacctaagggctaaggcaggaggactgttacaagttcatggtctacatagtcccaagtcacccagagctatacagcaaaatcatatttcaaaaataagtcatttgagtctttaatctaattatgtcacatttaactgctacagagttgtcgagcaggtcctggcaaacactgactacttcagtactntcttcttttgcagactcagaggcctgggtacaaataaggctaactagcacctgcaacatc

SEQ ID NO: 6253 - DNA, 566 bp, Mus musculus
  misc_feature (372)..(372): n is a, c, g, or t
  misc_feature (381)..(381): n is a, c, g, or t
  misc_feature (402)..(402): n is a, c, g, or t
  misc_feature (407)..(407): n is a, c, g, or t
  misc_feature (448)..(448): n is a, c, g, or t
  misc_feature (460)..(460): n is a, c, g, or t
  misc_feature (467)..(467): n is a, c, g, or t
  misc_feature (539)..(539): n is a, c, g, or t
gtacctctacaagctggagccgaatgtggaagaggtctgccgcttccctgaactacctgcccgaaagcccctcacctaccaggctaagcagcttattgctcgggagattgaaatggagaagatgcgcagggcagaggctttggcctgggctcgaagtggcccccaggtggaccagggctcctcagggcctgcaagtctgtggacagacagtggggaaaaggggacaaggcagcctgtcccacgtaaccatgagcagcgcctagaacacatcatgacgagagcaaccgtgcaggagcagcctgagagggacttctttggacgtgtggtcatcaggaaagtggcagtcccgagcagagaggttgaggccccccnagaaggacncggacgagtggcgcatgggtntggcnagtgggcaggagtgaggtgtggttccggttcaacgagggcntctcaaatgctnttcggcncagcctgtacatcagggacctgctgtagccccactgccccaggacatcagatcgcactggctcccacagggnatggactaaagcagagacacccggaga

SEQ ID NO: 6254 - DNA, 375 bp, Mus musculus
  misc_feature (227)..(227): n is a, c, g, or t
  misc_feature (240)..(240): n is a, c, g, or t
  misc_feature (242)..(242): n is a, c, g, or t
  misc_feature (247)..(247): n is a, c, g, or t
  misc_feature (251)..(253): n is a, c, g, or t
  misc_feature (278)..(278): n is a, c, g, or t
  misc_feature (286)..(286): n is a, c, g, or t
  misc_feature (303)..(303): n is a, c, g, or t
ggtgtggctgtttcttagacatgacgactgggatgcctcttgccagtgtgtctcagacacttgaataattgcggtttgcacttactgtatgtcagaccacatcactacatctctatgcaagggggacaaggcaatgtggtggtcaaggatcttttagctaacctagtcaaagacttttccagttgattaatctattttcatatttataaaggagtcttaatgttttncctcaagactttncnacctntggnnnttgggagtggggctggtattgtagnccctaggncctgctctatgtatgtntcaacaggtgatacaaccctttagttaatggtttatacttggactgattttctttcctcctgtagctggagc

SEQ ID NO: 6255 - DNA, 447 bp, Mus musculus
  misc_feature (157)..(157): n is a, c, g, or t
  misc_feature (166)..(166): n is a, c, g, or t
  misc_feature (200)..(200): n is a, c, g, or t
  misc_feature (208)..(208): n is a, c, g, or t
  misc_feature (210)..(210): n is a, c, g, or t
  misc_feature (223)..(223): n is a, c, g, or t
  misc_feature (234)..(234): n is a, c, g, or t
  misc_feature (236)..(236): n is a, c, g, or t
  misc_feature (261)..(262): n is a, c, g, or t
  misc_feature (317)..(317): n is a, c, g, or t
  misc_feature (343)..(343): n is a, c, g, or t
  misc_feature (377)..(377): n is a, c, g, or t
tagaccccgagtcgccgcagaatcgtgggacccatcgttcctgtacgcagaaacagcatcccaggaaaggcaggaaatggagcccagtccctcatctccgctcttcagcagcgacatgctggctcttctagaaacctggacgccgccgcaggagtgnccgcctgcntgaagagtggaggggacaatgcaacggatgattntcaccctntntgagcacagacanttttcctttgntnttggcaccttcggagggagtagatnntggaagaggcggcagtgataccaacatgggcatcccggggtgggagctggccctnatccagactgtaccattccaaccctnccttggaaggaggcgcccaatagggtacacgctntaaagatgaagcaggcacaagctttgcctggtgtgtatttatttatttgtgaataaaccgattgtgctag

SEQ ID NO: 6256 - DNA, 324 bp, Mus musculus
  misc_feature (57)..(58): n is a, c, g, or t
  misc_feature (292)..(292): n is a, c, g, or t
gagtccatgtattacaacgatgcctatggagcacttgactactataagcgctaccgnntccgatcttacgaagctgtggcggcggcggctgcagcttccgcatacaattacgcagagcagaccatgtctcatcttcctcaagttcagagctcagctgtacccagtcacctcaactccacttctgttgatccttatgacagacacctattgcagaactctggctctgctgccacctcagctgcaatggctgctgccgcttcctcttcctattatggaagggacaggagcccantacgtcggaatgcggctgtgcttcccgcagtt

SEQ ID NO: 6257 - DNA, 448 bp, Mus musculus
  misc_feature (38)..(38): n is a, c, g, or t
  misc_feature (52)..(52): n is a, c, g, or t
  misc_feature (219)..(219): n is a, c, g, or t
  misc_feature (292)..(292): n is a, c, g, or t
  misc_feature (299)..(299): n is a, c, g, or t
  misc_feature (301)..(302): n is a, c, g, or t
  misc_feature (304)..(304): n is a, c, g, or t
  misc_feature (306)..(306): n is a, c, g, or t
  misc_feature (308)..(311): n is a, c, g, or t
  misc_feature (313)..(313): n is a, c, g, or t
  misc_feature (316)..(316): n is a, c, g, or t
  misc_feature (328)..(328): n is a, c, g, or t
  misc_feature (331)..(331): n is a, c, g, or t
  misc_feature (333)..(336): n is a, c, g, or t
  misc_feature (338)..(338): n is a, c, g, or t
  misc_feature (345)..(345): n is a, c, g, or t
  misc_feature (378)..(378): n is a, c, g, or t
  misc_feature (384)..(384): n is a, c, g, or t
  misc_feature (388)..(388): n is a, c, g, or t
  misc_feature (392)..(392): n is a, c, g, or t
  misc_feature (406)..(406): n is a, c, g, or t
  misc_feature (416)..(416): n is a, c, g, or t
tgggattctcccagagccttctccatagccactgtaangcaatgtgcccggntacacacagcagcctgcagccactcagaaggccctgtggagcgcgtgcacaccagcttctggctgctgacctgagaccaaactctgaacttccaagctgaaggggaccatctttgcagagtgatggtctttggtcctgatcacagattttctgaagccctgcaactntaaggcatccttttgtttacactcttagtatagcatttaccattattgcttaagtttttctgtggcctttggngtacgtngnncntntnnnngnacnatcggtaagaancgncnnnnanagacccngtatgggaaagaaggggaaacgtgtgagctggncaccancctncctnccaaagagataatntcatgagttntactaaaaactcattatccttaatcagtcatt

SEQ ID NO: 6258 - DNA, 512 bp, Mus musculus
  misc_feature (300)..(300): n is a, c, g, or t
  misc_feature (306)..(306): n is a, c, g, or t
  misc_feature (332)..(332): n is a, c, g, or t
  misc_feature (336)..(336): n is a, c, g, or t
  misc_feature (339)..(340): n is a, c, g, or t
  misc_feature (421)..(421): n is a, c, g, or t
  misc_feature (423)..(423): n is a, c, g, or t
  misc_feature (473)..(473): n is a, c, g, or t
  misc_feature (483)..(483): n is a, c, g, or t
gtggtaccactggatttgctggctcctcagcgtcgttggaatcttctgtattctcttagcgcatgaccactacactgtggacgtggtggtggcctactacatcaccacaagactcttctggtggtatcacacgatggccaatcagcaagtgcttaaggaagcctcccagatgaacctcctggccagggtgtggtggtacaggccatttcagtactttgaaaagaatgtccaaggaattgtacctcgatcttaccattggcccttcccctggccggtagtccaccttagtaggcaagttanatatanccggctggtaaacgacacataacagntctnccnnactagggaatgaagaacagtccgaagtgctaagaactccatgacagaagatgccataaagtaaccacctccccctgctatntntcaagttaccttgacttaacctattgcgttacctgctcagcactgtgatntttttttttntctccaaaggacccgcgttggacaacaat

SEQ ID NO: 6259 - DNA, 461 bp, Mus musculus
  misc_feature (270)..(270): n is a, c, g, or t
  misc_feature (272)..(272): n is a, c, g, or t
  misc_feature (276)..(276): n is a, c, g, or t
  misc_feature (279)..(279): n is a, c, g, or t
  misc_feature (326)..(326): n is a, c, g, or t
actagttcacctaaagccttatcagctcctcctgtggacccaagctgctgtaagggagagcaggcgtcagcaagcagactgagcgtgaatagtgccgctttccccacacagtccccaggactcagtccttccactgtgacagttgaaggacttggccacacagcgactgccacaggaacaggcgtctcttcaagtcttcctaaatctgcacagcttttgaaatctgtttttgtgaaaaatgttggttgggctacacagctaactagcggngntgtngtngggttcagtttaatgatgggtcacagttggttgtccaggcaggagtntcttccatcagttacacatcaccagatggtcagacaactaggtatggagaaaatgaaaaattacctgaatacatcaaacagaaattacagtgtctttcttccatccttctgatgttttctaatccaactcctaat

SEQ ID NO: 6260 - DNA, 527 bp, Mus musculus
gaggagtacgagacccgattcctgtgcaacacctcgaaggaatggaagaaagcaggagttgagcagctacggctcagcacagtcgacatgactggggtcccaaccttggccaatctccacaaaggagtccagtttgctctcaagtaccaggcactgggccagtgtgtctatgtgcattgtaaggctggtcgatccagaagtgccacaatggtggcagcctatctgattcaggtacacaactggagcccagaggaggctatagaagcgatcgccaaaatccggtcacacatctccatcaggcccagccagctggaagttctcaaagagttccacaaggagatcactgcaagggcagcaaagaattaactactgattatctctcatgctgacttaagagtctgaagactgtggataacaaagaacttggatctccctgagatatagtaacaagtttacaggacaaagcagcttaacccgaccacactgcaaatgtgctgactggtagataatgtgtctcctttgccttc

SEQ ID NO: 6261 - DNA, 524 bp, Mus musculus
  misc_feature (60)..(60): n is a, c, g, or t
acttttggtcagctgttcagagcacaatgtttctctagttaagtgtcatttatttgaggngaataaaaggaacttgtctggacccagacaaggaactgatctggaagaataagataaatcccagatgaggtaccctagcttacattccccagatgtggaaagtataagggcactcggctctgcccaaagactacctctgtctcagctactaagaattctgtccttacatttgcaaagtggaggcccaccttcccaacactgctcattcatgagcaggagcagtattggttgctaggcaaccagattttttttttcccaaccaaagatcttaaatcctgcctagagggccacaggagggcttgccccactcagaggattagactcctctcccagagtcactcacaggcaattatttcccattccactcagttctggctaccagaagatgctcccctctcagctgggtgaggctgctgatatctgtcggatgggtatcacagcgtaatttcatcatagggcttttc

SEQ ID NO: 6262 - DNA, 485 bp, Mus musculus
  misc_feature (298)..(299): n is a, c, g, or t
  misc_feature (302)..(304): n is a, c, g, or t
  misc_feature (307)..(311): n is a, c, g, or t
  misc_feature (313)..(313): n is a, c, g, or t
  misc_feature (316)..(316): n is a, c, g, or t
  misc_feature (319)..(319): n is a, c, g, or t
  misc_feature (359)..(359): n is a, c, g, or t
  misc_feature (372)..(372): n is a, c, g, or t
  misc_feature (377)..(377): n is a, c, g, or t
  misc_feature (382)..(382): n is a, c, g, or t
  misc_feature (408)..(408): n is a, c, g, or t
  misc_feature (439)..(439): n is a, c, g, or t
ccatctcctgatcagaaaggtcagagttctggatcactaatttatttggatttatatttttctgagccactaagacaaatgaagagggcaaaataaataagtttatgataagacataagtcaagggctaacaattattccatatatgttggtcctgactgaagtaatgacgttaaagtgttttgtggatagtagttattgactatatctaaaataatagcattaaatctaagttatattttcagaatccaatttaggaagtgattattatcacattatctgtaattacattcaccgannttnnnggnnnnngnttnatntttttggccgagaatctcatacttttcactgatttggaanacatgactggatntttanaaatnttcgttgacaaagagcattaacaaancaataactggatcatcactgaacttaaaacncaaaaacagtaacgagcaagggcgtcatttcagttgcagactgctg

SEQ ID NO: 6263 - DNA, 571 bp, Mus musculus
ctgactgtacttaccctgagttgacagacaaacacaagctttcagatatatgtaaaaacctcaatttccggcataaaatggctcagtatgcccagcgtgcttcggtggcttttcatacacagttgtttttcaaaagcaaaggaatagtaagtgaagaagcctatattctctttgtaaggaaaaatgcaattgtggtgttaattccaaagtatggcttagaaggtacagttttctttgaagaaaaagataaaccaaagccacgccttgcttacgatgatgagatcccttccctgagaatagaaggtacagtgttccatgtgtttgataaggttaaagtgaagatcacattagattcatcaaatcttcaacatcagaaaatccgcatggcccttgtagaaccacagatcccaggaataaatattcctcctaatgttgcagacaaggctcttactgcaccagggggaaagaagaggaagcttgagaagtagctacgttcaacagaacatccaaagactcaacagcaacaaaatggagagcatacttacagactcctgtgcgatagctactttta

SEQ ID NO: 6264 - DNA, 524 bp, Mus musculus
  misc_feature (454)..(454): n is a, c, g, or t
aagcctgccttattttctttgatgaaattgatgccattggaggggctcggtttgacgatggcgctgggggtgacaatgaagtgcagagaaccatgctggagctcatcaatcagctggatggctttgatcctcgcggcaacatcaaggtgctcatggccactaaccgccctgacactctggacccagcgctcatgagaccggggaggctggacaggaagattgagttcagcttacctgacttagagggtcgaacgcacatctttaagattcacgctcgctcaatgagtgtggaaagagacattcgatttgagctgttggcccgcctgtgtccaaacagtactggagcggagattagaagtgtttgcacagaagctggtatgtttgcaatccgagcacggagaaaaattgctacagagaaggacttcttagaagctgtaaataaggtcatcaagtncttacgccaaattcagcgctactccccgctacatgacatacaattgagccccagggctctgagtgaaaga

SEQ ID NO: 6265 - DNA, 519 bp, Mus musculus
  misc_feature (319)..(319): n is a, c, g, or t
  misc_feature (431)..(431): n is a, c, g, or t
  misc_feature (465)..(465): n is a, c, g, or t
aaccccatgatgaacttgagcgtgtgcgtgtcagctgtgccatcatcttctttgccagcatcttccagtttgccatctggactacagccctgctgcatcagacagaaacactgcagccagctgtgcaatttggtgggcaggagcatgctttcatgtttgccaagcttgcactgtatccctgtgccagcctgctggcctttgctgccacctgcctactgagtcgtttcagcacagccatcttccacctcatgcagatttcagtgccctttgcattcctgttgctccgtctccttgtacgccttgccctggcaggccttcnagtcctacggggcctctggccacaccatccccaacaagaccagagtgaacctgaggcacagtcccagctcttgcctgacccctgctaatgccaagaaagccactcctgcctntcctaggcatattgtaaggggtcctatggagatntcttagtacaagtttattgtgacactggggctgtggatatattggcctgggtat

SEQ ID NO: 6266 - DNA, 546 bp, Mus musculus
  misc_feature (192)..(192): n is a, c, g, or t
  misc_feature (222)..(222): n is a, c, g, or t
  misc_feature (252)..(252): n is a, c, g, or t
  misc_feature (270)..(270): n is a, c, g, or t
  misc_feature (343)..(343): n is a, c, g, or t
  misc_feature (346)..(346): n is a, c, g, or t
  misc_feature (366)..(366): n is a, c, g, or t
  misc_feature (403)..(403): n is a, c, g, or t
  misc_feature (412)..(412): n is a, c, g, or t
  misc_feature (432)..(432): n is a, c, g, or t
agcaacagatcgtttttctctgaaatcatctcttcaatttcggatgtgaaattcagccacagtgggaggtatatcatgaccagagactatctgaccgtgaaagtctgggacctcaacatggaaaatcgccccattgagacataccaggttcatgactacctccgcagcaagttgtgctccctctatgaaaangactgcatttttgataaatttgagtgtgtntggaatgggtcagacagcgtcatcatgacnggctcctacaataacttnttcaggatgttcgaccgaaacaccaagcgtgatgtgacccttgaggcctcaagggaaaacagcaaaccccggnctntcctcaaaccccgaaaagtntgcgtcgggggcaagcgaagaaaagatgagatcagtnttgacagtntggactttagcaaaaagatnttgcatacagcttggcatccttcagaaaacattatagcagtggcggctacgaataacttatatatattccaagacaaggttaactagaaggacgagctactacttagtctcaca

SEQ ID NO: 6267 - DNA, 575 bp, Mus musculus
  misc_feature (450)..(450): n is a, c, g, or t
  misc_feature (481)..(481): n is a, c, g, or t
  misc_feature (511)..(511): n is a, c, g, or t
  misc_feature (540)..(540): n is a, c, g, or t
  misc_feature (548)..(548): n is a, c, g, or t
gaggcaccaaccaactggatggcatggatctgttggtcttactagatttaattggagcagcaaatccaacattccctaattttttccccaagactaccagatggtttaatagacttcaagcaattgaaaaggaactctatgaattgggattactcaaggatcattctttggagaggaagtattttcagaattttggctatggaaatattatccaggatgaccacattccatttttaagaaaaggtgtcccagttcttcacctgatagcttctcctttccctgaagtctggcacaccatggatgacaatgaagaaaatctacatgcgtcaaccattgacaatctcaacaaaatcattcaagtctttgtgttggaatatcttcacttgtaatgtttggatttagtttctggtaattgcttctacagcaacttcaagacaccatttatacaanctgcttccagataaatgtgtgtagacttctntcctatagattcattctgtaggtgtttttngaatatgtgatcagcgaactgtagaattnctatgatnccttcactaattttcctctagagatga

SEQ ID NO: 6268 - DNA, 478 bp, Mus musculus
  misc_feature (75)..(75): n is a, c, g, or t
  misc_feature (156)..(156): n is a, c, g, or t
  misc_feature (201)..(201): n is a, c, g, or t
  misc_feature (203)..(203): n is a, c, g, or t
  misc_feature (209)..(209): n is a, c, g, or t
  misc_feature (213)..(213): n is a, c, g, or t
  misc_feature (218)..(218): n is a, c, g, or t
  misc_feature (221)..(221): n is a, c, g, or t
  misc_feature (258)..(258): n is a, c, g, or t
  misc_feature (345)..(345): n is a, c, g, or t
  misc_feature (424)..(424): n is a, c, g, or t
gagagctcctcagataaactgtcattggaaggaatagtggtgcagagagcggaatgccggcctgctgccagtganaactacatgaaattaaagagattgcaaatagaagaatcttcgaaacctgtaaggctctcacaacagctggacaaagttgtnacaaccaattacaagcctgttgctaaccatcagtacaatattgantnatgaangganagaanaanagaggatggaaagcgagctcgggcagacaaacaacangtcctagacatgctgttctctgcctttgagaagcatcagtactataatctcaaggacttggtggacatcacaaagcagcctgtgggnatacctgaaagaaatcttgaaagaaattggcattcagaatgtaaaaggaattcacaagaacacatgggagctgaagccngagtacaggcattaccaaacagaagagaagagcgactgagagactcgtgtgcta

SEQ ID NO: 6269 - DNA, 370 bp, Mus musculus
  misc_feature (34)..(34): n is a, c, g, or t
agaggtcttaattgacatcacagaaaagcaacanaaacttaatgatacaggcaaaaatgtcatgattaacatcccagaagagcaacaaaaacttattgacaaacgcaaagatgtcatgattgacatcccagaacagaacgcaattcctgataatagccaatatcaagaccaggaacaaatagttactttacaggctttatttccttcaacagaaacatctgaaaatagcatgattgacacctcggaatcacagcaggagtcttctgatttatgtaccgaatcttctgattcatctaccgagtcttctgacctatctacggacccttaaagctgacatgttagctcaagatctctgtgcagttcaaaatgt

SEQ ID NO: 6270 - DNA, 536 bp, Mus musculus
ccaacccgtggtgctatgagaattttattcaggctcgttccctacgccgtgcccaggacattcggaagcagatgttaggcataatggacaggcacaagctggacgtggtctcctgtggcaaatccacagtccgagtgcagaaggccatctgcagtgggttcttccggaacgctgccaagaaggacccacaggaaggctaccggactctgatagaccagcaggtggtgtatatccacccctccagtgctctcttcaacagacagcccgaatgggtggtataccacgaacttgtgctgaccacaaaggaatacatgcgtgaggtcaccaccatcgacccccggtggcttgtggagtttgctccggctttcttcaaagtttctgacccaaccaagctaagcaagcagaagaaacagcagcgcctggagcctctgtacaatcggtatgaggagccgaacgcctggagaatctcccgagccttccgccggcgctgaaagacagctgactacttgcctctcctgtatcatggcttcctgtga

SEQ ID NO: 6271 - DNA, 491 bp, Mus musculus
  misc_feature (173)..(174): n is a, c, g, or t
  misc_feature (189)..(189): n is a, c, g, or t
  misc_feature (242)..(242): n is a, c, g, or t
  misc_feature (244)..(244): n is a, c, g, or t
  misc_feature (258)..(258): n is a, c, g, or t
  misc_feature (282)..(282): n is a, c, g, or t
  misc_feature (356)..(357): n is a, c, g, or t
  misc_feature (420)..(420): n is a, c, g, or t
ttccaccatactcctgtcagaattgtccagtcagacatcatggagtacctaaaccaaaccagtacccagtaagaaaggctttacaaatcttgtctttgttccactcggtcaccagcctccatatgaccaaagcccacagcacttcctgtgtccctactaatgcatgtgcaatnnacagagatcctaatntatcattcaaagcactggccggttaaaagaagtggggatgggtggccagatcntntgggtcccagcctncttctcctccaaagctgggcatgntttgtcaagttctccttctgtttagccctttggtaccacagcaccctgtagttttcttagggaattttgaaggnntgagagcagaaacctctcatcacatgaagacagggcatttccaccaggatcccaaggtccctntggctcatatcctaccagccttcctgagtgacttcctgtttgtgcattcaggtcatggcacttggctacag

SEQ ID NO: 6272 - DNA, 410 bp, Mus musculus
  misc_feature (178)..(178): n is a, c, g, or t
  misc_feature (263)..(263): n is a, c, g, or t
  misc_feature (268)..(269): n is a, c, g, or t
  misc_feature (279)..(279): n is a, c, g, or t
  misc_feature (286)..(286): n is a, c, g, or t
  misc_feature (321)..(321): n is a, c, g, or t
  misc_feature (373)..(373): n is a, c, g, or t
ggcatcattgcctgcatcatcaaaggtgaacacagctggagcaagtgatacactgtcagttaatggacaggccaaaacccacactgaaaattccgaaaaagtccttgagccagaagctgcagaagaagccttggaaaatggaccaaaagactctcttccagtgattgcagctccatcnatgtggacaagaccacaaatcaaagactttaaagagaagattcggcaggatgcagattctgtgattacagtacgtcgaggagaantcgtnnaccgtccgantcccgantcatgaggaaggatcatacctattttgggaatttnccacagacagttatgacattgggtttggggtttattttgaatggacagactntccaaatgctgctgtcagtgtgcatgtcagtgagtcc

SEQ ID NO: 6273 - DNA, 400 bp, Mus musculus
  misc_feature (263)..(263): n is a, c, g, or t
  misc_feature (268)..(268): n is a, c, g, or t
  misc_feature (271)..(271): n is a, c, g, or t
  misc_feature (289)..(290): n is a, c, g, or t
  misc_feature (295)..(295): n is a, c, g, or t
  misc_feature (307)..(307): n is a, c, g, or t
  misc_feature (330)..(330): n is a, c, g, or t
  misc_feature (334)..(334): n is a, c, g, or t
  misc_feature (347)..(347): n is a, c, g, or t
  misc_feature (360)..(360): n is a, c, g, or t
cctgtgcccattgtatgcagtgggacactctgcatgctgggcagccatgaagccagagtctataggaggtgtcctggcagagttacataaagcactttaagtcaagccggagtggtaggtaagtcctctgcacaggagccttgccttgggtgagtgattcactgggatcattcaggacaaaggagaagtttccaggacccagagtgatgaggtgacaaatactattgggtctaccccggagcttatcatctatcctctagccntgctntgnaagactgtaggaggcttnnctggnctgagggaaggngcatgagctcagggtccaagccnactnttctgcatccaancaagcaggtggcnactggcttgtgaggagctgaagagtggtctgtgcccataa

SEQ ID NO: 6274 - DNA, 522 bp, Mus musculus
  misc_feature (27)..(27): n is a, c, g, or t
  misc_feature (29)..(30): n is a, c, g, or t
  misc_feature (33)..(35): n is a, c, g, or t
  misc_feature (37)..(41): n is a, c, g, or t
  misc_feature (43)..(46): n is a, c, g, or t
gaaggagatgacgacacatcacgcagnannagnnnannnnncnnnnactatgtgtttgcttaccttcattccttctgataatatattttccatgatttttgtttatttttgttaacatttaaaacatctgtgtggcatgaaaactaaggggaagataaaatttctacatgtgatactgtgatactataggtttaactcaagaggttgatagagcgtttgttataagacgtaacgtaacctactgttcatgtttgctctggtctgaagtgtttagctgttgagctggattccttaggagaccaaattaagatggcttaaattacatcttaaaattttcatttcctgtagttaattctgcatgtattagtcttagaagtaaacacaagttaaaacaacctgacaggaattccccaagtggcttgttttccaaagtcccgagaacaaccctaagtttcctaggtcttgtaactcagcaaggcttgtgaatggaaataacagtgcccaatcacattctgctttaaa

SEQ ID NO: 6275 - DNA, 384 bp, Mus musculus
  misc_feature (49)..(50): n is a, c, g, or t
  misc_feature (57)..(58): n is a, c, g, or t
tggaatgaccaaggccgacttgatcaataaccttggcaccattgccaanntcgggcnnccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatccttcacagtgaggactgacacaggtgaaccaatgggtcgtggaacaaaggttatcttgcatctgaaagaagaccaaacagagtatttggaggaaaggagaataaaggagatcgtgaagaagcattctcagttcattggctatcccattactctctttgtggag

SEQ ID NO: 6276 - DNA, 517 bp, Mus musculus
ggaattaatccctgagtatctgaatttcattagaggggtagtggattctgaggatctccctctaaatatttcccgtgaaatgctgcaacaaagtaaaattctgaaagttatcagaaagaatttggtcaagaaatgcttagaactatttactgaactagcagaagataaagagaactacaaaaagttttatgagcagttctcaaaaaatataaagcttggaattcacgaggactctcagaatcggaagaagctttcagagctgttgcggtactacacatctgcttctggggacgagatggtttctctgaaggactactgtaccagaatgaaggaaaaccagaagcacatctattttatcacaggtgagaccaaggaccaggttgctaactccgcctttgtggaacgtctccgaaagcatggcttagaagtaatttatatgattgagcccattgatgagtattgtgtgcaacagctgaaggaatttgagggcaagaccttggtgtctgttaccaaagaa

SEQ ID NO: 6277 - DNA, 136 bp, Mus musculus
gaagcttctttgatcccacctctcagcatagagattggtgcccgtgggtgaatatcacactcgtcaaagaaaccaaggagaatggggaaacagaagtggatgcctgtaccccagcagagccaggttggaaggcagt

SEQ ID NO: 6278 - DNA, 266 bp, Mus musculus
agctggacctgtgcaccacagtgctgccccagatcgagaaactgctgcagagcaagtatgagagctatgtccagaccgggtgcacctccctgaagctgatcctgcagcggttcctacccctcatcactgacattttggcagccccgccctctgtgggtgtggacatcagccgagaggagaggttgcacaagtgtcgactctgcttcaaacaactcaagagcatcagtggcctcgtcaagagcaagtcgggtttgagtggccgccat

SEQ ID NO: 6279 - DNA, 555 bp, Mus musculus
atgagaccaagacggcactgctgagcctgtttggggtcccactgtggtacttctcacagtcacctcgagtggtgatccagcccgacatctacccagggaattgctgggcgttcaaaggttcccaggggtacctggtggtgcggttgtccatgaagatctacccaaccacattcaccatggaacacattccaaagacactatcacccactggtaacatctccagtgcccccaaagactttgcagtctatggactggaaacggagtatcaagaagaggggcagcctctgggacggttcacctatgaccaggaaggagactcactccagatgttccacacactggaaagacctgaccaagccttccagatagtagagctccgggtcctgtccaactggggccaccctgagtacacttgcctctaccggttccgagtccacggagagcccatccagtagagcactccagccatgtacatgtctgtatataccaagacgccataacactggaactcattgagaaagagagcacgtgagcataggaacttgtcagccaccc

SEQ ID NO: 6280 - DNA, 339 bp, Mus musculus
  misc_feature (75)..(75): n is a, c, g, or t
  misc_feature (78)..(78): n is a, c, g, or t
  misc_feature (110)..(110): n is a, c, g, or t
  misc_feature (144)..(144): n is a, c, g, or t
  misc_feature (147)..(147): n is a, c, g, or t
  misc_feature (154)..(154): n is a, c, g, or t
  misc_feature (161)..(161): n is a, c, g, or t
  misc_feature (168)..(171): n is a, c, g, or t
  misc_feature (178)..(178): n is a, c, g, or t
  misc_feature (204)..(204): n is a, c, g, or t
  misc_feature (241)..(241): n is a, c, g, or t
gctgcccatgcccagacagaagtagcaaagaaatccggattaaaaccgccgacattataaacacaggggaaacanacngactcttttcaaagaagtttaccccctcttcnactcaaccctgaagacactgtcataaattgttgnacngtggaanttagtantcccttnnnngatgttntcattcattacatctgtttcatgttnaggtgtagtgggcgtggctgttgaaggaagtttgcantcttgcagcttttattccctgtgcaacaaaagcttagaacctgttaaagggatattaaaacaaagttgtagaatacaaacagtaattggccatgcaaa

SEQ ID NO: 6281 - DNA, 492 bp, Mus musculus
  misc_feature (67)..(67): n is a, c, g, or t
  misc_feature (313)..(313): n is a, c, g, or t
  misc_feature (321)..(321): n is a, c, g, or t
  misc_feature (407)..(407): n is a, c, g, or t
  misc_feature (424)..(424): n is a, c, g, or t
  misc_feature (428)..(428): n is a, c, g, or t
  misc_feature (442)..(442): n is a, c, g, or t
  misc_feature (462)..(462): n is a, c, g, or t
gtaacctgctagtagccacttgtctcctgcctcatcaggttcttgtctccctcccaccctgatgganggagtcctggcccctcctccactccgtggagccagcttagggctacagcgctcaaagcaagaaaacgccttccccaaggagcctgcacagtgggaagtggccgtgccctgttctcactttagcaaagatcttgggctggagcatggggtaggcccaggaaagcccctggggttctggaaggtggctccagcttcacgtctgccaaccatgtgtgttcccagcttgcccgcagagccctgtgccccngtgcacancctgcacaggtaacacagagcctgagagttacagcgggcacacgggagagttagttgtaagcaccgatatcaacttgacccctttntctttgacctagggctntctntcggtcacctagantctgcttcccggcagttatntcatagctgctgtttgatgacatctcagca

SEQ ID NO: 6282 - DNA, 447 bp, Mus musculus
  misc_feature (251)..(251): n is a, c, g, or t
  misc_feature (255)..(255): n is a, c, g, or t
  misc_feature (262)..(263): n is a, c, g, or t
  misc_feature (265)..(266): n is a, c, g, or t
  misc_feature (284)..(285): n is a, c, g, or t
  misc_feature (309)..(309): n is a, c, g, or t
  misc_feature (341)..(341): n is a, c, g, or t
  misc_feature (366)..(366): n is a, c, g, or t
  misc_feature (404)..(404): n is a, c, g, or t
gccgctctgattccctagtgaggagccggaggccatccttgggggaattactcctgcggcatgcacacagcccaaccagggcccgacaggcggtgcaggttctccaacctgggcgagatggaacaggacttggactaggtgggggctctccaggggcttcaactccagttctacttccccggggcggggcttctgagcgccaaggtgaggctcttcgagtcaagaatgctgtctactgtgcagtcattttncctngagtttnntnnaaggagttggctgccatnntcccaggcccatgctgtcacctcncctttcttgttggatacttcagaggaggtatntcttcctcccatctcaggctttggncccctcaatccttagttttcttccatggacaatcaggnccttctgtggcctgggctgaaatccaggacacgggctcctttt

SEQ ID NO: 6283 - DNA, 364 bp, Mus musculus
  misc_feature (131)..(131): n is a, c, g, or t
  misc_feature (300)..(300): n is a, c, g, or t
  misc_feature (328)..(328): n is a, c, g, or t
  misc_feature (336)..(336): n is a, c, g, or t
ctgtgtacgagctggactacggcaagcatgagctcgtcaacataaggaaagtgcagcccctagtggacgtgttccgaaagctgcccttccaggcggtcaccgctcaactggcaggcgtgaagtgcagccangtggtcggaggaggcttcgatggtgtttcgaaatcacgtggagaagaaagccctggtggcgttggtgcagacagttgttgagcacactaatccttgggaccggaaagtggtgctctatctcgtagacacgtcgctgcccgacactgacacctggattcatgactttatntcacagtatctgctagagctttcgaaangttaattnaatcactgcttgagatgttgaccgctaa

SEQ ID NO: 6284 - DNA, 445 bp, Mus musculus
  misc_feature (372)..(372): n is a, c, g, or t
  misc_feature (374)..(374): n is a, c, g, or t
cagagcaggcaaccgcactgttaagctgttttgtgtttcaagagaattctagtgagatgcccaaactaacagagcagttagctggaccactccgacaaatgcaggaatgtgctaaaaggattgcaaaagtttcagcagaggcaaagctggagattgatgaagaaacttacctaagctcattcaagcctcacctgatggatgtggtgtatacctgggcaactggggccacatttgcccatatctgcaaaatgacagatgttttcgaaggcagtataattcgttgtatgaggcgtctggaagaactgcttcgacagatgtgtcaagcagcaaaagccattggaaacacagagctggagaacaaatttgctgaangnaattaccaaaatcaagagggatattgtatttgctgccagcctctacttatagagttcagcgttatccacca

SEQ ID NO: 6285 - DNA, 504 bp, Mus musculus
  misc_feature (289)..(289): n is a, c, g, or t
  misc_feature (307)..(307): n is a, c, g, or t
  misc_feature (311)..(311): n is a, c, g, or t
  misc_feature (313)..(313): n is a, c, g, or t
  misc_feature (349)..(349): n is a, c, g, or t
  misc_feature (374)..(374): n is a, c, g, or t
  misc_feature (425)..(425): n is a, c, g, or t
  misc_feature (462)..(462): n is a, c, g, or t
  misc_feature (471)..(471): n is a, c, g, or t
agatgttttctctctatctcacaggtcctgcagggaacagctgaggggcccagatctgtcccttacaaattgactgcagaacagggtcccctcacttaactctggaacacagacaggccatggcttccataccctcaagtgagcaagaacacttgccagtgttaaaccattctccgccctagagtagccagcttttctacagaagtcctttctatgctggacacatcggtgcacttttggtgcatattttttagtgatagctataaagtaaaagcagggggtggggtgntcgtgtttgcaggagggncctntncactaagcgtagggtttgctggttggttcactggcncagtactgatccacaggcagttgtncccctatggaggagtttaccccagcatggttgtaattttttccccagctantcaaaaatcagtactaagtttccagaaaactggacantctgcaacnccaaaggggcagagtctgtatctcgggttgtat

SEQ ID NO: 6286 - DNA, 471 bp, Mus musculus
  misc_feature (45)..(45): n is a, c, g, or t
ggaccttcggacagtaaagcacttcatatggaagagtggtggggnacctcaccctccattaccgtcagaagtccacgtgagggtgggcccatgctcctgggttcttcaccaaccacctttctctgtggccccaagagtagtcctaggaagcccaccacgtcctacgggagcaagacctccaaccggcctatttggtgacgtgactaatggagatgtaatatagaaaccaggctccatgcatagattaaggtgtccccagggactcaagagtgcaaggacaagcccctggcactgtccggggagatgtacagagaatctacaacaggccagtgcagacttcgctgactccttttgaaggacccccctttgtctcttagcacttgttagagaacatcagcggggccacatcagtcgccatgtttcagtttcaaacccacaggctctgcagcttttccaagtacattccactca

SEQ ID NO: 6287 - DNA, 164 bp, Mus musculus
  misc_feature (96)..(96): n is a, c, g, or t
  misc_feature (124)..(124): n is a, c, g, or t
tgagttctggaaccacccccacttgtgccccacatgggccagtcactgttgagtcctttctcaagaaagactgcaactgttacttcccaggtcatngtgggtctgctaggttcagtgatggcangttcacatctgtatccaaggaagttgttatctggcagagg

SEQ ID NO: 6288 - DNA, 287 bp, Mus musculus
  misc_feature (95)..(95): n is a, c, g, or t
  misc_feature (180)..(180): n is a, c, g, or t
atcctgtagtgttgggccactcctgcctacagcggtattagagactccgtgagaccagctttcattaactttagccgggtacagcgggcctgaancactacatgcactgcctttgggagtgggcctgctccttccttaccccatgaggagccctgtctgaggcttcctgggcagactcancagtaggggcccttcccagtcgtctcctccccttgtcttggcatcagttgttttctatgaaaacagtgggttggttttgtgaagggtcttgggttagaaccacaatg

SEQ ID NO: 6289 - DNA, 523 bp, Mus musculus
  misc_feature (43)..(47): n is a, c, g, or t
  misc_feature (49)..(49): n is a, c, g, or t
  misc_feature (51)..(52): n is a, c, g, or t
  misc_feature (56)..(56): n is a, c, g, or t
  misc_feature (58)..(58): n is a, c, g, or t
  misc_feature (62)..(62): n is a, c, g, or t
  misc_feature (65)..(65): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (84)..(84): n is a, c, g, or t
  misc_feature (90)..(91): n is a, c, g, or t
  misc_feature (123)..(125): n is a, c, g, or t
  misc_feature (232)..(232): n is a, c, g, or t
  misc_feature (242)..(242): n is a, c, g, or t
  misc_feature (246)..(246): n is a, c, g, or t
  misc_feature (248)..(248): n is a, c, g, or t
  misc_feature (253)..(253): n is a, c, g, or t
  misc_feature (259)..(259): n is a, c, g, or t
  misc_feature (263)..(263): n is a, c, g, or t
  misc_feature (266)..(266): n is a, c, g, or t
  misc_feature (269)..(269): n is a, c, g, or t
  misc_feature (272)..(272): n is a, c, g, or t
  misc_feature (274)..(276): n is a, c, g, or t
  misc_feature (282)..(282): n is a, c, g, or t
  misc_feature (286)..(286): n is a, c, g, or t
  misc_feature (289)..(289): n is a, c, g, or t
  misc_feature (295)..(295): n is a, c, g, or t
  misc_feature (304)..(304): n is a, c, g, or t
  misc_feature (306)..(306): n is a, c, g, or t
  misc_feature (315)..(315): n is a, c, g, or t
  misc_feature (318)..(318): n is a, c, g, or t
  misc_feature (320)..(321): n is a, c, g, or t
  misc_feature (323)..(323): n is a, c, g, or t
  misc_feature (325)..(326): n is a, c, g, or t
  misc_feature (339)..(339): n is a, c, g, or t
  misc_feature (346)..(346): n is a, c, g, or t
  misc_feature (357)..(357): n is a, c, g, or t
  misc_feature (372)..(372): n is a, c, g, or t
  misc_feature (388)..(388): n is a, c, g, or t
  misc_feature (422)..(422): n is a, c, g, or t
  misc_feature (443)..(443): n is a, c, g, or t
  misc_feature (451)..(451): n is a, c, g, or t
  misc_feature (490)..(490): n is a, c, g, or t
gggcacctgagaatacatgtttgtgtgcaggtaggtgtatgcnnnnntngnntccngnacantanctttggggccantnagntnaacagnnagcctggaacttgctctagagcaagagtcctnnnttctacctggtcaacaaaggccctggtccatggtctcccttgtgctcaatctcagcaccggctaggggaggtatcttggtatctcggtactctttctccactctttntggggtaggncagnanccccntgagancccngtngtnccncnnnccactnacancancataantgaaggatntnataataccnacnanntntnncaaagtggtgggntctagantcagcactganccatttcctttgganccttcctttaaccacncaggactataaactgaatggtgtatacatgacantcacagattgcccttttgcgnccagagancccaacttggagacctgtaccccaggtgccagggtgctntcaccatggctcccttgagcaaatggaacaaat

SEQ ID NO: 6290 - DNA, 545 bp, Mus musculus
  misc_feature (408)..(409): n is a, c, g, or t
  misc_feature (471)..(472): n is a, c, g, or t
  misc_feature (474)..(474): n is a, c, g, or t
tcatcccttgtcattctactgtgtcctaagccctggtggtcgaccttttctttttcttcctatcctcagggacctgtgctgctccaccctcgtgtcccacttggttgtttagttgaggcactttataattttctctactgtcccacactcccgttggctttatttccctgctgtctcctgtcctttgcagcgtgacccccactctttgccaactcctccttcccacaggcactggccaagctttagggcaggttctcttctgagggaactgggtggtgtcaggccagcagtgctgtgcttgggtcactgtcgccttgaacctacactgtacccttgtccagctcagcactcatgatgcaggacagcagggtcccctagcactttgccagcactgaggatggcatgttnntcttctcttttggaggcgagggacttcccttctgtattaggggagaagaacagaacctactnntnctggaccacagttgagactccctgctagggtgtaaagtggatagtaagatctgtgtaggtgttaactggaa

SEQ ID NO: 6291 - DNA, 412 bp, Mus musculus
  misc_feature (285)..(285): n is a, c, g, or t
  misc_feature (288)..(288): n is a, c, g, or t
  misc_feature (299)..(299): n is a, c, g, or t
  misc_feature (323)..(323): n is a, c, g, or t
  misc_feature (336)..(336): n is a, c, g, or t
  misc_feature (351)..(351): n is a, c, g, or t
aatgcaagatgcgtaggcccctggcttttaaagttcattcggaagaatatattttaaaatactgaaatgttcctaaacatttttatattaacttattacatgcaatagcattaggttttaaatcaagattttgcttttattattttcatacattttcagagatgaagatgcaaggagcttccttaatacctcagataattcaaataagagttctatccctgcaacttattgttaacctgagtagaaaagtcagtgttttattacaattgagaaacagactacctntancaattattccnatggagactaaagcatccacattntaccttagacgancagtgagttctttcnagacgtagggaaatgagcatttttactaatgatttctagttcctctgctctcacgtatgtt

SEQ ID NO: 6292 - DNA, 86 bp, Mus musculus
gatctattcagatgaagtgcttcccactgctgacacaaccgtgtaaagcttgactacatcagaacacacagttgtaaaatgatttt

SEQ ID NO: 6293 - DNA, 347 bp, Mus musculus
  misc_feature (275)..(275): n is a, c, g, or t
aaatctgtgcacataccgttgccacagctgccactgtcagcatcacagccaaacgagaagcttgcagaggtcctcagcaggcttctggaaggggaaggacgcttctcgagaaatgtgccattgccacataattatcacattgattttgaaatcagaatggatactaacaggacccaagtattttcattttctgatgtagatgcaagttctgccacaaacatgcagagagtagcagtgctgtgtgttcctaagtctgtttactgtttaaattcatnccaccccagaggattgatggccatgaaaatccgacatttgaatgtaatgggcttccatgtgatcttgatcca

SEQ ID NO: 6294 - DNA, 274 bp, Mus musculus
acatcggagctgtctttgggcttggctttcccccttgtctcggagggcccttccgctttgtggatctgtatggtgctcagaaggtagtggaccggctacggaagtacgagtctgcctatggaacacagtttaccccatgccagctgctcctcgaccacgctaacaactctagcaagaagttctaccagtgacaggccctcccaccctaccccaccatgcactaacccagacctggcagtgccgcttctcagctgtgctgtccaaattatcagga

SEQ ID NO: 6295 - DNA, 391 bp, Mus musculus
aaaagccgggtagcctttgctcagatgaccatgccttgccccaacttctatattctggatgaacccacaaaccacctggacatggagaccattgaagctttgggccaggctctcaacaacttcaggggtggtgtaattctggtatctcatgatgagcgcttcatccgactggtgtgcaaggagctgtgggtgtgtgagaacggcagtgtcactcgggttgaggggggctttgaccagtaccgggccctcctccaagaacagttccgccgggagggcttcctctagagccccagttgagtaaggactgtgcctaggacgtggactggttttggaagatccctgagctaccatgtaggcaaccaactccaagcttaggactttccctacttgg

SEQ ID NO: 6296 - DNA, 322 bp, Mus musculus
  misc_feature (249)..(249): n is a, c, g, or t
  misc_feature (251)..(251): n is a, c, g, or t
  misc_feature (265)..(266): n is a, c, g, or t
cggacgcatcagatggttttactgaggaagctctgtctccccatgctgtgcttcctgcttcacaccatactgcacagcaccggacagtaccaggagtgcctgcagctggccgacatggtgtcctctgagcgccacaagctctatctggtgttttctaaggaagaactaaggaaactgctgcagaagttaagggagtcctctctaatgctcctagaccaggggctcgacccgcttggctatgaaattcantnataactcaccattnntctgatgcccatgactagaggaggatgcttgcttgcttcgttgagttgcttggttg

SEQ ID NO: 6297 - DNA, 224 bp, Mus musculus
attcttatgtggctgcaggatcctctggaaatgactatgatttaatggctcagccgatcactcctggcccctcaattccaggtgccccacagccaatcccaagactcttctttgctggagaacacacaatccggaactacccagctacagtccatggtgctctgttgagtgggcttcgagaagcaggaaggattgccgaccagtttttgggagccatgtacact

SEQ ID NO: 6298 - DNA, 323 bp, Mus musculus
  misc_feature (191)..(191): n is a, c, g, or t
  misc_feature (208)..(208): n is a, c, g, or t
gcaggaaggattgccgaccagtttttgggagccatgtacactttgcctcgtcaggccacaccaggtgtccctgcacagcagtccccaagtatgtgagacagatggttctgaacagagagatccaacggcatgtcatctgccacgtaagcaagctcttctagcaatactagatcctactgagaaactccatntcatcagctactgggantcctagtttgacagcagaggctggctcctttggctgacagcaacttacccattgatttggaagtacagctccataaagactgctcgagaagcaagtggtgtgagataacctctta

SEQ ID NO: 6299 - DNA, 488 bp, Mus musculus
  misc_feature (74)..(74): n is a, c, g, or t
  misc_feature (116)..(116): n is a, c, g, or t
  misc_feature (160)..(160): n is a, c, g, or t
tccacttccagtatgaggtcaccgaggtgaaggtctcttcctgggatgcagtcctgtccagccagagcctgttntgtagaaatcccagatggattattagctgatgggagcaaagnaaggattattagcactgctagagtttgctgaggagaagatgaanagtgaactacgtcttcatctgcttcaggaagggccgggaagacagagctccactcctgaagacgttcagcttcttgggctttgagattgtgcgtccaggtcatccctgtgtcccctctcggccagatgtgatgtttatggtttaccccctggaccagaacttgtctgatgaggactaatggtcacagaggatgctttgcctaagagccacagtgggggaagaggggaagttaggcagccttgggacagaggagagggtctctggctgtctagggaaggacattgaggggctcaggttgagggttgcccattgtgttctcggagttgac

SEQ ID NO: 6300 - DNA, 247 bp, Mus musculus
taaagttttaatgtctctgtaagcatagctgctccacctggctttgtgttcagtgttctaggttggcccaccttgggggagaggggacaggcttggatatttgagttcctcacatactgcagttatttttgttaacaaccaattacttccttgctttgttttgttgccttgcctgtagggaggtaaagttgcttaattagttaatgtataaaaatacatgccattgcacaggctgcgtgtgacagca

SEQ ID NO: 6301 - DNA, 403 bp, Mus musculus
  misc_feature (36)..(37): n is a, c, g, or t
  misc_feature (192)..(192): n is a, c, g, or t
  misc_feature (194)..(194): n is a, c, g, or t
  misc_feature (283)..(283): n is a, c, g, or t
  misc_feature (295)..(295): n is a, c, g, or t
  misc_feature (373)..(373): n is a, c, g, or t
aagaataagttgtctgctcccttcctgtaataacanngtctaaaatcacttggagtcctaaaaacaagcaaactcacatgtttgagttcttctgctcctgaatttgttatttttttgatacttgcttctattaccttttatatatatatggttatcctagtgcaaaaattcattagacttgattcccttaancnagttagaagtgtgaaggaggaagacattggctgaagctctcataatactagtgggttagtagtcactgtgcattgacagacttgtgttntctatgtagctntcagttagttagaaagctttactgttccactgtgtacattaaggcatgtgttggtatatatgtgtattctgtgtctantcacaggctctccagtacctgacatgtgta

SEQ ID NO: 6302 - DNA, 402 bp, Mus musculus
  misc_feature (29)..(29): n is a, c, g, or t
  misc_feature (73)..(74): n is a, c, g, or t
  misc_feature (119)..(119): n is a, c, g, or t
  misc_feature (223)..(224): n is a, c, g, or t
  misc_feature (229)..(229): n is a, c, g, or t
gacgccatcctcagatatgttcgtagggntggtgatcctcctcagacacttcctgaagagccgatggaagttnngggagcagaaagaacttcccctgaacctcagagagagaatgcttnccccagcccctggaacaacagcagaagaagccatgtcccgaggcccgccccctgctcctgaaggaggttcccgagatgaacaggatggagcttcagctgatgcnnagaanccctgggcagctgcagtcccccctgaatgggtccctattatccagcaggacattcagagccagcggaaggtgaaacctcagccgcccctgagtgatgcctacctcagtggcatgcctgccaagagacgaaagctccggtctgatatccaaaaacgactgcaggaagatcccaa

SEQ ID NO: 6303 - DNA, 181 bp, Mus musculus
gttgcgtgtgaacacgagcactccaactgcctcctgatcggacacaagaagtttaagatcgatggagaatggtggacatggatcaattacagccgcttccaagagctcgttctgcagtacgaagagagtggaggctccaagacgttcagctcgagggattacatggccagaaccccacagt

SEQ ID NO: 6304 - DNA, 481 bp, Mus musculus
gaaaactaccagatgctcacattgggaggagatgctgaactggagcttgtggacagtttagatcctttttctgaaggaatcatgttcagtgttcggccacctaagaaaagttggaagaagatctttaacctctcaggaggcgagaaaacccttagttccttggccttagtgtttgctcttcatcactacaagcccactcccctctacttcatggatgagattgatgcagctctggattttaaaaatgtgtctattgttgcattttatatatatgagcaaacaaaaaatgcccagttcataataatctctcttcgaaataatatgtttgagatttcagacagacttattggcatctataaaacatataatagtacaaaaagtgttgcagtgaacccaaaacaaattgcgtctaaaggactctgttgaagttgttcacactgaaaattttcaaatctagattgggtgttctagttttgtctgt

SEQ ID NO: 6305 - DNA, 393 bp, Mus musculus
  misc_feature (28)..(28): n is a, c, g, or t
  misc_feature (37)..(39): n is a, c, g, or t
  misc_feature (58)..(58): n is a, c, g, or t
  misc_feature (62)..(62): n is a, c, g, or t
  misc_feature (289)..(289): n is a, c, g, or t
ggagatttgaatgcataccagtgttttntattatttnnnattgccaactgtccttcangtanggagagttaacctgtactatgtcagcataaaaagcccatctccagatgtgcccaggtgtgacagggggctatgaccttccacttaaaaagcatgtttaactggatgctgagagcctactgtgtatgtcaagaagctacacaagcatgttgtggatatgtgtaaagtatagtccaggtaaaacactttgccaagtttcaatagacttcacctctccctcagacttgancctttacactcaggagggtttgctccaagcatgagctcttgtattctacttacataggtctaatttataccaagaatcaggtagaataaatgtgcccacaccct

SEQ ID NO: 6306 - DNA, 489 bp, Mus musculus
acacaaagctgatgatgcccactcaccctgcactcctgtggctctgacgttaaggtttctgtttagagaaaagaactgtgtagcatgtgcagggaactgtgaaggaagactgagaccgcctggaaacctgtcaggggctcacaccacgaactctcagaagttgggcaggggtgctggctttgttagccggcttttttgggaaatgctttttttgacctgttatataaatgaagtgggtatgaggtctcagctacccagcagatggaacatcgcccagggacagcttggggtttccaggtaagaaccctagaaaggtggatttaatcctcacaggttttgttttccaaattcatttgcttttatttttctaagaactgtaaactctattttttcatgttctcagggcccctgggtagacaaacaaagcttgatttcagagcagaaataggccaagaaaccatggcgttgcgtgtgctgagtccagacaaa

SEQ ID NO: 6307 - DNA, 195 bp, Mus musculus
  misc_feature (48)..(48): n is a, c, g, or t
gaacagacactggtgcagactccaactgatgtggagctcccaccgaangaggtcatgctcacacctgccagtcagaacgacctctcggacttccgcagcgagccagccctctatttctgacccctgcaactgtcaggatggccaagacttagccccaggtgtggtggtcctggaagccagtcaatacccaggagc

SEQ ID NO: 6308 - DNA, 417 bp, Mus musculus
tattggcagctgatcaaactcttcaggcaggattcctgtggactttgagatttcctgttacctcatcttcttttttaaagtacacctgacttgggagggtactgtctctaatgtatatttctagtgtttacagacactaagtgtgtatatgtagtaactatttacagaccacgcatccttatactgtgacttcacctagatcttctaccaagctgaagaccctgctggctctgaaacaatccttgcagttactccccagctgttcgtctggacagctcattcaagtggatttttaactattagggatcactgcgaagtttcgttggattttattttatgtccttcagagcaccctcccccacccactagggtccagaagagcaatggaggaagtgacagctaatggtgcagttctaa

SEQ ID NO: 6309 - DNA, 511 bp, Mus musculus
  misc_feature (312)..(312): n is a, c, g, or t
  misc_feature (438)..(439): n is a, c, g, or t
gactccagccaactttcttgatgttggtggaggcgccacagtccagcaagtaacagaagcgtttaaactcatcacttcagataaaaaggtgcaggctattctggtcaacatttttggaggaatcatgagatgtgatgttattgcacaaggaatagtcatggcagtaaaggatttagaaatcagaatacctgttgtggtgcggttacaaggtacacgagttgatgatgctaaggcactaatagcagacagtggtcttaaaatccttgcttgtgatgatttggatgaagctgctaaaatggttgtaaagctctnctgaaatagtgaccttagccaaagaagcccatgtggatgtgaagtttcaattgccaatatgagcaagaccttggtggatggctacgggtattaatgtgctgtaattctttattatactgtggtctnntcctagtgtcccttttcttttaatgtgtggagaatgtaatcaccacataggcacacatacctttgaaagcat

SEQ ID NO: 6310 - DNA, 402 bp, Mus musculus
gcacatctttgtgatctagccttgtctctttaggaaagccttcagtctttcagagaggacctagaacattaacagtgttgagataatacatgctgggtagtctctagtcagcaagtgcacatgggctcgcctgacgagatcacgagatcggttcttctgcccacaggaggaaggatcggaatgatggtttgttttctttctttcttttttgaaatgtaggtttactttatgaaaaccattaaaatgttgctagctgaaagcaacaagtagttccaaatgcattgtgggtttcagttaggccttcccagttgtcttccttgttgctgaaggtcctcaccagctgagtgtagaggataccaaaggaattggaagatgagaaggcttattagtcactccctgtga

SEQ ID NO: 6311 - DNA, 220 bp, Mus musculus
aattctggcattccatcgagccgaagaggctgtgttcagcagtggggagcatgagatctttgtccagttctgcactgccttcctggaagaccttgttccttatttgaaccgctgtcttcaagtccttttcccaccagctcagatagcccagactttaggcatttcacccacccagctctctaagcacggaaaccttggacacgtgaacatcagcgccatc

SEQ ID NO: 6312 - DNA, 185 bp, Mus musculus
  misc_feature (44)..(44): n is a, c, g, or t
ctttcatcattttggtggcttctctgtttggcctcattagtctncgctcacaggttctcagctgccatttgatttcctaacttgttctgaagtgttccctgagtactgatcactttttcttttgagacatatgacaaagtcacaaagtctcagactagaagtagcctagtactatcatggtatta

SEQ ID NO: 6313 - DNA, 254 bp, Mus musculus
gtcctcggaatggagaatgctcatcaattatgtaggttctctcatttcattcatctcacgttattttgagttcttccccaaaggctgttgagtttagcattagtagggccatgggtcatgaatctgaagttttgaccgccttgtgtctagagagccatgaagagaaaaggatcaaagggggcaaagtctcagagttaacctagaacctgacacgctcaaccacactgcagatgtctgtatctccacagactgga

SEQ ID NO: 6314 - DNA, 487 bp, Mus musculus
  misc_feature (88)..(88): n is a, c, g, or t
  misc_feature (198)..(198): n is a, c, g, or t
  misc_feature (346)..(346): n is a, c, g, or t
  misc_feature (377)..(377): n is a, c, g, or t
  misc_feature (434)..(434): n is a, c, g, or t
  misc_feature (436)..(437): n is a, c, g, or t
gaactcagggcattaaactcttaaaaactatattgaaatggcttatggcaagtgcaggaagatctttttctacagcagtcaaagagcnaacttcagcttctgcctttgttctttaagatcgctccagtggaaaatgacaatagttatgatgaactgaaaagagatgcaaagctctgtttgtcactaatgtctcagggnttgctgtaccctcaacaagtgcctttgatacttcaggtgctaagccagacagcaagaagcagttcttggcatgcaagatatacagtgctgacctacctccagaccatggtattttataacctctttattttcctaaacaatgaagatncagttaaagacatcagatggctgattatatnccttttggaggatgaacagttagaggttcgagaaatggctgctaccaccttaagtgntnntgttacagtgtaacttccttaccatggacagtgctatgcagattcatttt

SEQ ID NO: 6315 - DNA, 395 bp, Mus musculus
  misc_feature (320)..(320): n is a, c, g, or t
  misc_feature (337)..(337): n is a, c, g, or t
  misc_feature (354)..(354): n is a, c, g, or t
  misc_feature (369)..(369): n is a, c, g, or t
tcaagtacctagactcagacacggagaaggaactacaagcactttatgcactacaagcatccatagtaaaacttgaccaacctgccaacttgctccggatgttttttgattgcctgtatgacgaggaggtgatatcagaggatgccttctacaaatgggagagcagcaaggaccccgctgagcaagctgggaagggcgtggccctcaagtctgtcacggcctttttcacgtggcttcgagaagcagaagaggagtccgaggataactaatacttcaaatacacaaacgaaacaaaagaaacaatttaagtatttttttanaaaagtttcacgtcttncgccaatcacagtgcangcaaggccaactctncgcagaaaccccacgtgtgcgcgagt

SEQ ID NO: 6316 - DNA, 439 bp, Mus musculus
caagccatcgatgcagtgaagcctggtgttcgatacagagaactgggaaacatcattcagaaacacgcccaagcaaatggattctcagttgttcgaagctattgtgggcatgggatccacaaacttttccatacagcccccaatgtcccgcactatgccaaaaataaagcagttggtgtgatgaagtcgggtcatgtgtttacaattgagccaatgatttgtgaaggtggatggcaggatgagacttggccagatggctggactgcagtgacgagggacgggaagcgatctgctcagtttgagcacaccctgctggtcacggacactggctgtgaaattctcacccggagactcgatagctctcggcctcatttcatgtcccagttttaatttctctcaagatgcctaacatacgaacaccatctcgtactgtgcattt

SEQ ID NO: 6317 - DNA, 444 bp, Mus musculus
  misc_feature (308)..(308): n is a, c, g, or t
ccctcctgtcaagcgttcaagtggagaaaccaaaaggagacgaaagcgtgtactgaaatctaaaacctttgtggatgaagaaggctgcatagtgactgagaaagtctatgagagtgagtcctgcacagacagtgaggaggagcttaagatgaagccggcctcagcacacaaaccccctgctgccgctgtgaaaagggagcccagagaagaacggaagggccccaagaaaggggctgctgctctgggcaaagccaacagacaagtgtccattactggcttcttccagaaaaagtaaatgctacctctgnaaggactcgggctggtcaagggagaagaccaagaagtatagactgtcacttactgtgtaagtttgcctcgctccttgcctcgcctggatcagatgctgctctgccatcacgggacacgtgtaccacttctgttttc

SEQ ID NO: 6318 - DNA, 407 bp, Mus musculus
  misc_feature (215)..(215): n is a, c, g, or t
  misc_feature (217)..(217): n is a, c, g, or t
  misc_feature (309)..(309): n is a, c, g, or t
  misc_feature (339)..(339): n is a, c, g, or t
tgcaggagtaccagcggagagaaggggtggacatggagcagctgctttccctaggctctagtgacggggatgaaaagtacgagaagaccacagttagcagtggggatccaacgttttataggttcatgaagagaattgctgcttgccaggagcagattttgaggtattcgtggagtggagagcctctctttctgtcctgccccacatttgaagtntntgaggtcccagcctgcagtggctgtggaggccagaggacgtttgagtttcagcttatgccagcactggtcagcatgctcagcagtgctaatntaggtcttgccgtggaatttggaacgattntcgtttacacatgtaaacagagttgctggcctccaaatcagcagatgcccatggaagaattctgtgtt

SEQ ID NO: 6319 - DNA, 390 bp, Mus musculus
  misc_feature (26)..(26): n is a, c, g, or t
  misc_feature (297)..(297): n is a, c, g, or t
  misc_feature (299)..(299): n is a, c, g, or t
cagttccagccctattatatctgtgntgctgaagaggaggattatggcagcgttgtggatcttgatcatgcgcacagccttctgcaggagtaccagcggagagaaggggtggacatggagcagctgctttccctaggctctagtgacggggatgaaaagtacgagaagaccacagttagcagtggggatccaacgttttataggttcatgaagagaattgctgcttgccaggagcagattttgaggtattcgtggagtggagagcctctctttctgtcctgccccacatttgaagtntntgaggtcccagcctgcagtggctgtggaggccagaggacgtttgagtttcagcttatgccagcactggtcagcatgctcagcagtgctaat

SEQ ID NO: 6320 - DNA, 477 bp, Mus musculus
  misc_feature (42)..(42): n is a, c, g, or t
  misc_feature (80)..(80): n is a, c, g, or t
  misc_feature (87)..(87): n is a, c, g, or t
  misc_feature (103)..(103): n is a, c, g, or t
  misc_feature (118)..(118): n is a, c, g, or t
  misc_feature (141)..(152): n is a, c, g, or t
  misc_feature (154)..(156): n is a, c, g, or t
  misc_feature (158)..(158): n is a, c, g, or t
  misc_feature (161)..(164): n is a, c, g, or t
  misc_feature (167)..(168): n is a, c, g, or t
  misc_feature (170)..(177): n is a, c, g, or t
  misc_feature (179)..(180): n is a, c, g, or t
  misc_feature (302)..(302): n is a, c, g, or t
  misc_feature (304)..(304): n is a, c, g, or t
  misc_feature (322)..(322): n is a, c, g, or t
  misc_feature (324)..(324): n is a, c, g, or t
  misc_feature (326)..(326): n is a, c, g, or t
  misc_feature (329)..(329): n is a, c, g, or t
  misc_feature (341)..(341): n is a, c, g, or t
  misc_feature (343)..(343): n is a, c, g, or t
  misc_feature (346)..(346): n is a, c, g, or t
  misc_feature (348)..(348): n is a, c, g, or t
  misc_feature (351)..(351): n is a, c, g, or t
  misc_feature (356)..(356): n is a, c, g, or t
  misc_feature (385)..(385): n is a, c, g, or t
  misc_feature (401)..(402): n is a, c, g, or t
  misc_feature (404)..(404): n is a, c, g, or t
  misc_feature (430)..(430): n is a, c, g, or t
  misc_feature (434)..(434): n is a, c, g, or t
gcccgcgagcaaaagctcccaatagccattctgaatatcggnccccacccggtctgacgatttggcttgcctgaagctgnattcccnctgtggagagttgctncctttaatagacccncggagacagcactctgatgtccnnnnnnnnnnnntnnncnttnnnntgnntnnnnnnnntnnagatccctaaggatccccccaccccccaatgccgctccaactctgaatcctagaggtggcaaagccacgtctagaggccaggcaccctcctgtttacagaaatgagagctgccccctaaggnanagacttttccaaagaaanancntgntcttgatggagnanctntntcnccttntggtaaccggaagaaggaccaggcagaantcagtaaaccacaacnntntatgaggggcaacgtggagatagatntcantcattcagggcatttataattcattcataattccaaatggatg

SEQ ID NO: 6321 - DNA, 192 bp, Mus musculus
  misc_feature (49)..(49): n is a, c, g, or t
  misc_feature (124)..(124): n is a, c, g, or t
gagaacaagacacagcagagcccctccaaggacgctgaggcagcagacngagtcggtttttgcgtcctctcaggagagcagcagtgcggtgcccctctgccagccagcagacctgaggaccacngaatgacatgtcatgctctggaactagatagagtcatcgtacagttagcattctggacttgaactctg

SEQ ID NO: 6322 - DNA, 490 bp, Mus musculus
  misc_feature (159)..(159): n is a, c, g, or t
  misc_feature (338)..(338): n is a, c, g, or t
  misc_feature (342)..(342): n is a, c, g, or t
  misc_feature (346)..(352): n is a, c, g, or t
  misc_feature (359)..(359): n is a, c, g, or t
  misc_feature (366)..(366): n is a, c, g, or t
  misc_feature (391)..(391): n is a, c, g, or t
  misc_feature (439)..(439): n is a, c, g, or t
ggttgacccacactaggcgaaactggactcgtacgactcttttatatttttatacttgaaatgaaatcttttgcttcttttctaagcgaatgattgctttcaatgtttgcactgatctagttgcatggttagtcagaaactgccatttgaaaaaaaaangttatttttatagctgcagaaaaatgaatacagttaaatgtattatacataattttggaaccaaagaggccagcggatcagttttaatttttattagatggtgaggccatcttctatgaggtagatgttctaaacaatccttcgagtggcctgccagtgtttcagggtataaatgattntttntttnnnnnnnattcagntgatgtntcttttctgtccgtacacacccagnaggtagagtaaaataaatgactggtggagtgaaggtgtgtgctgtaantcctcacctttagtttatttaataaatccctccttaggttctgtttcataa

SEQ ID NO: 6323 - DNA, 361 bp, Mus musculus
  misc_feature (331)..(331): n is a, c, g, or t
  misc_feature (336)..(336): n is a, c, g, or t
gttgtgttgtgtgccatcatgtctatcccactgtttgtgtcctgtgtgggcaggaatgtgacaatacctgatgccacccagaactcacttttgagctcttaatgtgaaacatggggaaagtagcaggtgttgaaaaacagaagaggtcctgtatgcagtctcataaacaaaaccccatcattttgtcttggtgtgtgctgtgttgggaagctttggaggttcctaggtacctggtatctggctcccagcagcagctcctgttccttgtagatccatgggctcctttgtgaacaacatacctttttctccatccttctcactgtggtggcanccttnttcagtgtgcccaagccatgtttgg

SEQ ID NO: 6324 - DNA, 390 bp, Mus musculus
aagacgtacaatcgccttgcttttcaaccaatcctgactcttctgagacatgagcgagtgtgacaatgtcaaaacactgtgcacaacgaccgattgtccctccctggtactgatgggacggggccagaaagtgggagccaaagtgttcttttctggtttttctgtgtgctgtaggatgatcgaacgggttcgggaggtttgtgggcagtccccttctctggtggccaaatggactttcctttctcctcagtggcaagcactacatccacacatgcacttgtgacctttctttaatgttgccaacttacgtttgtgcatttgtgtcagaatgtttagtttacaaactcgggggctctaattgtataatttgctttgaggagatctactagg

SEQ ID NO: 6325 - DNA, 493 bp, Mus musculus
cagctagcatctgaccttggaactagaagtgacctcaagctcagctacttggaagaagctgtgatgcacctggaccacagcgatcccatcactcgagaccacatgggctctgtcatggctcaggtgcgccagaagctcttccagttcctgcaggctgatccacacaactcacttagcaaagctgcccgccgcctcagcctaatgttacacggccttgtgacccctagcctcccttagccatttaaagagggatgaggtgatgctgaaggccagttggcaggtttaggtcaaggcagggccatgtctgctgtttccctgctcaggccttcctctctggtgtgtggagggaggtatgcagcagggctcacgggcagtgctctactgattgtggtaaccagcagggtcaggcgggcccagggcacgtagtgtgccttcttgggtcctaccatgcctgaagcgtgaccccaagatcgtgacaccacttgagttgaat

SEQ ID NO: 6326 - DNA, 516 bp, Mus musculus
  misc_feature (341)..(341): n is a, c, g, or t
  misc_feature (354)..(354): n is a, c, g, or t
  misc_feature (374)..(374): n is a, c, g, or t
  misc_feature (386)..(386): n is a, c, g, or t
  misc_feature (389)..(389): n is a, c, g, or t
  misc_feature (412)..(412): n is a, c, g, or t
  misc_feature (427)..(427): n is a, c, g, or t
  misc_feature (465)..(465): n is a, c, g, or t
  misc_feature (484)..(484): n is a, c, g, or t
aactgacaggacatcgggctgctggggaaagggcgcctgtgcagacggcctgcccggccagaatgctgctctgcctctgcacccaaccatgttcctcggtgaacccagaagggctagcctgggcagtcttagactcatcctgtgggtattgtggacacactgcttggcttcaagctaggcctggtgccagaggatcgtctcagctgcctgtgacgtgctcctttggtcttgaatcttgaatcaaggtgtggtggccttgttcttcactcacttggcaggtgggagattgagtcccgtgtgccatacagacctcagaagcacttattaagtgcctgtgtatntcctagaatgggntggtcctttgtataagaaanctaggagaaccngtntaaggtgtggagtgggaaccctntctttcctaggccancctgtgttcattcacacagagacaccaccaacagcagntcatccatgggacagtgtntctcatactgtgtttatggcttcctcagagca

SEQ ID NO: 6327 - DNA, 187 bp, Mus musculus
tcatccttgtggtgcttacacacacccagttgtctccacagctctgatacctttgccttctgttctcctctctagcataagactttggcttctgccttaaggttttcctaaggaattaacaggtcttttcatcttgtatagtttttacagtgtgaatccaacattggctcagtatgctaatgtgaca

SEQ ID NO: 6328 - DNA, 316 bp, Mus musculus
  misc_feature (53)..(53): n is a, c, g, or t
  misc_feature (264)..(264): n is a, c, g, or t
gaagtgtcttggagatttactgaaatagctaattgtcaggtgcttaagctttntgtgcagtaagcctaaaagttagcagaagatggcctcctgccagcaggaaatctttaccctttagtacccgaaccagtctcaaggtgttctttggaaataaccagggttaaagtttttaatttctcaggaagagctcttcagcatggcaggacgtgtaatgagggctttcgcaagtccttcagcgctgcagagcagtaagctatccatccngtgagtgtggcggctctttctacagctgaactcctcctcagttgagttttca

SEQ ID NO: 6329 - DNA, 463 bp, Mus musculus
  misc_feature (341)..(341): n is a, c, g, or t
ttggccttgctgacccagtttatatcccttcttgggtcaggcaccagtatctgcatacagaatctggggctgatacacagagccaagccactgcttctcatgtggttgattgtttacaagcctaattgtaaaaactgaaggcatttttcctgctgccttttcccaaagtggttaggtttggaaaatggataacactagtattattttatttgtgctttttaagccatgtcccccaggtgggaatcgcatgcttgtcttcagactcctactgacctgcctcatgaggtttggacatggctgtgtgggttgaggtgactgctgccctcattgctctttgcctntctctgctttatgcctggaaagctttccaggaggtggaggagaagggtccttacacttcctgaggtaccgtgtcacctgcagtgagttggcaactggggatgtgggcactgcagcttttatt

SEQ ID NO: 6330 - DNA, 495 bp, Mus musculus
  misc_feature (321)..(321): n is a, c, g, or t
ataaggcctgcgtatcccagctcaatgggatggtcttctgtccccactgtggagaggatgcctcagaggcccaggaggtgaccattcctcggggcgatgggggaacacccccaattggcaccgcagctcctgctctgccacccctggcacatgatgccccagggcgagcggatacctcccagcctagcgcccgaatgcgagggcatggagagccgcggcgcccgccctgtgatcccctggctgacaccatcgacagctcagggccttcactgactctgcctaatgggggctgcctctccgctgtgggtctgcccccagggncgggcagggaagccctggaaaaagccttggtcatccaggagtctgagaggcggaagaagctgcgattccacccacggcagctgtacctgtcggtgaagcagggggagctgcagaaggtgatccttatgctgttagacaacctggaccccaacttccagagcgaccagcagagca

SEQ ID NO: 6331 - DNA, 531 bp, Mus musculus
  misc_feature (317)..(317): n is a, c, g, or t
  misc_feature (326)..(326): n is a, c, g, or t
  misc_feature (362)..(362): n is a, c, g, or t
  misc_feature (371)..(371): n is a, c, g, or t
  misc_feature (391)..(391): n is a, c, g, or t
  misc_feature (394)..(394): n is a, c, g, or t
  misc_feature (459)..(459): n is a, c, g, or t
tgaaaccccagagaagcggcaggcccgactcattcgagagcgagaggctaagaggctcaagaggagactggagaaaatggacatgatgttgcgcgctcagtttggtcaggacccttctgccatggcagccttagcagccgaaatgaacttcttccagttgcccgtgagtggggtagagttggacagccagcttctagggaaaatggccttcgaagagcagaacaacagctctctgcactgaaccacaccctcttgcctgacctcccatccactccagccctcggggattggtgctgcagtcactcaggaggccacantccttgctnccacaggcaggtccgggttggttgcagggaaacctntgcaccctntgcatttgggaaaaggatgnggntcaggaggggacctggctcaatgcagttctggacaagggagcaggcactccagaaacctggactnttcagcccacggtggcaggccaggactatgggactgtgggacccagtatggtccatgaagctgtgagggcaa

SEQ ID NO: 6332 - DNA, 196 bp, Mus musculus
  misc_feature (171)..(171): n is a, c, g, or t
tttttagaacagaagggactcgtattacatcatgatactggagctcaggatctgggggctgagggctgtgccaggcgtggaaggagggtggcttcagtgtttaccctgcggtgcccaggacagtctgagcacagctctcctcactcacctccagtcttcaccagaccaggntgtgcaattactgtgctacactctg

SEQ ID NO: 6333 - DNA, 395 bp, Mus musculus
  misc_feature (112)..(112): n is a, c, g, or t
  misc_feature (262)..(262): n is a, c, g, or t
  misc_feature (329)..(329): n is a, c, g, or t
agcagcgacagagtgggcaagccttaccgtggagtgaagcctgtgttcagcatcggcgatgaagaggaatatgacacagatgaaatcgacagctcgtccatgtcagatgatngataggaaagaggttgtcaacatccagacctggatcaacaagccggacatcaagcatcactttccctgtaaagaagttaaagaaagtggacatatgtttcctagccatctgctggttaccgccacccatatgtactgcttaagggagatntctttcaaggaaaggcctggcttacatccagtctcggcaagcactaaattctgtagtgaaaattacntccaaaaaaaaacatcccgagctaattaccttcaagtatggaaacagcagtgcttccgggatagaa

SEQ ID NO: 6334 - DNA, 482 bp, Mus musculus
  misc_feature (261)..(261): n is a, c, g, or t
  misc_feature (326)..(326): n is a, c, g, or t
  misc_feature (328)..(328): n is a, c, g, or t
  misc_feature (332)..(332): n is a, c, g, or t
  misc_feature (336)..(336): n is a, c, g, or t
actaacaggccccaagagcttgatgaagctgttctcaggcgtttcattaaacgggtatatgtgtccttaccaaatgaggagacaagactccttctgcttaaaaacctgttgtgtaaacaaggaagtccactgacccaaaaagaactcgcacagcttgctagaatgaccgatggatactctggaagtgatctgaccgctttggccaaggatgcagccctgggtcctatccgagaactgaagccagagcaggtgaagaatatntctgccagtgagatgagaaatattcgattatctgacttcacagaatccttaaaaaagataaaacncnagtntgantcctcagaccttagaagcatacatacgctggaacaaggattttggagacaccactgtttaaaggaatggatgcctctgtgagcccatagaacatcgcacttcacaggaaacaagagctttggctacaggaacccagacttcgttta

SEQ ID NO: 6335 - DNA, 212 bp, Mus musculus
agagtctcggctctgacgcggtcttccgccggctgcgctacacgctgtcgcctttacttgagctgcgtgcgcgcggattgctgcctgcctagagtgcatcatgtcggctttggccgcttgtacctctgtctcctttgtgttttctgggtgcctgcttatatgaaaagggtgggggtgaagttcgtctgttccgatatcacctgagtgcaggg

SEQ ID NO: 6336 - DNA, 534 bp, Mus musculus
gtgggaaaaccatactgtctacgttccttcaagggtcatattaatgaaaaaaactttgtaggccttgcttccaatggagattatatagcgtgtggaagtgagaacaactccctctacctgtattataaaggactttctaaaactttgctaacttttaagtttgataccgttaagagtgtattagacaaagatcggaaagaagatgacacaaatgaatttgtcagtgctgtgtgttggcgggcactatcagacggggagtccaatgtgctgattgctgctaacagccagggtacaattaaggtgctagaattggtataaagagtttcctgaagtcaaactgtgtttgatcctcccaaaagccatctgcagctgatgatgagaagaaaaagaaatggcatgtaatgtctcccccaacatcatttggatttgttttaagtaccttttccctcctttatgcctttgggacactgggaatatccagagaattcgccaccatcagtgtaactatgaactttgctgttggcagtgtggcta

SEQ ID NO: 6337 - DNA, 565 bp, Mus musculus
  misc_feature (164)..(164): n is a, c, g, or t
  misc_feature (167)..(168): n is a, c, g, or t
  misc_feature (172)..(175): n is a, c, g, or t
  misc_feature (177)..(178): n is a, c, g, or t
  misc_feature (206)..(206): n is a, c, g, or t
ctaactaactcatctgcagctcagtggcagccaccttgtgcctctgaggtatagtagctacgctggggacttcctgttaaacacgtggaccccaagccagttctaacaccaaaggtgtttacaaagaaggacttggctggtcacatatccttaggccttgagtnttnngggnnnnannctgccgccctccaccccccccccccccnatcagttataaccctttggttgatgttagcttctccctatgctgtcctcctctaccggagccccataggcttgtgaatggacaggttcaggcggcgcccagggcctaagcattgagaagtgtattctccatctcctgccaaactatggctggtgtcaagggatgacagtaactgccctgtggccctctgaagaggtactgtggatcagagaaactgggtagatgtccacaaagctgggagcctcattaaagcatacaagatgggaatgggcctggaaggggaggctggtgcccagtagaggcaggtttccctcctcctccaaagcaggaaacctgagagctagagtccctgcttaatta

SEQ ID NO: 6338 - DNA, 85 bp, Mus musculus
attaaaactactaggactgctatattcaggaatgtgacagtggaaaagcatttaaatgtagcttgtcagattcaccatgctactt

SEQ ID NO: 6339 - DNA, 193 bp, Mus musculus
cattgtctttgaatgtattggaagcagacatgcattgactgtgacatggttgcacctgaggttcccccctcactttctggacagactgatactatctatcaaacatttgtttctgttggtttggggataaagaaaaaggaacccaatgttaccttaaagtgatgaaatacttgtgtaaaaaggtagcaatact

SEQ ID NO: 6340 - DNA, 539 bp, Mus musculus
ggaacgaacgtttatgtgaccatattacatctcttcgcctcttgcactgttgtcttgtttcactgatcttagctttaaacatgaaagaagtccttaaaatgcctgcactgtgtattaaacaccaggtaatatgtgcaaaacagagggctcagcaacaacttttcacttgtgaattggcaggaaaaggtagcggcatcatgtaagttaaaaattggctaatgttaagttattgcagatcccacattcattatgctgcagtactgtacatatttttcttagaaattagctatttgtgcatatcagtatttgtaactttaacacattgttatgtgagaaatgttactggggaaatagatgagccacttttaaggtgctgtcatatagcttggaatgaatgattaaaatcatttgaagcattgcttctgggaaattcaaattggaaggttttattcattcttgaatttttccttctcaagagctcttctattcatacacggctaagttctttaaagatgtggaggacacctgtctgcggaata

SEQ ID NO: 6341 - DNA, 455 bp, Mus musculus
  misc_feature (68)..(75): n is a, c, g, or t
  misc_feature (77)..(77): n is a, c, g, or t
  misc_feature (79)..(79): n is a, c, g, or t
  misc_feature (81)..(81): n is a, c, g, or t
  misc_feature (83)..(83): n is a, c, g, or t
  misc_feature (188)..(188): n is a, c, g, or t
  misc_feature (365)..(365): n is a, c, g, or t
  misc_feature (367)..(367): n is a, c, g, or t
tctcatggtagcaagcgcccagagtggggaacgagagtgccatatcgtagtgcttacagatgatgatnnnnnnnntngngnanttggcagctggggtactttaagtgtagattgatatttatcttgcctcaggtaagatgaatattacaaagttgcactttatagatggtggttaaatggagctgttnaagccattttagagctgtgatgcacagtataacataagtgcttctatcagagtattcctcagtacagtatgtatagttggcccacatcaagcaaaaacatatttatcttgggtttatttaaacaattaggataaaatttgatgcttatagtgttggttcactcatctccagagcccntncagccctattagagtgagtcacatgcagggagggtgaacgtcaagaggtggtttactgtccagtctgccttatccttaatctgttcat

SEQ ID NO: 6342 - DNA, 543 bp, Mus musculus
  misc_feature (101)..(101): n is a, c, g, or t
  misc_feature (349)..(349): n is a, c, g, or t
  misc_feature (367)..(367): n is a, c, g, or t
  misc_feature (373)..(373): n is a, c, g, or t
  misc_feature (392)..(392): n is a, c, g, or t
  misc_feature (394)..(394): n is a, c, g, or t
  misc_feature (396)..(397): n is a, c, g, or t
  misc_feature (400)..(400): n is a, c, g, or t
  misc_feature (413)..(413): n is a, c, g, or t
  misc_feature (420)..(420): n is a, c, g, or t
  misc_feature (426)..(426): n is a, c, g, or t
  misc_feature (466)..(466): n is a, c, g, or t
ccgggaccagtttttaaggcagatggaacagatcgtcgaaggcattaaacaaagcaggatgaagatggaaaagaagaagcaggagaacaagatgaggaggnaccagttgaacgatcagtacttggagctcctggaaaagcagaggctctacttcaagactgtgaaagagttcaaagaggagggccgaaagaatgagctattactatctaagatcaaagccaaggcctcctgaaaactccatctccgtttctggatgtccctgatatttttttaatgacgtgtatagactacaggatcttgacatggttctgccggtgatggcagagagacccaggaaaattcatttcanttctctagacggatgttntctttntcctacttgtttcatttcntntnntcnctggctgcggctngatggantcaganccctacaaagaaccgtgggcagtgtggatgacactcaganccccataggcagtgcccactcactctgaccactcaacttccatttcttcagtgacactgcatttatgaaggtaccgg

SEQ ID NO: 6343 - DNA, 448 bp, Mus musculus
  misc_feature (64)..(64): n is a, c, g, or t
gtgctttgtatactgacacttccatttgatacctcttgctattgtagaacggttactagcaaangttgggaagttttgtaatgttgagtgctgttaactgttctaagcacaaagcaggttttgtttgaagaatgcctttaagtggctgtatatttttactcctattacctggccataactttgacttaaatttcattagtacaggtcagtttcctaaaatgccaaaatgaacaaaactttagcaaaactatcttgcctcatttgatttgcagggattttattatatcattttgttttgttttgttttttagcactcttaaagatggttgggcagtgtaattatcagatgtttgttttctaaatagatatttttatatatgctttatgtaaaccaaaatgtgttttattccttcagattttctaacatgcttacacttgggctactatt

SEQ ID NO: 6344 - DNA, 502 bp, Mus musculus
  misc_feature (367)..(367): n is a, c, g, or t
ttggtggagataactaccgccctttctgtaccgatgcactcccgctgcttgtaagagtcattcaggctccagaggctaagaccaaagaaaatgtcaacgccacggagaactgcatctcagcagtgggaaagatcatgaagttcaagcccgactgtgtgaatgtggaggaggtcttaccacactggctgtcatggctgcccctacacgaagataaagaagaagctgtccagaccttcagttacctgtgcgacctgattgaaagtaatcacccaattgttcttggcccaaacaataccaatctaccgaaaatattcagtataattgcagaaggagaaatgcatgaggccattaaacatgaagacccctntgccaaacgcctggccaatgtagttcgccaagtacagacttctggaggattgtggactgaatgcatagctcaactcagtccggagcagcaggcagccatccaggagctcctgaactctgcctgaagggccttaac

SEQ ID NO: 6345 - DNA, 122 bp, Mus musculus
actggttttattccctgctattgtggagattgtgttttaatcaggttttaagtgtgtcttgtgtgtaattgtattctttgcatggaccttgtacatagttttatttgctggacttttatgat

SEQ ID NO: 6346 - DNA, 421 bp, Mus musculus
aactatcgtaattatctgctgcctgctgggtatagccttgaagagcaacgaattctggattggcaaccccgtgaaaaccctttccagaatctgaaggtcctcttggtgtcagatcaacaacagaacttcttggagctctggtctgagatccttatgactggaggggcagcctctgtgaagcagcaccattcaagtgcccacaacaaagacattgctttaggggtatttgatgtggtggtgacagacccctcatgcccagcctcggtgctcaagtgtgctgaagccttgcaactgcctgtggtatcacaagaatgggtgatccagtgcctcattgttggggagagaattggattcaagcagcatccaaaatataaacatgattatgtttctcactaaagatacttggtcttactggttttat

SEQ ID NO: 6347 - DNA, 478 bp, Mus musculus
  misc_feature (114)..(114): n is a, c, g, or t
  misc_feature (207)..(207): n is a, c, g, or t
  misc_feature (312)..(312): n is a, c, g, or t
  misc_feature (314)..(314): n is a, c, g, or t
  misc_feature (321)..(321): n is a, c, g, or t
  misc_feature (325)..(325): n is a, c, g, or t
  misc_feature (383)..(383): n is a, c, g, or t
  misc_feature (402)..(402): n is a, c, g, or t
  misc_feature (444)..(444): n is a, c, g, or t
agcagatcctccaagtatctggatgaagcatatgaggaaatggttaacatcattgaatataacaaggagttacaagccaaggtcaatgtcctgagaaggcagttggctgaattnggaaacagaggatgggctatgagagagtccttgaaagatcgcctacctgtcctgaggacctgtctagtcctgagtcgtctctccctctgtttngcccttcaattcatgttcacagtagccttgaacttggctgtaggtgcggaatccctgtaatgtaatggccttctaagcactgcaaggtggcagtcactcacagantntggcctnttanggccctccacttaatgagcaggtggtgctgtcacctcactacatatatgacacctatnccctatgctgttccccatntctagtttctcaccagtggtccagactagttaagaatccatntacaacatgggccaggcttatttgcattcgagta

SEQ ID NO: 6348 - DNA, 474 bp, Mus musculus
  misc_feature (312)..(312): n is a, c, g, or t
  misc_feature (327)..(327): n is a, c, g, or t
  misc_feature (329)..(330): n is a, c, g, or t
  misc_feature (345)..(345): n is a, c, g, or t
  misc_feature (365)..(365): n is a, c, g, or t
  misc_feature (443)..(443): n is a, c, g, or t
aaaccgctccccaacagaggctggagaagtctacgttggtgagagccccagcctagccccggtcatacttggcctccatctgcacaggtagaaacctgccccactcaggaccctcccagaagtgcctcctgaagccaagaagggacttgtatgtggtgccttatcacccaccctctcccacccagactgtccttccttgtaaccagagccctcactgctcctgagtcttatttataagctacataaatatttttaatctggccccaaatgaagtagctggtcagatggccctttctaatcctatgtattgangcttatgtaaaaganannaaaaaaatcatcttnccttcctttttgttcctttnttacccacaagcgattactacttgaaacttatcaaaaacccaatgggtgcaaagactaaagagaggcagtgtgaccantctatgatttgtactgtttacggtgaagcta

SEQ ID NO: 6349 - DNA, 357 bp, Mus musculus
  misc_feature (27)..(27): n is a, c, g, or t
  misc_feature (241)..(241): n is a, c, g, or t
cagtgggaatgctaatttctttaacanggttttccaagttaagtgcatttacttgacaataaaaaggatcaaggctctttaggacaaggtctcagttaaaaggaagaacatgtctaaagtaaaagaaacttttataaaaagtttacatttactatggcagtgttgtgaataaaaattaaattttgtgttcttacagtttatttgtaaaagatactcttattatggaagcatgatttcttanatttaaataggtagatctcctgttactaatgctctttaagatgaagttgagagctaaatcttagtgcaattgttacaaggacagtgatttttaggtggcaatgttctggttcagtt

SEQ ID NO: 6350 - DNA, 426 bp, Mus musculus
  misc_feature (41)..(41): n is a, c, g, or t
aatacagcggtcctgttgagttctcccagctgcagcttcgntgtctgccaaggttctttgcctctcattgtcatgtacatttgtgtacactaaagcttagcggtcggtctgtctgtgtactcctcggtaagactccataggatgtatttgctcgttaatgagggttctctgttcagtagcttcaagatcttttctctgtacatttattttccaaaaattgcttcaagtttgagtcttctagaatgcttgtaaagtcccgttttaattttaagagtcgatttgtagttctgtagtgtaactttgggaaccatctgcccatctatggaataaagtttctcgggggccttggcgtagactcggtgccacatgattcattgcagagcgtgctagcgtcagcaggcctcttctgctctgctaagtacagtt

SEQ ID NO: 6351 - DNA, 404 bp, Mus musculus
gacgggacatcgtgtgacatactcccctcgcaaagagaaagcactcaagatctacctggatggggcgccaaataaagatgtggctcaagactgactgccagtgtagcctttcccctgagggcttgtttaagtagatggttcactactgctgggtagtgccattttggccggacatggtttgggtaatcccatgacaccagcactgattggactgcccttcaccaatcagaagctcagtgcccagtgggccactgtcttgacttggaatcatgttgtgcactatggtcagatgtactgtaaagccaaggatgtgcaaagagaaacaagcaaagcctgctactatgaagggagggggacaagtagattcattgattgcggacaaatgtgcacatagccgctagtaa

SEQ ID NO: 6352 - DNA, 456 bp, Mus musculus
  misc_feature (280)..(280): n is a, c, g, or t
acaggctaaaggcttcgctctacctccctggcagacttggcaccctgcgttctttcccaacttaaacctgtgtccacagttcttgggagccagcccagatgtcaggaggaggtgacaccatgtaggcatgctctagtggcagcggcaccactgagggttgctcacctggtgtcgcatgatgcaccaggtcagttagatggcatcaaagccacctcctgtagaagagtttagcaggactcaggagccatgccagcagtggcactctaatgtccccaggaanggcagaatttcctgcgtgctgcaccctggccagagctgtcctcatcatgtcatagagctgcatgctcctctcccttagcaaacaagccgtggaacagccacccctgtgggatagtaatggcctggtgcctgccgctgtcttctgctcatctgattccctcaataaaccctgtgtag

SEQ ID NO: 6353 - DNA, 329 bp, Mus musculus
  misc_feature (59)..(59): n is a, c, g, or t
taaagacccctctaggaggcagcttcctggtatatgagtccttcctctacagacggganaaagcaactggtgataaggtgtactggacctgccgggaccaggcacgcatgggctgtcgcagccgagctatcacacagggccagcgggtgatggtcatgcgcaggcactgccacccaccggacatgggtggcctggaagcccttcggcagagggagaacttccctaacctgacccactgggaaggcccagagcccctgcagccactggagttcctgcggacatcccttggaggccgcttcctggtgtatgagtccttcctgtacaggaag

SEQ ID NO: 6354 - DNA, 532 bp, Mus musculus
aaaacctctccctatacatctgtgttagttcattttgacatccaaatgcaggcacatcagaggaggctctaactgaaaagtaagagtgtgagtattgtaatttcactagactttctctttgccccaagaatgcctgagagaaaaccatatggtctgcaaagctgtttgtcagccgttcaaatgactcagacaacaggtcctctgtgtctaacgtgggtaaaagtagttggccaatatttgtgctgtatgagttctgattggttttggtagctagagatatttgtacacgattagatattttttttactgctttgttaaatgtctgaaaagtggtttgtcttttaaaaagtcaacaggtatgtaattacatagttaaaaagacgttcatatcagtgttttaaataataatgaatctttttgatgttaacataacatgtatatatatttatttgaaatgtaattaatttttagtattttcgaatgtactgttttagcatttaacatggtgtgggcagttccattcagtgtatcc

SEQ ID NO: 6355 - DNA, 536 bp, Mus musculus
  misc_feature (226)..(226): n is a, c, g, or t
taaaacttggctactgccccttagctcgtgcttgtcattagctcctcctgcatatcaaacccttactcactaaagttacagcactgctaaaatcctactgattaactcaccagcttccgtttacaaagtttcttccatttttattctgacaaagttccatttttttcctcctttctcgattgagatttttaacaacaccttgcccccatcccccaccccaaaaaangctcactcaatgttgtaggttctgttgctttttgtgttttgccaagcatgtcccttgccccaaaactaaagagcaaatgtttatttaaagtaaaaacaaaactataaataaattgtatactttataataatcagtggtaacaatttagagaccctggcagattaaaggttgcattatttttatttagatttttttcccttactattttgtactttaaagctggggatagatttcactggtttctgaggtaacagcagtaacgattaggaatatatagaaaagttcagtgaccagtcatttcttgtacaaa

SEQ ID NO: 6356 - DNA, 429 bp, Mus musculus
gaatatggcgactaactcctaggagttgctttactctgtcaggtgacttaagtcactgggagtcactaattttctctgagagaacagttgattgagaaatttctattgtaaatatctcagtgttacatagtgaagcttaaagtgtttgtagtcttgcataaggacacagcctaaataactgaccccttactcgctctgaagagcctccctgccccacccctacgtagctcatcttcagtgtgggccatgtgcagcgtgtttctgtgcagataatgtggccctgttctcgggaacccagaaccttttacagacattttttaattgtgttccttcctgctgccacaatcagcatgactgtatagagtcccttataccatctacacatccagagttatatggaagcagaatgcccaaatggacatgtcgtaa

SEQ ID NO: 6357 - DNA, 394 bp, Mus musculus
  misc_feature (172)..(172): n is a, c, g, or t
  misc_feature (188)..(188): n is a, c, g, or t
  misc_feature (223)..(223): n is a, c, g, or t
  misc_feature (274)..(274): n is a, c, g, or t
  misc_feature (279)..(280): n is a, c, g, or t
  misc_feature (323)..(323): n is a, c, g, or t
  misc_feature (360)..(360): n is a, c, g, or t
tctgggaaccctgccacaggattaagaaatggaggtgcctactacagacacttgggtggcctcctcagcgaaagccccatgagactgaaggtgagaggcaggagtggtccaggtgcctcgtacccttcatttgggacatagttgccccaaaggaagatgggctagatgattnccttactactacacanccctggctgcctacaagaactgtgatcctggcaantctgccatttcagaattgaagcagggttccccagctccagcagggtttttntcttnnagggtgtaccaaccatggtgcccactgtcagcctggcacatgntcttctgcagctatgacaagcatgtcagcagagggtncctgggaacagcttccttagcgtttgaggccaaa

SEQ ID NO: 6358 - DNA, 543 bp, Mus musculus
  misc_feature (240)..(240): n is a, c, g, or t
  misc_feature (243)..(243): n is a, c, g, or t
  misc_feature (456)..(456): n is a, c, g, or t
  misc_feature (459)..(459): n is a, c, g, or t
gattcacagtccgagaacgaggcctcacccgtgaagcgaccgcgactagtagagaaccccgagcggcctgaggagagcggccggtcgaagcagaagagccggcgccgctgcttccagtgccagaccaagctggagctggtgcagcaggaactgggatcctgtcgctgtggctacgtgttctgtatgttacatcgcctcccagagcagcacgactgtacgttcgaccacatgggccgtggncgngaggaagccatcatgaaaatggtgaaactggaccggaaagtggggcgctcctgccagcgcatcggggaggggtgctcctgaaggccaggcacggccaccacacgacgctgttcttagttcactaatgttagccttatttaggacaaagtcagccagacaccttgtactgggcacgcgtcagaccacagccggccgtttcctttctttagccanccngtcctggtactgtagcttaggggttgatggtggatgaaattgatttctggctggttactaaggtgcctgctagccattgtataa

SEQ ID NO: 6359 - DNA, 75 bp, Mus musculus
atatggacagttctttggaatgctcccatttactattagcttatcattttataagtaattttggagggactacat

SEQ ID NO: 6360 - DNA, 518 bp, Mus musculus
gtgtagactttgtctgccggctgaagtttccttccggcaattaccctccatgtttggatgataccagagacctgcttgtccattggtgccacggtgctcctggggtcatctatatgctcatccaagcatacaaggtgttcaaagaagagcgttacctgtgtgatgcccagcagtgtgctgacgtgatctggcagtacgggctactgaagaagggctacgggctgtgccatggtgctgcagggaatgcctacgctttcctggcactctacaacctcacacaggatctgaagtatctgtacagggcctgcaagtttgctgagtggtgcttagactacggggagcacggatgcaggacagcggacacccccttctccctctttgaagggatggctggaacaatatatttcttggctgacctgttagtccccacaaaggccaagttccctgcatttgaactctgaaaagaaagcatgtctcctgccgcttacagcatgactctgtgtattactctgggctac

SEQ ID NO: 6361 - DNA, 505 bp, Mus musculus
  misc_feature (127)..(127): n is a, c, g, or t
  misc_feature (356)..(356): n is a, c, g, or t
  misc_feature (360)..(360): n is a, c, g, or t
  misc_feature (369)..(369): n is a, c, g, or t
  misc_feature (378)..(378): n is a, c, g, or t
  misc_feature (381)..(381): n is a, c, g, or t
  misc_feature (426)..(426): n is a, c, g, or t
  misc_feature (434)..(434): n is a, c, g, or t
  misc_feature (450)..(450): n is a, c, g, or t
  misc_feature (463)..(463): n is a, c, g, or t
tggtgtctctgaggcacaggctactctcgagccagtggttttttttgtcgccctcgtgttgtgcgctggaagcttctctgctgtggtgaaccctggtgttgtgtgggtgggccagcctcacccacanctgcacagtcgtctgcccatttgtatatggtttcagttcagtcccagttcttaaaagaaatgctgcagaaacttgagttttctcatttatttcattctcttttttcccctaccaccagccaaatgacttttccttcccttctttccttttctgcacaactctagaaaaatgccatctttctagagtctttaacccacaaagttcccgagggtgctactggtgtgagttncccntggtgggcnagggaaganccntctgttggctggaaacactcataaccattcctttagattcgtttnccttatgntcataaacgcgatttncaaaaacaagganccttagtgaatgtacagtacctagacttctgtgttcgcgcag

SEQ ID NO: 6362 - DNA, 387 bp, Mus musculus
  misc_feature (163)..(163): n is a, c, g, or t
  misc_feature (283)..(283): n is a, c, g, or t
  misc_feature (308)..(308): n is a, c, g, or t
  misc_feature (359)..(359): n is a, c, g, or t
atggacccactggacaaggtgctgtccgttctcatcaaaaaactcggaactgccctgcaggatgagaaggagaagaaaggaaaggacaaagaagaacactagaatagcaattccatctgtgaaacacttgactctgttaatttctattacactgcaatttttntcagcaaaatttaaatggtactttaaaataattctaaattttgtggccattattgaaagtttgtaagttaatctgtttattctagctctaccattctgtatacagtaaagtattgcatgnaaaatgtaaattttgtagaaaactnaattaaaagatatacatctgctcattaaagtttatgattgttttatgtgcnatatggttgctgcatttaaagtattaca

SEQ ID NO: 6363 - DNA, 507 bp, Mus musculus
  misc_feature (309)..(309): n is a, c, g, or t
  misc_feature (335)..(335): n is a, c, g, or t
  misc_feature (337)..(337): n is a, c, g, or t
  misc_feature (366)..(366): n is a, c, g, or t
  misc_feature (382)..(382): n is a, c, g, or t
  misc_feature (384)..(384): n is a, c, g, or t
  misc_feature (387)..(387): n is a, c, g, or t
  misc_feature (418)..(418): n is a, c, g, or t
  misc_feature (449)..(449): n is a, c, g, or t
gagggatcaatcaccatggaacagttcagcaccatcctcaagaccacctttcctctcaagaaggaagagcagattcaggagctgatggaggcagtaggctggggtccagacagcagcaacacagacatgttaaactaccgatctttgtttaatgaggatgaggaagggcagagtgagccatttgtgcagaggctgtgggaacagtatgaaagtgacaaggaagcatacttagaggaactgaagcaggagctagacctggatcctcttgaagacgtgaccctactgaagatgcgtgggaccctgatgaanatagatcctaccatggacaagcagantntgagtgcctacctgagccaggcctatcanatccctgcaattgatntnccnactggaggatgaggagaagcaggggataatntccataaaggttgagactgcacttgatcganttaggatggcagacacgaagcgtgtaggaccacgagagccagacccagcaagctagag

SEQ ID NO: 6364 - DNA, 452 bp, Mus musculus
  misc_feature (314)..(314): n is a, c, g, or t
  misc_feature (316)..(316): n is a, c, g, or t
  misc_feature (319)..(319): n is a, c, g, or t
  misc_feature (334)..(334): n is a, c, g, or t
  misc_feature (353)..(353): n is a, c, g, or t
accacgcccaggatgtcattttagaagtcatttacactgaccctgtggctctttccctgggcaccgtggcagaaatcactggtcatcagctcatgagtttgtctactgcaaatgcaaagaaagaccccagctgcaaaacctgtaacatcagtgtcggacgctaacaccactttcgccccttccccgccccacacaccctgtcttcccataggagcattaccctctgttgtccatctgccatcagatgtccccactgaagcatgcatatgccgctgtcaccaaaagcaaactctgtcattcagagcctttccgtntntcntcttgcccgcccttntccaccactttcaacgatntccccaggttgtcctgacactgtttgcctagatgctgcaatgcttttatgtttcctttatgccaaacataacaagacagttatatagaccgctttagca

SEQ ID NO: 6365 - DNA, 303 bp, Mus musculus
gtttggtgatattatttcagctgctgctgtactaccacagattattggcttttagtttcctaaagagaaaaattgccttcttactagaaagcctttgtgtattgccggtttttctgtttgggaaaatctaaggatttactgtggttagtagtacagaagaaatgtggatttgatgaactagtgcctatgattttaacttatgtttgatatatagtagtagggttataaatgttgattattttgtgccaacagcccagaattgtcacttgtatgtcagcagaagctatgacctctgcttccaaa

SEQ ID NO: 6366 - DNA, 208 bp, Mus musculus
  misc_feature (47)..(47): n is a, c, g, or t
caactgcaatgaggagtggcctgccccggccaagcgccccttctgcnggggggcatcccagtgcctcgcagcaagcttgtacagcctgttcgaagatcattgccagctcctaaaagttatggtagcatgaaagatgacagttggaaagacggctgttactgaccagcagagatgaggacacagatgtccacagcttcatggacaccgt

SEQ ID NO: 6367 - DNA, 172 bp, Mus musculus
gttcaaaatgcaatactgtgtctcctgtcagtgggaacagttcaagaagatcgtcaggggcgatcagcaattcttgttctccactaaacgccacctcaggaagtgggaagttcacaccagttaatccaagaacaaagactgaaaaaaaaaatgaagaaggttggtttgctct

SEQ ID NO: 6368 - DNA, 484 bp, Mus musculus
  misc_feature (233)..(233): n is a, c, g, or t
  misc_feature (271)..(271): n is a, c, g, or t
  misc_feature (284)..(284): n is a, c, g, or t
  misc_feature (292)..(292): n is a, c, g, or t
  misc_feature (319)..(319): n is a, c, g, or t
  misc_feature (377)..(377): n is a, c, g, or t
  misc_feature (413)..(413): n is a, c, g, or t
  misc_feature (459)..(459): n is a, c, g, or t
gggcgatcagcaattcttgttctccactaaacgccacctcaggaagtgggaagttcacaccagttaatccaagaacaaagactgaaaaaaaaaatgaagaaggttggtttgctctctctgcccacataccgtaagtgaagccccagcagagagtgtcctcagtgacttattcctggcctttccttcgcacttcacagattccatttcaagttaataacatttttcttcagatnaaacctgcataggtatcctgtatttatggaaacagaanaaagaattatttnaatatttnaccttttcaaatgttttttcaacaaancacctctaattccctgtgagtaaagctttgcaggagtttaagttttatatttgtttanccttgttaaatgcattagtgatacattgttactttngtcattttggttgaatgtttgtttgttatttagtgcatcttaaatncaatcaccttcccacaagaactaat

SEQ ID NO: 6369 - DNA, 473 bp, Mus musculus
tattgggcagaccatcccacgataaaaattttttgggaagtgtttcatgaattaccactagagaagaagaaacaatttctattatttttgacaggtagtgatcggattcccattcttggtatgaagagtctgaaactagtcatccagtcaacaggaggtggtgagagctatctcccggtttcccatacctgttttaatcttctagatctcccaaaatatacagagaaagaaaccctccgatgtaaactgatccaagctattgatcacaatgaaggcttcagtttaatatgaccttggacttttctgtttagtacaaaaaccactcgtgtttctcttgtgaattcagcacagtgagagttacttctgtaattcttacttataaattgttcactactgtactgatgaaagcccaaaattaaaaactgtgcattaatactaaactgtacagaaccatgaattgtccatcctcatac

SEQ ID NO: 6370 - DNA, 481 bp, Mus musculus
  misc_feature (73)..(73): n is a, c, g, or t
  misc_feature (309)..(309): n is a, c, g, or t
  misc_feature (336)..(337): n is a, c, g, or t
aatcctctcctgccggatgaaaagcctgacagaagtcgaggaaaggccaacaatcctagtaagaaatacctcnttttctttgaagaatgctctgaaatataaaactgtcaagctaattctttttttcattaaaagctccaggtctggttccaggtccgaaatcccatccctctgcatcctctggcaatacgctccttccatcagtcatggcatccaccattttactcgttgcttctgctgtaaacttcatcgagctatagcttgaaacgctatcttaatctttatctgaaagactgctatggggatccnacaggaagtcaagagaaaaaaatgtannttttccttggacagacttgactgtataaaagaactgtatatttgttcctcattttacaatttaaaaagctggtccagatagtatcatagaattaacttttcatttctgtattaattttaggactgcaaaaatcccaaagctata

SEQ ID NO: 6371 - DNA, 433 bp, Mus musculus
  misc_feature (406)..(406): n is a, c, g, or t
gagagcaccaacaatgacgaagacatgagcaagaggtatgggggcttcatgagaagcctcaaaagaagcccccaactggaagatgaagcaaaagagctgcagaagcgctacgggggcttcatgagaagggtgggacgccccgagtggtggatggactaccagaagaggtatgggggcttcctgaagcgctttgctgagtctctgccctccgatgaagaaggcgaaaattactcgaaagaagttcctgagatagagaaaagatacgggggctttatgcggttctgaagcccttttccagcagtgaccccgacccccactagcctgctccatcccccatgagcaactgccttgtcaatgatgtttcttgtcacatgctgctttgtgctgtacagttgcccccgtggtntagataactacactgcctgaaagctgt

SEQ ID NO: 6372 - DNA, 419 bp, Mus musculus
  misc_feature (361)..(361): n is a, c, g, or t
aaaaatatatctcattttgggctcaaagcattaatccagtaactgaaaagagaatacaagtggagcatacaagcgatgaagatcttgagacagactcattggactgaatttccccctcccccccttgatggaagaaatgttccagattctaaattgaggacttcactattaatggcattattaactgtgttatgattgttaacaaaatatcctgtaaggtacacactacatattaaggttggccattattcctgttttttttttcttttgaagccaagcttacaatgaagctttgtgtttgaagttataacagacatagatgaagacggcgactgtacattatctcacttagagaatatgnaaatcattttgttttgaagctaggtattaaactggagtagctattacgttcttgaaaa

SEQ ID NO: 6373 - DNA, 514 bp, Mus musculus
  misc_feature (51)..(51): n is a, c, g, or t
tcggagctgagcacgttgctttccagcctctcacgatacttcagaaggggngcccccagctcccctgctgctggagtcctgccctcaccacagggcaaggccacctctctctccaaagccagcccagaatctcaggagcctctgatccaacttgtgcaagcctttgtccggcacgtgcagagatagggcgccgactgctgtctacctgctgctcctaccaacctgcactgcagcctgggtagagggcgctgccaccacaaggccagccactgagcaggcagctcccttcgtcgtcctcctgcccacccgctgacattatttttatatagctaaagaggtcaacagcacgggcagggagccaaggggctgggtgctcagactcttaacaatatcccaaggtggcccctttcctccgagcattcccatggcacttcaccagccagggaggccctgggtgctggcagcacaggagagtcctgtgtgtagtgagggttttccatgatctattcttgca

SEQ ID NO: 6374 - DNA, 437 bp, Mus musculus
  misc_feature (198)..(198): n is a, c, g, or t
  misc_feature (252)..(252): n is a, c, g, or t
  misc_feature (287)..(287): n is a, c, g, or t
  misc_feature (323)..(323): n is a, c, g, or t
  misc_feature (399)..(399): n is a, c, g, or t
  misc_feature (401)..(402): n is a, c, g, or t
  misc_feature (409)..(409): n is a, c, g, or t
aaagctaggtttgttgtatctgaacaaacatctctctggctgtattagggaacacagctcacttctgtgggaatggcccccacatctcagttgtctggggcccttgagattaaaatactgctcttttttcctacctgtgcaattgtatcttaaacaatttgtcatccctggaagaaggttctattagctttctgggantataatgaagaactacaagttaggtggtttaagcaaacaaaaacatccctgtcncagtcccagacaccagaagtctaaaagtattaacnaaatgttgcttcttaaagttgtgggcaggaactctntcctggcttctaccaaggaagcgtccagctttccctggttttcagacacagcataatttctaattgtaattctttntnntctgctntctgttgtatccaaatttctctttgtga

SEQ ID NO: 6375 - DNA, 476 bp, Mus musculus
  misc_feature (220)..(223): n is a, c, g, or t
  misc_feature (227)..(227): n is a, c, g, or t
  misc_feature (298)..(298): n is a, c, g, or t
  misc_feature (307)..(307): n is a, c, g, or t
  misc_feature (317)..(317): n is a, c, g, or t
  misc_feature (325)..(325): n is a, c, g, or t
tgcatgccagccaaagactcttgggagacatactgcttacagccgaggagcctccagtcctctagtaaattctctccagaccaaaaaacaccattacagataaaagaagaaaatcctgtcttcaaaacacctccatgttcacaggaaagtttggagacagagaatctctttggtgatgtgaagggtactggttctcttgtgccaacaaaagtaaagagcnnnngcantccatggaggatgtgagcttgcatcagttcttcagttaaacccctgtagagttgctaaaacaaaggctctnccaagcaanccaagatacntcctttgnaaatatccagtggagtgtagacccaggagcagacctttctcagtataaaatggatgttactgtaatagatacaaaggatagcagtcactcacgattaggaggagaaacagtggacatggactgtacattggtcagtgaaaccgtgctttta

SEQ ID NO: 6376 - DNA, 452 bp, Mus musculus
  misc_feature (400)..(400): n is a, c, g, or t
  misc_feature (418)..(418): n is a, c, g, or t
agttaactgtccgtgtgaggcgctcactcaaccaataagccccaagaactcaaagcaataatcttcgttactgagatgcgcggctgttagtgtttgttgttggtttttgttttttgggttttttttttttttttggttttttttcggtttttgtttttaataattcctaataaaagagaagctgcatttttattggattttatctttaatttttctacacatctgaggggagcctcaggagactttggcttcctttcttccccccaccccctattccctggaccctctcactccactggacctaactgtgggttcgtggacctggatttacatttctgattcgtttgaggaaaaaaaaatttttttcttttgaagatgttacatggtgttttgaagccancaagttccaccctcggtntctttttccctccgcatctgtaacttctttttcc

SEQ ID NO: 6377 - DNA, 490 bp, Mus musculus
gaatagcttcggtgtcatcccaagcactcccttggccatacatactccactgatgccaaaccagagcattgacgtctctctgccgctcaacaccttgggcccagtcatgaagatggagcccctgaataacctgcaggtggctgttaaaaacaatattgatgtcttctacttcagctgcctcatcccactcaatgtgctttttgtagaagatggcaaaatggagcgccaggtcttccttgcaacgtggaaggatattcccaatgaaaatgaactccagtttcagattaaggaatgtcatttaaatgctgacacagtttccagcaagttgcaaaacaacaatgtttacactattgccaagaggaacgtggaagggcaggacatgctgtaccagtccctgaagctcactaatggcatttggattttggcagagctgcggatccagccaggaaaccccaattatacgctgtcgctgaagtgtagagcccctgaa

SEQ ID NO: 6378 - DNA, 289 bp, Mus musculus
ttagaagccaatccttggcgtcggacattcggtgtttttaatgaacgattgggactgcatctgtccttcatccgtgcatgccctctctcttcccgtctattaagtgcagcagctgtgggcatttgacaagtgataaatatgtgcacgcacacgcaggaggctgcaggttggcctcaaccctggcacgcacagaagtggagcatgggttgactctgtaggcacctcctgtccttcctcccgctgctgcttctcctcagaagtccgtccctgtgggatctctgttacacac

SEQ ID NO: 6379 - DNA, 478 bp, Mus musculus
gaatacatatggcttggcttccgctgcacatgcaggtccagttataaccgaccagcttctgtgtacagtcttgtgtcttagaagccaatccttggcgtcggacattcggtgtttttaatgaacgattgggactgcatctgtccttcatccgtgcatgccctctctcttcccgtctattaagtgcagcagctgtgggcatttgacaagtgataaatatgtgcacgcacacgcaggaggctgcaggttggcctcaaccctggcacgcacagaagtggagcatgggttgactctgtaggcacctcctgtccttcctcccgctgctgcttctcctcagaagtccgtccctgtgggatctctgttacacacccttgatcacagaagaaccaagaagctacccaaccccaaactaggagagtcagagggaagctggaggctactacgcaaggctgcatatctaacggcctctttgtgtaaaaca

SEQ ID NO: 6380 - DNA, 268 bp, Mus musculus
ttttacagaggatgttcccacctgcaagacttgtggaaagaccttctcatgttcttatacactaaggcgacatgccacagtgcacacacgtgagcggccctatgagtgccgctattgcctacgaagctacacacagtcaggggacctctaccgccacatccgcaaggctcacaatgaggacctggccaaacgcagcaaaccagatccagaggctagcaccattctaggggtgcagcccctctctggctcccaaacgacagagagacat

SEQ ID NO: 6381 - DNA, 296 bp, Mus musculus
  misc_feature (71)..(71): n is a, c, g, or t
taagcgcactgcgttccagtactggtcggcctattgcgtttgtcagaaaaattccttggaccgcggcagcnagtgagctgagagaacattttgcacagtttggccatgtaagaaggtgcactgtaccttttgacaaagagactggctttcacagaggcatgggttgggttcagttttcctctcaggaagaacttcagaatgcactacaacaagaacatcatattattgatggagtaaaaatccacgttcaagctcaaagagcaaaggctttgcacggagctcaaacatctgatgaa

SEQ ID NO: 6382 - DNA, 465 bp, Mus musculus
tgtaagagacgatcccatttccccagaccagaaggaaaacagttttccaagctgcatccttggccctgggactcccagcagcccagagccggggcctgttctggtcaaggacacccctgaggagaagtatgggattaaggtcacgtggagacgcagaaggcacctgtttgcctaccttaaggagaaggggaagctggatggaagccagttccttgtgaagatctgacaggaccgcagagcttcagttcttcccggagctgctgtggggaggtttcgcaagtcatcctggtttgaaaggatgaaaggggacgaacagcaataggaagaccacttagccagagtcggagttcggtttctagggttccgcctcgcaccaggaaccgttgaatttagtgtcatgaactgttggtatttttctcacattaactgtttagacctctgacgtttcttgtactgttcacagcg

SEQ ID NO: 6383 - DNA, 495 bp, Mus musculus
  misc_feature (187)..(187): n is a, c, g, or t
  misc_feature (307)..(307): n is a, c, g, or t
  misc_feature (310)..(310): n is a, c, g, or t
  misc_feature (316)..(316): n is a, c, g, or t
  misc_feature (321)..(321): n is a, c, g, or t
  misc_feature (333)..(333): n is a, c, g, or t
  misc_feature (367)..(367): n is a, c, g, or t
  misc_feature (414)..(414): n is a, c, g, or t
  misc_feature (420)..(420): n is a, c, g, or t
  misc_feature (454)..(454): n is a, c, g, or t
  misc_feature (465)..(465): n is a, c, g, or t
  misc_feature (467)..(467): n is a, c, g, or t
  misc_feature (470)..(470): n is a, c, g, or t
gagtgcctgatataagctgctttgggcttggattttgatacccttcaccccggccgcccattgtggtgggagggagcacaatggctgtgtagttaagaatgatcttgaacttttcctcttgtcttcatctcccgagtaatgggattaaaggcgggcaccaccacacccaatttatacaccctatttntttgtacagagctaggaatccaagggttttgtgcatgctagacaggcactttacaaagctacatctccagcccctaggcgtggttttttaaagtattttgtaccctgctttgtactccanatncctagnaggtncccagtattttnttagctgatattgaaggacagtaactagagtttntgctacacactattttaagtctggggaaaaaggagtagacacgacantctttnccttaattgcgactcttgacactggaggagacantcaaccttgtntnttngtagatgtctcacagttaaagtact

SEQ ID NO: 6384 - DNA, 483 bp, Mus musculus
  misc_feature (154)..(154): n is a, c, g, or t
  misc_feature (158)..(158): n is a, c, g, or t
  misc_feature (287)..(287): n is a, c, g, or t
gggctacctgccacgtggttagcgactcatgggactcaacccaggcctttgcagattatgtcagcaccatgtgatggggcccatacctcacaggcccatcctcagtaccatcagcttgcagggactgagccgtgggctgcccagaatccccaancacntgattctgtcatcctctttctgccactttgtctatttctgtttccttttcatcttcccttgcactgaggtcctggaggccttgatgaggcccagcaaaggcattcccaccgctgagttcagaggctttngggccacttactcagtactctgggaaccccaggccaggaggttacgggtctctatcgtcactgaggaaaacaccccctacccctgctctggggtttcctgcttcattcctcaagcaggcacccaggctttagagaagtataggaatgcctaacaccaggcctcttccctcctgggcttaccaatgtgttcccaggc

SEQ ID NO: 6385 - DNA, 580 bp, Mus musculus
  misc_feature (150)..(151): n is a, c, g, or t
  misc_feature (357)..(357): n is a, c, g, or t
  misc_feature (456)..(456): n is a, c, g, or t
tcagctccattcaggctaccattgccaagctcagcatccggcccctaggtggcttggattccccagctgccagcctcccaggccttgtagaacccccaggtcttccaccagctagccttccagagtctacccctgtcccatcttcctcgnntcccccactctcttcacctctgcctgaagccccccagccagaggaggagccgtcagtgcctgaagcccccagcttagggcccccctcgtcatccctggagctgttggcctctctgactccagaagcattttcactggacagttctttacggggaaagcagcggatgagcaagcagaactttctgcaggcccacaacgggcagggtntaagggctgcccagcctacggatgaccccctcagcctcctggatccactctggacactcaacaagacctgaaaaggctttgcctatctgatccttacanctacacctcccatccctgctgccttcagctctgccagatggagatgcactgcaggcctcagatcaggctctgctcccttgaggaacctgacatttttccagccctgggctgctgaaataataaa

SEQ ID NO: 6386 - DNA, 143 bp, Mus musculus
gctgccaaaggtgctttcatggttcctgcccgggagcttcgcagcaggagacgtcactactcagtggcaggcagaggaggttaacaatagcacagaatgacctgggccagtgcaggaaacactgcttcaaaccacgagtctct

SEQ ID NO: 6387 - DNA, 531 bp, Mus musculus
  misc_feature (43)..(43): n is a, c, g, or t
acttcagcccatcggaacttgagtgggtcactaaggagaaggnagccacactcctctatgccctgctggtacgagtggaataaggggtgacataccactactccaagcacagccgggcctcaagcccaggactcttgaatgacgactgcctccacctcattcccgtgactgagagcatgtccagtgctgtcctggcaaggaggagcacgtaggcaggctttgatttagagcaggtgtgaagcacatctctacattcagggcccagcacactccctctgctgagagggagcccagctcgtctcgggtccccccttcatgcactgacttggggaacatgactccctattattaccctcccccatatcacttaatttatttccgtttttgtttctggttactgtgaatcccaaaggagtctctctgtgcccacatgaagctgctttttccgtggccactgggcgccatggggagggagtgggtaaaaggaagggctgcccgaggacgctgtgggcctctgtacagttgttactg

SEQ ID NO: 6388 - DNA, 316 bp, Mus musculus
  misc_feature (210)..(211): n is a, c, g, or t
aaacactggatctgccaggcctagggtgtgaggcaaagagatgccctacgagtatcccagtctggcaggcatagttactacacagaaggaaggccaaagccacacttgctttgtaatgtggctgttgcacccagcccttcttggctcaaacaattttttttatttctgaataactttttgggggtagaaaccaaatttctatatacacanntacatacacacacatgaatatgtgtgtgtgtgtatacatatatatgtatatgtacacacacacacacacacacacttacttttgagggcctatttatgttctgaa

SEQ ID NO: 6389 - DNA, 478 bp, Mus musculus
  misc_feature (91)..(93): n is a, c, g, or t
  misc_feature (95)..(95): n is a, c, g, or t
  misc_feature (98)..(98): n is a, c, g, or t
  misc_feature (100)..(101): n is a, c, g, or t
  misc_feature (104)..(104): n is a, c, g, or t
  misc_feature (107)..(107): n is a, c, g, or t
  misc_feature (111)..(111): n is a, c, g, or t
  misc_feature (348)..(348): n is a, c, g, or t
cacctctcaaagaactcttgaatgaaagcgaagaaaaaaattaacaaagctctgaataaaaagagggctctggaggatactttagaacaannntnatntnnttnaancaangttttatccaagctgaacaccatgaaaatggaaagcaagaatactgtgaagatgctgaaggaagagattcaaaagctggatgacctttaccaacaaacagtgaagataaccagttaactgtgcagaccacaactgaagaaagaagaaaggtgggaaacaacttacaacgtcttttggagatggtcgccacacatgtagggtctttggagaaacatcttgaagaggaaaatgctaaanccgacagagagtacgaagaattcatgtctgaagatctggaaaacatcagagagatcgaagagaagtataagagaaatgctgcccaacttaaggctcccgacaaatgaagataatctttcatagacataac

SEQ ID NO: 6390 - DNA, 503 bp, Mus musculus
  misc_feature (338)..(338): n is a, c, g, or t
  misc_feature (422)..(422): n is a, c, g, or t
  misc_feature (464)..(464): n is a, c, g, or t
  misc_feature (471)..(471): n is a, c, g, or t
gtgtgtttgctctaggagactctgtagccttattctctgggtgggcctgtgccttcatgccccactaataaagaatccctgtctttaaagaccagagccagtcctttaagccatgttctttttcagtaagccctcagaatattggagtggtccccaaatcactccagactgtaagacagctctcctatggaatgcttttattgtcattgaattgacagggaagtttggttgagatgtggtccatcatcttagaggctcagatctgttgtatcagttgagggggaccttgggcctgcctgggatttctctgccatctatgtaatttcatcagtctctcnggttgtggacagccgataccagtttcccctgatctgcagagaggaagacttccagtgagcagaacaggctcttgctcacttttntcctaagttgttgcaagctcttgttttcctcactgtctgtanccataancctgatggtgggcagagttagcagacctttaa

SEQ ID NO: 6391 - DNA, 483 bp, Mus musculus
atcgagttaaacacatgcggaccccccaaaagaagaaaatcaaactgagtcaccccaaggacatggacagtttcaagttagaaagagagcgtagctatgacttagtgcgtaatgctgaaactcattccctgccctcagacacatcctactccgaacaggaggactctgaggatgaagatgccatctgtccagctgtgagctgcctgcagccagaaggagatgaggtggactgggtccagtgtgatggcagctgcaatcagtggtttcaccaggtctgtgttggtgtctctccagagatggcagagaaggaagactacatctgtgtgcgctgtactgggaaggacgcaccaagccgaaagtaaaaacaaaacacacactcacttcatgtaattcaggactccaataaagaagatttcctcaatctcagcaaagctacaggactggggtcgagccagcctgtacacggtgctatttctattcctt

SEQ ID NO: 6392 - DNA, 503 bp, Mus musculus
gaatgacgctgcatatgttgacttcaggaactacagacttagctgacgtcaatctctaaaaggcttaatagacacgaacacacttgtatggtatgcactcaaactcagattgctgtttcttttaaaaagtcatcatttgtattgacatgcttctgttcctagttccagtttggaggttttataaagttataataataagttaatgtgttcatcttcattattttgcatgtgacctaatctgaaaagtacatgtagtatttgacattgatattttaatactgtagaagctaaaattaacaattcttctatataataatctgggttccataaatgagtttcagagaacttgtgagcccttccaaaattgtgtgtagagtttggaatatatgcatttttatttcttaatctttgatccatcataatatatgtatttttctatatggtgtaagatttaagagttaattttatttttgatcaaaacagctatttgtctcaacaccatt

SEQ ID NO: 6393 - DNA, 459 bp, Mus musculus
  misc_feature (86)..(86): n is a, c, g, or t
  misc_feature (234)..(234): n is a, c, g, or t
  misc_feature (236)..(236): n is a, c, g, or t
ggctttgcaccgtcaacagtgtggaggaaaagattctcgcggctgccaagtacaagctgaacgtggatcagaaggttatccaagcnaggcatgtttgaccagaagtcatccagccacgagcggagggccttcctgcaggccattctggagcacgaggaggagaatgaggaagaagatgaggtaccagacgacgagaccctgaaccagatgattgctcgccgggaggaagaattntnatctttttatgcgcatggacatggaccggcggagggaggatgcccggaacccgaagcgcaaaccccgcttgatggaggaagatgagctgccctcctggattatcaaggatgacgccgaagtggaaaggctcacctgtgaagaagaggaggagaagatatttgggaggggctctcgccagcgccgggatgtggactacagtgatgccctcaccgagaagcaatg

SEQ ID NO: 6394 - DNA, 466 bp, Mus musculus
  misc_feature (67)..(67): n is a, c, g, or t
  misc_feature (69)..(69): n is a, c, g, or t
  misc_feature (296)..(296): n is a, c, g, or t
  misc_feature (364)..(364): n is a, c, g, or t
  misc_feature (382)..(382): n is a, c, g, or t
gtagacggaaagatttaccatccatcatgttatgaagattatcaaaatacatcttcatttgattgcncnaccatctcccagcaagacaccagttgaaaaccctttgaacattatgttgaacattgtcaaaaacgaattgcaagaaccctgtgaaagtcccaaagttaaggaagaacaaattgatgccccaccagcttgttcagaagaaagtgtagcaacacccactgaaattaaaacagaaagtgatacagttgagtcagtttaaataaaatgagaaaagtatgcttttctttttnaacaaaagctgctgttggatctaggtgaagaatttttttatgtatatatagaaatatctatattaatntgtctagctgtggcaggnccttcagctatcatttggttaataaatacattttagtatttgcatttcctactgcctgcacagtttcaggtgcttgttgtgtga

SEQ ID NO: 6395 - DNA, 521 bp, Mus musculus
  misc_feature (316)..(316): n is a, c, g, or t
  misc_feature (337)..(347): n is a, c, g, or t
  misc_feature (383)..(383): n is a, c, g, or t
  misc_feature (394)..(394): n is a, c, g, or t
  misc_feature (397)..(397): n is a, c, g, or t
  misc_feature (406)..(406): n is a, c, g, or t
  misc_feature (408)..(408): n is a, c, g, or t
  misc_feature (413)..(413): n is a, c, g, or t
  misc_feature (418)..(418): n is a, c, g, or t
  misc_feature (430)..(430): n is a, c, g, or t
  misc_feature (438)..(439): n is a, c, g, or t
  misc_feature (466)..(466): n is a, c, g, or t
  misc_feature (479)..(479): n is a, c, g, or t
atagatatgtatctccagctagagtcatccacaatgtccacttttggaaagtatgtaatgaaacagtaatgcttatttaaacttggacactgatgccatcaagcaactaacaaatatatttaagtactaaaagtgattttactttttagaaaatatttttaaaattgtcaatttaatgcagatgaacacatttctattttaagttacagggattctgtataagaatgttcatatgaaaaacatggttaactttttttctttgttggttttgattgaattagatgggtaacatgagatgttaatattcatacatgtnataaactgaatgatgaacaannnnnnnnnnnatttcttgagtgaccttagaatgtgacccttatgtntaatgtgtgtnttnaaacatgantncagtnccagntatgagccatantcccaganntgatattattccatttatagaagatanatatacagtattnaaacttgtgattttttttccgtgggagatggaaggctttttt

SEQ ID NO: 6396 - DNA, 526 bp, Mus musculus
gttgaaagcacccattacctagtagtcctaatccttaaccctaagtgtaaatagcagtggatagagcgagagcatttgctgcagttaaatgggaagcgccatgatttgtatgtgcattttacacttgctactgcagtgatttgattaggatcttcctgtgtagattgttaggcatcaaatcgttgtagatcaagagttggagctgagttaagtgaggacagcctgtgtgcacagtgtgtggtatggtcctcctttctgtgtgtttcataacttcctgcttctctgacctgtccatagcgtgtggggagtttgcagtgtgcacttactactagttagtctgattgtttcatacacttttgtggtggtgtagatcatgtttactgtcactgttttcctgtcatcatagttcttttggtatatatttctgtgtctggtgatatattaaagtatgtccttgtaaacttttttgtaaaagttatttcctaaatataaaaacattatgactagcaccactatgtcttcttaa

SEQ ID NO: 6397 - DNA, 209 bp, Mus musculus
gaaacagttcgggatggctcccagcattgggcctgtatccttccccgaggcacaagagggcctcatgggcattggacgtcgtcccttcagccagggcctccagcagatgatggaccatgaagcaaagctgctggtggccaaagcctacagacacaccgagaaggtgctgctagacaacctggacaagctgcaggcgttggcgaatgccc

SEQ ID NO: 6398 - DNA, 552 bp, Mus musculus
  misc_feature (186)..(186): n is a, c, g, or t
  misc_feature (188)..(188): n is a, c, g, or t
  misc_feature (266)..(266): n is a, c, g, or t
  misc_feature (282)..(282): n is a, c, g, or t
  misc_feature (304)..(304): n is a, c, g, or t
  misc_feature (309)..(309): n is a, c, g, or t
  misc_feature (317)..(317): n is a, c, g, or t
  misc_feature (320)..(320): n is a, c, g, or t
  misc_feature (332)..(332): n is a, c, g, or t
  misc_feature (335)..(335): n is a, c, g, or t
  misc_feature (337)..(337): n is a, c, g, or t
  misc_feature (365)..(365): n is a, c, g, or t
  misc_feature (370)..(370): n is a, c, g, or t
  misc_feature (451)..(451): n is a, c, g, or t
  misc_feature (455)..(455): n is a, c, g, or t
tctctgttagttaaggagctagtcatctcagagtaaacagaaccctgagcggcatttcttggtgaatggtaaggacatcaatgtgttggtgaggtgtcaacaatttgataaaatctgtatgtgctgactccataggctaaagcagaaggattgtaagttaggcattgtgatagatgctaaaaaaantntagggacaaaaataagctcagattattggtttttcttttttaacataggatctcatgtagcccgcactggccttgaanaccctctgtagccagnggatgaccttgaactcctgatnttttnatcttcanttntcaatgggtaantcntntgtccccccatgcccagctagacttagnttttntccttattactatatagcaggaagatggacattaagttacaatcattttcatttgggattaatgtagtgaaattctttatntctnccttctattctaatttagaggctccaatagagctttaaggctgggttccagatcatactcatctttgttcttgcagcttgcctatggtgtgacttaa

SEQ ID NO: 6399 - DNA, 537 bp, Mus musculus
acattcttggctcacaggttttggaaaaggaggcagagaggagagacatctttgactcctcagaaccagggagtgcaatacaaagactattgagtgctgctcacatttacaaaaacgaacactacttggtagaatcttagcacactttccttgtctcatttcatttcttctgaggaaacaggaaagttaattcataatttccttttccctctcaagcactttttaaatttccagagacctctgatcaagggtcatttttagagccttttgatgtgtgtttaatctcactcaatgttcttttggtgactgcagtgatactgagcctccgtgggaaggcttaacagttagagtgcactttaattcattaattcacgatccatgtggccttataataatgggtcaaggaacccatttcattcttgcctgccaaagagttacacagaagcacatcaaacaccagcacttcacctgcacgaagggatgagactgggatccctgagtaaacttctttaatagtgtgtgctatgccatttggaa

SEQ ID NO: 6400 - DNA, 531 bp, Mus musculus
tgaaccacatgcagagtctacgcttcgagcataagctgtatgctcaggtgaaacagaagatggaggagatgcagcagcacaacatgtcctggatcgaggtgcagttcctgaagaaagcagttgatgtcctctgccagtgtcgtgccacactcatgtacacttatgtcttcgctttctacctcaaaaagaataaccagtccattatctttgagaataatcaagcagatctagaaaatgccacagaggtgctttcgggctaccttgaacgagatatttcccaagattctctgcaagatataaagcagaaagtccaagataagtacagatactgtgagagtcgacgaagggttttgttacagcatgtgcatgaaggctatgaaaaagatctgtgggagtacattgaggactgagactggccctgcataaaatgaactctgaaaactttaccatctagagtgctcatgcaattaaaacaaacacaaacaaggaggcactaagcctgttctgacaccgctggtctgtagtaccaga

SEQ ID NO: 6401 - DNA, 553 bp, Mus musculus
  misc_feature (417)..(417): n is a, c, g, or t
  misc_feature (461)..(461): n is a, c, g, or t
  misc_feature (522)..(522): n is a, c, g, or t
  misc_feature (526)..(526): n is a, c, g, or t
gctctactgcagtcatgtcaatggttggctacatcctggggcttggagaccgtcatggtgaaaacattctttttgactctttcactggtgaatgtgtacatgtagatttcaactgtctttttaataagggagaaacgtttgaagttccggaaattgtaccatttcgactgactcataatatggttaatggaatgggtcctatgggaacagagggtctatttcgaagagcatgtgaagttacactgagactgatgagggatcagagagaacctttaatgagtgtcttaaagacttttctacacgatcctctagtggagtggagtaaaccagtgaaaggacactccaaagcaccactgaatgaaaccggggaagttgtcaatgagaaggccaagacccatgttcttgacattgaacaangactacaaggtgtgatcaaaacccgaaatagagtaacagggctnccattatctattgaaggacatgtgcattacctcatacaagaagctactgatgaaaacttantctntcagatgtaccttggttggaccccata

SEQ ID NO: 6402 - DNA, 499 bp, Mus musculus
aacgaaacactagagcagtccaacaaaaatcacttgactgaaatttctaagtttcaggtgagatccatggcacccctagttattgatcagacagaaggacccaagtcaaatacagaaaatgccatagcaatgaatgaagacagccaacttagcagccgcactaaagccatcatatcgaagaccaaacagatcgaggaggtttacctacaatattgtgagacttttgcaatagtggtgaaaatgctgcttgacaaagacccctcattacaaaagtctatccagtttgcactgagacaaaatttacaggaaatgagtgagcgctgtgttgaagaactcaactgtttcattactgagtatgataattctcaagatttcggagacccttttaagaagtagtacacaggtcaaaaaaatttttttggttcttttctccttggattgtgtaaatccttactattttgtgatgaagaaaaatactttgacagctggatgcatttcc

SEQ ID NO: 6403 - DNA, 468 bp, Mus musculus
  misc_feature (319)..(319): n is a, c, g, or t
  misc_feature (325)..(325): n is a, c, g, or t
  misc_feature (354)..(355): n is a, c, g, or t
  misc_feature (373)..(373): n is a, c, g, or t
  misc_feature (393)..(393): n is a, c, g, or t
  misc_feature (411)..(411): n is a, c, g, or t
  misc_feature (413)..(413): n is a, c, g, or t
  misc_feature (415)..(420): n is a, c, g, or t
  misc_feature (422)..(422): n is a, c, g, or t
  misc_feature (424)..(424): n is a, c, g, or t
  misc_feature (431)..(431): n is a, c, g, or t
  misc_feature (433)..(435): n is a, c, g, or t
gagtgttaattgaccacttcaggtatatgttagtactgggtaaacatttctgacctcctcaggcacacaacatgtagtgtcctgataagcacttagactgatgtggcaagcagttgcaaagtagcaaatacacacatttcctcttctcctcccctttaatgaaaaggctgtgaaacctttaaatcttgtttttctgatgagatggtattgaagtgtatacaacttttaagtttgctggaatactaaaaagaaaaaacttatgagctgttatgtctttagttctctctcttgtgaacacttaataaaaaggtgttctcangatganagatcatttatgctgcatgctaaaaccannaagtaattttcacagtangtgactccatataaatgaantgtggtaacaatactggnanannnnnntntnccagtantnnnaccacaattcatttatatggagtcacctactgt

SEQ ID NO: 6404 - DNA, 283 bp, Mus musculus
cacagaagactgttcaacccactcttcagctagtgagtgaaaaaaggaagtcttccaagagtctctgcttttgccttaactctgatccctctgatgtggcattgttcttgcctctgagtccttgaatgctggactatgatagggtgggaccaatgtctacatctccatccactggggccgaggctgctgtctgagaaaggtggctaggggtaggcaggatgatcataactcccatcctgcgatgtcatcatatggaacatggccagtccagagtcagggcttg

SEQ ID NO: 6405 - DNA, 184 bp, Mus musculus
gaagcttgccaaatcttctcagatcatagcagaacttcagacaaccatttcctctctgaaagaggagagcagtcggcagcagcttgctgcagaaaggcggctccaggatgttatacaaaagtttgaagatgagaagcagcagctgattagagataatgaccaagcaatcaaggctttacaagat

SEQ ID NO: 6406 - DNA, 412 bp, Mus musculus
  misc_feature (335)..(335): n is a, c, g, or t
  misc_feature (367)..(367): n is a, c, g, or t
ggatgactctgaagtgggcaaggctgggcacgtcatgcgacgcttctttgagagccgctgggaggaattttatcagggaaaacaggccaatctgtgaggcaaggaagttgggagtcactttgtggcatcttctccaaccttccaaacaaaaacctgccgttctcacctgctgatggctgccctgggtggactcaagtcagacaatgctgactcttgactctgcccttggcagcacccacatcctcttgttccgaatcccttttctcccttcctcctctggctcctcaaataagagatgcagagatgaggtccttctggatggaaagccaaaaaanaaaaaattttcctgtctctcctcctcctcccncccccccccattaaaatggagagagacaaagaagtcctccttccc

SEQ ID NO: 6407 - DNA, 306 bp, Mus musculus
  misc_feature (122)..(122): n is a, c, g, or t
agctcacgtatctaagcagccatgactacaagcacctgtacttcgagtccgacgcagccacagtcagtgagatcgtgctcaaggttaactacatcctggaatcacgagcgagcactgcccgngctgattatcttgctcaaaaacaaagaaaactgaacaggcgaacaagcttcagcttccagaaggagaagaaatcagggcagcagtgacactggcctctagtctggtgccacagcccaggtggcctgcaaggccaggtggaccggagtccaccagcatcctgtagtgccgagacccgcaggcaca

SEQ ID NO: 6408 - DNA, 439 bp, Mus musculus
  misc_feature (36)..(36): n is a, c, g, or t
  misc_feature (91)..(91): n is a, c, g, or t
  misc_feature (167)..(167): n is a, c, g, or t
  misc_feature (175)..(175): n is a, c, g, or t
aaggctttcagctgcatatcgacattcatggcagtnaagacttacttcctgtgtagcaccttccacaatctcttctgcaggagagcgggcnattaacaatggatatgtgaagttcttgatgataaacttaaaaaataacagagaacacctacctcttgttggaaaangttggccnttgaatggagaactgactgtttaaatggccgtattgagagttgcattgtagtggatatgaccttgctggatgaggacaagaagcccatctggtatgtgagttctccagtgtgcttgagatctgcctgccttcctgatttcccgcagccggcttactctttcgagtacatggacagcgtaggaggagtgtgcgcagacctagggtggtttgaaaataccgatgaatacttcattgtcagactggacatttacctcagtgtagcaa

SEQ ID NO: 6409 - DNA, 363 bp, Mus musculus
  misc_feature (65)..(65): n is a, c, g, or t
  misc_feature (67)..(67): n is a, c, g, or t
agagacctcaagcaacaattcccagacgttgaagctggacgagaccatggactccataggagaanantgacccatttacagccaagctgagctttgagcaaggtagctctgagtttgtgcctgtggtggtgaaccggtcagtactacgctccatgagccgaagagatgttctcatcaagcgctggcccccgccgctgcaatggcaatatttccgctcgctgttgcctgatgcctccatcaccatgtgcccctcctgctttcagatgttccattcagaggactacgaactgcttgtgctccagcacgcctgctgcccttactgccgaaggcgtatcgacgacactggcccgtgagcagcgacag

SEQ ID NO: 6410 - DNA, 499 bp, Mus musculus
  misc_feature (247)..(247): n is a, c, g, or t
  misc_feature (259)..(259): n is a, c, g, or t
  misc_feature (261)..(262): n is a, c, g, or t
  misc_feature (264)..(265): n is a, c, g, or t
  misc_feature (275)..(275): n is a, c, g, or t
  misc_feature (279)..(280): n is a, c, g, or t
  misc_feature (287)..(287): n is a, c, g, or t
  misc_feature (289)..(289): n is a, c, g, or t
  misc_feature (294)..(294): n is a, c, g, or t
  misc_feature (300)..(300): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (355)..(355): n is a, c, g, or t
  misc_feature (371)..(371): n is a, c, g, or t
tattcttatatctcctgttcttctgttcttcctcccaacctttaaaaaatagccagcttcattgattagttatgtgaaatgctgacgttacaacactgcagttactgatacaaatggtgttagctggaaatattaaagcattcttatatgttttgcttatttctagtatattcttcagaaagttaagacatgtttcatgtccaagtgcttaagtcttagtatagtgtttatgatcctataaaacaancaataggatgtnanntnncttttgtttnattnnttgggtntnatttntacttnatccntttnanaagaatagtgtatcagtacaatgtaataacatgattttcatganacagtagagactgaancctttcaaagttatttgatttttagatcatcagacatgtaatgaaaatggttcagtttgcaatgtgagctttgtacttggtggtatgacaaatgtttgcttttataatatacagattttccttgcaaa

SEQ ID NO: 6411 - DNA, 493 bp, Mus musculus
  misc_feature (305)..(305): n is a, c, g, or t
  misc_feature (336)..(336): n is a, c, g, or t
  misc_feature (344)..(344): n is a, c, g, or t
  misc_feature (369)..(369): n is a, c, g, or t
  misc_feature (387)..(387): n is a, c, g, or t
ctgtgtgtctgctttacctgggaaagctcaaggactccctgcggcagctggaggccatggtgcagcaggaccccaggcactacctgcacgagagcgtgctcttcaacctgaccaccatgtacgagctggagtcctcaaggagcatgcaaaagaagcagagcctacttgaggccgttgctagcaaagaaggggacagcttcaacacacagtgcctgaagctggcttagttccctccaggtctctgtacctgcagacacttgagcagatgggtcagtaaaagcatttgatgggtgtgcaggagcatnccttcggctggctgggctaccctcagacccnctgacctncctaccatgcagttgcacaatactncctgttggtgaaggtganccatatgcatggcattcagaaacagggaacataaggacatggggttcccttggtttgttcatggaagctaacttgttctttggtcacttctgaatactcgtttggt

SEQ ID NO: 6412 - DNA, 358 bp, Mus musculus
  misc_feature (164)..(165): n is a, c, g, or t
  misc_feature (325)..(325): n is a, c, g, or t
gaattcctactccaggttagaagggcacaggtggtttccaaggttctctgggtcctgggtgggtgttgaagtggtgtacaaagggagagaaagtctgggatgggcagggcttttgaagagtgggggctggtgaaacacaagtttagaaatgaatttaaccatcnnagccatgtatgaaattcacttctagaggtggcccctgatttccccaagcctcactcaggacagaaggcaccattcagttcagccttctgccccctttgcctgacccccaagcctgggtaccgcaaacaccaaggcctccagacagtgcagggcaggtgcnagggcctgagatgctgacagcaggttctgcagc

SEQ ID NO: 6413 - DNA, 529 bp, Mus musculus
  misc_feature (357)..(357): n is a, c, g, or t
  misc_feature (375)..(375): n is a, c, g, or t
  misc_feature (465)..(465): n is a, c, g, or t
tgttcctctaactgtgcctgattattataaaataattaaaaacccaatggacttgtcaaccatcaagaaaagacttcaggaggattattgcatgtatacaaagcctgaagactttgtagctgattttagattgatctttcaaaactgtgctgaattcaatgagcctgattctgaagtagccaatgctggtataaaacttgaaagctattttgaagaacttctaaagaatctttatccagaaaaaaggtttcctaaggtagaattcaggcatgaagcagaagactgtaagttcagtgacgactcagacgatgactttgtacagccccggaagaagcgtctcaagagcaccgaggatcnccagctgcttaagtaacnccgcactgggccagcgcgctgtgctagagatttctcatcaaaactaaagacagcaaaaggcttgtcagtgatctaagggtttgtgagctntctgctctgtttttgctgtttactggactttggtttctttcataacccatttctttaacctctt

SEQ ID NO: 6414 - DNA, 282 bp, Mus musculus
aaggatgggctcttcggttatcgatgaaatctctgtagaagaggtaaataagatggaatcccagttggaaaggcattctaaacaagcaatgcaaatccaagaacagaaagtacaacatgaagaagcagtagttaagttacggcacagtgaacgagacatgagaaatacactggaaaagttcgctgcaagcatccagggcttatcagagcaagaagagtatctgtgtgtacaaattaaagaactggaagctaacgttcttactacggcccctgacagaaaaca

SEQ ID NO: 6415 - DNA, 192 bp, Mus musculus
aggagaagtttcagcaccacctctgcttcttctcaaaaagagattaacaggagaaatgcttttgccaagaccaagaccaccttgcgccgcagctggagcagttccaccacggcaggtggtctggaggggaccgtgaagctccacgaggggtctcaggtcctgctcacaagctctaacgaaatggccacggtt

SEQ ID NO: 6416 - DNA, 267 bp, Mus musculus
aggagaagtttcagcaccacctctgcttcttctcaaaaagagattaacaggagaaatgcttttgccaagaccaagaccaccttgcgccgcagctggagcagttccaccacggcaggtggtctggaggggaccgtgaagctccacgaggggtctcaggtcctgctcacaagctctaacgaaatggccacggttagcgtcactgaaggggtccgtgctaaaacccagtcaacagtgccaatggcagtggctctgacagtgctctggaag

SEQ ID NO: 6417 - DNA, 504 bp, Mus musculus
ttgttctcaagatttggacgttcttcagcatcacagccgtctgagccatctaaagactcactggaagatgataagaagccttcagcttcaccctctaccaccaccgtggcaacgcagaccctgccgcacagtggctccggcttcctcgactccgcatatttcagacttcaagaatcgttcttttatctcccacaacttctttttccggaaaatgtaatgcagagtaaagatgatagcctcgtggaactggaacacaggatcgactttgaactcagagaaggccttgtggagagccgctattggtcagccgtcacgtcgcacactgcctattggtcatccttggatgtcgctctttttcttttaacattcatgtacaaacacgagcatgataccgaggccaagcccagcctaggttcactctgaactcttgaaggacgtgaatgcccaaagcttttctgttaaacatgtgtcaagatgcagagacttcaaggttccagttttgtt

SEQ ID NO: 6418 - DNA, 463 bp, Mus musculus
  misc_feature (32)..(32): n is a, c, g, or t
  misc_feature (34)..(34): n is a, c, g, or t
  misc_feature (36)..(37): n is a, c, g, or t
  misc_feature (270)..(270): n is a, c, g, or t
  misc_feature (272)..(272): n is a, c, g, or t
  misc_feature (284)..(284): n is a, c, g, or t
  misc_feature (306)..(306): n is a, c, g, or t
  misc_feature (316)..(316): n is a, c, g, or t
  misc_feature (319)..(319): n is a, c, g, or t
  misc_feature (333)..(333): n is a, c, g, or t
  misc_feature (347)..(347): n is a, c, g, or t
  misc_feature (350)..(350): n is a, c, g, or t
  misc_feature (352)..(352): n is a, c, g, or t
  misc_feature (355)..(355): n is a, c, g, or t
  misc_feature (367)..(367): n is a, c, g, or t
  misc_feature (371)..(371): n is a, c, g, or t
  misc_feature (389)..(389): n is a, c, g, or t
  misc_feature (391)..(391): n is a, c, g, or t
  misc_feature (393)..(395): n is a, c, g, or t
  misc_feature (397)..(407): n is a, c, g, or t
  misc_feature (411)..(411): n is a, c, g, or t
atatataaccgtctgtgtgccaaacagctaanananntgtgggagcaggatgcatttactgtgtacagtgctaaccagagcatggtgactcggacacagaaaatggatggacgctgaggtactgggggggtctgagctgtagatattttccaccatgcttttcatctgtgatgtgcatccagcaacccccgtgtgtatgcttcctgaggtaagtgtgcacgttaccatgtgttaccatgtcacatgttcatacactgaggcaccagtttntnaagtgccttgcnttagatcacacagcaaatgganagagtgtggnttnaaagccagaccatnttctttcctgtgcntgntnaanggtgtcactcanccantgaccttgagaagcctgnanannntnnnnnnnnnnnaganggccataaagcccagtgttacctagcagatgcagtcgagattcttacactca

SEQ ID NO: 6419 - DNA, 516 bp, Mus musculus
  misc_feature (94)..(94): n is a, c, g, or t
gaaactgctgatctcttgagcctggtttcagaggaagatgtatcaaacagactttatgataataatccaccagattctcatctattagttaaancccccaaacagactcctttatcgctatcaactcctgcatcttttatgaagtttggaagtctgaaaaaaatgagagaggaccgttggacaacgattgctaaaattgataggaaaagaagactaaaggaagcagaaaagttattttcttaatttcagaaaaccaatgttggttacagagatgaaaaacattaaatagttatctttattatttccaagagagccaaactttaccaaggaattcatattttaaaattaattacagaaataacttgggtttatgttactatatttgtggcctaaaaataaaataactatatttcatctgaatttttattgtattcagatacttaacattttgttgcttttacttgcaatggatattgaagttcgaagttttttaacttgagcttttgatcattagaa

SEQ ID NO: 6420 - DNA, 283 bp, Mus musculus
ggttgaacatctgcagttcctgctgtccagttatcaacacgtgctgagagagcacctacggagctcagtgattgatcggaaagacttaatcatcaaaagaattaagcccaagccccaacaaggagatgacatcacggtgctggatgtggagaagcagatcgaggccttccgcagccgcctggtccacatattgggagaacctttagtcccccagctccaagacaaagtgcatttgttgaagctgctgctcttctatgctgcggacttgaaccccgacacagag

SEQ ID NO: 6421 - DNA, 316 bp, Mus musculus
  misc_feature (72)..(72): n is a, c, g, or t
  misc_feature (87)..(87): n is a, c, g, or t
  misc_feature (97)..(97): n is a, c, g, or t
acctgcctgtcgaagagttccaaggagcaggctttgaacctcagcagccaactgaacatacccaaagatacnagccggctgaagaancacatcaccntgctgtgtgataggttagccaaaggtgggcgtctctgcgtgagcacagatgcagcggccccgcaggccatggttgtgccaggtggctgtactccaatcccagagtcagacctagaggaaaggtcactagatgactccacagagctgtttaccaaccacaagcacctcatgaccgagccccccatgcctgaagtctcagcccgccaaggagttttggaat

SEQ ID NO: 6422 - DNA, 354 bp, Mus musculus
  misc_feature (292)..(293): n is a, c, g, or t
gaagacctgaagactaaactgccttttccttcgggcgttggcagctagctaattgcactgaaccacacttgagagcatacgtacattcatataatgttcgagtttggactgttcttgttaatgtactttcttaggattaaatgtcaggattctgttcatactaagctatttgaagaaaaagtgtttagtactgtttgcataaaagaacaaggagatgagcaagatgaatgctggtttcaatggggttgttttaagaaatcagctattttcagaatacatgggattttttttnncaatgttagagaaactgtgtaatttaccataatccttaagctctggaacccatacaagtga

SEQ ID NO: 6423 - DNA, 205 bp, Mus musculus
aaatccaacttgctggaaaccataaccaaaaagaagacattatccctggttggtgtgacccctccaagaggacgtctgtcctcgtcctcgttactgcttagtggaacaacctgctgacctggacaactttgccaggattggacacctgtaagaaagcactggccatcgactacctttgagtcagccagacagcacgtgctgactg

SEQ ID NO: 6424 - DNA, 409 bp, Mus musculus
  misc_feature (248)..(248): n is a, c, g, or t
  misc_feature (253)..(253): n is a, c, g, or t
  misc_feature (260)..(260): n is a, c, g, or t
  misc_feature (263)..(265): n is a, c, g, or t
  misc_feature (268)..(268): n is a, c, g, or t
  misc_feature (280)..(280): n is a, c, g, or t
  misc_feature (284)..(284): n is a, c, g, or t
  misc_feature (287)..(287): n is a, c, g, or t
  misc_feature (291)..(291): n is a, c, g, or t
  misc_feature (295)..(295): n is a, c, g, or t
  misc_feature (298)..(298): n is a, c, g, or t
  misc_feature (312)..(312): n is a, c, g, or t
  misc_feature (359)..(359): n is a, c, g, or t
  misc_feature (363)..(363): n is a, c, g, or t
  misc_feature (378)..(378): n is a, c, g, or t
aaacctgactatgcactgagctctgtgggagcctccatcgacctggagaagacgtccagtgactacgaggaccagaacactgcctacttctggaaccgcttgagcttctggaactatgcccgcccgccttctgtcatattggagccagatgtgttccctggaaattgctgggcttttgaaggtgataaaggccaggtggtgatccgactgccaggtcatgtgcagttaagcgacatcaccctgcagcntcctncacccantgnnncanacaccggagggnccancancgcncctnggngactttgcagtctntgggctccaagctgatgacgagactgaagtgttcttggggaaattcntctntgatgtgcagaaatntgaaattcagactttccacctccagaatgat

SEQ ID NO: 6425 - DNA, 334 bp, Mus musculus
  misc_feature (248)..(249): n is a, c, g, or t
  misc_feature (261)..(261): n is a, c, g, or t
  misc_feature (265)..(265): n is a, c, g, or t
  misc_feature (289)..(289): n is a, c, g, or t
  misc_feature (299)..(299): n is a, c, g, or t
  misc_feature (301)..(301): n is a, c, g, or t
  misc_feature (303)..(304): n is a, c, g, or t
gtggaatacgagtctgcctcggttcgtcactcactggagcatatccttcaggacgtgtcttctgacccttgagcttggttctttaagttcctacctgtatctttttagtccgatgtctatttggtggagcagatattcataactgacctgtgtgtcttctagaatgttgaactttggaagctatgcttttttctgtagctttggtgttttgtctaagaaatacattaattctaggagaactaccagtnntttgctgggctntacnattcattccttttggacaatggantctattcctntncnncccttgtgataccttgttatgcttctgaaa

SEQ ID NO: 6426 - DNA, 107 bp, Mus musculus
agaaacagaggcgccggcaggagaagaaagagcgccgggctgaaaacctgagacgccgtctagaaaatgagcgcaaggctgagattgtccaagtgatccgcaatcct

SEQ ID NO: 6427 - DNA, 183 bp, Mus musculus
gttgcgttctattgaaaaacgagacaccctggccttgctccagaaacagccaccccagaggcctgtagccaaggtctgagttcaggacagtccataggcctcagcaaacaaggcacttctcaggccactgactgacacctctcctggagccagcacaccaacgctgtcacattaagacggaga

SEQ ID NO: 6428 - DNA, 473 bp, Mus musculus
  misc_feature (344)..(344): n is a, c, g, or t
  misc_feature (383)..(383): n is a, c, g, or t
  misc_feature (431)..(431): n is a, c, g, or t
  misc_feature (448)..(448): n is a, c, g, or t
ggaatactttggaggccgcgctcgattgcattcgctacatcacgagacacgtagtgaaagagaacgacgtccgcgaggttgttgaagattggaaattcatagcccaagttctcgatcggatgtttctatggacgtttcttctggtttcaatcattgggacgctagggctttttgttcctgttatttataaatgggccaatataatagtcccagttcacattggaaacacaattaagtgaaaccaagaaattacactggacttagtgagcagtcaagcagctcttaggacacgtatgccattatgaaaatatttacaatttgatataggcagtaacagattagcnagtttctgacattggcttaatgttgtccattagaactgnagtaatagccttgagtaccaacactgtccgcctgcactagtgaaggcntaccatcgcatcctggnaaatcctactaacttgcaaccagtg

SEQ ID NO: 6429 - DNA, 380 bp, Mus musculus
  misc_feature (222)..(222): n is a, c, g, or t
  misc_feature (273)..(273): n is a, c, g, or t
  misc_feature (277)..(277): n is a, c, g, or t
  misc_feature (344)..(344): n is a, c, g, or t
gggctctgcactgggcagatcaagactggtgccccttgccgatctgagcgcctggccaagtacaaccagatccttagaattgaggaagagctgggcagcaaagccaagtttgctggcaggtccttcaggaaccccctggccaaataaagcatggaccggagatccctggagccaccagctgctaggtcctctgtccctgatgtcatcccagcagctcaaggncagcccagtgcgtgcccctcccatgtcactgcttccttaggtatccacacntgancaccagaatccctgctggagacccagttttgcaatcatgtgattggtctgaatcattgtttctgtcnacctgacttcccagctagtgtctggagccctcggaa

SEQ ID NO: 6430 - DNA, 101 bp, Mus musculus
ttggtggctgtgcattacaaaaggtatgagtgaaggaggtgagatgctgacaaaagattctttgggcccagtggagaagcagtaacgtctttccagctgtc

SEQ ID NO: 6431 - DNA, 335 bp, Mus musculus
  misc_feature (49)..(49): n is a, c, g, or t
  misc_feature (273)..(273): n is a, c, g, or t
ttctatccccttttagagtcctcatcaatgggatccagggggatgtatnttcactggtgcctgatgtatgaatagacttgatttaaccatcctgaagtgtctagacagaacctcatgtggcattctatcccataaattcacacaattttgatctgtcaatcaacaaggagatgagtaaaagcacagatgaaaacaaagacagaaacatagtgggccacacctcctacctgttcctgtgagtctgccctgctgccccctcatttcctgggagcnctctgccatgctgtaggagagattcctccctagctactaggcagccaccaatctcaatcttc

SEQ ID NO: 6432 - DNA, 524 bp, Mus musculus
  misc_feature (160)..(160): n is a, c, g, or t
  misc_feature (162)..(166): n is a, c, g, or t
  misc_feature (463)..(463): n is a, c, g, or t
  misc_feature (478)..(478): n is a, c, g, or t
ttaacatgtctctcagtggtcgctatctggaggagcttagtcaaaggtaccgcaaacaaatggaagaaatgcagaaggctttcaataagacaatagttaagcttcagaatacttcacggatagcagaagagcaggatcagcggcaaactgaagccatccncnnnnnccaggcacaactgaccaacatgacacagcttgtttcaaacctatcagcaactgtagcagaattaaagcgggaggtttcagatcgtcagagttaccttgtcatgtctttggttttatgtgttgtcttgggactgatgctctgtatgcaacgctgtcgaactacttctcaatttgatggagattacatttcaaaacttcccaaaagtaatcagtatccaagccctaaaaggtgtttctcttcctatgatgacatgaatttgaaaagaagaacatcatttcccctcatcagatccaaatntctgcagtttactgncaaagaagtagatccgaatgatttgtacatcgtagaacccctcaag

SEQ ID NO: 6433 - DNA, 406 bp, Mus musculus
agagctcgaggagctgtcgcccagcccgcccgctctgcatggtcccgggggcggcttagcggccctggacgcggccaccggggactacggcggaggcgtgctcggcgccaacctgctctatggcagaacgtggtgatgagccccgagggtctgcctgcgactcgcaggatccgccaagaaactgcaagaacggatgggggaaatgtacagatgctgaccctttagtgcatggagataagaacgaatgagtcacggagagggtcaggctgctctgaacctctttactgggggtgggagaaggcaacagccccggaccgaataatgtgacaccacactctgaggtggtgatttcccttctttcagaagttcctaagttatgcggaagaactgactgacggaatacgca

SEQ ID NO: 6434 - DNA, 536 bp, Mus musculus
  misc_feature (400)..(400): n is a, c, g, or t
  misc_feature (403)..(406): n is a, c, g, or t
  misc_feature (408)..(408): n is a, c, g, or t
  misc_feature (412)..(412): n is a, c, g, or t
  misc_feature (416)..(416): n is a, c, g, or t
  misc_feature (423)..(423): n is a, c, g, or t
  misc_feature (427)..(427): n is a, c, g, or t
  misc_feature (432)..(432): n is a, c, g, or t
  misc_feature (435)..(435): n is a, c, g, or t
  misc_feature (440)..(440): n is a, c, g, or t
  misc_feature (443)..(443): n is a, c, g, or t
  misc_feature (453)..(453): n is a, c, g, or t
  misc_feature (462)..(462): n is a, c, g, or t
aaatgctactgaaacttgcctgagaactataggaccatggcaagcaaaaacaattaaacaaaattagaatctgaatatttggctgaggccatatattggaagttgaatttatggaaaaaagcacaaacaaccttggaagcactttgcacaccgtgatgaacttcctgggcccaaaggtaccagggcaaataactggcaccatctaccctttccaagtgtttagttactggatcagtggtgagaataatattaataaaacaagctatctctgacatctagtacacatgtataaatctgcttattttcagcctgccgcagaggcatactatttatttttttcagtgtcacatttagaatggtgatggtttacagatcttcatatttttgttttacagtttanacnnnnantgtnagcnactgctnacantgaanctnggaanctnactggtttanaatctgctnaccctttccaaaattaaatccttggaaagctgttgaacccaaagcttttgaacctgccaaacagattacccttt

SEQ ID NO: 6435 - DNA, 242 bp, Mus musculus
  misc_feature (176)..(176): n is a, c, g, or t
cagcaggctatggaccgaaagattgtcctggagctggaccggaaggttgccgaccagcagagcacactggagaaggcaggggtagctggtttctacgtgaccaccaatcctcaggagctgacgctgcagatgaacctattggaactcatcaggaagctgcagcagaggggctgccnaagtgggaaaggcagctctgtgaccaagcagggggtccttgctgtcctccgttgcctaggatggct

SEQ ID NO: 6436 - DNA, 430 bp, Mus musculus
  misc_feature (87)..(88): n is a, c, g, or t
  misc_feature (249)..(256): n is a, c, g, or t
  misc_feature (258)..(260): n is a, c, g, or t
  misc_feature (262)..(262): n is a, c, g, or t
  misc_feature (327)..(333): n is a, c, g, or t
  misc_feature (335)..(335): n is a, c, g, or t
  misc_feature (337)..(337): n is a, c, g, or t
  misc_feature (340)..(340): n is a, c, g, or t
tagctggtttctacgtgaccaccaatcctcaggagctgacgctgcagatgaacctattggaactcatcaggaagctgcagcagaggnnctgccaagtgggaaaggcagctctgtgaccaagcagggggtccttgctgtcctccgttgcctaggatggctggcgggtgccacagccttgactgtgtgggggctactgtccagctgccaacaggtctgatctctctgaggggctgattagatcctggctannnnnnnncnnncnatccactgttcagatttggaggggaagggcccaagcaataggaatgatgtcatgagaaggccccnnnnnnncngnatnctgagtgggaatattggttctagcaccttctcctctgggcatatcccacattccttccaggcttgggtgttgccttattcctgtgtagcc

SEQ ID NO: 6437 - DNA, 288 bp, Mus musculus
ggccagcaaggacacctccaagctgctgttgctgtatgatgaggacattctcgaccgggacccactcagggagcagaaggacctggcgttcgcacaggcttatctcaccagggtacgcgaagctctccagcacacccctggcaaatacgaagatttccttcagatcatctatgaatttgagtcaagcacccaaatgcacagcgctgtggatctcttcaaaagcttgcaaacccttctccaagactggcctcagctcttgaaggactttgctgctttcctgctgcctga

SEQ ID NO: 6438 - DNA, 498 bp, Mus musculus
agtactggaggctttccgtgcacatgccagccagcgcatcagccaactggaacagggtctcacatctatgcaggaattcagaggccttctacaggaggcacagacccaactgatagggcttcacacagaacaaaaggagctggctcagcagacagtgagtctgagttctgccttgcagcaggactggacatcagtccaattgaatgtgagtgtttggggccatcactaccactcccttagaggcaatttcctgtccttgagtatgctctactgatccaattactttggtagtatggaatatgggcagctttgctgagttggtctcgagaactcaccaagaaactcacagccaagagccggcaggcccttcaggaacgtgatgctgcaattgaagaaaagaagcaggttgtgaaggaagtggaacaagtctctgcccatttagaggactgtaaaggtcaaatcgaacaactgaagttggaaaatagtcgccttactgca

SEQ ID NO: 6439 - DNA, 527 bp, Mus musculus
  misc_feature (108)..(111): n is a, c, g, or t
  misc_feature (113)..(115): n is a, c, g, or t
  misc_feature (117)..(118): n is a, c, g, or t
  misc_feature (361)..(361): n is a, c, g, or t
gaaaagcttttcctctgaaaggcaatactgggaagtgggcatgaatctcaccggggatgcactctgggccttgggggtgtgcagggacaacgtgagtcggaaggacannnngnnnanntccccagaaaacggcttctgggtagtgcagctgtccaaggggaaaaaacagctgtccctgttacccaattccactctagtcactctcacagagcctcccagccacatggggatcttcctggacttccaggctggagaggtgtccttctacagcgtgaacgatgggtcccacttacacagcttttcccaggctgccttccctgggccgctgctgccattcttctgcttgggggctcccaagtcnggccagatggtcatctccacagtgaccatgtgggtgaagggatagaggcttgaagccgggcagacactgggtgtgccacagttccccagaaggcagggtgcttcaccaccgtggccacctacccaggcttccctggggcactaagagttaatacctgtgctggcag

SEQ ID NO: 6440 - DNA, 563 bp, Mus musculus
atgccatcaacaatcgagccttctgcaactatgatggtggggactgctgcacctccacagtaaagaccaaaaaggtcactccctttcctatgtcctgtgacctacaaaatgactgcgcctgtcgagaccctgaggcccaagaacacaaccggaaagatcttcggggatatagccatggctaaggaaagacaggtgtcaaagatttcccaatgccaggacccgcatccctctggtattgatttcacagtctgctgctcaatgaaatggcctctccacaccagggatccttagcacccaaccggtctgcctttaatttcacccaggaaggaccaactgtggggcaatgaactgaatctcaccatgttgaatgatggagtggaatactatcctgtagtctaagatggattgaacacacggcatgtagacccagagcctctaaaaattctttccatttctcaaatgaccatagcccaaaagaacaacaaaacggtgtgtgtatcaaggagtatgcacatctgtggttagtacacaggcatgcatgcacacccatgccaatgtctgtg

SEQ ID NO: 6441 - DNA, 548 bp, Mus musculus
  misc_feature (360)..(360): n is a, c, g, or t
  misc_feature (367)..(367): n is a, c, g, or t
  misc_feature (371)..(371): n is a, c, g, or t
  misc_feature (390)..(390): n is a, c, g, or t
  misc_feature (398)..(398): n is a, c, g, or t
  misc_feature (410)..(410): n is a, c, g, or t
ttgcccaaaccctgaaaagttccagactgagtggggaagagaagagcctaaagtcccctgacttggcagaagaggtaaagttggtggagaacttgaagagtacagatatggagaaagagaaaaaaaatgaacccaaaggaaaataccagaaaaggtatgatttggacaaagaagaaaaagccagaaaagagccaaaggtattaaaatcatttaaggaaatcagaaatgcatttgatttatttaaaaaaacaacagaagaaaaaaatgatgttcttgagaataattcaaaaagagaagaaatatcactggattctaaaattatgaatgataacaaaaccaaggacaagtgttcacttaaanaaaaaanaaanactcgagatgagactgacncttgggcntacattgctgcngaaggggatcaggaagtttcagacagtgtatgccaaacagatgagacgtctgatggcaggcaaccagttttgagttcgggtatggacctgcagctggagtggatgaaattagaagattttcagaagcatctggatggg

SEQ ID NO: 6442 - DNA, 360 bp, Mus musculus
aagtgtgggttcagtccttagagaagaaagcagaagacttgagttcactaaatggccagctgcagagcgaagtcaccctgctgagaaatgaagtggcccagctgaaacagcttcttctggctcataaagattgccctgtaactgccatgcagaagaagtctggctatcatactgctgataaagatgacagttcagaagacctttctgtgccaagcagtccacatacagaagcgatccagcacagctctgtcagcacatccaatggagtcagttcaacatcaaaagcagaagctgtagccacttcagtcctcacccagatggcggaccagagcacggagcctgcactttcacagattgtca

SEQ ID NO: 6443 - DNA, 547 bp, Mus musculus
tcagggcagtacacaggcttcaatgaccacaagccactggaccccgagacgattgctcaggatattgaggagaccatgaacactgctttgaacgaactccgtgaactcgagaggcagagcacagtgaagcacgcccccgatgtcgtgctagacactttggagcaagtgaagaactcgcccacccctgcgacttccacagaatcactcagcccactgcacaatgtcgccctcaggggctcagagccacagattcgccggagcaccagctcctccagcgagacaatgagtactttcaagcctatggtggcgccccggatgggcgtccagctgaagcccccagcccttaggccaaagcctgctgttcttccaaaaacaaaccctacgatgggacctgccgcaccttcccagggtcccacagacaagtcttgcacgatgtaaaaacaaaggtcacgaggggaggggggatgtctgaagatgaaaatgaattagtggcaagagtgggtgatccacaaccttccttggtcttgcgcttataactggagagttt

SEQ ID NO: 6444 - DNA, 323 bp, Mus musculus
gacttcagaatatttgggcctcagacttagagtctaaattttcaaaactctcctcactggatgaccctgtttgtctggctttaatataatgcatccccaagtccccaaaagctttttaacagtgacacagacatccctctaaagtgcccttgaccctgctcttagaattggtgcattacagagctcatgcacactaattgggaaaaacatcacccctttccctccactgtaatttctcatgtaggttttgttcatagaaatgccccatagttcccaatatgtaccttttcttttatgaaatgttggactgttcaattcttagt

SEQ ID NO: 6445 - DNA, 560 bp, Mus musculus
aacaacctgtgtactcgctttgatgacaaactgatcccagatctttacagctacttcacagagccgtggtgcatggccctcttccacgatcgttttattgatctcaagaaagagttgcgccaaatcttaatctccaagcaggaggaagacaagcctaccatggaggagatagcctaccggttagaggaggaagaaataaacctgaatgagaagccccagaaatacctccaaagggtttttgaggattccctctacaaaagcctgctggagaagagcatcctagattaccttcattacaaccagtaccacctgcccatgtacgcatggccaggcatcatttagctgtagccagcgccccaccccccgctggcatcacttccactctctgtcagccaagtgctgacagaacaccccaacccccatcccccactattatacccttttttcctcccgtgttttccgtgtattccagtaggtggcgctaggctgtgtggccctgctaagccagggaactttacaaacaggcatgttcagagcagaataagccactctagcgataa

SEQ ID NO: 6446 - DNA, 565 bp, Mus musculus
  misc_feature (28)..(28): n is a, c, g, or t
  misc_feature (55)..(55): n is a, c, g, or t
  misc_feature (61)..(61): n is a, c, g, or t
  misc_feature (75)..(75): n is a, c, g, or t
  misc_feature (101)..(101): n is a, c, g, or t
  misc_feature (128)..(130): n is a, c, g, or t
  misc_feature (143)..(143): n is a, c, g, or t
  misc_feature (150)..(150): n is a, c, g, or t
  misc_feature (171)..(171): n is a, c, g, or t
  misc_feature (269)..(269): n is a, c, g, or t
  misc_feature (354)..(354): n is a, c, g, or t
  misc_feature (437)..(532): n is a, c, g, or t
gagataaatgtcacccgtaagatagccntgacatccattgtcagaaagtcccccntttaanagaaaaagaactgnctggaaatcattcatttttgtccccnactactctttttttttttttttttttnnncagtttcaagctnttgtgcntggtgtttttgtaagaatgcnctaactcaatacaactgggagaacctacatgctctttaatatttcagagtttgtacacaagggaaacttttacaaattgagaaagtttatcaaagacntttcattgaacaatttgaataaatcaaatgtgaataagttaacaggtgaaactttgaacaaaacttccatgtcagaagtttgtantgaagaaaaaccatcagtctttgtaattttaatattaactttcaaatggagccacacatgtgccaataaatatgtgagtgatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatattttttaaacaacttgtactgcaccaaat

SEQ ID NO: 6447 - DNA, 393 bp, Mus musculus
  misc_feature (103)..(104): n is a, c, g, or t
  misc_feature (106)..(107): n is a, c, g, or t
  misc_feature (109)..(109): n is a, c, g, or t
  misc_feature (111)..(115): n is a, c, g, or t
  misc_feature (118)..(120): n is a, c, g, or t
gagccttattctgaccatggagttcaagcagcatatcaccaggtttatgcttcaagtgccattgctatgcctgcacctatgatgcagcctgagccaattaaannanngngnnnnnttnnntattaagacaattgggcagctctagtccagctcaactgatttcttgtccattgatccttgtgtgaccaagatccagcttcaaggaaccggctagaagctgcccgttgtgaaacttagggaaccaaggttacattctgtgagaagaagcttttctcagccttcatctgtgggtttgaaacctcgctattctcgaagcccacactttcatcctagaaaagatttcagagcagaggattcagtttccactccaccttcctgtactgactttgttaa

SEQ ID NO: 6448 - DNA, 473 bp, Mus musculus
  misc_feature (212)..(212): n is a, c, g, or t
  misc_feature (216)..(216): n is a, c, g, or t
  misc_feature (276)..(276): n is a, c, g, or t
  misc_feature (396)..(396): n is a, c, g, or t
  misc_feature (406)..(406): n is a, c, g, or t
  misc_feature (419)..(419): n is a, c, g, or t
attgtgggacatcctctaatgccagcacttggaaggcaaaggcaatgccagcttggtctacataaaaagttccaatccagccagagctacataataacagactttttaaaaaatggttttgttagactttgtgtactatgaacatgaaaatgcccagggtttcatataaaaaatattattcaacctgctattttagccatggagttaatctnttanacttgaggctttaatttgctgataatttctctaaatacctccctttgctaatttcctggnttctatgagaacataacactaaaggctctaatagaggacgagtcctatggatactttgcactgaagtgaagtgcaagccgttcaggagagacttgagatgtctaagtcactacccaaaanaaacaaactnaggtagctagttnctgggatgttaaaaagtgaaactgcagcatagttttcaagtggagtactcttct

SEQ ID NO: 6449 - DNA, 488 bp, Mus musculus
  misc_feature (68)..(68): n is a, c, g, or t
  misc_feature (70)..(72): n is a, c, g, or t
  misc_feature (74)..(84): n is a, c, g, or t
gacagtgatctgaactgaatcctatatgacttcatcaacattagtagaaacagtatcttcaataccanannnannnnnnnnnnntgtccctttttggaggaaaattttaaaataacaactccaaacaatacataagtgttgtcctagtaagggtttgcttaatcagtaagtttctgtgaatgagtatgaatgatatagattttaaaacagtaataataacctgttcaccctctttgcctaataagcttggaaaaatatatcacattaataatcaataaaaattcttgaaaggctttttgtgccttgtcttagtataggaactttataaatgttttcttaactgattgtcagtcacatatactatgaaacgaaacattgtgcaactgctttgtaaattaatatgaaagaaaatatacctaatgaaataggagtgactattactgccatatttatttagtggaaagatgtctttgtgttgattcactcat

SEQ ID NO: 6450 - DNA, 326 bp, Mus musculus
agaggaatctaaggtcccaattaagaaaccagtagttaattgttccaagtacaggaatcccctcaacgcctcagaaacccacaacagaaagtgttccaaatccaggagaccaaccaactcctcagaaaccttccacagttaaagtttcagcaacccagcatgaacctgataccacgacaagaacatctacagacaaaggagagtctaactcaggtggtgaccgttatatatatggacatacatgtttaataaccttgacagttttgcatgcgatgctatcacttattggctacttgacatagccaaccaagagttaagaagtatat

SEQ ID NO: 6451 - DNA, 551 bp, Mus musculus
  misc_feature (284)..(284): n is a, c, g, or t
  misc_feature (340)..(340): n is a, c, g, or t
  misc_feature (395)..(395): n is a, c, g, or t
  misc_feature (404)..(404): n is a, c, g, or t
  misc_feature (412)..(412): n is a, c, g, or t
  misc_feature (464)..(464): n is a, c, g, or t
  misc_feature (493)..(493): n is a, c, g, or t
  misc_feature (524)..(524): n is a, c, g, or t
gtggtggacatatgtattcgggaaattgaagcaagaggattaaagtcagaagggctttacagagtctctggattcacagaacacattgaagatgtcaagatggcgtttgacagagatggtgaaaaggcggatatctctgccaacatctacccagacataaacatcatcactggagccctgaaactgtacttccgagacttacccatccctatcatcacatatgacacctactccaaatttatagaggcagcaaaaatctccaatgcggatgagaggctggaagnctgtccatgaggtcctgatgctgctgcctcctgcccactatgagaccctgcgctanctgatgatccacctgaaaaaggttaccatgaatgaaaaggacaatttaatgaatnccgaaaatntggggatngtgtttgggcccaccctgatgagaccccctgaggacagcaccctcaccaccntccatgacatgcggtaccaaaagctgatngtgcagattttaatagaaaacgaagatgttntgttttaatccaccagggaagtgagct

SEQ ID NO: 6452 - DNA, 225 bp, Mus musculus
  misc_feature (77)..(77): n is a, c, g, or t
gaaatcgtggacactttaggtgaaggagcctttggcaaagttgtagagtgcattgatcacggcatggatggcttacntgtagcagtgaaaattgtaaaaaatgtaggccgttaccgggaggcagctcgttctgaaatccaagtattggagcacttgaacagcactgaccccaacagtgtcttccgatgcgtccagatgctagagtggtttgatcatcatggtcat

SEQ ID NO: 6453 - DNA, 482 bp, Mus musculus
  misc_feature (399)..(399): n is a, c, g, or t
  misc_feature (453)..(453): n is a, c, g, or t
aaagattcggaagcctcggaccatttattccagcctgcagctccaggctttaaaccatcgctttcagcagactcaatacctggcccttcccgagagagccgaactggctgcttccttaggactgacacaaacacaggtgaagatatggtttcagaataagcgctctaagtttaagaaattgctgaagcagggtagtaacccacacgagagtgaccccctcccgggttcagcagccctgtcaccacgatcaccagccctgcctccagtgtgggacgtttctgcctctgccaagggcgtcagtatgcctcccaacagctacatgccggggtattcacactggtattcctcaccacaccaggacaccatgcagagaccacagatgatgtgacttctctgagngaacgcctacggagcttctgaaggagacattctccaccggcagaagaatctgcncaaacatggcagcatttttacttgtttaa

SEQ ID NO: 6454 - DNA, 452 bp, Mus musculus
  misc_feature (31)..(31): n is a, c, g, or t
  misc_feature (34)..(34): n is a, c, g, or t
  misc_feature (37)..(37): n is a, c, g, or t
  misc_feature (50)..(53): n is a, c, g, or t
  misc_feature (125)..(135): n is a, c, g, or t
  misc_feature (137)..(138): n is a, c, g, or t
  misc_feature (141)..(142): n is a, c, g, or t
  misc_feature (144)..(145): n is a, c, g, or t
  misc_feature (308)..(308): n is a, c, g, or t
  misc_feature (311)..(311): n is a, c, g, or t
gatgagattctggagcatgtaacagataggncgngtntgagagccttggnnnnaagattaagagtcagttaggaaagggaggtaaagaatctgacccaggtgtagtaacacaggatgtcaacacnnnnnnnnnnntnnttnnanntgaaaacgaatatatgactcctgtgagggatggaaaaggaactcaaacatcaaaatctacacaaggaaaatctaaaagaggatgtagaaaagcgccagtttcatctaagaccaacaggagacgccagattgctgggccagactctgaaagtgatcatgaaccnccnatcagaaatgaagatgagattacccagacgagccaaaacagctgcgctacagaaaagtaaacttaaccttgcagagttccttaatgaagatacaagttaagagagctgataaggatgaagtcctttgaagttgtgcttata

SEQ ID NO: 6455 - DNA, 560 bp, Mus musculus
cgaccctgttgatcctgataaattgtggagcgatggcagcgaggaggaaaatatcagtgacactctgagcggatggtataaaaatgggaagcaccccgagcacgctttctatgagttcacctttcggaggttttttgatgacaatggctacccatataattatccaaagcctattgagtatgaatacattcattcacagggctcagaacaacagtctgatgaagatgatcaacacacaagctccgatggaaacaaccgagatctagtgtatgtttaataaactaggagatcattgtaagaatttgcaagaggcctgaagtgcaggggtttttgaagttttgagaaaattatgcaaatgtgacagagtttgtgtgctctgtgtacaatattttattttcctaagttatgggaaattgttttaaaatgttaatttattccacccttttaattcagtaatttagaaaaaattgttataaggaaagtaaattatgaactgagtattatagtcaattcttggtacttaaagtacttaaaaagagaagcctggtatcttttgtata

SEQ ID NO: 6456 - DNA, 439 bp, Mus musculus
gggtctacaggctacctagagaccagcagaggccgcgagagcacagcaggcggcgttcacagccagagcatgggatctgagttgagtagaggcctcagttccagcagtggccatgcatccagtcctgcccctccctccaggcccagctcctctactagcaaggactccaggggctacaactagggctgcgggtcccttcctgcctcaactcttggcaggttttctaatgtctgccctgcttctccctagagactcctttctaatccctgtaagcccaggcctcttcggtttccctctgtctcttcccatctttccccatggttactgcctctgccttggccttgcctctctgttctcatcctccttgtttcccatctttacctcctcatctctctcccaagcttccctccatcctatgtctctgtctcctaactggatt

SEQ ID NO: 6457 - DNA, 475 bp, Mus musculus
tgcaatgaaatgaatcctccccttccatcacactgcaaaagatgctggacccttcgtgagaactggcttccagacgataaggggaaagataaagtggaaatctctgaaaaagccaaactggaaaactcagctcaggcagaagaaggcttggatgtgcctgatggcaaaaagctgacagagaatgatgctaaagagccatgtgctgaggaggacagcgaggagaaggccgaacagacgcccctgtcccaggagagtgacgactattcccaaccatcgacttccagcagcattgtttatagcagccaagaaagcgtgaaagagttgaaggaggaaacgcagcacaaagacgagagtgtggaatctagcttctccctgaatgccatcgaaccatgtgtgatctgccaggggcggcctaaaaatggctgcattgttcacggcaagactggacacctcatgtcatgtttcacgtgtgcaa

SEQ ID NO: 6458 - DNA, 324 bp, Mus musculus
gaatggagtgtgcaacaatttcaagcactgtcactgcgatgctggcttcgcccctcctgactgtagcagtccaggaaatggggggagtgtggacagtggtcctgttggtaagcccgctgatcgacacttgagtctctcttttctggctgaagagagtccagatgataaaatggaggatgaagaggtaaacctgaaagtgatggtgcttgtggtccctatatttcttgtcgttttactgtgctgtctaatgctgatcgcctacctctggtctgaagtacaagaagtagtatctccaccgagttcatcagagtcttcgtcttcatc

SEQ ID NO: 6459 - DNA, 332 bp, Mus musculus
agatctcagaatcatgttttccataaagaagacacattttctagtgatgcagagattaacaaatcacctgtcagctttactgaagagcttcacagtgagagaaaggaccacacacccaaggataccacaacagtcttctgtccaaacagcaactctgaagccctggaggcagagctaggaaattccccaggacgtcagtgggacctcacaggagcatgcggttcaagaaacagaccacttttcaagttgagaaacaaaagggtagaaaacccagggtcagaaaacactcctgaggatggcttacttggtgacacctctattcttaacgacct

SEQ ID NO: 6460 - DNA, 528 bp, Mus musculus
  misc_feature (360)..(360): n is a, c, g, or t
  misc_feature (493)..(493): n is a, c, g, or t
aggtcagctcactaggatcaacatgaactgagattgactcattaattgtttggccacctagaatcagcaggatgtttctttccccatgatgaccctggagggattctgtcctccacaaaaggagtactagccctgcgtcctctcttctgaccttgactacatctcatagtaagttcagagtagttggtgataaattaaaaatggtcattacagaagatgattgtcgttgtaactgtccactcatgtaggaagtgtaaccgctttcccagcttttggttttcattgggcatgtgtaatttccagaaacaacagattcacacttaagacacttgcgtttgatgcagtttttaatgagtggtntcctttcctttgtatttatatgttttagagactgcctgaaaggtgagcactgtacttgataaaggaaactgcatatgcagattcagtattgtacttctgtggacaattaggtggacactgagaatgggacttntcaacctgacagggtcagctacagtgccgtgttaa

SEQ ID NO: 6461 - DNA, 187 bp, Mus musculus
tctgcagaaagctgtcattacacctgattttgaaaaaaagcattgtgtcccaccatacagtgagtccaagcatcgacttcagaagcagcgcaggaaagagcgacaaaaaacagccggtaatggttggtttggcatgaaagccccagaactgacagatgaactgaaaaatgacctcagagcattgaag

SEQ ID NO: 6462 - DNA, 460 bp, Mus musculus
ttcaagcttggttcactgaggtggttaagtataaatgctattgaatagtagaattagctgtatagttatgcctgtgtgaaggaggggctcacagctgtccccagcagctcccctaagggggcagagctccttctagacatgtcgtataagtgtgattcttcttttataaacagtgtgatgtagctgtccctggtccccttccctttgtgactgggattgaatgttttatggcagggttaggctgggttgtgtggagctggagaagagcttgacctcagtcccaaatgcctgtgaggatggggatgggtgggggtctgaacacgaagcctctacctgtgcctcaggtaaggaaggggcctccctgcaatcatctgagctaattacctcagctccacagcaggcctgtatccagggcccctgcggaggcatcctggagtagcctcggtgtgtgagcacattt

SEQ ID NO: 6463 - DNA, 471 bp, Mus musculus
  misc_feature (299)..(300): n is a, c, g, or t
  misc_feature (336)..(336): n is a, c, g, or t
  misc_feature (345)..(345): n is a, c, g, or t
  misc_feature (347)..(347): n is a, c, g, or t
  misc_feature (351)..(351): n is a, c, g, or t
  misc_feature (353)..(353): n is a, c, g, or t
  misc_feature (363)..(363): n is a, c, g, or t
  misc_feature (376)..(376): n is a, c, g, or t
  misc_feature (404)..(404): n is a, c, g, or t
agacctgcccttcagaggacgtaggcttagagttctgggcagcttggggcctagcctgggtgaggggtctgtcctgggtgagaggttggctgcagtgactgccttgagagccctggaggcgtcctcaggccccagccatcgagcccagggatgtccagacccaaagccagcactaggtccagcagcttgccctccagggctccactgccttcatcacctgaaccctatccctccagcccattctctcccttagtgtaaccttcccttgctgatatctcttggcctaggtggggccacanntgaagtaggtggagctggggctggaccctttagatntcccaggantntggntnatctatatgncccaaattctgancctgcttatcctagggttcaaaattgcncaagcatcctgggaagatttgcaggtttccttatgtgggggcagttcctttctgttgggacaccata

SEQ ID NO: 6464 - DNA, 427 bp, Mus musculus
  misc_feature (60)..(60): n is a, c, g, or t
  misc_feature (352)..(353): n is a, c, g, or t
  misc_feature (377)..(377): n is a, c, g, or t
gactgttagggtgaatgtctgctagatagacttaagttacttgaaatgataatttaactngtggcacactctatgtgtgtatgcaggtatgtaactgtgggaacatatccaggctaaaaactctaagcttgagacttaagcttcggggcttagactgcatatggtacagtgtaaacagtgacaagatcatctccacgaggaagtgaattaagatacagttttaagatagagattgtttactgaagcgtgtctgacaatctgacttaatagagagcgagcgacatacaataatgaacctagtatttctttattcatggaatgtggaaattttatgacaggtagttttaagttnntcttttttgtgatttttttttttnagaagtacaaatacttcttggggttaggtagggtttacagcatgcttgat

SEQ ID NO: 6465 - DNA, 499 bp, Mus musculus
  misc_feature (291)..(291): n is a, c, g, or t
  misc_feature (294)..(294): n is a, c, g, or t
  misc_feature (336)..(336): n is a, c, g, or t
  misc_feature (340)..(340): n is a, c, g, or t
  misc_feature (364)..(364): n is a, c, g, or t
  misc_feature (368)..(368): n is a, c, g, or t
  misc_feature (382)..(382): n is a, c, g, or t
  misc_feature (400)..(400): n is a, c, g, or t
  misc_feature (404)..(404): n is a, c, g, or t
  misc_feature (411)..(411): n is a, c, g, or t
  misc_feature (420)..(420): n is a, c, g, or t
  misc_feature (465)..(465): n is a, c, g, or t
catccagtttctccacgaagacgagaagggcattcaccactctgtcttcagcacattcaagtccatacaaggtgtgtcgaagtcgaagggaacgggggaccagaactgccggatgctgcccgaccttcccaatgccctccatatcttggacgggccagaccaacgctattttctgggcttagtggatatgactaccgtgtatgggtttcgcaaacggctggaacatgtgtggaagatggtacgctatccaggccagagcgtctccactgtcagcccggctcactacgcccntcncctctgtcggtgggcagaggtgcacacagaatgactcacgtntctnccttcttcccttatggacaatgcnccgncaactattctgcanctgtacccagggagctancctncagttcntcctaccanccaccagagggaagcaccctcataactaatgctgtgaagactcanccccattcggtgacggtgctgtaccctgcataga

SEQ ID NO: 6466 - DNA, 482 bp, Mus musculus
  misc_feature (84)..(84): n is a, c, g, or t
  misc_feature (407)..(407): n is a, c, g, or t
  misc_feature (409)..(409): n is a, c, g, or t
  misc_feature (412)..(412): n is a, c, g, or t
ggacctcggtcagattcctgatgtagacattgattcggatggcgtcttcaagtatgtgctgattcgagtccacttagcagagcnttctggggatccggcgaaggagtgcaaggaaatcgtgcgtggctacaaatgggctgagtaccacgcggacatctatgacaaagtgtcaggcgagctgcaaaggaatggctatgactgtgagtgcctaggcggcgggcgcatctcccatcagagccaggacaggaagatacacgtgtatggctactctatgggttacggtcgtgcccagcactctgtttcaactgagaagatcaaagccaagtatcctgactatgaggtcacctgggctgacgatggctactgaagctctgccccaccccccaccccccggactaagtcaggtntntgntcttgctgtgttctgttttgaggggctggccctgtgctttccttttgtaccttaggcagcatagcacctg

SEQ ID NO: 6467 - DNA, 554 bp, Mus musculus
  misc_feature (40)..(40): n is a, c, g, or t
  misc_feature (213)..(213): n is a, c, g, or t
  misc_feature (315)..(315): n is a, c, g, or t
  misc_feature (336)..(343): n is a, c, g, or t
  misc_feature (409)..(409): n is a, c, g, or t
  misc_feature (465)..(465): n is a, c, g, or t
acatgtggaagtatgtcccgatgctggggttatcatccangaactgtcccagcgcattgcgtcaactggaggtgcagccctgattgcggattacggtcacgatggcacaaagacagacaccttgagagggttttatggacaccagcttcacgatgtcttaatcgctcctggaacagcagacctgacagctgatgtggacttcagttacctgcncagaatggcacaaggaaaagtagcctctctgggtccagtggaacagcgaacatttttaaaaaacatgggcattgatgtccggctgaaggttctcttggatanagcaggtgagccatctgcgannnnnnnnagctacttggagggtatgatatgttaatgaatcctcagaagatgggagaaagatttcacttctttnccttgctacctcatcagagacttcatggggggagtcaagaaaggaatgcctgccantcaaaaaccccctcctcctctgtagctgggtttgatgaacttgtttggcagtgatacttcagcttgaacttttattcctcagtgggcct

SEQ ID NO: 6468 - DNA, 317 bp, Mus musculus
  misc_feature (135)..(136): n is a, c, g, or t
  misc_feature (194)..(194): n is a, c, g, or t
  misc_feature (243)..(243): n is a, c, g, or t
  misc_feature (245)..(245): n is a, c, g, or t
  misc_feature (285)..(285): n is a, c, g, or t
  misc_feature (290)..(290): n is a, c, g, or t
tcctgactaacatcaccttcttgaaggttctcctctggttggtcctgctgggactgtttgtggaactggaatttggtctggcttattttgtcctgtccatgttctattggatgtatgtagggactcggggtcccnngaggagaagaaagaaggggagaagagcgcctactctgtgttcaacccgggctgtgaangccatccagggcacgctgactgctgagcagctggagcaagagttacagntncagaccccctcagggaagtaggaccagccccagctgttcntcctntccttgaacgtggactttagaggacaa

SEQ ID NO: 6469 - DNA, 418 bp, Mus musculus
  misc_feature (370)..(370): n is a, c, g, or t
aaaagatttcctctcgtggtggattttcaggcaaccgaggaggacggggtgcttttcatagtcagaacaggtttttcacaccgcctgcttcgaaaggaaactacagtcgtcgggaaggaacaagaggctcgagttggagtgctcagaacactcctcgaggaaattataatgaaagccgagggggccagagcaactttaacaggggtcctcttccaccattacggccgcttagttctacgggttaccgccctagtccccgggatcgagcttctagaggccgcgggggcctgggaccgtcctgggctagtacaaatagcggcagtggaggctcgagaggaaagtttgttagtggaggcagtggtagaggccntcatgtacggtcctttactcgatagatgtgttcttggcaacaccccaa

SEQ ID NO: 6470 - DNA, 418 bp, Mus musculus
gtttaagtccatgtcgggaaccatccagttgggccggaagctcatcacaaagtacaaccgccgagaactgacggacaagctgctcatcttcctggccctggccctcttcctcgctacagtcctttatattgtgaaaaagcgcctctttccatttttgtaagcgagagctgccagctttggcctgtgcacgcctgctccaggatccgggccgggatctcaaggactagccgggctgccaaactggacttcccctctccctcgggggctcggtgaacctaacagagggaaacacagcagcccagcctcctgccagagggcttggcaagggtgtgtggaatagaggagccgggaaccttcaggatggaggcactccagctcccccggcttccaaggactgcggctgccatagagagcacat

SEQ ID NO: 6471 - DNA, 383 bp, Mus musculus
  misc_feature (66)..(66): n is a, c, g, or t
tacatttcccaggagtctcagcagcgacaccaaccggaagcggcgggcgaattacttgtccttgcncggcgagtgaagcgagagactaaccatggtggctcgagtgtggtcgctaatgaggttcctcattaagggaagtgtggctggaggagcagtctaccttgtttatgaccaggagctgctggggcctagtgacaagagtgaggctgccctgcggaaggccgaggaggttgtgccaccagcaatgtaccagttcagccaatatgtgtgccagcagacaggtctggagatgccacagctcccaacccctccaaagattaaatttccaaacttccgtgattcctggaactcaggcatcatctcagtcatgtcagccttgtcgg

SEQ ID NO: 6472 - DNA, 503 bp, Mus musculus
  misc_feature (111)..(111): n is a, c, g, or t
tgcactcgcggtttccacaggattggagacagcaacgctgcagaagctggcgcttcggcggaagaaagtgctgggggccgaggagatggagctgtacgagctagctcaggntgctggcgccgccatcgaccccgatgtgttcaagatcctggtggacttgctgaatctgaatgtggctcccctcgccgtcttccagatgctgaagtccatgtgtgctgggcagcggctggcaagcgatccccaggactcggtgcccatatctctgtctacatccacatcagagacccgaggaagaaaccgaggtggccccattcttggcaatgtgaccatatcggcagaacgtggaagccgtgaaagacccatccagagaatgccacgccagcccagtgcgactcggctgcccaaggtgggaggatctggaaaaagcaactcccgaagcagcccataggctgggacagaggctgcacttgacaccgtcttcaagacagatgctatccaccttc

SEQ ID NO: 6473 - DNA, 406 bp, Mus musculus
  misc_feature (61)..(61): n is a, c, g, or t
  misc_feature (73)..(73): n is a, c, g, or t
  misc_feature (76)..(76): n is a, c, g, or t
  misc_feature (78)..(79): n is a, c, g, or t
  misc_feature (98)..(98): n is a, c, g, or t
  misc_feature (103)..(103): n is a, c, g, or t
gatgaaggcttggacatcacacaagatgtgaagccccccaaaagcctatatattgaagtgnggtgtttaaaangantnnatggagaatttgaagttgnatganggcacttcagtcctgcttaaaaagaatagtcagcactttttgcctcggtggaagtgtgagcagttaatcagacaaggagttctagagcacgtgctgtcctgactgtgtcctgtggtgacagcagctggatgtgaagctaagccaactcacagaaggaaacgtcctcactggacctccccctccttggttttaaattgacagacatgcattaacataaccaagatgggctggggtccagctcattggtagagcacctgcttaggatttgagaaacccagagtttcatccctagtacctcaagaa

SEQ ID NO: 6474 - DNA, 544 bp, Mus musculus
  misc_feature (336)..(336): n is a, c, g, or t
  misc_feature (342)..(343): n is a, c, g, or t
  misc_feature (348)..(348): n is a, c, g, or t
  misc_feature (519)..(519): n is a, c, g, or t
gatcatatcacagggcactttagaaggggctggcatacctgctgcctccagggattgccgcccctcagtcttcttgggcgtccaagaaggagctttctacctcacatctgtcactgctgccctttcccaggccgtctcccctcctgccgctgtcctcgcagtggtcacgcttaacctctctcacattctagatgggaaaactcatgattcagacccaaggaaagatctgtggtgctaacccaacagttggcatgcacagcaggcatgtccacttcaactccgtgtctctctcaaaacagaaaggtttgagattcagaagaaaggaataggaagaanccactnntcccncaactctcatctcttcctgagaagagtgcaccagcagccagagcacagggtcaggggccgaagggttacctcttagcttcttttaagtgctgagttgatgtttggcctctgtgggttgctacctttccctctgtgttataacttccttccttcccttcaatgctttgtgantcttaccagtgcatccctatgaaac

SEQ ID NO: 6475 - DNA, 505 bp, Mus musculus
  misc_feature (183)..(184): n is a, c, g, or t
  misc_feature (351)..(351): n is a, c, g, or t
gatggagaagctcacttccagctgtccagatctccctagccaaagtgacaaaaaacgcagttaaagcccaagcttccagctgctgctgtgcaccgagctaaggagcagttgctgttgctggaagtgttaggaagtggctctccctgtccatgcagtgttgaaccaccatgagtggatgtgttnnttagctgggtgttaatggagattttagaggtggaggagcctggccagagggtgtctgtcaggtcaagtttaaagactgccaaagagcaaaggttaggcctggaaatgtgaaaactggatccataactaaggatctaagaagtgtagacatgtagtggacacctgagntcagtgtatttgtcaattatttcttcctatagggaggaacagaattcgagttcaggagtctctgtcaggtagggatgttgccgctcaacagggggcacgggtgaactacttgtggacttgagggctgttgtacttagacccatctgtattttct

SEQ ID NO: 6476 - DNA, 479 bp, Mus musculus
  misc_feature (74)..(74): n is a, c, g, or t
  misc_feature (112)..(112): n is a, c, g, or t
  misc_feature (159)..(159): n is a, c, g, or t
  misc_feature (162)..(162): n is a, c, g, or t
  misc_feature (190)..(190): n is a, c, g, or t
  misc_feature (193)..(193): n is a, c, g, or t
  misc_feature (411)..(411): n is a, c, g, or t
agaccgccagacagctcactgcgttcccactcccgctcgagctccgcacccggaccggtggatcaggcccgggnaacccgcgccacaccggggaggaccggccacagcgagntagtgaacatggccacaccgttcctaccctcgggggccaccacaggngancagcggtggggaactgagctccggggangantctggtgatatggaatccttccagacccccgaggccgaggggacccggagtttggccgagctgtttgagaaggctgccgcacacgtccaaggcctggttcaggtagccagccgggagcagctcctgtacctgtatgccaggttcaagcaggtcaaagttggaaattgcaatactcctaaaccaaatttctttgattttgaaggaaagcaaaaatgggnaggcatggaaagccctcggtgactcaagccctagccaagcaatgcaggaatatatcgcggcagttaaa

SEQ ID NO: 6477 - DNA, 460 bp, Mus musculus
  misc_feature (149)..(149): n is a, c, g, or t
  misc_feature (195)..(195): n is a, c, g, or t
  misc_feature (220)..(220): n is a, c, g, or t
  misc_feature (287)..(287): n is a, c, g, or t
  misc_feature (320)..(320): n is a, c, g, or t
  misc_feature (336)..(336): n is a, c, g, or t
  misc_feature (339)..(339): n is a, c, g, or t
  misc_feature (348)..(348): n is a, c, g, or t
  misc_feature (354)..(354): n is a, c, g, or t
  misc_feature (381)..(381): n is a, c, g, or t
  misc_feature (388)..(388): n is a, c, g, or t
attcacagaaatccttagtccccagccgtgggcaaaagatgacatcaggcacaaaggcaaaggtgccgctgacggcattgtcccagaaatggaaacgggaccgagagcagactctggaggcagcttatgtaccagtggtggtggatccntcgggggcagaacccagacactagcatcaggttcagtttctacaanctcacagtattccaattctctaaantcccttctacaccctgcagaagcccacctgtggctacctgtaccaaagagaaaccgaccacacccgnaaacgctttgatgttcctccagcaaacctgatnttgtggcgcacctagnttntgcggcatntggaantccccatcctgcaccttcatcctatgntcctggntcccagagggaaagatcattcctgcctggagaagcagtgtatacctgggctagccaggtatgccgtgacagc

SEQ ID NO: 6478 - DNA, 476 bp, Mus musculus
gcctgggatccgagctcatcaaagaaagtaatgccaatcccatcttcatgcgcaaggacaccaaaacaagtttccagtggcggattcgaaatctcccctacccgaaggatgtgtatagtgtgtctgtggcccagaaggagcgctgcgtcattgttagaacgacaaacaaaaagtactacaagaagttctccatccctgacctagacagacaccagcttcctctagaggattctgcgttgagctttgcgcacgccaactgcaccctgataatctcttatcagaagccaaaggaggtcatggcggctgagtcagagttacagaaggagttaaagaaggtaaagacggcccacggcagtgctggggactgtaagacgcagtagctgtcctgagccttgcacctccagtgaggaggaaactgtgagacttccggcgtgggttttatggcgcgggcagcctcttctcttctaagaactaca

SEQ ID NO: 6479 - DNA, 479 bp, Mus musculus
  misc_feature (147)..(147): n is a, c, g, or t
  misc_feature (156)..(156): n is a, c, g, or t
  misc_feature (214)..(214): n is a, c, g, or t
  misc_feature (217)..(217): n is a, c, g, or t
  misc_feature (232)..(232): n is a, c, g, or t
  misc_feature (320)..(320): n is a, c, g, or t
  misc_feature (322)..(322): n is a, c, g, or t
  misc_feature (357)..(357): n is a, c, g, or t
  misc_feature (369)..(369): n is a, c, g, or t
  misc_feature (381)..(381): n is a, c, g, or t
  misc_feature (390)..(391): n is a, c, g, or t
  misc_feature (422)..(423): n is a, c, g, or t
aagtcttccaacctggagcgacatttatacttgatggctaacaaagacggacagttaatggcaaatttataccatcagttagagagtcagcttcacttccggattgagaagatgctggtcgagaagctgcagcaagagtttgttgcngactggtgntctgagggagaatgcctcgcagctatcagcactacctacaatgcatcaggctatattntgnatccacataccgctngttgcaaaagtggttgcagacaagatgcaagacaaaagctgcccagtgctcattgcatccacagctcactactccaagtttgcccctncnatcatgcaggcactggggattaaagaactcaaccngacgtcgtccanccagctttactnactgagctnntacaatgcattgccccctcctcacgaggctnntgctagagagaatgaagcagaaggagaagatggattaccaggtttgtgtagctgat

SEQ ID NO: 6480 - DNA, 485 bp, Mus musculus
  misc_feature (178)..(178): n is a, c, g, or t
  misc_feature (304)..(304): n is a, c, g, or t
  misc_feature (413)..(413): n is a, c, g, or t
tgagcgtgcccaacattatcatcacgcccccaaccccgacgggcatggggctttcccgggattctaacaagcaagtctggatggatgagctggggtcttatcaagacgatggagagctggaacctgaagcctgaagcggcgagacctgtgtggcagcaacctgccccgctgccccggngtgttgggggcgtggctacctgagcagctggatggggaacagcgaattgggtcctggaccaagacatggatggccagaagagtacagcaggtggctggcctcaacggagcagacatccgtggcctntgagtccgcaccaacccagaccccggcttggtgaagaggaggccaccctgccctacggtcaccgtgaccatggacctcggccctcgaggccccagagcacaaggacttntcgccagagcagggcctctgttttttacaagttgttttacaggtatgggacctacatcctgagcgagattta

SEQ ID NO: 6481 - DNA, 323 bp, Mus musculus
  misc_feature (278)..(278): n is a, c, g, or t
tgcagcagtggcgaaactggatgctgcagctgagcacgtacctcactcaccagaacggaagtatcatggaaggcttagcattatggaagaataatgtagacaaacggtttgaaggtgttgaagattgtatgatctgcttctcagttattcatggtttcaactattctcttcccaaaaaagcctgtagaacatgcaagaaaaagtttcactcagcttgcctgtacaaatggtttacatctagcaacaagtccacttgcccgctctgccgtgagaccttntttctgaggtttttttcattggaagttgtcgctgccgtaggtcaa

SEQ ID NO: 6482 - DNA, 265 bp, Mus musculus
gttgctcaatctcaaactggatcgggtcatgcaggacatagtgtataagctagtgccaggcttgcaagacagtgaagagaaacggattcgggaattctatcagtcccgaggcttagacagagtctcccagcccagtggtgaagagccagccctgagcaaccttggcctccccttcagcagttttgaccactctaaagcccactattatcgatatgatgaacagctgagcctatgcctggagcggctgagttctggcaaagacaag

SEQ ID NO: 6483 - DNA, 462 bp, Mus musculus
  misc_feature (345)..(345): n is a, c, g, or t
gagcatcactgcttgttgcatagccccatccctgtgacctgccctgtacgcttgctccacggcatgaaggatgaaatagttccttggcagagatccctgcaggtcgcggaccgaatagtcagcccagatgtagatgtcatcctccggaaacaaggtgatcacaggatgaaggagaaagcagatattcatctgcttatttgtactattgatgacttgattgacaagctttcaactgtagttccgtagaatcacatttgtagctggaatgccctccagtgcatccagaagattgaaagtgtggtagtaaatcaaagacccggatacttcagggttttccctcttgtnagtttgtaaatatcggatacgtatttatttaatgatgtctttgcacaaatacacaaattgtgaccaaagtattagctgctctttggaaatttttgtcctccttttatattttcccat

SEQ ID NO: 6484 - DNA, 431 bp, Mus musculus
gcaagagtggccaccatatgctgggcctgattgaggactatgatgccctctataagcagatcagctggggccagacactgcttgccaagatggatgttcaaacccaagaggctctgagccccacaagtcacaagctgggaccaaagggttcttcatccgtgcctctgagcaagtttctttccagtatgaacacagccaagctggtcctggaaaaagcatccaggttgctgaagctcttctggagggtctcagtccccaccaacggccagtgttcccttcactgtgagcagattggagaaatgaaggcagagaacacgaaactacacaaaaaattgtttgaacaagaaaagaagctgcagaacacagcaaaactattgcagcagagcaagcaccaggagaaagtcatctttgatcagttggtcatcacccac

SEQ ID NO: 6485 - DNA, 542 bp, Mus musculus
  misc_feature (252)..(252): n is a, c, g, or t
  misc_feature (255)..(255): n is a, c, g, or t
  misc_feature (258)..(258): n is a, c, g, or t
  misc_feature (275)..(275): n is a, c, g, or t
  misc_feature (320)..(320): n is a, c, g, or t
  misc_feature (322)..(322): n is a, c, g, or t
  misc_feature (351)..(351): n is a, c, g, or t
  misc_feature (400)..(400): n is a, c, g, or t
  misc_feature (403)..(403): n is a, c, g, or t
  misc_feature (423)..(423): n is a, c, g, or t
  misc_feature (434)..(434): n is a, c, g, or t
  misc_feature (508)..(508): n is a, c, g, or t
agaagcagcactccaatccatccgaggaggtcaagacacagtttaacgaaaacgccgatatgcaggatctgcccctgccaatacgtcaagattccgaagagaaagtgccatatctggagtcttctccaaaccagaaggttatcgctgaagacaacatagagaaagaagagaagatttcaatcactgagccttggtcttctcctgaagttgcatggccagaggaaaagcctgattttagcagcttctacatgntgnttnatgttgctgtacagaangcaaaagaaatggaggagcagaagaagcaaaaccccaacccacangntccccaacaacagttcatgtagccagttntttgaactctgggaggttcatttatacttaacctgattagcttgtaatnccntcttctgctccatattattntcctttagaantcttttccatcaatgttttctgaagaaagttactatccatgatattcaactttaacaaattgctaactttattntcctcccctggactttagccctatatatttatta

SEQ ID NO: 6486 - DNA, 297 bp, Mus musculus
  misc_feature (272)..(272): n is a, c, g, or t
gaaagtgcagatctgaatccttgctgctcagacacagaagatgcacaggaaagaatctccgtggataaggacactggtactttgggctctagccatattcatttttaaaaaaaaacaccaatatataacaaactacaatttatatcattgatctgtgattcttttccaatcacactgaacatttagctgtactttcatgtttggtttaatagtgtatgaatgaaaagcctaaaagggatgatagtgtttattttttaatttatttggtactntcaaacaccttttcagaatgagcaa

SEQ ID NO: 6487 - DNA, 535 bp, Mus musculus
  misc_feature (33)..(33): n is a, c, g, or t
  misc_feature (339)..(339): n is a, c, g, or t
  misc_feature (416)..(416): n is a, c, g, or t
  misc_feature (431)..(431): n is a, c, g, or t
gagaaaaacccctgcatccgggaggccaggagnagggcggtgattgaggtgcagatcctgatcacgtacctggacctgaaggaagccctcgagaagaggaagctgttcccatgtgaggagcaccccccacacaaggccgtgtgggagatccttgggaacctgtctgagatcctgggcgaagtcctttcatttggtggaaaccgaactgataagaactacatccgtctggaggagctactgaccaaacagttgctggctctggatgccgttgacccacagggagaagagaagtgtaaggctgccaggaaacaggctgtgaaactggcccagaacatcctncagctacctggacatgaagtcggacgagtgggagtattgatgggccaggagctgatctcgctggttcgcacctcatntcctttagagagctntcagctcatggagcctaaatgtaatttctatgtgcatagtcaatctcagtatttatgatttaatcaaattatattcagtatttctgctgcttttgatgttgcaa

SEQ ID NO: 6488 - DNA, 435 bp, Mus musculus
  misc_feature (242)..(242): n is a, c, g, or t
  misc_feature (244)..(246): n is a, c, g, or t
  misc_feature (249)..(249): n is a, c, g, or t
  misc_feature (255)..(256): n is a, c, g, or t
  misc_feature (260)..(260): n is a, c, g, or t
  misc_feature (280)..(280): n is a, c, g, or t
  misc_feature (283)..(283): n is a, c, g, or t
  misc_feature (286)..(286): n is a, c, g, or t
  misc_feature (289)..(289): n is a, c, g, or t
  misc_feature (329)..(329): n is a, c, g, or t
  misc_feature (349)..(349): n is a, c, g, or t
  misc_feature (371)..(371): n is a, c, g, or t
  misc_feature (403)..(403): n is a, c, g, or t
  misc_feature (405)..(405): n is a, c, g, or t
ggctccctggtcagataggccgagaaggacgccagggtttgccaggaatgagaggactgcctggtaccaaaggtgaaaagggagacattggtgttggcattgcaggagaaaatggtctccctggccctccaggtcctcaagggcctccaggttatggcaagatgggtgcaactggaccaatgggccagcaaggtattcctgggatccctgggcccccgggtcccatgggccagccagggaangnnnagnccactnncaancccctcagactgctttgggnccnatnccnaatggagcagcagtacccacccatgaagagcatgaagggncctttcggttgaaactcccncccacactgagatgaaggactntactaggaataaatggccaaagcttacaggantntgatgggttgtgaatgtttgtgctattcct

SEQ ID NO: 6489 - DNA, 320 bp, Mus musculus
  misc_feature (154)..(154): n is a, c, g, or t
  misc_feature (164)..(164): n is a, c, g, or t
  misc_feature (166)..(166): n is a, c, g, or t
  misc_feature (218)..(218): n is a, c, g, or t
  misc_feature (290)..(290): n is a, c, g, or t
  misc_feature (295)..(295): n is a, c, g, or t
gggagatcctgagccgctgttccgatttgaggcctgaccacagaccaccacctttccaattggcctatgaggcagaactgggcagcaatcccagtgcctgtgagctctgggccctggcagtggaggagaggaagcgccccaacatcccatccanttggagctgntntgccacagaccctcgggggctgagggagctcctggaagattgctgggacgcngacccagaagcacggctgacagctgagtgtgtgcagcagcgcctggcagccctggcttaccctcacggggcntcctntttcccagagagtccacagggctgc

SEQ ID NO: 6490 - DNA, 539 bp, Mus musculus
  misc_feature (65)..(67): n is a, c, g, or t
  misc_feature (182)..(182): n is a, c, g, or t
  misc_feature (357)..(357): n is a, c, g, or t
  misc_feature (415)..(415): n is a, c, g, or t
  misc_feature (510)..(510): n is a, c, g, or t
  misc_feature (514)..(514): n is a, c, g, or t
tcagtttcccacctatcgagtaaagttctgcacggcgggtctacgaggtctctcccacgctaagnnnggcctacgtcggggccagtgactgtttcctcctgccatcaaagtgctaagaaaaaacaatgcctttggccattctgcttagcctgctgaggcattgtggtgtgagagcagccttncctacaccccgccacctacacacatccccttggagagctgactgcagcagggcttcactcactcgactgcgccgccaagcctatgctcgcctctaccctgtgctcttggtcaagcaggacggctccactatccatatccgataccgggagccacgacgcatgctggcgatgcccntagacctggatgccctgtctccagaagagcgcagggcccggttccgaaaacgggaggntcagctccagcagaagagggaagaagagccagaggtagtggacagttttgacactgaacgatataaacagttttggaccaagaccaagaaataantctntcagggagttccaccagggacattt

SEQ ID NO: 6491 - DNA, 514 bp, Mus musculus
  misc_feature (275)..(277): n is a, c, g, or t
  misc_feature (279)..(283): n is a, c, g, or t
  misc_feature (285)..(285): n is a, c, g, or t
  misc_feature (287)..(287): n is a, c, g, or t
  misc_feature (290)..(290): n is a, c, g, or t
  misc_feature (292)..(292): n is a, c, g, or t
  misc_feature (297)..(297): n is a, c, g, or t
  misc_feature (301)..(302): n is a, c, g, or t
  misc_feature (304)..(305): n is a, c, g, or t
  misc_feature (310)..(310): n is a, c, g, or t
  misc_feature (316)..(316): n is a, c, g, or t
  misc_feature (330)..(330): n is a, c, g, or t
  misc_feature (334)..(335): n is a, c, g, or t
  misc_feature (337)..(337): n is a, c, g, or t
  misc_feature (352)..(352): n is a, c, g, or t
  misc_feature (360)..(360): n is a, c, g, or t
  misc_feature (362)..(363): n is a, c, g, or t
  misc_feature (367)..(367): n is a, c, g, or t
  misc_feature (376)..(376): n is a, c, g, or t
  misc_feature (379)..(379): n is a, c, g, or t
  misc_feature (388)..(388): n is a, c, g, or t
  misc_feature (403)..(403): n is a, c, g, or t
  misc_feature (406)..(406): n is a, c, g, or t
tgctcagagacttaccgagggcctgcacctgagtcagagccagaggtagctgcaattgtggacttcatcactggccatgggaacttcaaagctatgatctccatccacagctactctcagatggtcatgtatccttatggccattctctggagcctgtacctaaccacgaagagctgttcaatcttgccaaggatgcagtaaaggctctcaacaaggttcacgggatccagtacatttttggcagcatcagcaccaccctctattcagccagtgnnntnnnnntngnctngncttangacnncnncatcnagtatnccttcagcttcganctcnngnacactggacaatatngcttcctncnnccancctcacagnttntccccacanccgaggagacatggntgncattacagaccatcatgaaacacaccctgaatcacccctattagccacgctactcaggccggagcagttggggttcacccttttccctgaaaaccctcctgaattaag

SEQ ID NO: 6492 - DNA, 385 bp, Mus musculus
  misc_feature (343)..(343): n is a, c, g, or t
attactcttcctcatcatgttggtgttgaaactggatgagaaggcaccgtggaattggttcctcatatttattccagtctggatatttgacactatccttcttgtcatgctgattgtgaaaatggccggacggtgtaagtctggctttgaccctcgacatggatcgcacaatattaaaaaaaaagcctggtacctcattgcaatgttacttaagttagccttctgccttgcactgtgtgctaaactggaacagtttactaccatgaatctttcctatgtcttcattcctttatgggccttactggctggcgctctaacagaacttggatataatgtctttttngtgagagactgacctccgagtacatcgtctcatttctgttgc

SEQ ID NO: 6493 - DNA, 338 bp, Mus musculus
  misc_feature (50)..(50): n is a, c, g, or t
  misc_feature (53)..(56): n is a, c, g, or t
  misc_feature (58)..(61): n is a, c, g, or t
  misc_feature (64)..(65): n is a, c, g, or t
  misc_feature (83)..(83): n is a, c, g, or t
gcgtttgcgtggtccgaccggaaattcggttgttagatcaagcggtggtncannnngnnnngcnncaagtacaaagcgaatgntaagtgcgcgatcggcccagtgcatggtctccatggccacgcgctcgtgtgtatcgcggggcagcgcgggatctgcggctgcaggaccagtggaagccgctattcgcgccaaattggagcaagccctgagccccgaggtactggagctgcgcaacgagagcggtggccacgcagtcccagcaggcagcgagacgcattttcgcgtggcggtggtgagctctcgtttcgaggggatgagccccttgcaacggcacc

SEQ ID NO: 6494 - DNA, 196 bp, Mus musculus
aacgttgtcaacctgacacttgtggatttaccgggaatgaccaaagtacctgtaggcgatcagcccaaggacatcgagcttcagatcagagaacttattcttcggttcatcagtaatcccaattccattatcctcgccgtcactgctgcaaatacagatatggcaacatcagaagcactcaagatttccagagagg

SEQ ID NO: 6495 - DNA, 492 bp, Mus musculus
  misc_feature (26)..(26): n is a, c, g, or t
  misc_feature (149)..(149): n is a, c, g, or t
  misc_feature (221)..(221): n is a, c, g, or t
  misc_feature (228)..(228): n is a, c, g, or t
  misc_feature (326)..(326): n is a, c, g, or t
tccgtgcccagcaaggaagaggtatntttcctgcaatctttccaaatgccaattttttccaatgctcaaagagcaggcagagccatgggattggcatacatatctgccatattgtttttattaagtgctataatttttatttcttactntccttcaatggaaatcaaaatgtttccccgtgtctgaaaataaatttgcagcatacataaccttgaaaatcnaaatgtnttggcaatggttttggggacctagactgagatgtaatgggagatatttttaaaatattaacttagattttctaaggacataaagccctaccctatgtntcctatgacagaaaatggcaaaatgacatcaagcattctttcctatttggtttattacttctttggttgaattttttggtttagttttttttcatgtttttgtttatttgtttgttttgatttttgttcatttttatcattccaacttgccaattttgttttatag

SEQ ID NO: 6496 - DNA, 455 bp, Mus musculus
  misc_feature (31)..(31): n is a, c, g, or t
  misc_feature (90)..(90): n is a, c, g, or t
  misc_feature (95)..(95): n is a, c, g, or t
  misc_feature (139)..(139): n is a, c, g, or t
  misc_feature (411)..(411): n is a, c, g, or t
gatcaccatagatgacgttggagcagtgagngatggcacaacttgtggtccagactatttatgtgttcacagaaagtgtgtcagcaagtntgttntggtaagaaactgtacaccacagttatgccatatgcaaggagtntgcaacaataaagaccactgccattgtaataacacatgggaaccaccggactgtcaactacgtggccatggaggtagtatagacagtggaccacctccagtgcctttatctccttccaattggagtatgtacttcctagcttttataattatgtatgtgcttggctttattgctttgtatggcattcgtgaattaaagaaaaaatcctaaaataatcgctgccagactcaaaatctggtgataaaaatctcactagaaaaaaacaggatctntgattttcagacttgcaaaatctgaagaagatgccacgctaaaa

SEQ ID NO: 6497 - DNA, 474 bp, Mus musculus
  misc_feature (213)..(213): n is a, c, g, or t
cgatcagtgcggttggctggttccaggagaaggctatacccttgcagccactgagtctcagcagcttgctgagattgacataaagcttcaggaactctctgttgactctcccaccatcttcagccttgaaagtcagagccataagggtgatatggaatgtgatgccaatgaagaaagaaatacggaaccaactcccggagagaagatactccnggaccgcaaagagcaaagggaccgggagtctcggctgagagccatcgatggcaagctgaaagagctcagtgaacaggttgaggaatgtccaatgataacccccagtaaacggaatgagcggattacgtggagatggctacttgctaaaatccttgagccagagtgaaacaaattacgcagtttgtaaagtgtaactattctttttatttttataatacatcatggttctcaaaatgtgcatcctcctgtgatttgaaatgt

SEQ ID NO: 6498 - DNA, 205 bp, Mus musculus
gaaaagtctacagtatcctctctctgcaagtcctcctgactacagtgacctctgccctgttcctgtatttccaagctctgcggacatttgtccatgaaagccctgccttaattgtggtgtttgctctgggatctctgggcttgatctttgcactgactctgcacagacacacgcatcctctgaacctctatctactctttgcatt

SEQ ID NO: 6499 - DNA, 475 bp, Mus musculus
  misc_feature (285)..(285): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (326)..(327): n is a, c, g, or t
  misc_feature (336)..(336): n is a, c, g, or t
  misc_feature (358)..(358): n is a, c, g, or t
  misc_feature (370)..(370): n is a, c, g, or t
  misc_feature (379)..(379): n is a, c, g, or t
  misc_feature (407)..(407): n is a, c, g, or t
  misc_feature (445)..(445): n is a, c, g, or t
gactttgtgcttgtgaagttttgtcaatttttgcccagtttctcccgggaaagattactgcaaggattcagtgaagatatggcaatacaggcacagcaaatgttcaaaataaataagcaacatgctagaagggtttatgaaattcttcgactgctggtgactgacatgagcgatgctgagcaatacagaagctacagactggatattaaaagaagactaattagcccttacaagaaaaagcagagggatcttgccaagatgaagaaatgcctgagaccagaaganctgacaaatcagatgaaccagatagaaataagtntncancnntgagcagcntggaagagagatttcaggagcntggtggaggacnaccggcgtntcattgagcgacttgctcaagagtgaancccttgttccccagaatacctgcagatttctgtgcatncgtgctgtgaacctctgatgaccctaaagt

SEQ ID NO: 6500 - DNA, 424 bp, Mus musculus
  misc_feature (307)..(307): n is a, c, g, or t
  misc_feature (322)..(322): n is a, c, g, or t
  misc_feature (340)..(340): n is a, c, g, or t
  misc_feature (354)..(354): n is a, c, g, or t
  misc_feature (359)..(359): n is a, c, g, or t
cacagcctggcttcatagagaggacaggacgaacttgaaacaagaaagggagctaacttagagcagaggctcttcatccaaaagggaaaaatgatgactccacactgctttttagagttcaaatcaacatctttctggaaaaatatattttttaacagaatctttttattatttttaaaagatataaaactgactcctcccatcagtagcaatacaaggttatgcattttaaccagactttctcaggcctcttttggatacctttagtagttaactatttttgtctaaccctcctgtaaatacctanctgcataacagcccnaacccctggggaacacanccgagggcaccttnccccntctcacctggcgcaggcatccacccccacaaggctgtgctgatcacacggcaaaacagtaccttt

SEQ ID NO: 6501 - DNA, 318 bp, Mus musculus
  misc_feature (241)..(241): n is a, c, g, or t
agtgcttcacagttttcatgctcagctcccagttctctctgacagtgagagagacatgaagaaagagttacagctgatacctgatcaactgcgacatctaggcaacgccatcaaacaggttactatgaaaaaagattatcaacagcggaagatggaaaaagtgctgagtcctcagaaacccaccattactctcagtgcctaccagcgaaagtgcattcagtccatcctgaaagaagagggntgaacacataagggaaatggtgaagcaaatcaatgacatccgaaatcatgtcaccttctgacaccacctggaatgaa

SEQ ID NO: 6502 - DNA, 484 bp, Mus musculus
  misc_feature (301)..(301): n is a, c, g, or t
  misc_feature (305)..(305): n is a, c, g, or t
taaggcctcaagacactaattttatctggtttggtaactattgataaaggtataattgatctccagcagtagaaaaaggctttagggtatcacgagacatgtttatagttcagtttctcagaagtttaagtgcaagagccctgcatttttaaactatatattcattcaccttaataaatatgcaacatttattccacttatttgacaaataattgcagtgttaaattggaaatgtgatttcttatcaataataccaaaatagcaattagaaatagaactagccattttaaaggggttcagngtanctgtttcctgacaggttttcagaataaagattttgcatagtattttaagatatatagtatctgaaacaatttacagatttttataattcccattctaaaaatgcttaaatttttcataagattgtatttttaaatgaaagttctaaatgctatattttacctataacaatcacattttc

SEQ ID NO: 6503 - DNA, 441 bp, Mus musculus
  misc_feature (123)..(123): n is a, c, g, or t
gtttgatatccacactttgctgacttgaacctgctgctgcctacctgagtagaagtttatgaacttttgtgtattgcagtgtatgaatttgctcgtgtgaagactggctataagctgaaaagntatattattcgttacaaaacaaatcacatgtttaattcacatttttcaagtttcctatgacgtatatcaagtctgtccgtttcagtcgaacttacaagagcaattgatattctagttgtacaaagcagtttgcctgtgcatatgacccatgtaactttcttagtctcaaagctgcagctgtagtcctcagaaaggaagctccaggacatttcatgactataatgcatgcactatttatatagactgacctggctttaaaagatggagcctggcaagttcctcacataatcaatgtatccacctatccttcatttttat

SEQ ID NO: 6504 - DNA, 188 bp, Mus musculus
aagcaaaaatggcttaaacatacacactttctcacaaaacttctcagatttttgggacttaactgtacccagttactcatgaaataatatattcagtccaattaaatgaaatattatacatttttgtataaaatattaagcttagcacccatcattaattcatatggttttactcagcagtgtaaaaa

SEQ ID NO: 6505 - DNA, 423 bp, Mus musculus
  misc_feature (274)..(274): n is a, c, g, or t
  misc_feature (293)..(293): n is a, c, g, or t
  misc_feature (316)..(316): n is a, c, g, or t
  misc_feature (329)..(329): n is a, c, g, or t
  misc_feature (335)..(335): n is a, c, g, or t
ggcttaaacatacacactttctcacaaaacttctcagatttttgggacttaactgtacccagttactcatgaaataatatattcagtccaattaaatgaaatattatacatttttgtataaaatattaagcttagcacccatcattaattcatatggttttactcagcagtgtaaaaagcactctatgtcctcattctctatgcgagagccaatcagtaggaacgattgaccaacagaagaaaagctgttggaagaaatttctagattactagnaaagcactgataattgtancccagtagcatatggattttaanaaatacagttttncttttntcctagcagaacatgttagaggtaactgagttttctctaaaagttttgtaataattggcattaagtatatcattattcattgctttta

SEQ ID NO: 6506 - DNA, 334 bp, Mus musculus
  misc_feature (260)..(260): n is a, c, g, or t
atggctgaagtagaggcctggaaactgcagcagttggaggaagtcaggcagcaggaagaggagcagcagaaggaggagttagccaggctccggaaagaactggtgcacaaggcaaatccaatacggaagtacgcagcagtggaggtgaaatctagcgagctgcctctgactgtgccggtgtctcctaagttctccactcggttccagtagaagctgcatctatatcacaagcatggagcacgcgtcttcagactcacccnccatgtgtggaaacacacctgataactaatggatgccgggtgttttgaagatgactctacacagcaactttgaa

SEQ ID NO: 6507 - DNA, 511 bp, Mus musculus
ctcgggcggctgtatgcagatctaaatcgccacgtggatgcattgaacgcttggagaaatgccaccgtactgaagccggagcacagcctggcgtggaacaacatgatcatacttctggataacacaggtaacttagcccaggctgaagctgttggaagagaggccctgcaattaatacctaatgatcactcccttatgttctcattggcaaacgtgctggggaaatcccagaaatacaaggagtctgaagctttattcctcaaggcaattaaagcaaatccaattgttgcaagttaccatggtaatttggctgtgctttatcatcgctggggacatcttgactctgccaagaaacactatgagatctccttgcagcttgaccctgtggcagtaggcaccaaggagaattacagtcttctgagaagaaagctagaacaaacgcagaagaaagatgtctgatcttccccctaatgttttgagtttgtgagtgtgtgcatgaagcctctgttca

SEQ ID NO: 6508 - DNA, 114 bp, Mus musculus
tctgtctcacataggctgtaagctctctgagagcaggcacctgtcatcccagtccatcccaccgttcccttactgtactctgcaactcaccatctggaattaagtgacatgctt

SEQ ID NO: 6509 - DNA, 484 bp, Mus musculus
  misc_feature (206)..(206): n is a, c, g, or t
  misc_feature (233)..(233): n is a, c, g, or t
  misc_feature (253)..(253): n is a, c, g, or t
  misc_feature (258)..(258): n is a, c, g, or t
  misc_feature (263)..(263): n is a, c, g, or t
  misc_feature (275)..(275): n is a, c, g, or t
  misc_feature (278)..(278): n is a, c, g, or t
  misc_feature (284)..(284): n is a, c, g, or t
  misc_feature (291)..(291): n is a, c, g, or t
  misc_feature (294)..(294): n is a, c, g, or t
  misc_feature (296)..(296): n is a, c, g, or t
  misc_feature (309)..(309): n is a, c, g, or t
  misc_feature (323)..(323): n is a, c, g, or t
  misc_feature (370)..(370): n is a, c, g, or t
  misc_feature (374)..(374): n is a, c, g, or t
  misc_feature (383)..(383): n is a, c, g, or t
  misc_feature (387)..(388): n is a, c, g, or t
  misc_feature (425)..(425): n is a, c, g, or t
  misc_feature (438)..(438): n is a, c, g, or t
aatgttttgtagtgaacccagggtgggtgagggggaagcatctgtctcacataggctgtaagctctctgagagcaggcacctgtcatcccagtccatcccaccgttcccttactgtactctgcaactcaccatctggaattaagtgacatgctttaaaacttaagagtttagaagaaacaaaaggccttagagtcatctctatgtnattgtatcctggtttccccatctcctnatcctgatttctcattgctnttctntcctncctcactgtaanctncctccnttctgtncantntacagtaagaatncctgcttccaagantcagatacatagggacgtttttacccgttccgtagactctgtaactntcancccagtttncctnntgctgactcctggcatcacctcctgggacacttgctntcttttttacttntctcattttctttcacagcactgaggtctcaccaaattttctaatt

SEQ ID NO: 6510 - DNA, 375 bp, Mus musculus
  misc_feature (77)..(77): n is a, c, g, or t
  misc_feature (87)..(87): n is a, c, g, or t
  misc_feature (99)..(99): n is a, c, g, or t
  misc_feature (108)..(108): n is a, c, g, or t
  misc_feature (113)..(113): n is a, c, g, or t
  misc_feature (116)..(116): n is a, c, g, or t
  misc_feature (122)..(122): n is a, c, g, or t
  misc_feature (128)..(128): n is a, c, g, or t
  misc_feature (134)..(135): n is a, c, g, or t
  misc_feature (156)..(156): n is a, c, g, or t
  misc_feature (169)..(169): n is a, c, g, or t
  misc_feature (177)..(177): n is a, c, g, or t
  misc_feature (179)..(179): n is a, c, g, or t
  misc_feature (188)..(188): n is a, c, g, or t
  misc_feature (197)..(197): n is a, c, g, or t
  misc_feature (204)..(204): n is a, c, g, or t
  misc_feature (246)..(246): n is a, c, g, or t
  misc_feature (251)..(251): n is a, c, g, or t
  misc_feature (256)..(256): n is a, c, g, or t
  misc_feature (272)..(272): n is a, c, g, or t
  misc_feature (274)..(274): n is a, c, g, or t
  misc_feature (281)..(281): n is a, c, g, or t
  misc_feature (283)..(283): n is a, c, g, or t
  misc_feature (286)..(286): n is a, c, g, or t
  misc_feature (308)..(309): n is a, c, g, or t
  misc_feature (311)..(311): n is a, c, g, or t
  misc_feature (329)..(329): n is a, c, g, or t
  misc_feature (336)..(336): n is a, c, g, or t
gaagctgcacagtccgatgggagaacaagaccatgtactgcatcgtcagtaccttcggactgtccatctgaccaccnttgccagccntcagcctcgtgntcccagcantttcncantccatnttaacnaccagnntatgttgggcaaaccccttcntcctaagttgttntgtggcantntcaaaaaanccaaatgantccccantcacaggaaccacatgacttcagccagattagcagccacctntcatntgagncaggcagtaccacttntnttaactntnttntccaaggtgctaaaaactcaanntntgctggtggaaacagctntactttntgaaatgattcagatacactaactttccatactttattc

SEQ ID NO: 6511 - DNA, 555 bp, Mus musculus
  misc_feature (121)..(121): n is a, c, g, or t
  misc_feature (276)..(276): n is a, c, g, or t
  misc_feature (280)..(280): n is a, c, g, or t
  misc_feature (283)..(283): n is a, c, g, or t
  misc_feature (287)..(287): n is a, c, g, or t
  misc_feature (305)..(306): n is a, c, g, or t
  misc_feature (344)..(344): n is a, c, g, or t
  misc_feature (363)..(363): n is a, c, g, or t
  misc_feature (404)..(404): n is a, c, g, or t
  misc_feature (433)..(433): n is a, c, g, or t
  misc_feature (436)..(436): n is a, c, g, or t
  misc_feature (443)..(443): n is a, c, g, or t
  misc_feature (464)..(464): n is a, c, g, or t
  misc_feature (498)..(498): n is a, c, g, or t
  misc_feature (530)..(530): n is a, c, g, or t
acctaggaccatctgtacccgaagccaccacaacgtgttaaatgggatctgtgctgagggcaacgtagtggtggctgcctctggtggcctgtcattggaggtctggaggctgctggcctgnaagagctagctggacgcggctgtggatggatgttggtatagactgcctgctgaggctgcaccgaggcctctgctctggaggaattcctgccattggtgctgccctgctccacagacctgggatacaggaagtcccagggctgggcccacactgtncctncangggntgacattctagttttccnnaccaagagggttcttccctaccttccactcgtgggctntgcgttttgttttgttttnttttgttttgttgagacagggtctcatgtaacccaggctgncctcatattcactatgtgtttgaggcagnccnttgaatncctgatccccttgcttatatntcccacgtgttgggatggtaggtgtgccaccatncctgaatgacccattttgtttggatttggatntctctctcccacagcagtgaagaga

SEQ ID NO: 6512 - DNA, 559 bp, Mus musculus
  misc_feature (354)..(354): n is a, c, g, or t
  misc_feature (431)..(431): n is a, c, g, or t
atattacttcccttcttgttactgcttttgttttctgtctccaacattttcattagggctgtagctccccactctgtgtagataaaaggtgggttcagtccagctattattgccctgagggaacaaactacttttttgggagcaaatgttctccagcatatagttgacagtggttaggagccctccccttcccctgccctcctgtaacagcagaatcctatccttcctcttctgttcattgtattgaccaaccagtaatcctattatgtatctgagtgtgtgtatagggggaaggggttctttacattttctgtggtttgtgcttttttcttcagtaaattagttcccaccatncgcatgcccaggggccactacctggcattatcgcatgctgggatcattgggggagggtagtttgaaattcaccactntcctttgttttggagattcttattttttaataagtaatccgtcctatacaaatagctaattaactcttgtgttccccctgcccatatggctgctggtgtaaataaattgcattttcccattgctaaat

SEQ ID NO: 6513 - DNA, 269 bp, Mus musculus
  misc_feature (73)..(78): n is a, c, g, or t
  misc_feature (164)..(165): n is a, c, g, or t
cttgcaggcctagcggagcccgagtgtgccgtgagtaaagccagcgccctccgcacggtcgcttgccggttannnnnnggaggagatttcgttggccaacctggatactaacaagctggaggccatcgcccaggagatctatgtagacctgatagaggattccnngcctgggcttctgctttgaggtgcaccgggcggtcaagtgtggctacttctacctggagtttgcagacactgggagcgtgaaggatttcggcatccagccagtg

SEQ ID NO: 6514 - DNA, 517 bp, Mus musculus
  misc_feature (409)..(409): n is a, c, g, or t
  misc_feature (470)..(470): n is a, c, g, or t
gcagttcatcacttggtcctcagaacctccttccagcaggggctgtatatttcttgatggaaagttggaggcagggttagaagtaaaggggaagtgagtggcatatcaaaactggtctgtttcagtccctaaaatggggggttatggagggtgggagtcctgaggtgagcagaaaagaaaggtgctgctttatttgaaatgttttcttacctcattctgtgccccagtaaagggtccagcctcatctgtctggcttggccatgttcctgtcactgctccactgcctctctggtgcagctcatgattccaggtgctgcttgccacactaggttttctctcgaccaatttcagctcatcttccagtgctgctcctccgaagcctacacaagtttcctttttccttttgttntcgttttcgttttctaactttaaatttttatgttgttttgttttacctgtttttatggaanccttagaggagaatctctcatggctccctctgtttggattggaatgg

SEQ ID NO: 6515 - DNA, 407 bp, Mus musculus
  misc_feature (307)..(307): n is a, c, g, or t
  misc_feature (317)..(317): n is a, c, g, or t
  misc_feature (319)..(319): n is a, c, g, or t
  misc_feature (327)..(327): n is a, c, g, or t
  misc_feature (374)..(374): n is a, c, g, or t
  misc_feature (381)..(381): n is a, c, g, or t
gtcttcgataaacagacactctgtgcgatgtctgtgtgacaagactgtagggaggtcgtggcttctaccaacaggagctgctgtcatactgtgcactggtctgtagatctgcaccctgaggattcctgatttcttcatgaagcagacatcatagtttgatcatctggtctttttctttagctttgaatttttattcaaatgtcgcctctcttctccctttgagaaacaccacactgactttgtaggaggggccttgctgtggcctagggatgtgtgtatgtgtctaaacgaggttgtgtagcttccnacacttccantntcatcttngaccatgtgttcatattttcctcccacgggtggaaagtaagagacanccgagtntctgaacttcccacctgggatctgtg

SEQ ID NO: 6516 - DNA, 359 bp, Mus musculus
  misc_feature (274)..(274): n is a, c, g, or t
  misc_feature (276)..(276): n is a, c, g, or t
  misc_feature (299)..(299): n is a, c, g, or t
  misc_feature (329)..(329): n is a, c, g, or t
acaaagagtcgatgggctggcatttgtgaatgaagatgtggtggcctccaaagggagtggacagggcaccatctacctgtggagctggagccagacatgggcaggccggggcagacagtctgtgttgcccgtagtcatcctggtccggctgcagtggtcacccaccaacctggcctacttttcactcagcacctgtcccggcaaaaacctcgtgctgtgtggggacgaggaaggcagtgtgtggatctatgatgttgaacacctcctgaaagancnctccacaggcaacaactctgcancccccaacacagatcctgaagtggcctcanccaacagcattgggccaaccagtgaccaag

SEQ ID NO: 6517 - DNA, 430 bp, Mus musculus
tgcgagcgaaacctacaccatgagtctcctcaataaacccaagagtgagatgaccccagaggagctgcagaagcgggaggaggaggaattcaacacaggtcccctctcagtgctcacgcagtcggtcaagaacaacacgcaagtgctcattaactgtcgcaacaacaagaagctgctgggccgggtgaaggcctttgacaggcactgcaacatggtgctggaaaatgtgaaggagatgtggactgaggttcccaagagcggcaagggcaagaagaaatccaagcctgtcaacaaggaccgctacatctccaagatgttcctgcgcggggactcggtcatcgtggtgctgcggaacccactcatcgctggcaagtagagcctgctccctgccctgcgaaggcctgcagaaccctgcccagtgggcgagaaa

SEQ ID NO: 6518 - DNA, 365 bp, Mus musculus
  misc_feature (211)..(211): n is a, c, g, or t
  misc_feature (335)..(335): n is a, c, g, or t
gtgccaaagagaatttttccctggattggtgtaaacaaccggacgtgggccttcccaaacctgacctgatcctgttccttcagttacaattgctggacgctgctgcacggggagagtttggccttgagcgatatgagaccgggactttccaaaagcaggttctgttgtgtttccagcagctcatggaagagaaaaacctcaactggaaggntggttgatgcttccaaaagcattgaggaagtccataaagaaatccgtgcacactctgaggacgccatccgaaacgctgcacagaggccactgggggagctatggaaataaatcagcttccattnccaatacaattttctggttctgcaagagac

SEQ ID NO: 6519 - DNA, 401 bp, Mus musculus
  misc_feature (292)..(292): n is a, c, g, or t
  misc_feature (309)..(309): n is a, c, g, or t
  misc_feature (323)..(323): n is a, c, g, or t
  misc_feature (326)..(326): n is a, c, g, or t
  misc_feature (336)..(338): n is a, c, g, or t
  misc_feature (354)..(354): n is a, c, g, or t
aggagaaactgcacgcgctcttcagccaagagcatctcgtgatatataaggggtatgttgacgaccctcggaacactgacaatgcgtggatggagacggaagccgtgaactaccatgatgaaacaggggagaccatggacaacctcaccctggaggccggagatgacgcagggaaggtgaagtgggtggacatcagcgaccagctcaagttgtacgccagtcactctcagttcatcaaactcgtggcagagaaacgagatgcccactggagcgaggaccacgccgctgacanccgtgggctatagcctntccccgtgagccanccnctgcaggctnnnactgcagacagaaggnccacagaactgacaccccacagaggccacctggaaatgcttgcaaca

SEQ ID NO: 6520 - DNA, 62 bp, Mus musculus
gactgaaccacccaaaggacctggctttggtgtgcaagcaggcctttaacttgtattcaact

SEQ ID NO: 6521 - DNA, 469 bp, Mus musculus
  misc_feature (343)..(343): n is a, c, g, or t
  misc_feature (430)..(430): n is a, c, g, or t
agtcctggatctcgcccaaaggcagaatggatggctacctatctccgctatgaacaaggtggctgaagttttacaagtacctccaatgagagtatatgaagtagcaactttttatacaatgtataatcgaaagccagttgggaagtaccatatccaggtctgcactactacaccttgcatgctgcgagattctgacagcatattggagacccttcagagaaagcttggaataaaggttggagagactacacctgacaaacttttcactcttatagaagtggaatgtttaggggcctgtgtaaatgcaccgatggttcaaataaatgacaactactatgaggantctgacacccaaggatattgaagagattattgatgaactcaaagctggaaaagttcccaaaccagggccaaggagtggccgcttctngttgtgagccagctggaggccttacttctttgactgaac

SEQ ID NO: 6522 - DNA, 351 bp, Mus musculus
  misc_feature (309)..(309): n is a, c, g, or t
cttcactgtttttgtggcttttgagacccagggaatcccaatcaccagggacttggagaggccggaaagctgacatcctgttgtgtgagctcaggggacctccttagaaggaagaagtgctgcatgggccccgaggctcacggccaggcccagagtaactcttgacccagggaccttcacatcctcttcccaacacttgctctcagtagcctagtccctcttccctctgttcccatgtcctgaagggctgaaaggggacaagtcctaagctgtctggccctgcccagccgcaggcattgccccagctanctgagcaccaggtcagttaaggctgggactggccatcctcat

SEQ ID NO: 6523 - DNA, 494 bp, Mus musculus
  misc_feature (268)..(268): n is a, c, g, or t
  misc_feature (277)..(277): n is a, c, g, or t
  misc_feature (281)..(281): n is a, c, g, or t
  misc_feature (287)..(287): n is a, c, g, or t
  misc_feature (293)..(293): n is a, c, g, or t
  misc_feature (297)..(297): n is a, c, g, or t
  misc_feature (299)..(299): n is a, c, g, or t
  misc_feature (305)..(305): n is a, c, g, or t
  misc_feature (347)..(347): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (381)..(381): n is a, c, g, or t
  misc_feature (384)..(384): n is a, c, g, or t
  misc_feature (414)..(414): n is a, c, g, or t
ggtgtgtgatgccaaagagctcaacggggcctctcatggtgagcgtggatagatacgtgatgtctggtcatgtagtgagggccttgggggcttgcctttgaatgctatagcatatttagtgtgaggactggggacccagtaagatttagagagcaatatagcaaaacctgtcatcttggacctttttcacagctgatgctatcataattttgaaggatttttaagtaaaacagcagtgtacatatgtgtgtacaggacaccaagactncgcaggcangccntgaganccccanccantnttccgnccctcggcggacctgcagatgacctggagttcctgattcagntccctntntncagcccgggctgcctgggccacanccntgccagtgtgggcagtgtgacgaaaggcgncctgtactgccctaagaaatctgatgtaaagtttttgtatatttcatattccacccaccagattctgcttccatttaata

SEQ ID NO: 6524 - DNA, 408 bp, Mus musculus
  misc_feature (129)..(129): n is a, c, g, or t
  misc_feature (166)..(166): n is a, c, g, or t
  misc_feature (217)..(217): n is a, c, g, or t
  misc_feature (283)..(283): n is a, c, g, or t
  misc_feature (299)..(299): n is a, c, g, or t
  misc_feature (315)..(315): n is a, c, g, or t
  misc_feature (322)..(322): n is a, c, g, or t
  misc_feature (332)..(332): n is a, c, g, or t
  misc_feature (338)..(338): n is a, c, g, or t
  misc_feature (353)..(354): n is a, c, g, or t
  misc_feature (375)..(375): n is a, c, g, or t
gccaagcaatggttcagtatgtacaaacccatcacctacaacacaagcctgctcacagaagagtccgacaactttgtgaacaagctagaccccagcaaagtgttcaagagcaagaacaagattttaatncccaaaaaagaaagggcctgtaccacctgccagtggncagaaagggcctgggcccttacctcctcctacctctaagcctaccacaggnctctggaaatcctgtccgaaaataagcattctatcacctcagtaatatccagacacagatggcccntgtggcagcggcattntcctgagagaccaaanccttagncctttgtttnccactntcattagctaggggnntgggacgatcacactgaattntcctcaggagttccttcctctgtaggttgtgac

SEQ ID NO: 6525 - DNA, 565 bp, Mus musculus
  misc_feature (37)..(37): n is a, c, g, or t
  misc_feature (67)..(67): n is a, c, g, or t
  misc_feature (70)..(70): n is a, c, g, or t
  misc_feature (82)..(82): n is a, c, g, or t
  misc_feature (87)..(87): n is a, c, g, or t
  misc_feature (92)..(92): n is a, c, g, or t
  misc_feature (99)..(99): n is a, c, g, or t
  misc_feature (138)..(138): n is a, c, g, or t
  misc_feature (153)..(153): n is a, c, g, or t
  misc_feature (308)..(308): n is a, c, g, or t
  misc_feature (346)..(346): n is a, c, g, or t
  misc_feature (443)..(443): n is a, c, g, or t
  misc_feature (473)..(473): n is a, c, g, or t
  misc_feature (480)..(480): n is a, c, g, or t
  misc_feature (536)..(536): n is a, c, g, or t
gcatcgtttgtaacatgggccattccaacaccgaganttgatgtggccagcctgcggacaccagaanctngacctgggagangagtnaagantcccaanttgatcatgtgatatggcctgatggcaagaggatagtanctgctggcagagggnccgtctactgaatctcagctgctccacagtgcctacatttgtgctctccatcactgctaccactcaggctctcgccttgatagaactttacaatgctcctgagggtcgctataagcaagatgtgtacctgctacccaagaaaatggatgagtatntggcaagcctacacctgcccacctttgatgcccacctnacagagctaacagatgaacaagccaagtatctgggactcaacaagaatggacccttcaagcctaactactacaggtattaagttcctgtaatgcaanccagaagacatgttaaagaatagaaccaanccttttntcaaatactatccaaggaagaacctagcaagctgcttctccaatcagagctgcccnccgtgctcatcctgtgtgttaggttattt

SEQ ID NO: 6526 - DNA, 169 bp, Mus musculus
  misc_feature (56)..(56): n is a, c, g, or t
  misc_feature (58)..(58): n is a, c, g, or t
  misc_feature (77)..(77): n is a, c, g, or t
  misc_feature (79)..(80): n is a, c, g, or t
  misc_feature (84)..(89): n is a, c, g, or t
  misc_feature (92)..(94): n is a, c, g, or t
  misc_feature (96)..(98): n is a, c, g, or t
  misc_feature (101)..(102): n is a, c, g, or t
  misc_feature (104)..(104): n is a, c, g, or t
  misc_feature (126)..(126): n is a, c, g, or t
  misc_feature (128)..(128): n is a, c, g, or t
ttgggctcctcgttccgctggtccgtcgtcgccatggtgaagctgagcaaagaagncnaaacagaggctgcagcagntnnttcnnnnnnggnnncnnnttnncnatccgctggggctttattcctntngtgatttacctgggatttacaaggggtgcagatcctggaat

SEQ ID NO: 6527 - DNA, 334 bp, Mus musculus
  misc_feature (56)..(56): n is a, c, g, or t
  misc_feature (58)..(58): n is a, c, g, or t
  misc_feature (77)..(77): n is a, c, g, or t
  misc_feature (79)..(80): n is a, c, g, or t
  misc_feature (84)..(89): n is a, c, g, or t
  misc_feature (92)..(94): n is a, c, g, or t
  misc_feature (96)..(98): n is a, c, g, or t
  misc_feature (101)..(102): n is a, c, g, or t
  misc_feature (104)..(104): n is a, c, g, or t
  misc_feature (126)..(126): n is a, c, g, or t
  misc_feature (128)..(128): n is a, c, g, or t
  misc_feature (179)..(179): n is a, c, g, or t
  misc_feature (223)..(223): n is a, c, g, or t
  misc_feature (259)..(259): n is a, c, g, or t
ttgggctcctcgttccgctggtccgtcgtcgccatggtgaagctgagcaaagaagncnaaacagaggctgcagcagntnnttcnnnnnnggnnncnnnttnncnatccgctggggctttattcctntngtgatttacctgggatttacaaggggtgcagatcctggaatgcctgaaccntcggttttaagcctactttggggataaaggactgtttgaacatntggatttggacgcgatccaacatggaaggtgtatantccagctggacaagaaaggagacgtcatttcaacgattctgtggcagagtggaggagcctatactgatttatgat

SEQ ID NO: 6528 - DNA, 550 bp, Mus musculus
  misc_feature (330)..(330): n is a, c, g, or t
  misc_feature (334)..(334): n is a, c, g, or t
  misc_feature (336)..(336): n is a, c, g, or t
  misc_feature (344)..(344): n is a, c, g, or t
  misc_feature (347)..(347): n is a, c, g, or t
  misc_feature (349)..(350): n is a, c, g, or t
  misc_feature (406)..(406): n is a, c, g, or t
  misc_feature (466)..(466): n is a, c, g, or t
  misc_feature (472)..(472): n is a, c, g, or t
  misc_feature (501)..(501): n is a, c, g, or t
  misc_feature (504)..(504): n is a, c, g, or t
tttcaagctttcgtcagtggcaaccactcttaggcagcagcaattggttttggaaatttccgtgatgtcattaccacctgaatgtggacctttgctacttgtattaagaccagtggcctcgttttgctgtatcattacaatttggcttctttatattaatgtttgaaagggattaaacctggcattctagaacatgcccttcactggttatgtaaataaaactgtagaatgacacgtcagatgaagttagtgtgattttaattgtgcactacaaccaagctgtaaccagttattaataacttagaatgtaatcccaggacatttaagcanttantntacagtanttntnntgagatagtggaagaggaggaagaggagggcatttctgtatttcaggacttttctnggggtttcagaatgggtttatatgattttctttattattttttggtagttttatttattntatcantctttttaacaaatgtttattgctgcacntcntccccagtgtattattgttttactacccttgtagcactggagttta

SEQ ID NO: 6529 - DNA, 313 bp, Mus musculus
ttttgcctcactgagccgtgactcaggatctgccctgggtctgggcattgccctccacactccctgctatgcccagatacggcgggcgcacctagggaatggccagaaaatagcttgctttgtgctggccatggggctgctggtcttcctggaatggctgggctacccacctcagatcagcctcttctacatcttcaacttcctcaagtataccctctggccgtgcctggtcttggcccttgtgccctgggtggtgcacacattgagtgaccaggaagcaccgcccattcgctcctcttgatgtgttttgcct

SEQ ID NO: 6530 - DNA, 566 bp, Mus musculus
  misc_feature (371)..(371): n is a, c, g, or t
  misc_feature (421)..(421): n is a, c, g, or t
  misc_feature (481)..(481): n is a, c, g, or t
agcagtgtggctagacgtgaaatgagagaagatgcaagaagaaaatggacaaataaggaaaatgtgaaacagctaaaggatggaatatcaaaagaagttctaaagaaaatgcaaagaagaaatgatgacaaatccatatcagatgcacgggctcgcttccttgagagaaagcaacagagaatccaggaccacagtgacacattaaaggaaactggctaagcagtggactatccaattcaggaagcaggaaagcagccaggaaatgtgcttctgttttgccagttatttccgacagtactatcagaaggaagtggtcagcagctgttcctagcctgtgagccgaaagcaaatcagaatttataaatcacatntcatcaatactaacaaatgacattttgaaaggaaagattgggttgcatantcatagtacatgaatccaatcaaagatgatacaatatttccctcacttctgttttgctgnccttaactggtatcaaacagtgtcactgagatattttcaaagaacactgaattgtatttaatcagcgtgtattccatttgcattg

SEQ ID NO: 6531 - DNA, 361 bp, Mus musculus
  misc_feature (284)..(284): n is a, c, g, or t
  misc_feature (291)..(291): n is a, c, g, or t
gaccactgtgcagggcattgcggacgattatgacaaaaagaaacttgtgaaagctttcaaaaagaaatttgcctgcaatggaactgtgattgaacaccctgagtacggagaggttattcagcttcaaggggaccaaaggaagaacatctgccagtttcttctggaggttggcatcgtcaaggaggagcagctgaaggttcacgggttctaagatgaacccaagcgtggcgagtttcttaaatggttttgttctctaactcagtttggctgcctcgggagatganttctttnacagtaaacgacagactttgcgtttatttaatcattcagacttccactcacacctgcatggctacagaaa

SEQ ID NO: 6532 - DNA, 508 bp, Mus musculus
gcctatgccctcgatcacaataagaccaccagatgaccaacatcttcctactgcaaatacttgtatttctcgactttatgtcccactctattcctctaaacagattctcaaacaaaaattactactcgccattaagaccaagaattttggttttgtgtagagtataaaaagtgtgtattgctgtgtaatattactagctaattttgtagattttttttcccatttgtctataaaagtttatggaagttaatgctgtcataacccccaccccaccccacccccggtggtaccttaaagagattaaatgcaaacattccttgctgagtttgtagcttaaaggcctgagaagcactggcaccttttctctatgatggtttgctagtcgccaacttctaggtctaaccccagccaaagatgacagcagaacaacataatttacactgtgatttatcttttttgctgagggggaaaaatgtaaaatgttctgaaaattcactgctgcctttgt

SEQ ID NO: 6533 - DNA, 267 bp, Mus musculus
ctttctctccggattcagcaaattgaaacaactctcaatattttagatgcaaagctgtcatctatcccaggcctagaggacgtcacagttgaagtgtctcctttaaatgtcactgctgtcacaaacggatcacattctgaaaccacttcggagcaaacgcagcagaatagcacgcaagactctggagcacaggagagtgaagcgccatcagaaaatgtcctgaccgtagccaaggatccacggtatgccagatacctcaagatggtt

SEQ ID NO: 6534 - DNA, 493 bp, Mus musculus
  misc_feature (403)..(403): n is a, c, g, or t
gacgtcgctgtcaatagcaacttctacctgaggatgcagaacagtgatttcttgcgggaactggtggtcaccatcgccagggagggccttgaggacaagtatggcctacagctaaatcctgaatggcgcatgttgaagtaccggtctttcctgggctccatctcacagcagaacatccgttctcagcagcgacctcggatccaggagctggggaccctggatgccagtggctcactgggaacctgtcatggcccagaacggcctcacctgaacctttggttggaagcccctgacctgctcttggctgaagttgaccttcctaaactggacggcgcacaagggctggcactggaaataggagagaaccgcctggtgataggaggcccccagcaactgtatcatntggatgccactgttcccctgaggatcaacagtgaggcaagcagggctgcttttcaccgcaggaggaagcaactgatggtgtccatgcccc

SEQ ID NO: 6535 - DNA, 307 bp, Mus musculus
gcatcacgcccgaggaggccaagtacaagctgtgcaaggtgaggaaagtcttcgtgggtaccaagggcatcccgcacctcgtcacgcacgacgcgcgtaccatccgctaccctgacccgctcatcaaggtcaacgacaccgtgcagatctcgctagacagcggaaaaatcaccgatgccatcaagtttgataccggcaacctgtgcatggtaaccggaggcgccaacctgggtcgcatcggcgtcatcaccaaccgcgagcgccaccccggctcctttgacgtggtccacgtgaaagatgccaacgg

SEQ ID NO: 6536 - DNA, 228 bp, Mus musculus
  misc_feature (26)..(26): n is a, c, g, or t
  misc_feature (33)..(33): n is a, c, g, or t
  misc_feature (91)..(91): n is a, c, g, or t
  misc_feature (170)..(170): n is a, c, g, or t
ttggtttgagttttgattagtttagntatttgntttttcttgttttcattcaaagttttgttatttattggttatttattgttcttttaantaatttgatattttgataaggttatacacagtacatattgactgtcagctttcagttacaattgagtacattgcatttnttcttatgactaacacagtgatctccaactcttcactctaagagccttgttatttcag

SEQ ID NO: 6537 - DNA, 519 bp, Mus musculus
  misc_feature (26)..(26): n is a, c, g, or t
  misc_feature (33)..(33): n is a, c, g, or t
  misc_feature (91)..(91): n is a, c, g, or t
  misc_feature (170)..(170): n is a, c, g, or t
  misc_feature (229)..(230): n is a, c, g, or t
  misc_feature (244)..(244): n is a, c, g, or t
  misc_feature (275)..(275): n is a, c, g, or t
  misc_feature (278)..(278): n is a, c, g, or t
  misc_feature (298)..(299): n is a, c, g, or t
  misc_feature (309)..(309): n is a, c, g, or t
  misc_feature (312)..(313): n is a, c, g, or t
  misc_feature (317)..(317): n is a, c, g, or t
  misc_feature (320)..(320): n is a, c, g, or t
  misc_feature (325)..(325): n is a, c, g, or t
  misc_feature (335)..(335): n is a, c, g, or t
  misc_feature (362)..(362): n is a, c, g, or t
  misc_feature (364)..(364): n is a, c, g, or t
  misc_feature (414)..(414): n is a, c, g, or t
  misc_feature (423)..(423): n is a, c, g, or t
  misc_feature (449)..(449): n is a, c, g, or t
  misc_feature (494)..(494): n is a, c, g, or t
ttggtttgagttttgattagtttagntatttgntttttcttgttttcattcaaagttttgttatttattggttatttattgttcttttaantaatttgatattttgataaggttatacacagtacatattgactgtcagctttcagttacaattgagtacattgcatttnttcttatgactaacacagtgatctccaactcttcactctaagagccttgttatttcagnntgtgatcatgaaancccacagatatcagacccagatggatctctncantcttcatgggacttgggctnnccatagtttnttnntganccngactnaactacaaantccttcatacattcagtatggagagtntntccaactgtctggataggaacttaatgatggaaaacttacccatgctgcntcgttgctntcaaatatttagctactgtgaaaatnctgtggatgatggtgttgaacgcattaatggcaaatacatcagtntttctgtaatagctctcattaaatc

SEQ ID NO: 6538 - DNA, 546 bp, Mus musculus
  misc_feature (311)..(311): n is a, c, g, or t
  misc_feature (325)..(325): n is a, c, g, or t
  misc_feature (327)..(327): n is a, c, g, or t
  misc_feature (354)..(354): n is a, c, g, or t
  misc_feature (363)..(363): n is a, c, g, or t
  misc_feature (371)..(371): n is a, c, g, or t
  misc_feature (388)..(388): n is a, c, g, or t
  misc_feature (412)..(412): n is a, c, g, or t
  misc_feature (455)..(455): n is a, c, g, or t
  misc_feature (490)..(490): n is a, c, g, or t
ggatattttggccacaatctcagaagttgtttacattgatttgctagaaggagatactgaatgccatgcccgatttaaaacccccgaggatgctcaggcagtaatgaatgcacagactgaaattagaaagaagcacagttggaacctcgaggtcctttctggggatcatgagcagaggtactggcagaagattttggtagatagacaggccaaacttaatcaacctcgggaaaagaaaagaggcacagaaaagctaatcaccaaagctgagaagattagactggctaagactcagcaagccagtcagcacntccgtttctctgantnatgactgagaagatgacgacttttggncctcccttnctgaagtnttcttactgctgggctncctcatgactgttgtgttgagatntgcatgagaaaagaaaaggaaaaaaccttggctcctcaatgtntcaataagacttttctaataacaagtgcatgtttntcagattttttcaatgaacacccttacttttgaatttacgcaaatgcaacttcaga

SEQ ID NO: 6539 - DNA, 382 bp, Mus musculus
tgcagactaaacaggccgccatggagaaatctgaaaaggccaagcaacttcgagcgcttaggaaatatggaaagaaggtgcaaactgaggtcctgcagaagaggcagcgggagaaagcacacatgatgaatgccatcaagaaataccagaaaggcttctctgataagctggatttcctggagggtgaccagaagcctgtggaacgcagtgcaaaggcaggaggtaaaggccagcagatgagtaaagggcctaatgccaaacgaagatacaaaaatcagaagtttggttttggtggaaagaagaaaggctccaaatggaacacgaaagagagctacgacgatgtctccagcttccgagccaaggtggctcacggcaagggctc

SEQ ID NO: 6540 - DNA, 520 bp, Mus musculus
  misc_feature (356)..(356): n is a, c, g, or t
  misc_feature (396)..(396): n is a, c, g, or t
  misc_feature (410)..(410): n is a, c, g, or t
  misc_feature (438)..(438): n is a, c, g, or t
  misc_feature (469)..(469): n is a, c, g, or t
cacatccgccttcacagaagagctgcccggggagagggacttgacccacctggtggagatctatgactttaagccaacactcaagaccgaggacctgttggccactttctctgagttccaagagaagggattcagaatccagtgggtggatgacactcatgctatcggcatctttccctgccctgcctcagcactcgaggcactggccaaggatttctccgtgctcaagatccgcccgctcacacaggggaccaagcagtccaagctgaaagccttgcagaggccaaagttcctgcgactatcgaaggagaggccgcagacagattcagcggtggcccgcaggctggtggcccggnccttgggactccaacacaacagaaagaaagagctgcctantcccccaagtgttntgccatcttgaggccccggacccagctntccgaattaggctggggcccagtaccacacncctttacagataccaggacagcccctttgccctcactggagctgctatggg

SEQ ID NO: 6541 - DNA, 471 bp, Mus musculus
  misc_feature (36)..(36): n is a, c, g, or t
  misc_feature (137)..(137): n is a, c, g, or t
  misc_feature (267)..(267): n is a, c, g, or t
  misc_feature (288)..(288): n is a, c, g, or t
  misc_feature (300)..(300): n is a, c, g, or t
  misc_feature (335)..(335): n is a, c, g, or t
  misc_feature (357)..(357): n is a, c, g, or t
  misc_feature (361)..(361): n is a, c, g, or t
cagagggcctccaaatagactgggagaaaatcaaanccaaaattgagatggaaattactaaagaacgagaccgatcatccagcggccagtccagcaagagtgtgggcttaaagcactaagggccacgcttacctccnaactagtttggactaaccaaagatgtgcatgtttgtttgctttaagaagaaaaaaaagcataattttaagactagtgcttcctctagatggtagtgcacttgcctagcatacatgaggccctggggctcntccccagtcaaaagaaaaagncattgtctttgnataagtgtatgagttttctgtgtttttaatacttnaggtacgttcagaaaggttaancccnaaataccttatataattccatcatttctatttttctagtctaataattaagaaaatatttctatatgcttatctatgcccaaggagtgttgagtacattccagtttgttt

SEQ ID NO: 6542 - DNA, 553 bp, Mus musculus
  misc_feature (162)..(162): n is a, c, g, or t
acagaacatgctggtgcaatgtccagctgcctctcgggcttactgggcaggagagacaccagattgtaatttttcctaggttatggccattttgtgtctttgcgattgtgctgtgtgtgtttgggtttgagggagggctagctgggaggcccgagctgccanttgttgagcagccttgaaatcagcgctgagtgtctgtggccctcctggcccataagggctccatccttagtgatgtcatcaccactgcttcttggtgctttgtggtcctgatggacagagacaagggttctgggatctcagagtgagaagcatcctcctggtggggacctaagcttgagtgtgcagcgtgttacacaggcacatgtctggcagggacacggactggaggccaccttcgtccttgcgggtcactcacccacctctctctgttcttgatgaggaatgtactgctttgttcatgctgcccctaccagggccactcctactcatgaggacggaggcgccagcccctcccctttttattttactgttctaattgtctatttccttg

SEQ ID NO: 6543 - DNA, 519 bp, Mus musculus
  misc_feature (255)..(255): n is a, c, g, or t
  misc_feature (320)..(320): n is a, c, g, or t
  misc_feature (327)..(327): n is a, c, g, or t
  misc_feature (333)..(333): n is a, c, g, or t
  misc_feature (386)..(386): n is a, c, g, or t
  misc_feature (427)..(427): n is a, c, g, or t
  misc_feature (431)..(431): n is a, c, g, or t
  misc_feature (434)..(434): n is a, c, g, or t
gaccctgcagccaagtatcaagcattcaggccattttatgattctcaagaggtttctctggattttcagaatgacgtcccacactaatcctgacttatgtcacatagcaagtaaactaagagggaagggtgaggagaagtggggaggccagcagcccagcccacactcaggatcaccgctcacctttccagagcattctggactgagctgagcaacaggcagagggcgttagcctcattgtgaggtttttttttnccctgatgtcatcatcataacgttatttatttaaatgtagttattttggtatttaattttttttnagagagngggggngaaaccctgtattttcctggtagaatgaaatggctcagaatggtatatttagncaatttaaaacattatttacataaagaccaaatatgataantctnttntaagtattgcttcacccacagtatggagctgtcacaatgttactgcagatgatgcgtgttgacatggagttactgcacccaagct

SEQ ID NO: 6544 - DNA, 468 bp, Mus musculus
  misc_feature (315)..(315): n is a, c, g, or t
  misc_feature (334)..(334): n is a, c, g, or t
  misc_feature (386)..(386): n is a, c, g, or t
  misc_feature (388)..(388): n is a, c, g, or t
  misc_feature (439)..(439): n is a, c, g, or t
tgtccacccataaaccaagctattaatcttctaacaatagaacaataagtttacttagtgagctttgagaggagggttcaaataaaaaattgttaacacctggaagttgtgaaattatggagattttgattcataatgcaaagcatgtaatttttactataacatgtgagtgtgaaaatctctatcctcaggtaaccggttgagtgcatgagctctgacttcgaaacgaggtaactgtaggatcggaaggaagagcaggctcatgctgtcgcccacagcaggaccccactggtgtgtctggctaaccacctgtgncccaggaatacaaacccanccttgagaatgtagggaaggagctcttgaacacaacacagcctctgtctgtntntactgggcctgtgctgagtgctaagtgcctgtagctcactgcacccgtgtncctgagatgcagtgttgcacgttgacaca

SEQ ID NO: 6545 - DNA, 431 bp, Mus musculus
  misc_feature (93)..(95): n is a, c, g, or t
cagcgtccttcggagcggaaggaatatggcgtccgctactcgcgttatccaaaagctgcggaactgggcgtctgggcaagacctgcaggcgannntacagctgcgctaccaggagatcgccaagcggacccagccacctccgaaactccccgtgggccccagtcacaagctgtccaacaattactactgtactcgtgatggccgccgggaagttgtgcctccctcaatcatcatgtcctcacaaaaggccctggtgtcaggcaaggccgccgagagttctgcaatggcagccactgagaagaaggcagtgacacctgctcctcccatgaagaggtgggagctgtccaaggaccagccatacctgtgaccctgccctaggttaccttgctatatatgtctctagggccacatgactgcttttcctccttgga

SEQ ID NO: 6546 - DNA, 393 bp, Mus musculus
  misc_feature (94)..(94): n is a, c, g, or t
ggcccaacaccaacaaatctcagttcttcatcacattccgatcctgcgcttacctggataagaagcataccatctttggacgggttgttggggnctttgacacgctgacagccatggagaatgtggagagtgaccctaaaactgaccgtcctaaggaggaagtgctcatatgtacaaccacagtgtttgtggacccctatgaggaggctgatgcccagattgcccaggaacggaagaagacacagcatcaggtggatccagaggccaaggtcaagatgagtcagccccagcctggaaaccagggaccccagacataccgccagggggtgggcaagtacatccaccctgcggccacgaaacgatcagcagaggaagaaccatcgaccagcactg

SEQ ID NO: 6547 - DNA, 563 bp, Mus musculus
  misc_feature (358)..(358): n is a, c, g, or t
  misc_feature (396)..(396): n is a, c, g, or t
  misc_feature (488)..(488): n is a, c, g, or t
  misc_feature (490)..(490): n is a, c, g, or t
  misc_feature (515)..(515): n is a, c, g, or t
  misc_feature (518)..(518): n is a, c, g, or t
gaggaatgggctactccacacaagctgccaaacaagcccttcaccaggccagaggcaacctggacgatgccctgaaggttctcctcagcaacccccacatgtggtggttacaggatgcagaccctgaaaacaatagccgccaagcaagtccttcccaggaaagcatcaaccagctggtgtacatgggctttgacacagtggtggctgaagctgcactaagggtgtttggaggcaatgtccagctggcagctcagacccttgcacaccatggaggaagcctcccacccgacctgcagttctcaggagaggactcctcccccacaccgtccacatccccatctgactctgcagggacctntagtgcctcgacagatgaagacatggagacggaggctntcaacgaaatcctggaggacattccggagcacgaggaggactacctggactccacgctggaggatgaagaagtcattattgctgaatacttntncctacgttgaaagtataagttctgnccncaaagaacaactgatcagaaataagtgctacgtttcggctataaa

SEQ ID NO: 6548 - DNA, 430 bp, Mus musculus
agtcacctcggaagaaacgccatggttcctccacaagggagatctggccccgcgtcttggatcctgagatctgtgcgagatcccggctttgcgccctgtccgccctggagctggatttatcatcagtttagaatagcatggctacgatgtgtggtgcggatggatggacgagccccgcaagtgcagacaggacagtccacatcacctgccaaagcagccagcaatgcaacagctctccaagatcaggcctaggtggatcactgacctggctaaaagtaccaagaaggcctggatcattgtggtgcctctctccagaaaatggtgacaaaaattgaaatcaaccagcacatcaggatcctctgtggcaagaccaagataataatgggggacactgtcatctggcactgtggttccttcacgacaacagtgg

SEQ ID NO: 6549 - DNA, 466 bp, Mus musculus
  misc_feature (396)..(396): n is a, c, g, or t
  misc_feature (398)..(398): n is a, c, g, or t
gagcgatggctccactgaagagacagatgagtctgagacttgaatctgaagggtcccatctgtggcctgtaccttgttcccaccctgcttttgctgcccacaccagacttctccagcatcactgtgccaccctctgctgaagagaagggtgaattaataacagccctagtaagaccagcccagttcagtgatcctcagaatcccctaactcatgctctcagcaacctgctgggccctgagctgacatacatcacagagaagggtctgctttagtcttctgttggcagggctgcttatgctttaagtactgtcatctcagccagtccatgatcctcctagtaagggtaatttttcacaacagcatttataagggaaacgtgaattagtaatgcaggntnttcctggtggagggtgattcctgagagcatgtgctgggaagacctatcaactggcctgctggagagat

SEQ ID NO: 6550 - DNA, 328 bp, Mus musculus
  misc_feature (138)..(138): n is a, c, g, or t
  misc_feature (150)..(150): n is a, c, g, or t
  misc_feature (154)..(154): n is a, c, g, or t
tcaaagttccttttataggaggctaagacctaactatgttacttttcattgtaagataaagtttacttatgtaaatattccgagtcatggctggtatgcacaggcttcttatgtgggttattacagtaaactaatcanccgtggttcatnactnagttagatactaagtaatacttatactgttcctgagaatagattctttttcatgagaaagtgaaagagcaaatgtttaattcttcatacttgaaaacacaaactgaaatatctcacccatcagttttccttgggttttcactttgtgtagttctgactgtgcttaactaaagta

SEQ ID NO: 6551 - DNA, 540 bp, Mus musculus
  misc_feature (344)..(344): n is a, c, g, or t
  misc_feature (383)..(383): n is a, c, g, or t
tgtggacaatactggctgccggacgagtggccttaagcagtcaccgtttacggccactaactaagaatgcactattgagagacccctatgcactgcggccagtacggcgcctcatcgacaactgtgccttccggctctatgggcactgggtaaagaagggtgagcagcagaaccgggcagccctcttccagcaccagcctcctaggctgttccccattgctgccactgaactcgaaggagactccggtgccatcacagaggatgaggctacactggtacggagctagggccgtatccctgggcaagccagaaagaaggactctccaggaggacatttttttttnctatcattccaactgtttgggactcagaccttagccctnccttgccaagcctacaactgagaatgctgcttgtcacagaaaccagccctttacccctactactctggacttggagatcagggcagagatggaagggagcctcttcgagggttgtgcctggcctagctatcgccacctgcgctgcatctgaaataaa

SEQ ID NO: 6552 - DNA, 428 bp, Mus musculus
  misc_feature (247)..(247): n is a, c, g, or t
  misc_feature (367)..(367): n is a, c, g, or t
  misc_feature (385)..(385): n is a, c, g, or t
gagtttgtgtttgggtcatcggccatccaggccttggacctagtcgatcgagagtccgtcactttaatctcatcacccagtggaaggcgtgtttaccaggtgctagggagttctggcaaaacatatacatgtctggcttcctgtcattactgctcgtgcccagcattctccttctcagtgttacggaagagtgacagcctgctgtgtaagcatcttctggcaatttaccttagtcagcttctgaggnaactgccagcagctccatgtgtctgacaagcaactgacagacctattgatggaggacacaagaaggataaaaggtgcggctggaacatggacttcaaagacagaagcctagcaggaaacncattcacatctcacggtncccgaggtggaggaatgggatgcacttccagacttgtgactgt

SEQ ID NO: 6553 - DNA, 504 bp, Mus musculus
  misc_feature (30)..(31): n is a, c, g, or t
  misc_feature (33)..(36): n is a, c, g, or t
  misc_feature (109)..(109): n is a, c, g, or t
  misc_feature (114)..(114): n is a, c, g, or t
tgtgatctcacgaaagcgcttgggagcacnngnnnngatctgacgcgccgatcccccaaaacgctcttaggaagtttaaggcccaaaagaggtcccagggccaatggcnggagnctgggccgaccatgctactacgagaggagaatggctgttgcagtcggcgtcagagcagctccagcgccggggactctgatggggaacaggaggactcgccggccacgcgtgcacggcagcaactagaggcattgctcaacaagaccatgcgtatccgtatgacagatggaaggacactagtcggctgcttcctgtgcactgatcgcgactgtaatgtcatcctgggctctgcgcaagagttcctcaagccttctgattcattttctgcgggcgaaccccgtgtgctgggtctggccatggtaccaggacaccacatcgtttctattgaagtccaaagggagagtctgtcggggggcccgtatctctgaccacaattgcacttctctttga

SEQ ID NO: 6554 - DNA, 192 bp, Mus musculus
tgtttttgtcagagagtccgacagagccctagctcctccagagctggcccagaaccgagtgacgagagcccagcagacatggtgaaaatgaccaagtccaaaactttccaagcttatctgccacactgtcaccgaacttacagctgcatccactgcagagcccatctggccaatcacgatgagcttatctcc

SEQ ID NO: 6555 - DNA, 383 bp, Mus musculus
gaacctttggatacaggcctgtctttagcagaggatgaagagctggtgttacatctcctcaaaagtcaaaactagacattctctgtgccttcctgtactttgatacctctggatattactatgtgggcaagaaattgaaaacagctttggaaaacagttttgagttttgaaacatcaaggaacgtactcagaataaggacgtattgtatactgttagaatttatgtataggttcttattccccaccattggaaatgcttgttttgtttattttcacactgttgaagattaaaccaaggccttgtacatggtaaataagagctctactcctgagctgtgtacctagtccttgcttgtttgttttacaggcaaggttctggatct

SEQ ID NO: 6556 - DNA, 162 bp, Mus musculus
gataatgatattttgttacagtgtctttattatctcaaagggggttctaaagtaaatactcaaagcatatactttttagacattattttatactgaaacaactgacagtaggtaggacattactgattaaatctagtttatttgttccaatgactgtaaaat

SEQ ID NO: 6557 - DNA, 160 bp, Mus musculus
gagcccacacaggaaggcaagctgttccaattatatcctaagaatttcccacgctagaagaccatgagagaggccaaaagtttgtctacaaagtggagacagtactgaccaagccttggattcttattgtctcaaagagtaggggcagcttcctagcgca

SEQ ID NO: 6558 - DNA, 321 bp, Mus musculus
gtgtaactgcaaaagtttctgatggtactgcatatctagatgtagattttatagacgaaatacttaccagtatgatagggtattcagtaccagaaatgaaacaattaagaaaggaccctcttaaatataaaacattcctagaagggttacagaaatgtcagcgagatctgatcgatttgtgttgcctgatgactatttcatacgatccttcttcatgtaaaggggtggtgctggaattgcaagatgttggtatggaacacgtggagaacctaaagaaacggttgaataaataatttgccagaatgctattggagcacactt

SEQ ID NO: 6559 - DNA, 172 bp, Mus musculus
cactgcgtgctacgtgtacaactaaggtaaaggcaaactctgtaaagcaggagtttgaaaagcaagatgagctaaagcggtctgccatgagggcagtggcggctttgttaaccattccagaggcagagaagagccctcttatgagtgaattccagtcacagatcagctccaa

SEQ ID NO: 6560 - DNA, 520 bp, Mus musculus
  misc_feature (57)..(57): n is a, c, g, or t
  misc_feature (59)..(59): n is a, c, g, or t
  misc_feature (63)..(63): n is a, c, g, or t
  misc_feature (124)..(124): n is a, c, g, or t
  misc_feature (129)..(129): n is a, c, g, or t
  misc_feature (131)..(131): n is a, c, g, or t
  misc_feature (136)..(136): n is a, c, g, or t
  misc_feature (140)..(140): n is a, c, g, or t
  misc_feature (335)..(336): n is a, c, g, or t
  misc_feature (338)..(338): n is a, c, g, or t
  misc_feature (399)..(399): n is a, c, g, or t
  misc_feature (416)..(416): n is a, c, g, or t
  misc_feature (453)..(453): n is a, c, g, or t
  misc_feature (455)..(456): n is a, c, g, or t
catctttgactgcaactgtagcatttgcaagaagaagcagaacagacacttcattgntntccnagcttctcggttcaaactcctgaagggtgctgagagcataaccacatacacctttaacacngcacnanaagcnccangcacaccttctgcaagagatgtggtgtccagagcttctatactccgcgctccaaccccgggggctttggaatcgccccccactgcctggacgaaggcactgtgcggagtgtggtcactgaggagttcaatggcagtgactgggaacgagccatgaaggagcacaagaccatcaagaacatgtcaaaggagtgagnnanggcagtagccctgtaggttgcatgggtgtgtgtcgctgtgcaggcctgcctgggctaccantctccactccccatgtntctgaggttcactccagccaccatttctttaggcagntnnctgccttaacccaggtttcgtgtaagaaacttaaccttctcccttcctaccaatttttgtgtga

SEQ ID NO: 6561 - DNA, 405 bp, Mus musculus
gattagcctcgatcagggtgacaacaaagcaaagctgatgcgagcctgtatgcaggagccccttttcgtggagtttgcagactgctgtttaggaatcgtggaaccatcccagaagagggattcctaagactggatgtgttctctgctcaagttacctgctgctgctccaagaggtggctgttttcaaggccaccatacgcagcatgcacacgtgggtcttcctctaccacatggctcgctgcagcaacttcatgaagaggaaacttgtagccctggagtgatggctcagcagttaggagcattgactgcttttccagaggaccccagttttcagcacctatttgactacttacaactgtaattggttgcagaggatctgacagtctttactgtatgcatgtgcat

SEQ ID NO: 6562 - DNA, 62 bp, Mus musculus
accctgagagtgcagatccatgcaaactgccgtatccgaagggtttacttctcagacagact

SEQ ID NO: 6563 - DNA, 556 bp, Mus musculus
  misc_feature (316)..(316): n is a, c, g, or t
  misc_feature (343)..(343): n is a, c, g, or t
  misc_feature (348)..(348): n is a, c, g, or t
  misc_feature (351)..(351): n is a, c, g, or t
  misc_feature (381)..(381): n is a, c, g, or t
  misc_feature (383)..(383): n is a, c, g, or t
  misc_feature (432)..(432): n is a, c, g, or t
  misc_feature (438)..(438): n is a, c, g, or t
  misc_feature (441)..(441): n is a, c, g, or t
  misc_feature (445)..(445): n is a, c, g, or t
  misc_feature (454)..(454): n is a, c, g, or t
  misc_feature (464)..(464): n is a, c, g, or t
  misc_feature (478)..(478): n is a, c, g, or t
  misc_feature (505)..(505): n is a, c, g, or t
tttgctcggcgaggaatccacgacatgctggaacacggagggaacaagattctacctgtcattcctcagctcattatcccaataaaaaatgccttgaacctccgaaacagacagatcatctgtgtgacgctcaaggttctccagcatctggttgtgtcttcggagatggtgggcgaagctttgttgccctactaccgtcagatcctgccaatcctgaacatctttaagaacatgaatgtgaactccggggatggcatcgactacagccagcagaagagggagaacattggcgacctgatccaggagaccctagaanccttcgagcgctacggaggggaggacnccttnatnaacatcaaatacatggtgcctacctatgantngtgcttgctgaactgaccgggcagctgccggagggagcctcccttggtntcacanccntctntccctaaantcctagcatntcattacttgtganttctacagctgcaaacatagtagtttntgggccaaaagactgttagccctattgtaagcaaggctttcccatatataa

SEQ ID NO: 6564 - DNA, 549 bp, Mus musculus
aggtggacttccttgttggtggccagccataagacctactagccagttggcttctcagcatctctggccttttcccctgctcttccagtccctgacctttcagtgttctgagcagactgggaagttccttttggctgactcctttctggcaccatgccctgtaccaagtggctatgctcatggccacaggacttcgcctgctcaccaagttctcagagcaataaaaggtattcatccatgccggaagctgctcccaggtcaggggtgggagtggaatggtgccatggatcaacaggacctactcaccaagttctcagagcaataaaagatatctatccatgcctgaagctgttcccgggccaggggcgggagtggaaggtgccatagatcaacacgactgtggtagtgcctatgacattggtggtgctgatccttggagtctggataatgaccaggcttggcaggtgcgtagccagagagaccctcctctggacaaacctggagaacctgtgtgtgtgtgacatttctagcttgtcttgctgtgtgatc

SEQ ID NO: 6565 - DNA, 527 bp, Mus musculus
  misc_feature (142)..(142): n is a, c, g, or t
  misc_feature (150)..(150): n is a, c, g, or t
  misc_feature (154)..(154): n is a, c, g, or t
atgaagctcaccaaggccgtgcggtacctgcagcagcccgactgtctgctcgtgggcaccaacatggacaaccggctcccgctagagaacggccgtttcattgcgggtccgtgcacctaggggctggaggttggagggcggncccagccnttcncgtgtcctctgaccccagcgtccccttccctccctcgctctgcaggtaccggctgtctggtgcgagccgtggagatggccgcccagcgccaggcggacatcatcgggaagcctagccgcttcatcttcgactgcgtgtcccaggagtatggtatcaacccggagcgcaccgtcatggtgggagaccgcctggacacagacatcctcctgggctccacctgtagcctgaagactatcctgaccctcaccggagtctccagtcttgaggatgtgaagagcaatcaggaaagtgactgcatgttcaagaagaaaatggtccctgacttctatgttgacagcattgccgacctcttgcctgcccttcaaggttaaag

SEQ ID NO: 6566 - DNA, 529 bp, Mus musculus
  misc_feature (171)..(171): n is a, c, g, or t
  misc_feature (339)..(339): n is a, c, g, or t
  misc_feature (358)..(358): n is a, c, g, or t
  misc_feature (361)..(361): n is a, c, g, or t
  misc_feature (397)..(397): n is a, c, g, or t
ttcaccgtgaactttagggcccgaggaatagcatgaagtaatgaagcaagacattcctcagagggggaaactgcagagttttacctgaaagtttgttctctttaaactgctctgtgacagtggcatgtgggaggagacgtgcagctggttcactttcttagttgatgggtnaactgaagttccttcccacccccaacaaagaagatgtttagaaaagagattgggagtgtaagtttccaactagttaacagtgctaaaccgatagagctctcatttggggatggcatgccagagtctgtagagatgtctctgtcatgtcacttttcaaggattccttantggggcttgatcctattanccnaaacttttggtggtgaggtagagatttggggtgggnccgggggtagggtatggaaggatatgcttcctctgcctggcagatgtctacagcttgaaacaaacagttgtacctaatgaactttattcgtttagtgaaaatagatttatacacgaaccatcttgtttccca

SEQ ID NO: 6567 - DNA, 545 bp, Mus musculus
ttccttcttggagggaccactcagtagagcctctaagggacccaaatccttcagacattttggagaacctggatgacagtgtattttcaaagaggcatgcaaaactggagctagacgagaagaggagaaaacgatgggatattcagaggatcagggaacaaagaattttacagcgactgcagctcagaatgtataaaaagaaaggaattcaggaatctgagcctgaggttacctcatttttccctgagccagatgatgttgaaagtttgctgattacccccttcttgcctgttgtagcatttggacggccattgccaaaattagctccacagaactttgaactaccctggttggatgagcgaagccgttgcaggttggagatccagaagaagcacacacctcaccggacctgtaggaagtagctgtgctggcggtagcctgtcttcagatagttgtagcatgctgttccgagagaatagcagagacctgtatgtgtgacctgtgccctcatgtctgttatcattcactggtaatgcctttccatc

SEQ ID NO: 6568 - DNA, 483 bp, Mus musculus
ttctgtggccacaaaaacatctgctcactaaccacaattcagaagatcccacggttgctggtaggagcatcagatggctatttgtacatgtacaacctggacccccaggagggaggcgagtgtgcgctgatgcgtcagcacaggcttgatggcagtatggagacgaccagtgaaatcgtagactctgcatctcatgactgccccttagcaacacagacgtacggcacagcagctgccaaaggtgcctatgtgccctcgtcccccacaagacttgggaaagggcaggacgccaacttagaagcctacacagatgacctgggtgctgtgggtggtgcatgcctagaggatgaagccagcgctctgcgcctggatgaagacagcgaacatcctcccatgattctccggactgactgatcctgacctgtgaactctggcccaggagcagacaacactgcctggctgaggacttgagcattgctgcta

SEQ ID NO: 6569 - DNA, 420 bp, Mus musculus
tgaaggttttcatgcttacccgactctcagtggacattctggtactcttcctgcattgagtctcctgctgtgagctctgtggcatagcctgctgaggaatggaatggagatgcctatagaggtcccaatgtcatcgtcgtaagcaggtgtgaaaggagagatctcttcctcaccacccggctacctcaactcttttctggtagcagtgcctatgtagctgcatctaggttctcagaagcacagacatgtaaacaggtggttgggttgggctttaggacatactgtcacaggagagcttccagggtctctgagctggttttcttcacaggcaaacatcctgagggacctttaagtaggggagttctttattctgatttgcctgcagaagtaggaagacttgctatatcagtcctcagtagg

SEQ ID NO: 6570 - DNA, 186 bp, Mus musculus
ctttggattggtctattgtggattctatactgatggaacgaagaatccggccatggatcaataagaaaatcatcgaatacataggtgaagaagaagctacattagttgattttgtttgctctaaggttatggcacatagttcaccacagagcattttagatgatgttgccatggtactagatgaag

SEQ ID NO: 6571 - DNA, 349 bp, Mus musculus
  misc_feature (26)..(26): n is a, c, g, or t
atattactttacagcaaagtgccccnaaagtccctggagtgtgtgacagacagcagacagctgcagcgccagtgagtgggtgggcccaagtgacttcagttaggaacatgttgagggaagcaaagcccatgcccaccactgtccgtccctggaggccagctggagcagctcctttgtcctcatggtatatgccagcaggaggtgggagggtcagcatacttggggagcataaggcttgactaaccaactccatgtggaaaaaaaaaagctatctgaggaatgcagtgccactgtctttctggggcaacagtgtgtagtctatgctgcttcgtctaagtattctcctttt

SEQ ID NO: 6572 - DNA, 517 bp, Mus musculus
  misc_feature (105)..(105): n is a, c, g, or t
  misc_feature (110)..(111): n is a, c, g, or t
  misc_feature (312)..(312): n is a, c, g, or t
  misc_feature (346)..(346): n is a, c, g, or t
  misc_feature (348)..(348): n is a, c, g, or t
  misc_feature (390)..(390): n is a, c, g, or t
  misc_feature (394)..(394): n is a, c, g, or t
  misc_feature (397)..(397): n is a, c, g, or t
  misc_feature (403)..(403): n is a, c, g, or t
  misc_feature (405)..(405): n is a, c, g, or t
  misc_feature (445)..(445): n is a, c, g, or t
  misc_feature (481)..(481): n is a, c, g, or t
  misc_feature (487)..(487): n is a, c, g, or t
tgtcagggccccttcatgggagttacccagctcagtcctggaagggccggcgtctggactacatcacctaccgcagagtacccgggagtcgcctgagcccagagncggannaggtgacattcagtactgcctttgctggactcacggaccacttggctatgggcctgaagcttcaagtggtatgctcctgacgctggtgcccagacaaggggatgaatgtcgagaaagaccaccatggggggagcggagcccaataacccaataaccatgcgactcaaaggatctttattgtgggggcactcatactgcttnctgggcgcggcggtactcatacacactgcctcgntntgggaaggctggatatagcgggggcgagcctggtggtggtgntggntcntccggntntccatagcccccacccccaggcgtgtggaggcagaacgcntcctgagaagaagagcaagttttaacacaggttgcntccctntcccagttaagacacaatcactcaaccacc

SEQ ID NO: 6573 - DNA, 528 bp, Mus musculus
  misc_feature (183)..(183): n is a, c, g, or t
ggcctcattgtgaacagatgtccccaccccctccagacacttgagactccagggaatagggcgtcctagtgggtgggggtggggacatcctcttggaaatgggggaggaggaatgggatgaggaatcatcagagagatgaccaggagggagataaagactggactgttaaaaaaaaaaaaaangattaaaaaatctcgatgatagatcccagcactccttttcattctgggatgtaggggcattgattattctatttcggagtagtttttttatatggaatggggttatgtttgtgcttctccaatcttgcagcacttagaaataccactgccccacacagaattgagattccttccttgtgtgtgacactaatccagctgtaaccttttctgtaaacgttatgaataacctcacctcaaatggtgagtgggctaatgttcacacactggagctctgtcaactgcatttgccctgtgtgcttctccaccgcgccatggggaactaaggtcttgcttagtgcacctcat

SEQ ID NO: 6574 - DNA, 561 bp, Mus musculus
  misc_feature (58)..(58): n is a, c, g, or t
  misc_feature (60)..(60): n is a, c, g, or t
  misc_feature (65)..(65): n is a, c, g, or t
  misc_feature (361)..(361): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (398)..(398): n is a, c, g, or t
  misc_feature (406)..(406): n is a, c, g, or t
  misc_feature (432)..(432): n is a, c, g, or t
  misc_feature (460)..(460): n is a, c, g, or t
  misc_feature (462)..(462): n is a, c, g, or t
tgcacagtaggatcagcacctgcttccaacagcaaacgaactactaagcctcttccangntgcgnctgctgcatgcaggagagtaaagccaccggagcccaaaggggcattgagcagggacttaactccagggtctaccagcccagtggctagctgcagctttagcacctcaacttccccagcacgacaagcagctagaagcgtgtcccagagctctggctgaccaggggctttggcctcatagaccaaagtatccaatggggtttcaacctcttgggttggctgtgagaacggctcatcttgaggttgctgaggaagaggcccatgtgccccacactgctgctcttgacttctctccttnttcttcctcctcctcctccnctnggncagtacttcanattcacgnagatccagggtccccagggtcaattntactagctccaactctacttcggaaccntnttcttcctgagactctgaacctagaaaaagataggatcttagatctatctaaggaatagggagagggttgaaagatgtgtgcttcctcagatgggttta

SEQ ID NO: 6575 - DNA, 356 bp, Mus musculus
ttttgaccacatcaggacagtcattggatctgagttcattgggatcggtggaagctatgacgggtctggaaggttccctcagggactggaggatgtatctacatacccagtgctgatagaggagttgctgagtcgcggttgggatgaacgagagcttcaaggtgtccttcgaggaaacctgcttcgggtcttcagacaagtggaacaggtgagagagaaaagccttgggcagagccctgtggaggtcaagtttccagagaggcagcagagcaacacctgccactcccacctgctgcctcagcctcaggaggaccaacaccaggatacacacctgaaggtgacaaagctgccaaaca

SEQ ID NO: 6576 - DNA, 361 bp, Mus musculus
  misc_feature (183)..(183): n is a, c, g, or t
  misc_feature (200)..(200): n is a, c, g, or t
  misc_feature (204)..(204): n is a, c, g, or t
aaccgcataggatccatgtatttattttccttgagtttttatttatgctgtaactcgtgtcaagcattggttaaagggacaccaggcccagccgcgaggtatcagtacatgctttttaaagcacagtggtgccccccacccggccacccacagcgagacctcgccagagtctagagcccaggncgggctggtcccccaanacanccgagcggcctttcgctccttcctacccacaggcctggccggattgcaggtcctccgggtcctcctgtgcccaggcctcactctgagcccgtgccagggcaggaaagagctggctcctctggatctttcttttacatcatttatcatggactagccc

SEQ ID NO: 6577 - DNA, 404 bp, Mus musculus
tctgcagggctttactttacactctcctttttatccttgtatttttctaaaggtaactgattgcttagatgctgagtaaggaagatacattgttgtcattgtttggctttggtagaatgaaacttgaagacatttgataactgctctcatttaacttcattactacttaccacagcttcctcagtgtgttgaacaaggcaacttttctaggtaagtgctgcttaaatcagcacttagatgacttctgaacgtcaggcccattgaactgatgttgtgtagaccgtttctaagtcctaatttggaattttcagatgctttgcacttgacatattccaacagttcattggaacatggaggcaaaacgccagcctgctaaagagagcttcagttttacaacctggcca

SEQ ID NO: 6578 - DNA, 557 bp, Mus musculus
  misc_feature (102)..(102): n is a, c, g, or t
  misc_feature (104)..(104): n is a, c, g, or t
  misc_feature (162)..(162): n is a, c, g, or t
  misc_feature (189)..(189): n is a, c, g, or t
  misc_feature (224)..(224): n is a, c, g, or t
  misc_feature (284)..(284): n is a, c, g, or t
  misc_feature (352)..(352): n is a, c, g, or t
ttatcctggtgggttgtgtcaaagactctgtcagttgggaatgtatgtccttctgaaggaaagaaacatgcttctaactctggagcaggaggccaagcgacngnaggttgccaatgccaagtccggagcgcttagaaaaggtcgttgattccatggataacntagataaagttgtccaggagagggaanatgctctaaggcttcttcagaccggtcaagaaaancccagacccggtgcttggagaagggacatctttggacgaattgtctggcacaaattcaangcagtggcctataccttggtacctaaataaaagatacaacaggaggcggttcttcgcaatgccttatntggatcgctttatcagactaagaattgagaaacacgcccgcattgaagcaagaaagagaagtttacagaaaaagaaagaaaaaattctccatgcaaagttcccacatctctctcaagaacggaaatcaagtagtgtctaagatgagacccagaagtctggttccattgttcttaaagcctgtgtcctgacgtgaatacctgttaa

SEQ ID NO: 6579 - DNA, 324 bp, Mus musculus
ttttggaccaccacaggcatgtttccccaggagttcattatttgttttcacaaacacgtaaagattgaaaagcttgtgatacaaagttacttggtgcggactttgaggattgaaaagaccacatctaaagagccattggattttgagcagtgggttgaaaaagatttagtacacacagaggggcagcttcaaaatgaagaaattgtggcacgagatggctacgccactttcttgagattcattattgtctcagcatttgatcattttgcatctgtgcacagcatttctgcagagggactaacagtctcaagtcttccttagtaa

SEQ ID NO: 6580 - DNA, 529 bp, Mus musculus
  misc_feature (127)..(127): n is a, c, g, or t
  misc_feature (136)..(136): n is a, c, g, or t
  misc_feature (143)..(143): n is a, c, g, or t
  misc_feature (147)..(147): n is a, c, g, or t
  misc_feature (326)..(326): n is a, c, g, or t
  misc_feature (335)..(335): n is a, c, g, or t
  misc_feature (337)..(337): n is a, c, g, or t
  misc_feature (399)..(399): n is a, c, g, or t
gactttaagctcgacttcggcaatttccaaggcaaaatgagtgagaggtggcacggaggcaagaaggagttaaaagtggagtctatgttgtaatagaaattaaagtttcaactcgagaagggaaggnaaataaccngccgaangttnacctgatgacgaactacgagagcgcgcccccatcaccacagtataagaaggttatctgcatgggtgcgaaagaaaacggtttgccacaggaatatcaagagaaattaaaagcaatagaaccaaatgagtataaaggaaagatctccgacgaaatggaagacatcatcaaaaagggagantcaaaactntncataacagactctgaagctatgtgtgctagtatgaagtgcttttaacgtttgcgaacaggantctggaccttcttggttctgaccttgattttcaacagtgctgggaagggcttctcacataggtgattctttatttttaactgtaacaaagaactggaatggggatgggcttagaccattaaagggaccag

SEQ ID NO: 6581 - DNA, 555 bp, Mus musculus
  misc_feature (342)..(342): n is a, c, g, or t
  misc_feature (362)..(362): n is a, c, g, or t
  misc_feature (405)..(405): n is a, c, g, or t
  misc_feature (410)..(410): n is a, c, g, or t
  misc_feature (439)..(439): n is a, c, g, or t
  misc_feature (463)..(463): n is a, c, g, or t
gaaggatgcagcacctcttcaggataccccagggaagaacaaccagctataccactgcaggagggatgagtacctgcctccacaccccccacaggagacactagatgtaggcagattccaacgactgccccagctagaccaccccaacctaatccaacgcaaggccatctcaggttatgccggcttcgtcccccggtttgcctgggtaatggggatgaattaccgtgatggtgtcacacaagctatggatgactttgacaagaaccagttcgtgttcagacacccagtctgtgccctgggtgaaaggctgcctaggacccactggccaaacaccaccatctntagaagccaaggcctgattncctttctacatgggctttatcccatccatgcaggacaactatncactnacattcggtaacagcacccgaagagcctntcagaaggaattggacaggcgaanccacacactatgaattgctttaatggtggtatctgtacaagtgatgtcaggacacaggacagcaaatgcacagtggacatggctagcagaca

SEQ ID NO: 6582 - DNA, 506 bp, Mus musculus
gagctagacgagaccctgtcggagagactctggggtctgacggagatgtttcccgagagggtccggtcagccgccggagccacctttgacctctcgctcttcgtggctcagaagatgtacagattttccagggcagctttgtggattgggaccacttccttcatgatcctggttcttcccgttgtctttgagacagaaaagttgcagatggagcaacagcagcaactgcagcaacggcagatacttttagggcctaacacagggctgtcaggaggaatgccaggggctctacctccacttcctggaaagatgtagattcttccttcggtatttgtccttgtgggagaactttgaaattcatttgtgtttgaactgctgattgttggaactttttattcttttttttaaccttggcacatggatctatttgaacatagtgggaactttctctgtttctcatggagagaccccaggtacacctgtgccctacataatgaagtccctca

SEQ ID NO: 6583 - DNA, 498 bp, Mus musculus
  misc_feature (350)..(350): n is a, c, g, or t
  misc_feature (433)..(433): n is a, c, g, or t
accaggaggtcacgttgtctattcaacttgctcactgtctcacttacagaatgagtatgtggtgcaaggtgccattgagcttctggccaatcaatacaacatcaaggttcaagtggaagacctgtctcacttccgaaagcttttcatggacacattctgtttcttcccatcctgccaggttggggagctggtaataccaaacctcatggtcaattttggacctatgtacttctgcaaactgcataggctgccatagtgccaccctgtccctgaagtaggaaggtgatgactccattgaaactgaggctagtggcaggtgtatcccaaggcctgtctccatccattacatntaaagatagttgcaaacagcaggcagtagggactgctgcccagctctggattatcagcaggtttctaactcatgtctcatgtntcttagcctctactaaggcccttgctccattagggattaagacagaatctgtgaatgagcccata

SEQ ID NO: 6584 - DNA, 414 bp, Mus musculus
ttatctggtgaagtgctgtcgagcatacagaaagccctggtcctgctagctcccctaaagccaggtttggtggctcacctgtagtcagcactggagagagcccatgtgggagaatctaagttcacattcacccttggctatatggtgagttccaggccagcctgggctacacaagaccacgtctaaaaatgaaaacaagaaacaaacaaacatacaaaaaagaaaataataacttaggaagagccgttttgctgagcttgctaagtgtcagtgggagaatgtgtttcctggagaccaaagtcattcactgaagtcattcactcaggaattacatacacatggaaagtcacagacttagctgcgttccgagttactgaccaccagggggcagcatagcccttgctctcaagtaaa

SEQ ID NO: 6585 - DNA, 404 bp, Mus musculus
ggatgtaccaggtgtacagccaccacagcaaaatcattcaggaaagactacaagaatttacccagaagatggcaaagatcaaccatctggaaatggagcttaaacaagtctgccaaactgtggaaacggtgtacaaggacctatgtgtccagtctgaggttcccacttgcgaagaacagaattacaaagatggtgaatgctgacttctgctaagaggcttccatctcaatgtgagaaggcacagaggctgctgtttgaggcatgctgatattgttttttatagttctgtaacccaacacaaagccaccaatgctctttgtgctaattaccgtagtgtgacaaggtttgaccctgccataagccttgccttagcaaattctcccaacccacatctgtagttgatt

SEQ ID NO: 6586 - DNA, 407 bp, Mus musculus
  misc_feature (65)..(65): n is a, c, g, or t
  misc_feature (67)..(67): n is a, c, g, or t
  misc_feature (140)..(140): n is a, c, g, or t
  misc_feature (146)..(146): n is a, c, g, or t
  misc_feature (326)..(326): n is a, c, g, or t
gaagacccggaagtcatcccagagaacactgacctagtgactttatgtgtgaggaaggggctttngnactatcgggaagaaaacatcacaatagatcgcgcctgtagacaagaaatatttgcttatgaaatggaatctcntgcacnagggaagaaacctgaaaacccagcagacatgattgaagaaggagagtgtatcctatctgtgaacatcttatatcctgttatatttaataagcacaaagaacacaaaccataccagaccatgttggtactgggcagtcagaagctcacagaactgagagattcaatttgctgtgtcagtgncctccagatcggtggagaattcagcaacgcgccagaccaagcccctgagcacatcagcaaagacctctacaagtcggcttt

SEQ ID NO: 6587 - DNA, 225 bp, Mus musculus
gtctgtttgcatctatgtaaagccccatcctgactcaagcctgtcagacacaagatgttagaatttgtttaaaataaagggagatcaaaacagctgtcatagaacaagggggatgctaactaatgcagttacagcattgaaagatggattctttgctcaggctagaagggagcagttgctttctggcttgagtcggctttggttagcacaggatgctatgtgatg

SEQ ID NO: 6588 - DNA, 385 bp, Mus musculus
tatttaggaaagacctcacgggtgtaaaaaggccgaccaccatcttccctcccctaaccctgtgacaaacaagtctggctgcagtcaggatggtgggcagatggagctctgataggtcatacatgaatgtgaacgcaaagacatctcttgcatgcggctgctagctgtgggtaaggctgtcctggaactcctgcagctggctggagagggagagccatggcttccgggaggaagtggggctcctggagcaagtgtcaaagctttacagatccactgttaccttcacgttagcagaagctaaattttgttttttgtttttggttttttgttttttttaaatagggctgatttgatttgtgggattggtcactgacatggtttgcca

SEQ ID NO: 6589 - DNA, 530 bp, Mus musculus
  misc_feature (304)..(304): n is a, c, g, or t
  misc_feature (416)..(416): n is a, c, g, or t
gtactgtgtgacaatgcatcatgcatgaaccttcggtcagggatgtcgttggggaagtgacttcaaaagtattcaaaatttgacatgctgtttgtttagtcactacagtgccctcaaagggcagacattgcagcctttttatattgcctgccaaaatttgaagtattagaacaaagtgtgccatgagagaaaaacttaacaaggagttttgaaaagaaatgcaaagaacaaaactacaacactattttttaaaaagttgagtatctgagttaaaatttccaaatctttattttacaccaccttnaaaaattatatgagaacaaggtacatgcattatgtgtcacattactgggcaaactgttcaaatattttttttaaacctccctgtatagaaaatatcattaaggatgtaaaanccatgcttgcctatttgctgtatacatgtaatgaaattgtagataaagtgtagtgcattgaaacaaatgaacaaaaaagtagatacttttactatacaagggtgctggtgcaga

SEQ ID NO: 6590 - DNA, 262 bp, Mus musculus
gtgagcaacaacaggctgaccaccaacgggcttcctgtggagctgaaccaactcaagaacatccgcaccgtgaatctgggccttaaccacctggacagcgtgcccaccacactgggggccctgaaggagctccatgaggtggggctgcatgacaatctgctgactaccatccccgccagcatcgccaagctccccaagctgaagaagctcaacataaagaggaaccccttcccaaatgcagatgaatcggagatgttcgtag

SEQ ID NO: 6591 - DNA, 535 bp, Mus musculus
  misc_feature (288)..(288): n is a, c, g, or t
  misc_feature (295)..(295): n is a, c, g, or t
  misc_feature (298)..(298): n is a, c, g, or t
  misc_feature (300)..(300): n is a, c, g, or t
  misc_feature (303)..(303): n is a, c, g, or t
  misc_feature (315)..(315): n is a, c, g, or t
  misc_feature (319)..(320): n is a, c, g, or t
  misc_feature (322)..(323): n is a, c, g, or t
  misc_feature (326)..(326): n is a, c, g, or t
  misc_feature (346)..(346): n is a, c, g, or t
  misc_feature (365)..(365): n is a, c, g, or t
  misc_feature (385)..(385): n is a, c, g, or t
  misc_feature (388)..(388): n is a, c, g, or t
  misc_feature (486)..(486): n is a, c, g, or t
  misc_feature (508)..(508): n is a, c, g, or t
gaaaaagaccagctaaggcccaaggtgaatgtgtcttcttacatccattttatgctgaatttcagaaacaaattcaaggagcaacagccaaatacctaccttggctttaaagaattctctagaaagtgttcagaaaaatggagatccatctcaaagcacgaaaaggcaaagtatgaagccctagcagagctcgataaagcccggtaccagcaagaaatgatgaattacataggcaagagaagaaagagaagaaagagggacccaaaggcaccgcggaagcccccatcntccttcntgntnttntcccgggaccantatnntnntgntgaagcaagagaaccccgantggaccgtggtgcaggtgnccaaggctgctgggaaaatntgntccacaactgacgaagcagaaaaaaagccctatgaacagaaggctgcacttatgcgggcaaagtatttcgaggaacaggaggcctaccgcaaccaatntcaaggcaggaaggggaatttnttggaatcagccaagaccagtttgaaa

SEQ ID NO: 6592 - DNA, 145 bp, Mus musculus
aagctagcaagaacagatcactggcagattttgaaaaggccctgacagactacagggcagagctccgggatgacccaatcatcagcacacatttggccaagctgtacgataacttactggaacagaatctgatccgggtcatcga

SEQ ID NO: 6593 - DNA, 288 bp, Mus musculus
  misc_feature (131)..(131): n is a, c, g, or t
  misc_feature (248)..(248): n is a, c, g, or t
gttagacttttcaagtatactccataactctaaatgagcagcagtaagatgactttcagacaacctgtatactttctaatagtatcaggttggcccattctttattgaagcataaagaaccaatgggtagnctcgtgggctcctgtgatatcactgagatgggaggaactgtatcatacatagtaacgttcaagaaatgcattgcctcagttttacctcccagccccatagacatttcagggcttttntagtctgctagagttcttttctgtgtgaccatttcctgtg

SEQ ID NO: 6594 - DNA, 266 bp, Mus musculus
gtatagtgttcaaccttaaatgcatgactctgtatattatgtatagaagacaatgttttttaatttataaagttcagccttcattaatcgcatgggtttttctgcagctttttgtgaatactattgttttgtgtaatagaaacatttgtatatatttaatatcaaaatatccatgtggatagtaaaagtacttcattggacctactgtggatatttgtaggagtctttatctacaaataaagcaacagatagttttgtatttagtt

SEQ ID NO: 6595 - DNA, 89 bp, Mus musculus
  misc_feature (32)..(32): n is a, c, g, or t
tgcccaacttcagcgagtgctggtgggaccantggatcatggacgtcctcgtctgcaacgggctgggcatctactgtggcatgaagacc

SEQ ID NO: 6596 - DNA, 317 bp, Mus musculus
atcacctgagcactcgagccgaggcacctcagagcctttgcagattagtcaagtatctttgatctccaaagacacagagccagtagaattaaactgtaatttttctttttcaaggaaaagaaaaatcagttgtaccatctgtggtcataaatttcttcgaaagagccagttactggaacacatgtatacacacaaaggtaaatcctacagatataaccgttgccaaaggtttggaaactcattggcccagaggtttcagcagtattgtgacagctggcccgatgtccccttaaaaagctctcgcttgtcacaagaac

SEQ ID NO: 6597 - DNA, 559 bp, Mus musculus
  misc_feature (33)..(33): n is a, c, g, or t
aaatctgtggccatagaactttttatttttaancatcccatttttatgccttaccatggtgttgatttgtagatttcctacacggatgacctgctctcctccgactacagaaaagccttcttccactagcagctcgggacttgctgtggtctcacaggcaggctctgcagacctgttctcagagcccagcatcacttgctcagattttacagtgtcactagaggaacctgcccaatcatcagaatggctgaacatttgtcttgtaaggtaccgttttccttgaggttttagactagttgtttacattacaacccctgcccccaccctctcagtgatacttttactgggaatgtcaggactgaaacaagcaaggaagagacagaaggagtcagacacaaatgaaggaaccagctgagaggatgttcttcagaaacgcaggtttactgtacatggggcaaaatccaggctgttcaagtgttaaagttgtttttattttaaaaagccaccagtaataatctggaatttttacttttaaagctgcttagcctcaattttaaca

SEQ ID NO: 6598 - DNA, 549 bp, Mus musculus
  misc_feature (509)..(509): n is a, c, g, or t
gaagttctgggatacgcggtcctcaaatcctatgatggtcttgcaactccctgaacgctgttactgtgcagatgtgatatacccgatggctgtggtagccactgcagagaggggcctgattgtctatcagctggagaaccagccctctgagttcaggagaatcgagtctcccctgaagcaccagcatcggtgtgtggctatttttaaagacaaacagaacaagccgactgggtttgctctgggcagcattgaggggagagttgccattcactacatcaaccctccaaatccggccaaagataacttcaccttcaaatgccatcgatccaacggtaccaacacttcggctcctcaagacatctatgcagtgaatgggattgccttccatcctgtccatggtacccttgccactgtgggctccgatggtaggttcagcttctgggacaaagatgccaggaccaaactaaagacttcggaacagttagatcagcccatcgcagcttgctgcnttcaatcacaatggaaacatatttgcctatgcttccagct

SEQ ID NO: 6599 - DNA, 579 bp, Mus musculus
  misc_feature (91)..(91): n is a, c, g, or t
  misc_feature (348)..(348): n is a, c, g, or t
  misc_feature (421)..(421): n is a, c, g, or t
  misc_feature (429)..(429): n is a, c, g, or t
  misc_feature (458)..(458): n is a, c, g, or t
  misc_feature (485)..(485): n is a, c, g, or t
  misc_feature (534)..(534): n is a, c, g, or t
  misc_feature (549)..(549): n is a, c, g, or t
atttacgagatgtcctcaaggtgcaggaacaggaactgaagtatgaatttgaacagggcctgtctgagaaactgtctgagcaagaattagnagtttcgtcgtcgcagtcaagaacaaatggacagctttactctggacataaatactgcctatgccaggttgagagggattgagcaggctgttcagagtcatgcagttgctgaagaagaagccagaaaagcccaccagctctggctttcagtggaggcattaaagtacagcatgaagacctcatctgcagaaatgcctaccatcccattggggagtgcagttgaggccatcagagtcaactgttctgataatgaattnacccaggctttaactgcagccattcctccagagtccctgacccggggggtatacagtgaagagaccctaagancccgtttntatgctgttcaaaaactagcccgaagggnagcgatgattgacgaaaccagaaatancctgtaccaatacttcctttcctacttacagtccctactcctgttcccncctaagcaactgaancccccggcggagctctaccctgaagatata

SEQ ID NO: 6600 - DNA, 555 bp, Mus musculus
  misc_feature (359)..(359): n is a, c, g, or t
  misc_feature (477)..(477): n is a, c, g, or t
tgacctcgagtcagtagtccagcaagtcgaacagaaccttgaactgatgaccaaacgggctgtaaaagcagaaaatcatgtcttgaagctgaaacaggaaataaatttgcttcaggcccagctctcaaacttgaggcgagaaaatgaagccctgcggtcaggccagggtgccagcctttctgtagtgaagcagaacaccgacgtggccttgcagaacctccaccttgtcatgaacagtgcacacgcatccataaagcagctggtgtctggggcagacacactgaaccttgttgctgaaatcctcaagtctatcgacagaattagtgaagttaaagatgaggtggactcttgagacgctntacctgccaccgggtcccgtcacctctgcaccgaaggcaccacacatcttccgaatgtgttcctgtctatgcagtcctcatcaaagcatttcacggcctaatcatgtgactggccatntgcagtacggggctcctttccaccagttgaacctaacagtttacatgaagtcccactgttcgatagactcactgattt

SEQ ID NO: 6601 - DNA, 389 bp, Mus musculus
  misc_feature (244)..(244): n is a, c, g, or t
  misc_feature (248)..(249): n is a, c, g, or t
  misc_feature (251)..(252): n is a, c, g, or t
  misc_feature (265)..(265): n is a, c, g, or t
  misc_feature (279)..(280): n is a, c, g, or t
  misc_feature (333)..(333): n is a, c, g, or t
  misc_feature (341)..(341): n is a, c, g, or t
tctaggacgaggtcgggctcagcctcagtgttgtcaagtggaacacgaagtgagccagtgtgtaagtgagcagcctgtacagagacgcgtgcctcactgaggcagcaccgcttggtacgtgctgccgtcctcccaccaggaccataggaccaaggtcacacactgtgcacagtgcaaagcttcatacaccctctactgtgtgctgtcagctttggaaagccatttggggctgtcgattttgatncacnntnnatgtgtttgtgtnccttttgtatagtnncaattcagactggaattaaagcacacacccacctggggggtcagcaccagctntttgggcnggctggctggtttttgaaggacaggcaagacataagcagctccctgtg

SEQ ID NO: 6602 - DNA, 469 bp, Mus musculus
  misc_feature (66)..(66): n is a, c, g, or t
  misc_feature (87)..(87): n is a, c, g, or t
aggagcaggaggtctgcagtttctcactttggattcctttacatctctaagaatatggtaagaaanaaaaaagtacaaaaacaaaanaagccacatggagaccttctcaccctttactaacatagcagaaggaaagaaacaaacaaaagcgggttgtcgctaaagccttcaacactacaatagactgtgagtcgaaaaagaaaagccacagtcctgttgcttggagaatggatcgaactagagaacattacagtaggcacaggaaagtggatgcggaaaaataaccaaggacactgtctgtcattcacagccgctaggggcaacattttaaatggagggggaactctctgggataaaaggagaaccaggaggaggcgggcgagggtaagggtgggtgtgatcagagcacatcatacaggtacctcatacacattggagaaaaggaagctcattacctcatacaatatac

SEQ ID NO: 6603 - DNA, 472 bp, Mus musculus
  misc_feature (29)..(29): n is a, c, g, or t
  misc_feature (33)..(33): n is a, c, g, or t
  misc_feature (36)..(37): n is a, c, g, or t
  misc_feature (290)..(290): n is a, c, g, or t
  misc_feature (292)..(292): n is a, c, g, or t
  misc_feature (298)..(298): n is a, c, g, or t
  misc_feature (300)..(300): n is a, c, g, or t
  misc_feature (309)..(309): n is a, c, g, or t
  misc_feature (321)..(322): n is a, c, g, or t
  misc_feature (331)..(331): n is a, c, g, or t
  misc_feature (397)..(397): n is a, c, g, or t
  misc_feature (424)..(424): n is a, c, g, or t
gtggtccggttgttagttctctatatcantganagnnaacaatcagggaagaagacaaaaacatatttgattactgcagggaaaacaacattgaccatatagccaaagccatcaaatcgaaagctgcggatgtgaatatgacagatgaagagggcagagctctgctccactgggcatgtgaccgaggacataaggaactggtgaaagtcttgctacagtatgaagctggcattaattgtcaggacaacgaaggtcagacagctcttcattatgccgctgcctgcgagttntnttgganantcgtggaanctgctgctccanntctggcgcntgaccccaccctccgagaccaagacggctgcttgccagaagaggtgacgggctgcaaagcggtctntctgctgctgcagcggcacagagctancaaggcttgatccaaagcctgaagaagcacagtttggcagactaggac

SEQ ID NO: 6604 - DNA, 167 bp, Mus musculus
gttggagcgagatttgtttaaacaagtatttctaaaagaaatattgtacatagtcctggaaattatttgtggtaaggaaatattctttaatccagttgcatttctcagacaatgaagtggtgcgtccatgctacctcctgctttgtcaacaaagatgctatttaccc

SEQ ID NO: 6605 - DNA, 442 bp, Mus musculus
  misc_feature (68)..(68): n is a, c, g, or t
aggaaatattctttaatccagttgccatttctcgacaagaagtggtgcgtccagcctacctccgcttnttcaacaaagagctatttaccctttccatttgtatcataatagattttaaaaatctaatgttctttattgcaagacatacttttgttaacagaatttgtttctttgtaacgttttccatacgtttgacatgcttacaggacagggttgtctttatttaacattgtagaaatgtaattaataaacaaggctcactacacaatttagaataggctttctcatttatattccaaatttgatcatttagcaaaactattgatacacaaaatatttctacatatgagaatgtttacaatttgaattttagaagttgtttttggatgtgattctatgtatgaaaattgtgtaacactatgctcatgctaagaaccgactt

SEQ ID NO: 6606 - DNA, 190 bp, Mus musculus
aagttcgggattggctggcctccaccttcacacggcagatggggatgatgcttaggagaagtgatgagaagcccaggttcaagagcatcgtccatgcggtgcaagctgggatatttgtggaaagaatgtacagacggacatcaaacatggttgggctgagctatccaccggctgtaatcgatgcattgaa

SEQ ID NO: 6607 - DNA, 466 bp, Mus musculus
aggcaactgggatcgctcttttggaggaggaatgaatttatctagcaagctggcccaactcacttgccatggcaatctctgccacagcttccagtccttcaatacttcatatacagacacaggattatggggactctatatggtctgtgaacaagccacggttgctgacatgctgcacgttgtacaaaacgaatggaagcgtctgtgtacagatgtgactgagagtgaggttgcacgtgcaaaaaatcttctgaaaacaaacatgctgctgcagcttgatgggtcaactccaatttgtgaagacattggtaggcagatgctatgctataataggagaattcctatccccgagcttgaagcaagaattgatgctgtggatgcggagacggttcgacgagtgtgcaccaagtacattcatgacaaaagcccagctattgctgctctgggtcctattgagcgactacca

SEQ ID NO: 6608 - DNA, 454 bp, Mus musculus
gccaacttgatagaacggcgacagtttgaaacaaaggagaacaagcggctactagaaaagtctcagcgggtggaagccatcatggcatccatgcaggccacgggtgcagaggaggtgcagctgcaggagatagaggagatgatcacagcccccgagcggcagcagctggagacactgaaacgcaacgttaacaagttggacgccagtgagatccaggtggatgaaaccatcttcttactggaatcatacattgagagcaccatgaagaggcagtgacccagaagaagcaatgctgggatcaaactcagggcctttcacatgctagtcaactgatgttccactgagcacatccccaaccagaaaccagcatccttctcagaagatctagcagatcgaggaggacgaggacgaggaggaggaggaggaggtggtgactagatgagttctttgcagt

SEQ ID NO: 6609 - DNA, 456 bp, Mus musculus
atccctgatgatggtgttggccgaccaggacaccggtactaaggtgagcagagccgccaacaggaaaagcactcccgccacgatggtgatcttggccttggccgtctcgtcttgtacgcagttggtacactgggcgcccacgagcgccacgaggagcccgaaggcggccagcaggatggacaccacgatgagggctcgggcggcctgcaggtcctgcggcagggccagcagcgagtcgtacattttgcactgcatctgaccggtgctctgcaccacgcagttcatccacaggccctcccaggtgatctgcgccgtgatgatgctgctgccgatgaaggccgaaacgcgccacatgggaagggcgcagcacacgatggtgcacagccagcccagcacggccagcgacgtgccggtgatctccaggcccatggacatggctgctggacttgaaccggc

SEQ ID NO: 6610 - DNA, 129 bp, Mus musculus
  misc_feature (38)..(38): n is a, c, g, or t
  misc_feature (44)..(44): n is a, c, g, or t
atgggtctgacagtgttgtcatgactggatcctacaanaatttnttcagaatgttcgacaggaacacaaagcgggatataaccctagaagcatcacgagagaacaataagcctcgcacggttttgaagc

SEQ ID NO: 6611 - DNA, 333 bp, Mus musculus
  misc_feature (29)..(29): n is a, c, g, or t
  misc_feature (53)..(53): n is a, c, g, or t
  misc_feature (276)..(276): n is a, c, g, or t
  misc_feature (284)..(284): n is a, c, g, or t
  misc_feature (288)..(288): n is a, c, g, or t
  misc_feature (297)..(297): n is a, c, g, or t
  misc_feature (304)..(304): n is a, c, g, or t
ccatccaacagaaggctccaatcaaacantcttaaccgacgagtcaagcttcntccctcctgaggagacaagattcctccttcctgaggagccgggtaaggagctcatcgttgagagaggccctatgcaggcaatgaatgagattgatgcccagctgttgttgaacaaggaaggatcaccgagtaattaactataagtatttggttataaaaacagatctttgtgtgtcacataaatgttctcattttgatactgcacatttcagagaaatatatntacatttntacntcctatatntacattntctgacatcctaaggacatattcaataaa

SEQ ID NO: 6612 - DNA, 426 bp, Mus musculus
  misc_feature (67)..(67): n is a, c, g, or t
  misc_feature (145)..(145): n is a, c, g, or t
  misc_feature (262)..(262): n is a, c, g, or t
  misc_feature (286)..(286): n is a, c, g, or t
tttttcaaccaattccagcctcagatttgaatgctaccaatgaagacaaactgtcagagctcgaggnaaatcaagctgaagttaatgctggggatctcgctgatgacactggttctgctaatccccctcttgatattctgctttnccacactgtacaaactgagacacctacgtgacaaaagttatgagagtcaatactccatcaacccagagctggcaactctatcttacttccatccaacagaaggctccaatcaaacantcttaaccgacgagtcaagcttcntccctcctgaggagacaagattcctccttcctgaggagccgggtaaggagctcatcgttgagagaggccctatgcaggcaatgaatgagattgatgcccagctgttgttgaacaaggaaggatcaccgagtaattaacta

SEQ ID NO: 6613 - DNA, 537 bp, Mus musculus
  misc_feature (77)..(77): n is a, c, g, or t
  misc_feature (81)..(81): n is a, c, g, or t
  misc_feature (89)..(90): n is a, c, g, or t
  misc_feature (104)..(104): n is a, c, g, or t
  misc_feature (108)..(108): n is a, c, g, or t
  misc_feature (126)..(126): n is a, c, g, or t
  misc_feature (129)..(129): n is a, c, g, or t
  misc_feature (135)..(135): n is a, c, g, or t
  misc_feature (143)..(143): n is a, c, g, or t
  misc_feature (147)..(147): n is a, c, g, or t
  misc_feature (162)..(162): n is a, c, g, or t
  misc_feature (171)..(171): n is a, c, g, or t
  misc_feature (220)..(220): n is a, c, g, or t
  misc_feature (228)..(228): n is a, c, g, or t
  misc_feature (243)..(243): n is a, c, g, or t
  misc_feature (247)..(248): n is a, c, g, or t
  misc_feature (253)..(253): n is a, c, g, or t
  misc_feature (279)..(279): n is a, c, g, or t
  misc_feature (296)..(296): n is a, c, g, or t
  misc_feature (299)..(299): n is a, c, g, or t
  misc_feature (380)..(380): n is a, c, g, or t
  misc_feature (385)..(385): n is a, c, g, or t
  misc_feature (407)..(408): n is a, c, g, or t
  misc_feature (434)..(435): n is a, c, g, or t
  misc_feature (510)..(510): n is a, c, g, or t
tgaagggcagaaaaccgtccaggtggctggacgatctttggaaatcaaagagggaagtcttctgcattgagacctanctgnaggacgannaccagctgcatctngtgnccagacatttgcaagaantgnccaagnaagcagangagnccctgctctcgctgncaagagganacaaagtgaggtttaccatggaagttctttttccagaagccatcatctnctccatcnctgccctggatgagntcanntacanggaggcagaagagaagtacctgcgtngcccacccgtgcactanccntgagaaagagctattcgacaagaccatcttaaaggcggccaggaagaggtcagcagccaggattcgggctgccagggaccntcctntgcccactccttagaagggatnntcctcctttcagctgtcacccctgannctcccaagacaggagacaggaagtgcctccaaactggaacatctgggagaccgtgggggcacacaatggctgctntcaaagctcctcactaagtgtttcttt

SEQ ID NO: 6614 - DNA, 499 bp, Mus musculus
  misc_feature (37)..(37): n is a, c, g, or t
  misc_feature (86)..(86): n is a, c, g, or t
  misc_feature (209)..(209): n is a, c, g, or t
  misc_feature (212)..(212): n is a, c, g, or t
  misc_feature (411)..(411): n is a, c, g, or t
  misc_feature (443)..(443): n is a, c, g, or t
ccgcttccgcaacctgttagaaaatgcctggctcaanggtgtggcactgcctacttggggtcacaaggcctccggagcagatcgancttcgcctcacccccagctcttgggcagccagacccatcatctgtagcattgttaccagggctattgggacagcccaccatccggggactgctgtgtacctgtcctgacatccagctgcccanggnctaggagtggatatgaggctgagcccacctaaccgggcagagacttgctgaacttttaacttgaggatccttctcttgagaaaacctgtgggcattggagccaaccccacctggccttgaatcctgactgttgtgtcctgggcaagcacttcacctctcatgagcccttgttccccatttgtagaataagacaacacancctacctcacaagggttgttgtggggatgatntctgaaatacaactaccatgctttggtttgcttcttgcccgggataggcctgggac

SEQ ID NO: 6615 - DNA, 226 bp, Mus musculus
ggcagtaaggattttcgcacaggaaaagaagttgctccatggctactacgtgtatgaggtgaccgtgcagcctactggtggattcgaggaagtggccagtgaggacttggaacctagtgaagaactagaccagccctgttttgaggagtcagtagaagacgccctgagtgacgagcacagtgaggttttggatgtgatatccagtgaggagctggaccttagtgaa

SEQ ID NO: 6616 - DNA, 404 bp, Mus musculus
  misc_feature (30)..(30): n is a, c, g, or t
  misc_feature (249)..(249): n is a, c, g, or t
  misc_feature (371)..(371): n is a, c, g, or t
ctgtgctacgggttgatgaccggcagcggntagccagagaacgccgagaggaacgagaaaaacagctagctgcacgagaaaccgtctggctagagagagaagaacgagcccggcagcactatgagagacatctggaggcgaggaagaagaagctggaggaccaacggctgaaggaggagcggaggagggctgcggtggaggagaagcggaggcagaggctggaggaggacaaggagcgccatgaagctnttgtccgacggacgatggaaaggagccagaagccaaggcagaagtctaaccgctggtcctggggaagccctctccatgggagctcgagcatccacagtggagatccagacaggcgctcagtntccaccatgaatctttcgaaacatgttgatcct

SEQ ID NO: 6617 - DNA, 525 bp, Mus musculus
  misc_feature (348)..(348): n is a, c, g, or t
  misc_feature (371)..(371): n is a, c, g, or t
  misc_feature (413)..(413): n is a, c, g, or t
  misc_feature (423)..(423): n is a, c, g, or t
  misc_feature (497)..(497): n is a, c, g, or t
aaacagtcctgatccaggcgacctccatgctacaggacattgtgcacatgcaaacagaggcggaggacggcgactttgatgtggtgttccaactgcagcgcaaggagctgctgcagcaactgctggtattgctcagctcaggggtggttttgaaaacacagccggacatgggttcccaccaggacaagcagccccagggcctatccaaagaaagccaacgcatcacccagacatccaaggaaggggctgtttctctgctgcagcagctctcgaccatcacaacctataagccaggggatcttgggctggtgcctcgacgtccggtccgcatcccactcaaaccccagnatctcaggcccctctcctatatnacccgaatggggatctgccagaacacgaatgagatctacccntctggagctntcaaaaggttcagaaagtttacccttcctagacctttcctacaccgcaaatagcgaacggggagaccaagctgntgcagaaacagactgatgtggccacagt

SEQ ID NO: 6618 - DNA, 450 bp, Mus musculus
  misc_feature (292)..(293): n is a, c, g, or t
  misc_feature (295)..(295): n is a, c, g, or t
  misc_feature (310)..(310): n is a, c, g, or t
  misc_feature (312)..(312): n is a, c, g, or t
  misc_feature (321)..(321): n is a, c, g, or t
  misc_feature (343)..(344): n is a, c, g, or t
  misc_feature (350)..(350): n is a, c, g, or t
  misc_feature (354)..(354): n is a, c, g, or t
  misc_feature (359)..(359): n is a, c, g, or t
  misc_feature (362)..(362): n is a, c, g, or t
  misc_feature (364)..(364): n is a, c, g, or t
  misc_feature (367)..(367): n is a, c, g, or t
  misc_feature (398)..(398): n is a, c, g, or t
tgatgagttccagttattgcagagaaacttcatggacaagtactaccaggaatttgaagacacagaagagaataaactcacctatacacccatttttaatgaatatatctccctggtagagaagtacattgaagagcagttgctggagcgtatcccaggcttcaacatggcggccttcacaaccacgctgcagcaccacaaagatgaggtggctggcgacatctttgacatgctgctcacattcacggattttctggctttcaaggagatgttcctggactacagagcagannanaggaaggccgaggantnggacttaangcagcggcttggttgtgacttnntctgtntaantcatnttntnacnccagcttcccagaacaacctgcggcactagntcccaccttcgcacaaccggtgtgattgacatgagttcaccagaccagcagg

SEQ ID NO: 6619 - DNA, 243 bp, Mus musculus
cgttgccatggctgcaacacttacacagcagcaacagcctgctacagggccacagccgtctctgggagttagttttggaacgccattcggctcaggtattggcactggcttgcaatcaagtggcttaggttcttcaaaccttggaggatttggaactagctctggtttcggatgcggtaccacaggggcctccacatttggatttggaacaacagataaaccctcaggaagtcttagtgcagg

SEQ ID NO: 6620 - DNA, 409 bp, Mus musculus
  misc_feature (289)..(298): n is a, c, g, or t
  misc_feature (322)..(322): n is a, c, g, or t
  misc_feature (351)..(351): n is a, c, g, or t
  misc_feature (358)..(358): n is a, c, g, or t
  misc_feature (360)..(361): n is a, c, g, or t
  misc_feature (371)..(371): n is a, c, g, or t
cttagcaagcatgtctgtagtagatatgtctgcagaaaaaatgacaaaactagaagagaatttgcaaagagctgtggcacttaagaagactgtcgacaggtggcggaattttcatattcactgtatgtggcagacaacattggaccaacggagaaacctatttgctgccctaaggatgaaggatactaaggaacaggaattagcactgtctaacaaacagctactagtggtccgtcaagctgccttacacgagctgtttgaaaaggagtatcagcagtaccagcaggannnnnnnnnnatgggcaaagctttttatgagganagactctgacagctgccaagacactgttnttccacntnntcacgcctgntaagcaagccttcatgctttaccctgagcttcccaaaa

SEQ ID NO: 6621 - DNA, 430 bp, Mus musculus
  misc_feature (331)..(331): n is a, c, g, or t
  misc_feature (337)..(337): n is a, c, g, or t
  misc_feature (356)..(356): n is a, c, g, or t
  misc_feature (400)..(400): n is a, c, g, or t
aacatcccagcgtgcaggactccgtgcgtctctgaggagattttggagctcctttgtcaaattctacaaacagattctctaagggctattcagttctggctgctttatgctccatcaaaagaaaaagatttagctctggggcttctgcaaactgccgtggctcagcttatcccccagcccctttcctccatcccagcagagaagctctggaaccatctccaagagcttcaagagcctcaagagacacaagaggcagcctacagtccatccctgaagaagactaggtcaccacctctacccaaaacagacaaaccagagtacataggcaaancccaantcctcctggtgcatcccancgaggacccagaggagaaaacgaccaaggctgaaagctgaagancccagaccagagcacggagacttctgccta

SEQ ID NO: 6622 - DNA, 62 bp, Mus musculus
gtggcattgacctgttgatgaaagatgacggctccttctgtgtctgcgaggccaatgcaaat

SEQ ID NO: 6623 - DNA, 518 bp, Mus musculus
  misc_feature (202)..(202): n is a, c, g, or t
  misc_feature (204)..(207): n is a, c, g, or t
  misc_feature (209)..(210): n is a, c, g, or t
  misc_feature (213)..(215): n is a, c, g, or t
  misc_feature (222)..(222): n is a, c, g, or t
  misc_feature (288)..(288): n is a, c, g, or t
gaggccaatgcaaatccttttcaggagccaaaatatacaaatacaaacaaacaaaaaatactcagagaaaatactttccttcttcccccttcctgctgatgagtgagacgttttgggagctttggggtcagtgcccttctaaacttcccctcccccagtaacgcagctgcgcagtgcgtgctcagtgcagtggctcggaccntnnnnannccnnnctgctgncagcagagagataaactggtaggtggcagcagagaaaggaattcttcagactgatggctgttgacnttaaacctacataggagaagagatagcatgtgacgtaccaagtggagcgaggggcagcacagatgaaaactggactcaggaaggctgcctctttactgaatgttgtctccattgatgaagtaaccagtgatgttctggatgaagatagatctttgtcaccttttagagggggggaagaatgcagaataagaaggaattggttctttatatcttgttgcattcagtgtggg

SEQ ID NO: 6624 - DNA, 489 bp, Mus musculus
  misc_feature (294)..(294): n is a, c, g, or t
  misc_feature (302)..(302): n is a, c, g, or t
  misc_feature (318)..(318): n is a, c, g, or t
  misc_feature (321)..(321): n is a, c, g, or t
  misc_feature (327)..(327): n is a, c, g, or t
  misc_feature (342)..(342): n is a, c, g, or t
  misc_feature (357)..(358): n is a, c, g, or t
  misc_feature (372)..(372): n is a, c, g, or t
  misc_feature (385)..(385): n is a, c, g, or t
  misc_feature (387)..(387): n is a, c, g, or t
  misc_feature (389)..(389): n is a, c, g, or t
  misc_feature (391)..(392): n is a, c, g, or t
  misc_feature (407)..(407): n is a, c, g, or t
  misc_feature (409)..(409): n is a, c, g, or t
  misc_feature (413)..(413): n is a, c, g, or t
  misc_feature (419)..(419): n is a, c, g, or t
  misc_feature (422)..(422): n is a, c, g, or t
  misc_feature (429)..(429): n is a, c, g, or t
  misc_feature (446)..(446): n is a, c, g, or t
ttggtggctgttgtctcgctgcgctccgcgtccatgacgcctaacaccgcgtccagcatagaggggcccaggtccaggtggaaatacagcagcgggtccgcaggtgaaggcacagccacagggggctgtggggctgcaggtggagcgacagaatgtggggccacaaccggtggggctccaggctcgggaggcggaccgcccccgtggcgactcaggaatgaggtgtccccgaaggcgtcgccaccgcgtcccacgtgcaatgtgtgcctgaagtctccgaggggtgctgagatngagagtgntccgcgatccagccgnttnttgggntgtgcagggcccagntgcttcattaccggnntctgtggggacatnggcatatcagagntncntnntccgggagccccaantntgtntccctntcntacatantcagccacagaatgctntcataaaacagggctatggaagaactattattcccagttaaca

SEQ ID NO: 6625 - DNA, 502 bp, Mus musculus
  misc_feature (143)..(144): n is a, c, g, or t
  misc_feature (220)..(222): n is a, c, g, or t
  misc_feature (287)..(287): n is a, c, g, or t
  misc_feature (359)..(359): n is a, c, g, or t
  misc_feature (399)..(399): n is a, c, g, or t
  misc_feature (409)..(409): n is a, c, g, or t
  misc_feature (467)..(467): n is a, c, g, or t
ggcctgtaaaccacagcctgcagaagagaagctcaggaacttgaaatgctgactacaagtggaagttgttagatctgaacggccaaggagaaaacaaaaacacgtatctaaggaggaagtgtattatctgaagaacagaaaannaaagagaaacagcctcagaaaggtgttggacaacagttagcatagcattattcatggaaccagagcgtcagaagannntagaggcagagaagcaagaaaagatgttcaaagaaatagaccaagctgagcagcatggtaggcangaacaggaagatcaagagttttaggccacgtgggctacatagcaggatgctggggtaaaagtggggggtgtntgatagcacccaagtttactttaaaacatttatgtagtcntcagaaagancaagaaacagtagatgggattaagagatccatatcaggtttattacagtaaagatgtntcaaaacaatttttcttttgcagggaaattccaat

SEQ ID NO: 6626 - DNA, 553 bp, Mus musculus
  misc_feature (26)..(27): n is a, c, g, or t
  misc_feature (29)..(29): n is a, c, g, or t
  misc_feature (319)..(319): n is a, c, g, or t
  misc_feature (323)..(323): n is a, c, g, or t
  misc_feature (332)..(332): n is a, c, g, or t
  misc_feature (336)..(336): n is a, c, g, or t
  misc_feature (347)..(347): n is a, c, g, or t
  misc_feature (350)..(351): n is a, c, g, or t
  misc_feature (355)..(355): n is a, c, g, or t
  misc_feature (399)..(399): n is a, c, g, or t
  misc_feature (424)..(424): n is a, c, g, or t
  misc_feature (426)..(426): n is a, c, g, or t
  misc_feature (472)..(472): n is a, c, g, or t
  misc_feature (475)..(475): n is a, c, g, or t
  misc_feature (487)..(487): n is a, c, g, or t
  misc_feature (528)..(528): n is a, c, g, or t
tgaatccctaaacagggtttgccagnnancaaaatagaataaaagaccttcaaaaggaatataaaatgttacagatgaaatgccagcaatataagaaaaaccgaatggagcaagaggggaccattgcttctttgcaaaaggagatccacagacttgccaaagaggaggaagagcgcatcctcactcagaacagagtgtttgcccatctctgcagaagagtccctcactcagtcttggataaacaattgctgtgtctaattgattactatgaatgtaaacttagaaaacttcatatacaaaggcagtttgaggaagacantcantcagaaganaaanacttcacaaanccnnggtncctcaccaaattataaaggcgttctgatggtatggagaccagancactgacaaataccttttcataaancnaaatattcccctaagagagttccttattttactgtgaaatgcattncantcgttacagaancaactcaaggaatccaaatccaggatcgacgtgctggtagncccacagaacatgaattaagacttt

SEQ ID NO: 6627 - DNA, 480 bp, Mus musculus
  misc_feature (388)..(388): n is a, c, g, or t
  misc_feature (407)..(407): n is a, c, g, or t
  misc_feature (452)..(452): n is a, c, g, or t
agaagagacccttgcacaatgcctgaagaaaataacacacataaatttctcagacagaaatatagactcgattgatgacctctctctttgcagaaacctgagtgttttatatttatatgataatcgcattagtcaagtcactaacctgaattacaccacaaatctgacccacttgtacctacagaacaattgcatttcctgcattgaaaacctcagttcactaaagaaattggaaaaactgtatctgggaggcaattacattgcggtcatagaaggcttggaaggattagaagaactaagagagcttcatgttgaaagtcagaggctccctctaggcgaaaagcttctgtttgatccaagaactcttcgttctctagcgaaatccctntctactttgaatatcagcnacaataacattgatgacataaaagacttagagatcttggagaatnttaatcacctgattgcagttgacaacca

SEQ ID NO: 6628 - DNA, 353 bp, Mus musculus
  misc_feature (94)..(94): n is a, c, g, or t
  misc_feature (147)..(147): n is a, c, g, or t
  misc_feature (170)..(171): n is a, c, g, or t
  misc_feature (173)..(173): n is a, c, g, or t
  misc_feature (180)..(181): n is a, c, g, or t
  misc_feature (192)..(192): n is a, c, g, or t
  misc_feature (257)..(257): n is a, c, g, or t
  misc_feature (263)..(263): n is a, c, g, or t
  misc_feature (274)..(274): n is a, c, g, or t
  misc_feature (278)..(278): n is a, c, g, or t
  misc_feature (308)..(310): n is a, c, g, or t
  misc_feature (318)..(318): n is a, c, g, or t
gcaaagactgctgcatcaaaatttgggacctggctcagcaggtatcactgaattcataccgagctcacgctggacaggttacctgtgttgctgnctctccccacaaagactctgtgtttctttcatgtagtgaggacagtagaattntgctctgggatacccgctgtccnnangccggcnntcacagatggncctgcaatgcctctggctacctccctaccgctttggcttggcatcctcagcagagtgaagtcttngttttnggtgacgagantggntctgtctcccttgtggacaccaagaatgcnnnctgtaccntcagctcagctgtgcactcccagggtgtcactaga

SEQ ID NO: 6629 - DNA, 500 bp, Mus musculus
  misc_feature (43)..(43): n is a, c, g, or t
  misc_feature (123)..(123): n is a, c, g, or t
  misc_feature (170)..(170): n is a, c, g, or t
  misc_feature (412)..(412): n is a, c, g, or t
  misc_feature (473)..(473): n is a, c, g, or t
gcattgcggtgacggctgtttaattaaggtccatcgtcaccantcttggtttatgctggccacttccagatacttacatgaattccaaaccagttattattaacatgaacctgaacctgaacnattatgactgtgcttttgataaccagtctttgtttaatcagttttcnaaaatagataaacagaaatttgagagactcaaagacataatacttgatgtataaaatggaactaattgttgagattattgtgattttctaagactgaatagtttgcatttaattttgctagctgtttggcaaaacctgtcaacttctaaacatgtttctaggtatttatagaaatcatcgttaggatttgactatcttaacacaaaaataaatataaaataatcaattttaaatagtaaatngatataagcttacctttatgctttttgaaaatttaagttattatgaaaatagtaatatttntcatagctcattgtgcactgtatagtc

SEQ ID NO: 6630 - DNA, 558 bp, Mus musculus
  misc_feature (249)..(249): n is a, c, g, or t
  misc_feature (272)..(272): n is a, c, g, or t
  misc_feature (274)..(274): n is a, c, g, or t
  misc_feature (277)..(278): n is a, c, g, or t
  misc_feature (282)..(282): n is a, c, g, or t
  misc_feature (284)..(284): n is a, c, g, or t
  misc_feature (286)..(286): n is a, c, g, or t
  misc_feature (290)..(290): n is a, c, g, or t
  misc_feature (292)..(292): n is a, c, g, or t
  misc_feature (301)..(301): n is a, c, g, or t
  misc_feature (304)..(304): n is a, c, g, or t
  misc_feature (308)..(308): n is a, c, g, or t
  misc_feature (311)..(312): n is a, c, g, or t
  misc_feature (318)..(319): n is a, c, g, or t
  misc_feature (326)..(326): n is a, c, g, or t
  misc_feature (335)..(335): n is a, c, g, or t
  misc_feature (379)..(379): n is a, c, g, or t
aagtcttattattctctgcgagccttcagtaaaatctttgtgtgacggtctggaaaaagccattttccaagtgaagtcggggacattgccagctccagaaaatatccacaatgtagtgaagactttctacacctggcggaacgtggcagagagaactgaaaaggtgtatgagcgagtgtcgaaggaaactgttttgccaatgcacaagagattggacaggctcatctcacactgtggccctgtgacggnctacatgtttgctttgctggctntnctnngctntntnttcntnattttcctncantggntgnntccagnntctttcnttgatgttncaatagatgctactgggccaaggagagcctggactcatcaatgncctcgtgataagaaaagagatgagaatgataagatatcccaaagcaggtagaagcaagcccaagttaacaattcctattagatacttgcaatattcctgttagcatttgaaaggagttttgctcctgtgttgggctttagagttggatttgctacctctgtatggttcacttttgttgt

SEQ ID NO: 6631 - DNA, 112 bp, Mus musculus
gagtccgatgtctccaacaagccagagactaagtctggaagcccccagcctcccactgagaagctggcatccgtggaacaagactaagcagaagcaagaagccttgcctctg

SEQ ID NO: 6632 - DNA, 514 bp, Mus musculus
  misc_feature (270)..(271): n is a, c, g, or t
  misc_feature (273)..(273): n is a, c, g, or t
  misc_feature (277)..(277): n is a, c, g, or t
  misc_feature (286)..(286): n is a, c, g, or t
  misc_feature (290)..(291): n is a, c, g, or t
  misc_feature (293)..(293): n is a, c, g, or t
  misc_feature (315)..(315): n is a, c, g, or t
  misc_feature (325)..(325): n is a, c, g, or t
  misc_feature (345)..(345): n is a, c, g, or t
  misc_feature (351)..(351): n is a, c, g, or t
  misc_feature (388)..(388): n is a, c, g, or t
  misc_feature (392)..(392): n is a, c, g, or t
  misc_feature (394)..(394): n is a, c, g, or t
  misc_feature (409)..(410): n is a, c, g, or t
  misc_feature (430)..(430): n is a, c, g, or t
  misc_feature (435)..(435): n is a, c, g, or t
  misc_feature (466)..(466): n is a, c, g, or t
  misc_feature (469)..(469): n is a, c, g, or t
attccatatgccaacttgtactcagaaagggtttcccagaaggctggtaaaacattatctctgggtgagccttgggatctctctagaccataagcatttgaatcaggaggataaataaagatcaacctcacaatgtgggcagctgccatctaattcatagagcacacacccaaacaggttgaaaaggtggagactggattcttgctctcttcttactttgagacattcttcctcttctttccttgaaagtcagaccttctgtttgaactnnanatgntccaaagantttnnantataattaggctatcaatcatnacaataacancaacaaatccttgagggggnaaaatnaggtaacacagttaaaagaaatatgagcaactttatncatncngttcattcacaatgnngatacatagtaacccctaantcaanttaaagagaatggattgcattatttatggtntcntcgtgccatgagttcagcaagaccatgttgttatccagcttttca

SEQ ID NO: 6633 - DNA, 351 bp, Mus musculus
gtaaatgtggccctgcatatgaatcagaaaaccacagtaaagacttcttaaacaaggtttttagtgatccccatagtcggaaaattgagaagtctgggccagactgcaagctcaggtccttccacctgcaatcttcagcagcaggagccaaaacagaggagccgatcaatggcatgaactggaccaacacccaaggcacggaagaaagaactgagtacctgaagaaagtaagaagcatactgaacattgtcaacgaaggacagatatcgctcttgccacacctagctgcagacaatctggacaaaattcacgatgagaacggaaacaatctgttacacattgctgcatcaa

SEQ ID NO: 6634 - DNA, 345 bp, Mus musculus
  misc_feature (146)..(146): n is a, c, g, or t
  misc_feature (152)..(152): n is a, c, g, or t
  misc_feature (182)..(182): n is a, c, g, or t
  misc_feature (205)..(205): n is a, c, g, or t
  misc_feature (253)..(253): n is a, c, g, or t
tggtctcgccatcgaagtgcacagagccactcgcctccacgctggcgccgcagtggtccaccagatactccaccacgtctaggtgtccacggcgcgctgcgattagcagtggcgttccaccgccggccacctcacccagcagctcntccagntcctcacgcccacggctggccaacagtttntgcagcagaggcagcttgccgtngtgcgccgcattgtacaccgctgtgtgcagatccatgctggaagcctngctgctggatctagccgggccgccggtcgccagagacatccttcaccttctccagggctgtcatcttagcggttctcctgcttctgttaaat

SEQ ID NO: 6635 - DNA, 101 bp, Mus musculus
cagaagagcctgaacggaatggagttgctcctggtgctcaaattctatccattaagattggtgatacacggctaagcactatggaaacaggcacaggcctc

SEQ ID NO: 6636 - DNA, 257 bp, Mus musculus
agagtcgaagctggtctttgataatgaccactgctcagcgagagcctcatcttttctttcactcctaatttacccagctttcaaaaggaagagtctggaaatccaagaatcattttcgtgattcttgcaaaaaactagaacaagatagcaaagacttaaaaacacaccgaggaaagttaaacagtatagagatcatgagaagtaaggaagtcattaaaactgtgtaactctggagaccagaatatctgagtcttgag

SEQ ID NO: 6637 - DNA, 387 bp, Mus musculus
tgcaaagcctttcgaagccgtgaagggcgcctgaaagctgcctgtaacttggcgcgcttgggcataaccaatctgtgcgtgatcggcggggacggaagtctcacgggagccaacctcttccgaaaggagtggagcggacttttggaaaaactggctcggaatggtgatatcgataacgacacagtgcagaagtattcctacctcaacgtggtgggtatggtggggtccattgacaatgacttctgtggcacagacatgaccattggtacagattcagccctgcaccgaattattgaagttgttgatgccatcatgaccactgctcagagccaccagaggaccttcgtcctggaggtgatggggagacactgtggttacttggccttg

SEQ ID NO: 6638 - DNA, 278 bp, Mus musculus
  misc_feature (83)..(83): n is a, c, g, or t
  misc_feature (93)..(93): n is a, c, g, or t
  misc_feature (150)..(150): n is a, c, g, or t
  misc_feature (158)..(158): n is a, c, g, or t
  misc_feature (170)..(170): n is a, c, g, or t
  misc_feature (177)..(177): n is a, c, g, or t
  misc_feature (185)..(185): n is a, c, g, or t
  misc_feature (189)..(189): n is a, c, g, or t
  misc_feature (191)..(191): n is a, c, g, or t
aaaacttaatgacgcccttcaccagaagcagctgctaactttgcgattagacaatcagttgactattcaacagaaagatgccnaaaaatatcnaagaactaatgaaacaagaaatggaaaccattttattgcgacagaagcaactggaangaaacaanccatcagctgangagaaanggctgganatgntncgccgaaatctgcgagactttgagctgacagaagagcagtatgtgaagctaaaatcttttcctgaagatcaactctctattcctgaa

SEQ ID NO: 6639 - DNA, 545 bp, Mus musculus
  misc_feature (193)..(193): n is a, c, g, or t
  misc_feature (209)..(209): n is a, c, g, or t
  misc_feature (214)..(214): n is a, c, g, or t
  misc_feature (232)..(232): n is a, c, g, or t
  misc_feature (242)..(242): n is a, c, g, or t
  misc_feature (476)..(476): n is a, c, g, or t
gtgagcatccttgctacagagggctccgtgcctgggtgacagggttgttcattaggggacattttcagggaagttcctggggcaccccatctgtactggaacttcagcttcagagttaggctgggaaccagtgggtccctcctcagtgaataggtgttggggtctccctggctcagtcatgggtggctcttcnagcccagagcactgantcctntctgcgttcctttcttcngagcaccagngccaattagggcacaggtgtgtgctgctttccacctgactaaggacatacagccttgtggtggcttttctcatagcccctcctttctcttccagtatgtattcacatgacacaagcagatgcacacactaccaacacatctgatacaggtattaaataaacatgatttcataacctccacaggcaaggacacccaatcaacctaataaccatataagaagaaatgcttgaaagnaagagttggttctctctatttcatttcaaataagcacggccacactgttcatcgtctaaaccactcaga

SEQ ID NO: 6640 - DNA, 492 bp, Mus musculus
  misc_feature (228)..(230): n is a, c, g, or t
  misc_feature (232)..(238): n is a, c, g, or t
  misc_feature (242)..(242): n is a, c, g, or t
  misc_feature (244)..(245): n is a, c, g, or t
  misc_feature (247)..(248): n is a, c, g, or t
  misc_feature (250)..(250): n is a, c, g, or t
  misc_feature (252)..(254): n is a, c, g, or t
  misc_feature (357)..(357): n is a, c, g, or t
  misc_feature (360)..(361): n is a, c, g, or t
  misc_feature (366)..(366): n is a, c, g, or t
  misc_feature (373)..(373): n is a, c, g, or t
  misc_feature (387)..(387): n is a, c, g, or t
  misc_feature (408)..(408): n is a, c, g, or t
  misc_feature (411)..(411): n is a, c, g, or t
  misc_feature (413)..(413): n is a, c, g, or t
  misc_feature (419)..(419): n is a, c, g, or t
  misc_feature (424)..(424): n is a, c, g, or t
  misc_feature (427)..(427): n is a, c, g, or t
  misc_feature (445)..(445): n is a, c, g, or t
  misc_feature (455)..(455): n is a, c, g, or t
gggctttttctctacatctggctcctcctctcccaacccccctgcccccatgacactgaagcactggagagaaaatgccagtttcggatgcagtccacagaaaccacaatggggcgacacagcacatcacagatactctgaagagatggagacgacacagtgcaggaggaggtgtgtgccccactcccaccccacgagaaggaaaagggccccactaagttatcaggnnncnnnnnnnagangnngnngncnnnctcccagatcgttagcccccccaggcctctcaagaagtggcagcttgatgacagggctcatgtcctccatgagtggggctctctcagtggggatgccctgagnatnngcctnacagatntcccacaggcagangctggaaggctccctcagctnagnanatgggntttgnttntcccatcagactggactntcctacatgntaaatactgggtttctcggagtttgacctgtatcacc

SEQ ID NO: 6641 - DNA, 214 bp, Mus musculus
tgctggaagcaagatcctagaggaagcacaagtcttaggtggagaaggaaaagatatccttggctttcttcctcaaaccttggacaagggtagtgtagactcctctcaacccagtggttataggacctgggttccaattcaaaacagctagagaacaaagcccacagattctgaagtgttgaaacgttactgtgttttagtctgacttggtgtt

SEQ ID NO: 6642 - DNA, 148 bp, Mus musculus
tgtccagagaagcagcgcagtataagaaggccctagaggaggagaccaacgagaggaacctcgcacaccaggagctgattaaacaaaagaaagatataagcatacaattaagctcagcccagtctcgttgtattcttctagagaagca

SEQ ID NO: 6643 - DNA, 429 bp, Mus musculus
  misc_feature (135)..(135): n is a, c, g, or t
  misc_feature (269)..(269): n is a, c, g, or t
  misc_feature (275)..(275): n is a, c, g, or t
  misc_feature (295)..(295): n is a, c, g, or t
aaggcctagtagctccaagtcagacactgcattagagaaatttaagggagaaattgcagcctttaaaacatccctggatgaaatcacctctgggaaaggaaaaatggccgaaaaaggcagaagcagactcttggngaaaatccaagttcttgaagccgagagagaaaagaatgtttattacctcctggagaaggacaaagaaatacagagactcaaagaccacctaaggtcaagatatagctcttcttcattgttcgagcagctggaanagaaancaaaggaatgtgagaagaancagcagttgctggagtccctatccaaagagacagatgtcctgaaaaaccagctgtccgccacgacgaaaagactttttgaacttgaaagcaaagccagtacactccacctgtcacagagcatgcctgcaaactg

SEQ ID NO: 6644 - DNA, 471 bp, Mus musculus
  misc_feature (319)..(319): n is a, c, g, or t
  misc_feature (330)..(330): n is a, c, g, or t
  misc_feature (336)..(336): n is a, c, g, or t
  misc_feature (346)..(347): n is a, c, g, or t
  misc_feature (359)..(359): n is a, c, g, or t
  misc_feature (373)..(374): n is a, c, g, or t
  misc_feature (387)..(387): n is a, c, g, or t
  misc_feature (389)..(390): n is a, c, g, or t
  misc_feature (392)..(392): n is a, c, g, or t
  misc_feature (395)..(396): n is a, c, g, or t
  misc_feature (398)..(398): n is a, c, g, or t
  misc_feature (409)..(409): n is a, c, g, or t
ggtttgatcgagacagaccactgagaggacgtggaggccccagaggaggcctgaggagcagaggccgaggcggtcctgggaacagagcttttgactcctttgaccaaagagggaaacgagactttgagagatacagtagcaatgataaaacaaacagaatggaggacagcatgggtggctgtggcattcgcccctggggatcaggtaaagacactagtgatacagagccacctgcacccatggaagagacctcgatgatggaggagtgccagggcgccctggacgaggagtctgcagccaaagttcctgagttggaggnagaagaggaanaccaantccaagaganngaccttagatgngtggaaaaaccttnnaagaacaaaccananncnaanncntgagttcaatnttcggaagccagagtccacagttccttccaaggcagtggtgattcacaagtccagatacaga

SEQ ID NO: 6645 - DNA, 338 bp, Mus musculus
  misc_feature (46)..(46): n is a, c, g, or t
  misc_feature (69)..(69): n is a, c, g, or t
  misc_feature (199)..(200): n is a, c, g, or t
  misc_feature (212)..(212): n is a, c, g, or t
  misc_feature (305)..(305): n is a, c, g, or t
gctcgcagccatggttagaaccctgcgcttccaacatggcagagcnaggaagccaggcagccgctgccngccaccaagtcaccggctagagtgactgactcctgtgtcggaatagctccagccgctcagcagcgccgtgggaggaccatggcaatagggaaaatgactgcttctggggaaggtgatgtgagccgtgctnnggctgtgtgctnaaataagctccatttagagcagcttttccacccaaccttctaaagtccaaggcagaaaaataaagtctccattcatccgttgctggtaggacnacaaacttgtacagtcactatggaaatcagctt

SEQ ID NO: 6646 - DNA, 492 bp, Mus musculus
  misc_feature (292)..(298): n is a, c, g, or t
  misc_feature (301)..(301): n is a, c, g, or t
  misc_feature (304)..(305): n is a, c, g, or t
  misc_feature (307)..(314): n is a, c, g, or t
  misc_feature (316)..(319): n is a, c, g, or t
  misc_feature (322)..(322): n is a, c, g, or t
  misc_feature (328)..(328): n is a, c, g, or t
  misc_feature (332)..(332): n is a, c, g, or t
  misc_feature (335)..(335): n is a, c, g, or t
  misc_feature (349)..(349): n is a, c, g, or t
  misc_feature (352)..(352): n is a, c, g, or t
  misc_feature (355)..(355): n is a, c, g, or t
  misc_feature (363)..(363): n is a, c, g, or t
  misc_feature (384)..(384): n is a, c, g, or t
  misc_feature (399)..(400): n is a, c, g, or t
  misc_feature (403)..(403): n is a, c, g, or t
  misc_feature (411)..(411): n is a, c, g, or t
  misc_feature (417)..(417): n is a, c, g, or t
  misc_feature (432)..(432): n is a, c, g, or t
  misc_feature (458)..(458): n is a, c, g, or t
  misc_feature (461)..(461): n is a, c, g, or t
  misc_feature (466)..(466): n is a, c, g, or t
gctacccaaggcctaaggctggtgaaggcaggccctgttctctcctagaaccacttggaatgaatggcgctctctgttgccctttgtccttgcaggaaaagagttcctggtctgagaaagaaagtacactaaagcgagcagagaagagagacaaagagctcctaaaggctgagttcctcctggtctaccatgactgcgtgctccctcttctgcactcgacactgctgcccccctttaggtgggccgaggaagagacagaggctgcaagatggaaagccattgctgacttccnnnnnnnganccnngnnnnnnnngnnnnccntgaagnctcngcngtcaccagatgganttnacnaaccattngacctttcggagcagaccttngacttcttgggtganntangaaagaantcaggntaatggcgaccatgntccgattcccactggacccagggagnttncaggnagacttgcctcaaacaactgagccaa

SEQ ID NO: 6647 - DNA, 458 bp, Mus musculus
  misc_feature (77)..(80): n is a, c, g, or t
  misc_feature (82)..(85): n is a, c, g, or t
  misc_feature (87)..(87): n is a, c, g, or t
  misc_feature (89)..(89): n is a, c, g, or t
  misc_feature (92)..(95): n is a, c, g, or t
  misc_feature (97)..(98): n is a, c, g, or t
  misc_feature (100)..(100): n is a, c, g, or t
  misc_feature (314)..(314): n is a, c, g, or t
  misc_feature (393)..(393): n is a, c, g, or t
gtagggactcacctgcatgaacacacagagcaggacaagaaggatgaagagccccgggattccagccatgctgagtnnnncnnnngnancannnncnngnagtcaggaggatgaaagctatacagttcatttactgcagcctggcagggcacagccgcacgctggtcatgtttctaagactgggaacattcctcaggttccaagcgagagcctccctcaggtaatggtctcacttacatgcaaggacttgcttgaccttaggatcatttccacacctcaaatccaaatgaagctattccccacccccttcatgntgaagaagtaaagaccatgggacattacagggccacatctagaaaatttaccactattctgtgaacatatggccagctntcatttttatgaggtttttgaatgtttttttaacttgattctatataccttgtcttatcctgtct

SEQ ID NO: 6648 - DNA, 272 bp, Mus musculus
  misc_feature (46)..(46): n is a, c, g, or t
  misc_feature (55)..(55): n is a, c, g, or t
  misc_feature (61)..(61): n is a, c, g, or t
  misc_feature (82)..(82): n is a, c, g, or t
  misc_feature (107)..(107): n is a, c, g, or t
  misc_feature (215)..(215): n is a, c, g, or t
  misc_feature (230)..(230): n is a, c, g, or t
  misc_feature (237)..(237): n is a, c, g, or t
  misc_feature (242)..(242): n is a, c, g, or t
ggtgattcggatcaagattccaaatagtggcgcggtggactggacngtgcactcngggccncagttactcttcagggatgtnctggatgtgataggccaggttctgnctgaagcgacgacgacagcgtttgaatatgaagatgaagatggtgataggattacagtaagaagcgatgaagagatgaaggcaatgctgtcctactattattccacantaatggaacagcaantaaatgnccagntaatagagccgctgcagatatttccaagag

SEQ ID NO: 6649 - DNA, 364 bp, Mus musculus
  misc_feature (121)..(121): n is a, c, g, or t
  misc_feature (175)..(175): n is a, c, g, or t
  misc_feature (185)..(185): n is a, c, g, or t
  misc_feature (191)..(191): n is a, c, g, or t
  misc_feature (237)..(237): n is a, c, g, or t
aacatgaccctgaatgcaagttaaaagcaaagtcagcccactcaaagtcaaaagagggtgatgaagcacaccgctccaagattgacaggccatcaagaccaccaccacctaccatgatggnccttgaggacacagatcccacccattttacaaaccagcacagtacaacatggcntcttccaaantcagantcctcacagaaaggcttccataacaagcagtaaaataatacaaacnaaaagggatcggcctcgaaaatggacttcgtatagcacatattacttcttatagcacatattactgaaagatacaacatgcattccacgttggctgttgtccttctgtgtgccattctgggagttgc

SEQ ID NO: 6650 - DNA, 143 bp, Mus musculus
agttaaagcctggtggaagattgatattgccagtcggtcctgcaggaggaaaccaaatgttggagcagtatgacaagctacaagatggcagtgtcaaaatgaaacctctcatgggggtgatatacgtgcctttaacagataaa

SEQ ID NO: 6651 - DNA, 223 bp, Mus musculus
agaccttagcctgcaagagctgatttgagtggtttccttcatgctaccccattaaagcatcagaaactcatggcattaaagagtgacaagtgttgcatggtcagtttgactcgcagctttaggaagggagggcgaggcctggtcggcacggcatgctttgcagggtgaccttatttatttatcagatttttctgcataattatgtcatgttatagctgctata

SEQ ID NO: 6652 - DNA, 505 bp, Mus musculus
  misc_feature (312)..(312): n is a, c, g, or t
  misc_feature (338)..(338): n is a, c, g, or t
  misc_feature (340)..(340): n is a, c, g, or t
  misc_feature (356)..(357): n is a, c, g, or t
  misc_feature (364)..(364): n is a, c, g, or t
  misc_feature (418)..(418): n is a, c, g, or t
  misc_feature (420)..(420): n is a, c, g, or t
  misc_feature (422)..(422): n is a, c, g, or t
gaagtcgttcgcttcctggtggagcagggtgctactgtgaaccaggcagacaacgagggctggacgcctctgcatgtggctgcctcctgtgggtacctggacattgccaggtacctcctgagccatggggccaacattgctgctgtcaacagtgacggggacctgcctttggacctggctgagtcagatgccatggaggggctgctgaaggcagagatcactcgccgaggtgtggatgtcgaggcagccaagcgggctgaagaagaattgctgcttcatgacacaaggtgctggctgaatgggggtgctatnccagaggccaggcacccccggactgngncctctgccctgcatgnngctgctnccaagggctacatcgaggtgatgaggtgagctaggccagagtgattgttttgtntntntgctgttgcctcagcacttgaatccaatctgtccaaggctgcagaactgacaagaaactgcagcacaccaccagaaggttttt

SEQ ID NO: 6653 - DNA, 364 bp, Mus musculus
  misc_feature (95)..(95): n is a, c, g, or t
  misc_feature (97)..(97): n is a, c, g, or t
gtagtatcgcatagaagcagtccttgagctgtcctatagaagggtaatttgatacggaccttgtggctatatttttataatggtaatttttaacntntgagctggtggtttgcctcaacaacataaacttcctaatgatcagcgctagatgattgaatataaaatgctttattaatcaaacaagtgcacttgaacattttaaatctttatggtgagtaaattaaaagaagtttattaataatgtttttaaaaattatgcctgcagaatatttactttattatttgattaaatgtattatttatatttttctttctgcttttgtaacgatggttcaggtgtcttctggctcacttccaggaggtt

SEQ ID NO: 6654 - DNA, 537 bp, Mus musculus
  misc_feature (284)..(284): n is a, c, g, or t
  misc_feature (335)..(335): n is a, c, g, or t
  misc_feature (337)..(337): n is a, c, g, or t
  misc_feature (340)..(341): n is a, c, g, or t
  misc_feature (343)..(343): n is a, c, g, or t
  misc_feature (421)..(421): n is a, c, g, or t
  misc_feature (474)..(474): n is a, c, g, or t
gatcctgaccatcgatgtgagacctggatggaggcagggcacacgcatcacctttgagaaggaaggggaccagggccccaacatcatccctgctgacattatcttcattgtgaaggagaagctgcaccctcgcttccgcagggagcatgacaacctcttcttcgtgtaccccattcctttgggcaaggcccttacctgctgcactgtggaggtgaagactcttgatgaccggctgctcaacatccctatcaacgacattgtccaccctaagtacttcaagattntgccaggtgaggggatgccactgcctgagaaccccagcaagaagggagacntnttnntnttctttgacatccagttccccacccgcctcacaccccagaagaagcagatgctgcgccaggcattgctgacctaattntgggggacctgagcaggaacagggatggagagggctagctgggccttgcctgntcctatccactcaactcccacagcctatgaagatggggaggcgtgagaccttaggctgacata

SEQ ID NO: 6655 - DNA, 307 bp, Mus musculus
ggagctgtttcactcaatccagagaacctgcctggacttgtctaaagcaatcgtgctctatcaaaagagaatatgtttcttgtctcaagaggaaaatgaactgggaaagtttcttcgatctcaaggcttccaagacaaaacccgagcaggaaaaatgatgcaagccacgggcaaggccctctgcttttcctcccagcaaaggttggccttgagaaaccctttgtgtcgatttcaccaagaagtagaaacttttagacatcgggccatctctgatacctggctgacagtgaaccgcatggagcagtac

SEQ ID NO: 6656 - DNA, 300 bp, Mus musculus
  misc_feature (109)..(109): n is a, c, g, or t
ctgctgtgatggtctatgatgatgccaataagaagtgggtgccagctggtggctcaactgggttcagcagagtacatatatatcaccatacaggcaacaacacattcanagttgtgggcagaaagattcaagaccatcaggttgtgataaactgtgccattcctaaagggctgaagtacaatcaagctacacagactttccaccaatggagggatgctagacaggtgtatggtctcaactttggcagcaaagaggatgccaatgtcttcgcaagtgccatgatgcatgccttagaagtgt

SEQ ID NO: 6657 - DNA, 454 bp, Mus musculus
  misc_feature (45)..(45): n is a, c, g, or t
  misc_feature (104)..(105): n is a, c, g, or t
  misc_feature (260)..(260): n is a, c, g, or t
  misc_feature (348)..(348): n is a, c, g, or t
  misc_feature (427)..(427): n is a, c, g, or t
attgccgcgctttcccacttagaaggacgccggcgcccggccctngggcgaagggcaccagactgcgagggcggcagccgccggcgcctctgagagcgtctacnncgctccgcgtgcactaggctaggctgccagggctgggtggccaccccacgccgcactcgttgctggggtctgtgcttcgaggacaccggttccggaggggacacgacttgccaaagtgcaaacgagggtcccgtggtgcgtcaccgtgcaaaacntctccacggattcctcggatgctgatttcggtgatttggggttttgttttgttttgtttttgagaagaggagagctgggccaagaggntccctttgccccagcggaggtacgagaagaatcagaaaataccgaaaagtccacttccttcagagtaaacaataaaganccaccgggctgcagacgtccgcgttag

SEQ ID NO: 6658 - DNA, 394 bp, Mus musculus
  misc_feature (26)..(26): n is a, c, g, or t
  misc_feature (63)..(63): n is a, c, g, or t
  misc_feature (70)..(70): n is a, c, g, or t
  misc_feature (159)..(178): n is a, c, g, or t
  misc_feature (180)..(184): n is a, c, g, or t
  misc_feature (187)..(187): n is a, c, g, or t
  misc_feature (191)..(191): n is a, c, g, or t
  misc_feature (193)..(193): n is a, c, g, or t
  misc_feature (197)..(197): n is a, c, g, or t
  misc_feature (199)..(199): n is a, c, g, or t
  misc_feature (202)..(202): n is a, c, g, or t
  misc_feature (206)..(206): n is a, c, g, or t
  misc_feature (215)..(216): n is a, c, g, or t
  misc_feature (219)..(219): n is a, c, g, or t
  misc_feature (225)..(225): n is a, c, g, or t
  misc_feature (228)..(228): n is a, c, g, or t
  misc_feature (238)..(238): n is a, c, g, or t
  misc_feature (246)..(246): n is a, c, g, or t
  misc_feature (253)..(253): n is a, c, g, or t
  misc_feature (257)..(257): n is a, c, g, or t
  misc_feature (267)..(267): n is a, c, g, or t
  misc_feature (272)..(272): n is a, c, g, or t
  misc_feature (274)..(274): n is a, c, g, or t
  misc_feature (278)..(278): n is a, c, g, or t
  misc_feature (298)..(298): n is a, c, g, or t
  misc_feature (300)..(301): n is a, c, g, or t
  misc_feature (307)..(307): n is a, c, g, or t
  misc_feature (314)..(314): n is a, c, g, or t
  misc_feature (333)..(333): n is a, c, g, or t
  misc_feature (345)..(345): n is a, c, g, or t
  misc_feature (354)..(354): n is a, c, g, or t
  misc_feature (367)..(367): n is a, c, g, or t
acgttgcgtctcaggaaatggacgtnacaaaggtgtgtggagaaatgcgctttcagttgaatnaaaccanaatggagaaggatgaggtggaaaaggaacacagagaatacaaagcaaagtctcacaaggatcttgaaatgaaagtccaggaaatagagnnnnnnnnnnnnnnnnnnnncnnnnncgngcancntgtngnacnggancagcagaanncanctcggnccngacaggagtncctgcgantcacagngctnctgggcgagnccgancnccanctgcacctcaccagactggnannagatancattcancaaagctttagcaatgaancaaaggcccaancccttcagncccagcagagagnacaggagctgacacagaagatacagca

SEQ ID NO: 6659 - DNA, 543 bp, Mus musculus
  misc_feature (48)..(48): n is a, c, g, or t
gtaatctgttcgtaatttatcccgtgtgaccttgagtctttcccgtcntaaggaccgggactgtccgaagcgatgcctgtccacctctcttctctctttcccttctccctgctcccacagccctggaaaccgtgatgagagaacgggaactttcaacgattaatgctgagaggcgtgctggcggcgtgcgccgatcccgggagcagcggacacgtagtctctagtcaggcagcacgtcgggcgcctcagcagaagagcgggcttcattgctgcagcggccagcccccgcccccaccccacgtggttggaggtttccagaagcgtagccaccaccgtgcacgcagctccgggcccgtggggtgttggttcttgccctcgtaaccccctctgtccagccaccatgataagcgccagcagagccgcggccgcgcgtctcgtgggcaccgctgcgtcccagagccccgcagccgcccgtccccaggtgagaagctgccatgccttccggtgggggctccaggcccggactcgagtgaggcaggcctt

SEQ ID NO: 6660 - DNA, 524 bp, Mus musculus
  misc_feature (161)..(161): n is a, c, g, or t
  misc_feature (200)..(200): n is a, c, g, or t
  misc_feature (211)..(211): n is a, c, g, or t
  misc_feature (215)..(215): n is a, c, g, or t
  misc_feature (228)..(228): n is a, c, g, or t
  misc_feature (270)..(270): n is a, c, g, or t
  misc_feature (275)..(275): n is a, c, g, or t
  misc_feature (301)..(301): n is a, c, g, or t
  misc_feature (304)..(304): n is a, c, g, or t
  misc_feature (314)..(314): n is a, c, g, or t
  misc_feature (319)..(319): n is a, c, g, or t
  misc_feature (341)..(341): n is a, c, g, or t
  misc_feature (368)..(368): n is a, c, g, or t
  misc_feature (374)..(374): n is a, c, g, or t
  misc_feature (380)..(380): n is a, c, g, or t
ttgaggtttggatctacgaggtcgcaggaggctcgggtgtccctactgtccgactctcaagaaaaaaaaaaaaaaaaaaaagcaaaaagcaacttatttaacttttatacttttggaggcagggtctcgatttatacatttatgtagctcaggctggcttnttagtcctgcttcctccttctgtttgctggttgacaggngtgtgacacgnccanctgccctttgttnttagtgcaccccagaccgaaagtcccatccgacttgtttttnttccnctttaggattagattttcagcacgtnttnacatccactntcccncctcagccagaccctccttccncctcacagtgggtccagtgttagccanactctntgcctntgtaggccttcgaaagaaaaagcagatgccattgagaaactccatcctaagggggaggcaagccgatgggactggggttgactccatttgccagctaatgtttctgccaaactggttttttccatctatgcgattgggatccaa

SEQ ID NO: 6661 - DNA, 273 bp, Mus musculus
  misc_feature (228)..(228): n is a, c, g, or t
  misc_feature (231)..(231): n is a, c, g, or t
atccagaattttacacgcctttagaaaggaagttacttaagataatctctcagaaggatgtgttccactcccttttccaacacttcagctatagctgcatgatggagaaaattcagagttatgtgggtgatgtgttaagtgaaaaatcatcaacttttctaatgaaggcagcaacaaaagtagtggaaaatgagaaagcgaggacacaagcgtctaaggataggccanatnccaccaacactggaatggacactgaagttggtttgaataaag

SEQ ID NO: 6662 - DNA, 318 bp, Mus musculus
  misc_feature (31)..(32): n is a, c, g, or t
  misc_feature (40)..(40): n is a, c, g, or t
gctacattacacttgcaagtctggggctcanntggcatcngtgatattgagacagctgtaaaatttgctgctcaacttatagacctgggagcagacgcgagtttgcggagtcgctggacgaacatgaacgctttgcattacgcttcgtactttgatgtcccagagcttatcagggtgattttgaagacatcgaaaccaaaagatgtggatgccacttgcagcgactttaattttgggacagccctgcacattgcagcacataacttgtgtgcaggagccgtgaaaaccttgctggagctgggagcgaaccctgccttt

SEQ ID NO: 6663 - DNA, 541 bp, Mus musculus
  misc_feature (26)..(26): n is a, c, g, or t
  misc_feature (29)..(29): n is a, c, g, or t
  misc_feature (31)..(32): n is a, c, g, or t
  misc_feature (37)..(37): n is a, c, g, or t
  misc_feature (67)..(67): n is a, c, g, or t
  misc_feature (86)..(86): n is a, c, g, or t
  misc_feature (92)..(92): n is a, c, g, or t
  misc_feature (97)..(98): n is a, c, g, or t
  misc_feature (114)..(114): n is a, c, g, or t
  misc_feature (117)..(117): n is a, c, g, or t
  misc_feature (180)..(180): n is a, c, g, or t
  misc_feature (315)..(315): n is a, c, g, or t
  misc_feature (343)..(343): n is a, c, g, or t
  misc_feature (431)..(441): n is a, c, g, or t
  misc_feature (443)..(447): n is a, c, g, or t
  misc_feature (449)..(449): n is a, c, g, or t
  misc_feature (451)..(456): n is a, c, g, or t
  misc_feature (458)..(458): n is a, c, g, or t
  misc_feature (460)..(462): n is a, c, g, or t
  misc_feature (464)..(467): n is a, c, g, or t
  misc_feature (469)..(471): n is a, c, g, or t
  misc_feature (473)..(475): n is a, c, g, or t
  misc_feature (477)..(480): n is a, c, g, or t
  misc_feature (482)..(482): n is a, c, g, or t
  misc_feature (484)..(484): n is a, c, g, or t
  misc_feature (486)..(489): n is a, c, g, or t
  misc_feature (491)..(491): n is a, c, g, or t
  misc_feature (501)..(501): n is a, c, g, or t
  misc_feature (503)..(503): n is a, c, g, or t
  misc_feature (506)..(506): n is a, c, g, or t
  misc_feature (511)..(511): n is a, c, g, or t
caaacagcagcgacgtctgcgcagancgngnngcgcngagcaacagcaatggcggcccggcagcgcnatcctctcctggccttgcngcgcanccggnnttcagcacccgcctcnagngcctccgccatttgctgagtgccgctgaccaatcaaaagcgatatctcatcttgggcccgccnacacagaggcctcattggctatagttcacagactaagttcgtcgctggagctgtcagccaatgatcaaaacacggagcgtggaggaagtgggtactttgagggaattgctgcaagaagccgtgtgatcgattaanaggaaaggaaggtcgagggtccaaacgngctccaaagagacgcccaggctctaggtcggagctgtagagaatggctcagtcgttacgagcactggctgctcctccaaaagacccgnnnnnnnnnnncnnnnncnannnnnngntnnncnnnnannnannngnnnngngngnnnnantccgacgccntnttntggantccgcggacacgtggcacccatatatttat

SEQ ID NO: 6664 - DNA, 266 bp, Mus musculus
  misc_feature (183)..(183): n is a, c, g, or t
ggctcgcccgtgaaactttcccaggctcctccgagaaacgctgccgccagcactctccggaccgagagacaagccgtcagcgacccggatggagcgggaggggaagggctggcggttccggaacagtgttggctcacgttttcagctaacttcttggaagatacgaggttaaattacccaaantctttcactcagagaaaaacagggcttacagctacagttcctgcttcatgaaaacgaaatccagatttcacaggccaatttta

SEQ ID NO: 6665 - DNA, 509 bp, Mus musculus
  misc_feature (305)..(305): n is a, c, g, or t
  misc_feature (379)..(379): n is a, c, g, or t
  misc_feature (384)..(384): n is a, c, g, or t
  misc_feature (409)..(409): n is a, c, g, or t
  misc_feature (412)..(412): n is a, c, g, or t
  misc_feature (416)..(417): n is a, c, g, or t
  misc_feature (419)..(419): n is a, c, g, or t
  misc_feature (435)..(435): n is a, c, g, or t
  misc_feature (449)..(449): n is a, c, g, or t
  misc_feature (456)..(456): n is a, c, g, or t
  misc_feature (477)..(477): n is a, c, g, or t
  misc_feature (479)..(479): n is a, c, g, or t
ctcctttgtcttggttggcttctaagcctctagatcaattataaattttgaagatacttactatatgagtttctgttgtttaattctcaagaacacatctcaattaaggatctttgaggctggagtccactcagtgcttgccattcattaaactgaagagaggacagcttcctcggtcaaataaaatcgtggttctctggtcactttagtgattctaaataacacgaatattctggtgattccttcatttcaagtcagtgacctagcatggtgtgagaaaagtaaatagagaactgaggatgttngtcatgaaaacagaatgctctggaggcacatgatctccaaagaattaggacctgtgccactgggttccatgagnaaaanacaagaggtggggttccaggaagantcntcanntntcagagggatagcccngtggttaagagagntactgcnagaggacccacactggacagntnataactgcatgaaacccacgaagccccatg

SEQ ID NO: 6666 - DNA, 418 bp, Mus musculus
  misc_feature (98)..(98): n is a, c, g, or t
  misc_feature (147)..(147): n is a, c, g, or t
  misc_feature (200)..(200): n is a, c, g, or t
  misc_feature (250)..(250): n is a, c, g, or t
  misc_feature (268)..(268): n is a, c, g, or t
  misc_feature (274)..(274): n is a, c, g, or t
  misc_feature (294)..(294): n is a, c, g, or t
  misc_feature (342)..(342): n is a, c, g, or t
  misc_feature (383)..(383): n is a, c, g, or t
  misc_feature (392)..(392): n is a, c, g, or t
gaaaatacagtccataagtttgaaaggaagcaagcaggggcttatggaaggatttgaagggagaaaaggcaaaggagaaatgtgattatactataatntcaaaaatacaaaataagaacataaaacacgaatttgtttcaactgaantaatacctatgcatccatttcaccttaaaccatttatctacttgcccttattntcctacttgctaaaatgctgtagaagagtctgtcattgcctattaagagngaaacaatactatccttntgtttntcctaccataaatgacagtntcctagaaaaggagattcacatcggaagtaaggattcataaagacaanccaaggaaattaaaaataagatgaaagacttgggttatcantcatatttntcagtacttgcttctggagtagtgaa

SEQ ID NO: 6667 - DNA, 532 bp, Mus musculus
  misc_feature (478)..(478): n is a, c, g, or t
  misc_feature (481)..(481): n is a, c, g, or t
  misc_feature (484)..(485): n is a, c, g, or t
  misc_feature (492)..(492): n is a, c, g, or t
  misc_feature (497)..(497): n is a, c, g, or t
  misc_feature (499)..(499): n is a, c, g, or t
gaacctcatagacttcacccaggaatattggcagtgctgtggggcttttggagctgatgattggaacctaaatatttacttcaattgcacagattccaatgcaagccgagagcgatgcggtgtgccattttcctgctgcactaaagaccccgcggaagatgtcatcaacactcagtgtggctatgatgccaggcagaaaccagaagttgaccaacagattgtaatctacacaaaaggctgtgtgccccagtttgagaagtggctacaggacaatttaaccatcgtggctggtattttcataggcattgcattgctacagatttttgggatatgcctggcacagaatttggtgagtgacattgaagctgtcagggctagctggtagacccctgcgaccactgctgtcagacactggactgatcccccctcactgactgaccctctgtgcgccggccggctgatggcgggctgtagaggnctngtnnacaggcntacantntcacctgatggagctgccaagaacttaactttc

SEQ ID NO: 6668 - DNA, 392 bp, Mus musculus
gctcgtattttgactggattgggaagatacttccaaggtttggacaaggaagggaatgggcttttagaaaaggcagattttcagcaagctctgaaaacctttcacttggaagtgtctgaacaggactttgagtctttctggctaattctgcaaggatatggccatagcaagaacaaggttgactatggagaattcaaacgtgccatttttggtgaaatgaatgaatataggaagtcatttgttcgcaaggccttcatgcaactggattttaacaaaaccggcattgtgtctgtaatagacataagaaagtgttactgcgccaagaagcatccacgtgtgatctcagggcattcaacagaggaggaaatcaaatcatctttcctagagacgtt

SEQ ID NO: 6669 - DNA, 559 bp, Mus musculus
  misc_feature (396)..(396): n is a, c, g, or t
  misc_feature (430)..(430): n is a, c, g, or t
  misc_feature (479)..(479): n is a, c, g, or t
  misc_feature (515)..(515): n is a, c, g, or t
  misc_feature (524)..(524): n is a, c, g, or t
tgtacattcacaactgtccatcttgttagggaacaccagaatctttaaaatgtgtgtaaagattaagtcctgtaaatttgcaaaataaaattatgttccgttgctcattgtcaaaggttaggtaaatgaacaaatgtacctaactaataggctcagccactcccaacctggtgattaactttgccggtttccttataaaaataaatagactctcatcagggaaaatgaacagcttccataaatagacctcctcaccaccattttaatatccaacatttattaaacatgtaaattttaatgagattcatagtggaatattaaccaatcccttagaacaaagaggtgacatggcctttctcagaaaagtgcacattaaaatggcagcgtttatttttncccatgtttcatgagccaatgttctattaatctnaaataacagaatttatctgacgactctcattttagacattttgggtgtntctggtgttgcagatgttccctgatgagtttctctntcttcttcntcttggctgtttaatcgcgggaggccccatgtgaa

SEQ ID NO: 6670 - DNA, 265 bp, Mus musculus
  misc_feature (72)..(72): n is a, c, g, or t
  misc_feature (90)..(90): n is a, c, g, or t
  misc_feature (122)..(122): n is a, c, g, or t
  misc_feature (142)..(142): n is a, c, g, or t
  misc_feature (175)..(175): n is a, c, g, or t
gaacaaattgtacatcgggaacctcagcgaccacgccggccccgcggacctggaaagtgtcttcaaggacgntaagatcccggtggcggnccccttcctggtgaagacgggctacgcgttcntggactgcccggacgagggnctgggccctcaaggccatcgaggcgctttcagntaaaatggaactacatgggaaaccgatggaagttgagcactcggtccctaaacggcagaggattcgtaaacttcagatacgaaatatccc

SEQ ID NO: 6671 - DNA, 450 bp, Mus musculus
  misc_feature (189)..(189): n is a, c, g, or t
  misc_feature (195)..(195): n is a, c, g, or t
  misc_feature (203)..(203): n is a, c, g, or t
  misc_feature (205)..(205): n is a, c, g, or t
  misc_feature (210)..(210): n is a, c, g, or t
  misc_feature (221)..(221): n is a, c, g, or t
  misc_feature (223)..(223): n is a, c, g, or t
  misc_feature (225)..(225): n is a, c, g, or t
  misc_feature (243)..(243): n is a, c, g, or t
  misc_feature (247)..(247): n is a, c, g, or t
  misc_feature (249)..(249): n is a, c, g, or t
  misc_feature (251)..(251): n is a, c, g, or t
  misc_feature (255)..(255): n is a, c, g, or t
  misc_feature (262)..(262): n is a, c, g, or t
  misc_feature (267)..(267): n is a, c, g, or t
  misc_feature (271)..(271): n is a, c, g, or t
  misc_feature (302)..(302): n is a, c, g, or t
  misc_feature (309)..(309): n is a, c, g, or t
  misc_feature (334)..(334): n is a, c, g, or t
  misc_feature (336)..(337): n is a, c, g, or t
  misc_feature (397)..(397): n is a, c, g, or t
  misc_feature (423)..(423): n is a, c, g, or t
  misc_feature (425)..(425): n is a, c, g, or t
actgactgagcggagatgagtgactggaagggctacatcagtgcagtgctgcgggatcagcggatcgatgacgtggctatcgtgggccactcggacaatcgctgtgtgtgggcatcacggcctgggggtctgctggctgccatctccccgcaggaggtgggtgtgctcaccgggccagaccggcacacntttctncagacggntntgagngtggcaggccncngntgctgcgttatccgtgantacntncnggcngagggtnacggngtantggatgcgcgcaccaaggggctagacgggcntgcaatntgtgtgggccacacgccacgggcgntnntggtgctcatgggcagacgaggcgtgcatggaggcatcctcaataagacagtgcacgatntgattggtgggctgcgtgagcagtgntnttagtaggacagctagaccgcccgt

SEQ ID NO: 6672 - DNA, 168 bp, Mus musculus
ttcaggaagtggatgccttcctcctgcacctctccaagctcaccaaagaggatgagcagcagcaggccctgcaggacatagcctcccggtgtacagccaatgaccttaagtgcattattcggctgatcaaacatgatctgaagatgaactcgggtgcaaaacacgtgt

SEQ ID NO: 6673 - DNA, 291 bp, Mus musculus
gaagctacgtgcagaaggacctcaagaatggttttccaagagtgcaaggacttgaatgctgttgctttcagatttaaagataaagagagaccacgaggctatacgtccaagattgcaggaaagttgcactattatcccctaaatggagtgctcacagctgaatatctattggaggaatttagacccgacttgatagacatggttcttgataaactcagaccagaaaatgtgcgggtggcaatagtttccaaatcatttgaagggaaaactgaccgcacagagcagtggtat

SEQ ID NO: 6674 - DNA, 457 bp, Mus musculus
ggcaccaaaatcacttttccgagggaaggcgatgaaacaccaaatagtatcccagcagacattgtttttgttattaaagacaaagaacatcccaagtttaaaagagacggatcaaatatagtttatactgctaaaattagtttacgggaggcattgtgtggctgctcacttaatgtgccaacaatggacggaagaaacctacctatgtcagtcactgatattgtgaaacctgggatgaggagaagagttattggatatgggctgccatttccaaaaaaccctgaccagcgtggcgacctactgatagaatttgatgtgtccttcccagacgtcatatctgcagcatccaaagagagcctgaggaagcatctccctgcctcttaggatgagaagaaccttgctatccatagtttgataagacactgaaaatataaaagtaccggcagttgactgctgt

SEQ ID NO: 6675 - DNA, 530 bp, Mus musculus
gaacgtcagcttatcgatcacagatggactgttcacaaagattcgattggaagagcaacgttcaaggtttgctttactctgtgttctcttgaagaacaagtaaactgcacagagcatggctaccaaactgggacgcagacatggacacaggcccccactgagtcccttgtgtctggacaggcacacctgaaatctgacatgaagtgagggttctcagtaggtgaggcaaagagctatacatgttgacacaccttataaccacaagcttaattctcaagataagttgatatacagaacagtaacttgctactctgtgaaccccatcacccaggtgtaatagcgtctagactttgaaaatgatgccttaccagagtttgcgatgggtgtgttctttttgtatccactcatgtgtacacaggggcttttcttggacagcctgttcagagcctaccatatcatacagtgcttcttttacattcatttgtgaacacttctatcatgtcatgaaattatccacttcctcaagacaa

SEQ ID NO: 6676 - DNA, 312 bp, Mus musculus
  misc_feature (152)..(152): n is a, c, g, or t
  misc_feature (236)..(236): n is a, c, g, or t
ggatatggcctggaatctcagcagccattttttgaagacccaacaagagccagcaacctagaggaggatgaagatgatggatggaatataacctacttgccatctgccgtggatcagactcattcctctagagacacacaggactcaccgcncctgtgacacctacctttcctttttctccaactcgtcagagctggcatgtcccgagtctttgcccccatggacgctgagtgacnccgactccaggatctccccagcgtctccagctgggagtcctaatgcagactttgcagctcatgaagaatccctagg

SEQ ID NO: 6677 - DNA, 77 bp, Mus musculus
agccaccaaagatctcaaataaagtcgatgtttggtcagtgggtgtgatcttctaccagtgtctttatgggaggaag

SEQ ID NO: 6678 - DNA, 423 bp, Mus musculus
gggattcttctttgcagttaatcattggaatcctgaaagtagtggtttaaagaaaatacagacttctcagtaaatgctttgtgtatacctacaaattccaggctgaagagcacctactgaattctccgagccatcagagacatgcatgttgcaatctcaaatataagacatgttttaattctgatgtgaattcatgtaaaatagggtgttgtatttttttaagattttgctttgtagctgtggttggcctgtactatatacgtagcagaggctgacctcagactcaaggcaatccctgtgcctcaacctcttgaatgctggtatgacatcacgtctgtcttgaaatcctttagtggcatgaacaatctgccaaaaaaaatttcccaagctttccaataggatctgaaacttaacccctagatt

SEQ ID NO: 6679 - DNA, 157 bp, Mus musculus
agaagagacctctgtggatgccggatgcctccttgccacagccgtcatcactctgttcagtgaacctaacactgaggaaggtggaaagactccattgacggtggcccagaaaaaagcccagaacataatgcagtcctttgaaaacccatttcggatg

SEQ ID NO: 6680 - DNA, 468 bp, Mus musculus
gaagagacctctgtggatgccggatgcctccttgccacagccgtcatcactctgttcagtgaacctaacactgaggaaggtggaaagactccattgacggtggcccagaaaaaagcccagaacataatgcagtcctttgaaaacccatttcggatgttcctgccttctctggaacacaaggcccacatctctcaagcagcaaagtttgatccttcttcgaaaatctatgaaagccctggtttggtccccagcacaacgtaaagctggcgtggagatgcacacctgtgagctcagcacttgggaggagacagcagaggacccgaagctcaaaggcgtcttcagccacacagtgtattctagataacggggggtctaagaggccctgccttttaaaaaaaaaaaagaaaagaaaaagaaagagaaagaaaaagcagcaagcagcctgctctgctctgcttcacacgagta

SEQ ID NO: 6681 - DNA, 539 bp, Mus musculus
gagtcatttgccagagacctgccagacttcccttccattaacgtggatcctgctggcctggacgacgaggacgacaccagcattgggatgcccagcttgatgtaccgctccccaccaggggctggggatacccaggtcctgcctgctagtcggaatgaggctgcactgccagagctcctgcttagttcccttcctggaggatctaaccttaccagcaaccttgccagcctggtctcccagggtatgatccaactggccttgtcagaggcctcccagacagacccttctggcccacctccccgaagagcaacaagaggcttcctccgggcccctagttcagacctggacactgatgctgaaggagatgattttgaacttctggaccaatcagagctgaatcagctagaccctgccagttctaggagccactgagagactcctttgaggggggtcactgtgctgtaggttattttcctccaccccacttactgtgatggggcaagggaagaacccagtcttgtcccctgaattttatctgt

SEQ ID NO: 6682 - DNA, 537 bp, Mus musculus
acttgccgaaattgtttgcgcatttcaagaaaaacaacttaactgcagatatctacctaatcgattgaggcccaaggggctggagagatggctcggtggttaagagcatgttctactcttccagaggacccacgtttggttcccagcacccacatcaggtggttcacaatcacttataactccagctccatggggacctgatgcctctggcttccacaggattttcaccttgtacagtaagtccctgcccttggacttggcctgccgcatctgggacgtattctgtcgagatggagaggaatttctcttccgcacagctctgggcatcctgaagctttttgaagatatcctgaccaggatggacttcatccacagtgcccagtttctgaccaggctgcctgaggacctgcccgcagatgaagtgtttgcagctatctccacagtccagatgcaaagccggaacaagaaatgggcacaggtgctgtctgcactgcagaaagacagccgggagatggagaaaggaagcccatccctcag

SEQ ID NO: 6683 - DNA, 124 bp, Mus musculus
ggaagattcagagtggacagtgtttgagaagatttgaaagggcacatagtaaaggtgtcacctgtctaagcttttccaaggacagcagtcagatcctcagtgcttcttttgaccagacaatacg

SEQ ID NO: 6684 - DNA, 267 bp, Mus musculus
aatgcagatgataaggctaacagtataagatgtgcacctcagatggcaagctctgatctgagcaatatgtagacagaacagataattccttacccttttcaaaacctacgtagtacttgtgattttcacttttgtctttttcatgtattttaatgtggaattggggattagaagccatgttagttgaaggctcttgtttacaacttccttttgtggtcttcattagcatgaagtcataataaattcctgacaatacgaaggttcttg

SEQ ID NO: 6685 - DNA, 96 bp, Mus musculus
gaaggtcctagagtcagtgtttcgtatcccacctgaacttgatatgtctttattacttgagttcattggtgctaatgaagacaccggacattttaa

SEQ ID NO: 6686 - DNA, 123 bp, Mus musculus
ggacgtggtagcaacgagccccacataaagcgtccaatgaatgccttcatggtgtgggcgaaagatgaacggaggaaaatccttcaggcctttcccgacatgcacaattccaacatcagcaag

SEQ ID NO: 6687 - DNA, 273 bp, Mus musculus
ccccagtcagcatgtgcactgaattaagatggtccatcgaaaaggattttagcagtctttgcgacaaacagccaattggaagacttctttttagacaattctgtgatacaaaaccagatctaaaaaggtgcattgaattcttggatgcagtggcagagtacgaagttaccattgaagaggaacaaagagaatttggactagccatcttcagtagattcttcaaagagaagtcagaagtccccttaccagagatacctccagatattgtgaaag

SEQ ID NO: 6688 - DNA, 503 bp, Mus musculus
atccaacaaggatgcagctctaatggaagctgcccgggccaataacgtgcaggaagtcagaaggctgttatcagaaggtgcagatgtcaatgcaagacacaaacttggctggacagcactgatggtggcatccatcagccacaatgagagtgtggtgcaggtcctgcttgctgctggagctgacccaaaccttggggatgagttcagcagtgtctacaagactgccaatgaacagggagtccattctctggaagattaggtcagagaccatactgattcacttcatgtccccaaaatgactcctacatgtcagccaacgctcatgaaacaaaccagactgttttacctcctctttccctgcccagatggccaagcacacagttcctagtcactcgagaggatgacttcaacaaccggctaaatcaccgtgctagcttcaaaggctgcacagccctgcactatgctgtcctggccgatgactacagcatcgtcaaggagctgct

SEQ ID NO: 6689 - DNA, 536 bp, Mus musculus
actcattcactgtagtccatcctaattttgatgcaaaattactgaaaaatgacttgatgctgataaaactctcatatcctgctactatcaacatgtatgtgggaactatagccatagctatggaaccaatggcatttaatgaatcctgcttcataccaacatggacctggaataactacaaaaaccttagtgatcctgacatcttgacatggataaatgagtattctctttccccaagtgactgtttggacactcttcatcaacagaaacaagaaacaagaataaacattatgtgcataggacattcacttaatgctatgtctgcaactaaggaagtatcagctgctccagccatctgcagtgggagggtgcatggaatattgtcctgggggaaagcaagtgtagccaatggaagcaaaggcttcttcactgaaattcatccctatgcaagatggatcttaaaaatgatacgatcacactgagaagtgacaccactcagtataaaatcatgccgtctgtacaatggatcaacaatt

SEQ ID NO: 6690 - DNA, 517 bp, Mus musculus
agcaggtccctgttttgttctgtcttaaggtgatgttctgcaaggccttggacagtgtggccgacattccaaggagctatggttgtcacatggtaccagcagctggaagacgggactaacgtatcatttcactgtgttccctcaccttagggctacatcctggacatggaggtaaaggcattatcagaccctgggagaaatagtgagtggtggtgatttagggacaaaacaaacctcacattggttcaagagccccctgctgtaacaaatccgggatggggagtcagatagagtacaggaaataggagaaaaggcgggggcagagcgaggccgtggggggccggcctgaggcagcctgcaacagagaagagacaggaaatcagggttgtggaaacaaccccctttttctggtctgttagccaggggctgggaaatgaaaagggcagtgtgaagctgggtagggagaggcaggttcatcattgccagtcactagagtcagctagccagtgtctcgaga

SEQ ID NO: 6691 - DNA, 283 bp, Mus musculus
tgaagacccggacatgcctcaacctcaggcgacccctgagcattcagatgatcccaaattagaagagacgaatgctgtacttcaaaatgctattcgtaagatgcacagactcgacaagctattggccaaaaaacaatgtagagaaaaggaagttaaaaagcaaggtctagaaatgagagttaagctgtgggaagagctcaagtctgcaaaaaacactgaagacttagaaaatgacgaggagttgggaaacacaaaaaagtttttgtgcttgacttcagaatct

SEQ ID NO: 6692 - DNA, 492 bp, Mus musculus
agcaacatcctttgtacaatgcagagagatgcaaagtgttccagtgtgacctcactagagacgacctgcttgaccacgtcccaccagagtctgtggatgccgttacattgatctttgtgctctcagctgtgcaccctgagaagatgcgccttgtcttactaaacgtgtacaaggtattaaaaccaggcagaagtgtcttattccgtgactacgggctgaatgatcacgccatgcttagatttaaagctggaagcaaacttggagaaaatttttatgtcaggcaagatggaaccagatcgtatttttttactgatgaattcctggcgcagctctttgtggatgcaggttatgaagaagtggtgaacgagtatgtgtttcgagagacagtgaataaaaaagagggcctgtgtgtgcctcgagttttccttcagagcaagttccggaagcctccgaaggacccagcccctaccagtgactctgcttcactttgaa

SEQ ID NO: 6693 - DNA, 520 bp, Mus musculus
gggcactgactgtgactctgaacttggtaaagcagcactttcagaactaccgcttggttcttccttgtcttcagctcttgcgagtctattctaccaactctgtgaactcagtatctttaggtaaaaatggagttgtggagttgatgtttaaaatcattgggccattcagtaagaagaattcgggtctcatgaaggttgctttagacactcttgctgcattgctaaaatcaaagacaaacgccaggagagcggtggacagagggtacgttcaagtgcttctaaccatctatgtagattggcaccggcatgataatcggcatagaaacatgctcattcggaaggggattctacagagcttaaaaagtgtcacgaacatcaagttgggcagaaaagcatttattgatgcgaatgggatgaaaattctgtataacacttctcaagagtgcttggcggtcaggactcttgatcctcttgtcaacacatccagtctgataatgagaaaatgcttccccaaaaaccg

SEQ ID NO: 6694 - DNA, 121 bp, Mus musculus
cttcgaagccgctccactcgcatgtccactgtctcagaagttcgaatccctgctcaggagaatgaaatggaggtggagctgcctgtgcctacaaactctcgcaagcagtttgccattccca

SEQ ID NO: 6695 - DNA, 381 bp, Mus musculus
gagtttagagccatttaccggtgtattgtacatagagaagaaatcacggagattttcaacacgtatactgaaaataggaaaattctttctgagaacagtctgattgagtttctaacccaagagcagtatgaaatggagatcgatcactctgattcagtagagatcatcaataagtatgagcccattgaagaagtaaagggtgagcgacagatgtcaattgaaggtttcgcaagatacatgttttcatcagaatgtctactgtttaaagagaactgtaaaaccgtgtaccaagatatgaatcatccattaagtgattattttatttcatcatctcacaacacatatttgatatccgatcaaatattgggaccgagtgacatt

SEQ ID NO: 6696 - DNA, 481 bp, Mus musculus
catttctcttgggacaggcttcaggaactcagagtctacgctccatgcgccgctccacagctcttagcagtagctcggagtattgctccaacagggcctgcgtctgctcagcccccacagccccagggctgccacctgggctggacagcaccgccccagccagaacctcgagctcctgtcgcaccgaagagaaggtgtctctcaggagacgggtgatgtgactttgctctgccgaaggtgtcttatagctggtcacctgcaacaggaacactgaaagtgagctggagagcagtagacagtggaatatagaaaaggggctctgccagtgccttgcccacccagtagaagggactgcctaggagttctacacacaagatcaggatggccagagtcactctgatgggtggcccagatgaggatccctccagactattagaaccatctacttcttgacaacttttcccaacaactctttcagatg

SEQ ID NO: 6697 - DNA, 553 bp, Mus musculus
gtgcattgaaatcgtctcactggccttctgccctgaggctgacgtcatgtctgatgagactatccagcaggtatatgtggagtacaaattctgtgatctgtctctatcggagacagagacttcgatgtccctgaggaaactaatggcaggcgaagaaatccacttctactttagtaatgtgatagatctggaccctgtggagcaccaaagccgaaggcagtttttgtttgccatgctacatgctcaagattctgatgagggacgtgtcaagtttacagtggtaagtgatcctctggatgaagaaaaaaaagaatgtcaagatataggctatgcataccttgaactgtggcagatatttcaatctggaaaagatatcctagagcaagaactagagattgtgagccctagaaaccaggccatccaaattggaaggctgaaggtttccctccaagcagctgctgccctccatggcatttataaggagatgactgaagatctgttttcatgaaagtacaagttctactccactcaacgatttgagggcatcacagtc

SEQ ID NO: 6698 - DNA, 114 bp, Mus musculus
gcaagagaaggtcagctaaatggttcatctgcagcacatggtgaaataagaggctgtagtacttgagcaagctggagaaatcaccactagaccatgctgtggggccttcctgtg

SEQ ID NO: 6699 - DNA, 429 bp, Mus musculus
aatcaccactagaccatgctgtggggccttcctgtggatgtgttaacaagcaaacttgcaagaactcaacagagctcccaggaagtaccaatacccagaagttgaagcctggggtagaataggggtggcagtgttgcaccttcccttcatgctggctgtttcttgatactctgctgcctggtccagtttaacacccaatgacatcaggacccaatgcagctcctacctaccccaagactggacaggcttatctacacagcagaccaatgtgatgactcctggctatggctgcagctctgcaggacttgaggagcaagaagtcatggagtcagtgggctcttgttgcagttttgtactccacttggtttttcaattgagcttatggcttttttaaaacatgacttgaagctctagttttctagatctttt

SEQ ID NO: 6700 - DNA, 240 bp, Mus musculus
gcacactgagtggtggtattctctccagcggcaagggaaagtacagccggttagaagttcaagctgatgtccaaaaggaaattttccccaaagacacagccagtcttggtgcaattagcgacagcgcaagcactcgtgctatggccggttccataatcagttcctacaacccacaggacagagagtgcaacaatatggaaatccaagtggacattgaagccaaaccaagtcactatcagt

SEQ ID NO: 6701 - DNA, 458 bp, Mus musculus
tcgggccccaactgtatcagagttatggggccacatggactctgaggtaccgaagtcagaaagctacaggcagcggccctcgttcactactttcttggacagacagaagtctcatcagagatctgtagtactaaaagaggtgaagcctgtgtcgggtcccaacctgaagggggaggaagagccacttatggccagtaaggctgaagctgtggaaaacccaacttctgaccagcccacaaggcaaagatgaggctgcgcctcaatctcaaggagcaacagatgatcacccagatcttctccttcaaccttcctccccttcatcttgttaacctggaccccaactgcagcagtcattccttggtgaatcctccagtcaagcctgccagagaaacacacaggtcacgtaagcagtggcctccctccctcagccgaagcacctgcacggaaacagagccata

SEQ ID NO: 6702 - DNA, 251 bp, Mus musculus
gaaggaggagctcaatgctatctcaggacccaacgagttcgctgaattctataacagactcaagcagataaaggaattccatcggaagcacccaaatgagatctgtgtgccaatgtcagtggaatttgaggagctgctgaaggctcgagagaatccaagtgaagaggcacaaaacttggtggagttcacagatgaagagggatatggtcgctaccttgatctccatgactgctacctcaaatacattaacc

SEQ ID NO: 6703 - DNA, 514 bp, Mus musculus
ggatgcgcacgataaccttgcaggtggctgtccggggccctggacctcggtcttgagcccgcacgtccagctcgtaggtgtcctggcgctcgtagtccacctgcccagccaaggtgaggcggccagagcgcgggtcgagccggaagaggtggcgggcttcgggaggggtgcgggcgccgaaggtgaacacaacgtcgccgttgggaccttcgtcgggatcggcagcgtccaggtcgagcagcagcgatcccacagggcctctctggaagcaacactcgccctgttccagaagaacaaaatcacagcgtgacgttgaaacctggcaggaacctggggtaacttagccatctgcctatgaaaccgtagaacttcagcattaccactttccctggctggggtcctcgagatgcctccgtaggtatccaggtatctccactcccggagctgaaggacaggttgtgccaacctggaacaagactgattcttattgattcttaccgaaggactctattga

SEQ ID NO: 6704 - DNA, 475 bp, Mus musculus
aaatgtcgtctttattgtcctggagataggacgagtgaccaaaaccaaagacggccatgaagtgagatcctgcaaagtagctgatagaacgggaagcatcactatttctgtgtgggatgagatcggagggctcatacagacaggggatattattcggttgaccagagggtatgcatcaatgtggaaaggatgcctgacactttatactggaagaggtggtgaacttcaaaaaattggagaattttgtatggtgtattcagaagtgccaaatttcagtgagccaaacccagattatagaggacagcagaatagaggggtacaaaatgaacagaaggataaactgagcaccaatacatttggaccagtgggaaatggtgatcagactggccctgaatctaggggatatcatcttccatatggcagaagcaatggtccgggacctatcagtccacagctaccaggaacacctagtagt

SEQ ID NO: 6705 - DNA, 441 bp, Mus musculus
  misc_feature (268)..(268): n is a, c, g, or t
  misc_feature (276)..(276): n is a, c, g, or t
  misc_feature (413)..(413): n is a, c, g, or t
  misc_feature (416)..(416): n is a, c, g, or t
ggcgtgtaaacacagatccccgggccccgcccctcagagtcgtgacgccgccgggaccaccggggcgcacagcgtcacctgtggcgcttcctgccccagcgagccccgtggcaccccacttaagtcccgccaagttccccttaaaaggtggaaaacaacttcagagtctgactccattaaacacagctcgtccccaaagccttggaatgtccgctcctcacgtgacacctcacaacccatccttagactccagaaggctggatgagcncagggaanttaaggtggaaaggagcaagactagttgggatgcagtagactgcaggccacttctatatgactattctgacgacctgctatatgactattattccagaactttctagaccaaagacatgggtagttaagtgcttagntanaagttctgatgacattgtggctgta

SEQ ID NO: 6706 - DNA, 135 bp, Mus musculus
tagacttctggctaaatctggacgtctaactgtagagattgccgacgcagggtaaaggagaggtaggagatgacgtgaatacccagtcgccataaaaagaagatcgtggacacgtcttctgcaagtgattttgaa

SEQ ID NO: 6707 - DNA, 565 bp, Mus musculus
  misc_feature (359)..(359): n is a, c, g, or t
  misc_feature (361)..(361): n is a, c, g, or t
  misc_feature (367)..(367): n is a, c, g, or t
  misc_feature (384)..(384): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (416)..(416): n is a, c, g, or t
  misc_feature (419)..(419): n is a, c, g, or t
  misc_feature (487)..(487): n is a, c, g, or t
  misc_feature (490)..(490): n is a, c, g, or t
  misc_feature (510)..(510): n is a, c, g, or t
  misc_feature (523)..(523): n is a, c, g, or t
  misc_feature (535)..(535): n is a, c, g, or t
gtcctggctgtcattctggtgctcatgatactcttaataatcatatgcatcataagtgcctacaccaagtcagagaccgcttccgaagcagggccttcagagctagaggagcttccagaaggggagaaggaagagcaggaggaggtcctaccagaagaggctaaaggggaggaggaggagttggagtatgggaaggaagaagcagaagagcaaggagcagtagaagaggaaggagcagaagaggcaaacgaagaagcagcagcagaaaagaaagacgaagatgaagaagagggagaggaataagtgggggagataaagccaataagtagccgagcctctcacagccctgagaatgagtntncaggangcagaagctgtgggaanctgccantntnagtgggcaagggaggaagganccntctgtcactagtgttcaatggacaggtgtttacatactatttcagtactttacatatttcatttgaanttntcctatagctttggatattnttgttcttgtatntttgggctgatnttttagtcaccagaaaatgctttcttccac

SEQ ID NO: 6708 - DNA, 383 bp, Mus musculus
gatcatcagcttgtcaatcttctcttgctccacaacattcactttcttgctaaccagagcaggcgcaatagttttattgatgtgctcaacagcctgtgagacacccttccccatgaagcgggtcttatcattgtctcggagttctagggcctcgtagatgccagtggacgcaccgctgggcaccgcagctcggaagagaccttttgcggtgtacagatcgacctcaacagtgggattcccacgggagtcaaagatctctctggcgtggatcctgagaatagacatggcgaatttctggcagtaggatcgctgcaaagcaaggaaagagggtctagaaaatatttttatcagctggtaggattgcttgactgctttttaggttt

SEQ ID NO: 6709 - DNA, 421 bp, Mus musculus
  misc_feature (60)..(60): n is a, c, g, or t
  misc_feature (264)..(264): n is a, c, g, or t
  misc_feature (267)..(267): n is a, c, g, or t
  misc_feature (271)..(272): n is a, c, g, or t
  misc_feature (283)..(283): n is a, c, g, or t
  misc_feature (315)..(315): n is a, c, g, or t
  misc_feature (324)..(324): n is a, c, g, or t
  misc_feature (335)..(335): n is a, c, g, or t
gggtggccactctgctacggtttgcttcgctctcaacagtgcctccctcccccagcaganctgaagtgcttctgtctaagaactaagtccattccctttcgggacttgccaccatcatcctgttctctgggttcctatttttggtggtgttaagtgaaggaagaagtgttccctctaatttctccctgtcccagtatataacctgctatcttggggcagcttttgatgtctgacatgtcacccttcccaagttggtctcttccnacnactnnctgtcttcacngtggcaccctcttaccacaaccctaactctgntcatttgtncctttctcttntcatctctgtacactactaatattcactgtgggttggggagctgattttaagcatgttcagtggctcccctccagtttcagtgtaa

SEQ ID NO: 6710 - DNA, 323 bp, Mus musculus
  misc_feature (31)..(31): n is a, c, g, or t
  misc_feature (42)..(42): n is a, c, g, or t
  misc_feature (51)..(51): n is a, c, g, or t
  misc_feature (55)..(55): n is a, c, g, or t
  misc_feature (65)..(65): n is a, c, g, or t
  misc_feature (75)..(75): n is a, c, g, or t
  misc_feature (88)..(88): n is a, c, g, or t
  misc_feature (92)..(92): n is a, c, g, or t
  misc_feature (114)..(114): n is a, c, g, or t
  misc_feature (236)..(236): n is a, c, g, or t
ggaacgctgcaacctgggtataaatattatncctttattttnggctagagnaaanttatttttancctagatctnaccattttcatantctnacctgaaagattcacagaagtntcaagtgctatgcattgaaacttgttttttaaacattacctggcactgtgtatattaatgtaaaacaatgttaatttacccagattttcagtttgtactgcctggtatgtctgtgtaagaanccaatttttgtgtatttgttacagtttcaagttatttatatttgatgttttgtaaactcaaacaacaaatatactgtacttatggac

SEQ ID NO: 6711 - DNA, 134 bp, Mus musculus
  misc_feature (71)..(72): n is a, c, g, or t
  misc_feature (74)..(74): n is a, c, g, or t
  misc_feature (101)..(103): n is a, c, g, or t
  misc_feature (107)..(107): n is a, c, g, or t
aggatggttgactgcatcattatggacagaagtactgtggctggaatgaaggacaaccaccttgttccttnntntggaagcttcagagtttttggacattnnnttcntccagttggcatttgtttgaaattgta

SEQ ID NO: 6712 - DNA, 262 bp, Mus musculus
  misc_feature (58)..(58): n is a, c, g, or t
  misc_feature (82)..(82): n is a, c, g, or t
  misc_feature (88)..(88): n is a, c, g, or t
  misc_feature (124)..(124): n is a, c, g, or t
  misc_feature (131)..(132): n is a, c, g, or t
  misc_feature (149)..(149): n is a, c, g, or t
  misc_feature (166)..(166): n is a, c, g, or t
  misc_feature (211)..(211): n is a, c, g, or t
atccgtgccagctgggatggagacccctgaactcattgagctgaggaagaagaagatngaagaggcgatggatggaagtganacaccntcagttattcactgtattgccagagaagagaacagncactgtnngggggagccatgatggnatccacccacatttatnacatgtccacggttatgagccggaagggcccagcccctgaattgncaaggtgtggaagtagcgctggcgcctgaggaattggagttggaccccatg

SEQ ID NO: 6713 - DNA, 534 bp, Mus musculus
  misc_feature (151)..(151): n is a, c, g, or t
  misc_feature (308)..(308): n is a, c, g, or t
  misc_feature (333)..(333): n is a, c, g, or t
gcagctctagttctgagtctgacctccagacagtgtttaagaaagaaaatatcaaaactgagccacagtccagctgcagacttcaggaactccaagccaagcagtttgtaaagaaagatgctgccacctattggcccttgaactggcgcancaaactatgcacctgtcaagactgtatgaaaatgtatggagaactagacgtcctgttcctgacagatgaatgtgatacagttctggcttatgagaacaaaggcaagaacgaccaggcaactgatagaagggaccctttaatggacacccttagcagnatgaatagagtccagcaagtggagntcatctgtgaatacaatgacttgaagactgaacttaaggactacctgaagagatttgctgatgaaggcacggttgttaagagagaagacattcagcagttctttgaagagtttcaatcaaaaaagagaaggcgagtggacgggttacagtattactgcagctaaagtggaatgccacttcctcggtcaggttcacgaaaat

SEQ ID NO: 6714 - DNA, 241 bp, Mus musculus
  misc_feature (26)..(28): n is a, c, g, or t
  misc_feature (34)..(35): n is a, c, g, or t
  misc_feature (41)..(42): n is a, c, g, or t
  misc_feature (45)..(45): n is a, c, g, or t
  misc_feature (59)..(59): n is a, c, g, or t
  misc_feature (69)..(69): n is a, c, g, or t
  misc_feature (71)..(71): n is a, c, g, or t
  misc_feature (92)..(92): n is a, c, g, or t
  misc_feature (95)..(95): n is a, c, g, or t
  misc_feature (97)..(97): n is a, c, g, or t
  misc_feature (120)..(120): n is a, c, g, or t
  misc_feature (168)..(168): n is a, c, g, or t
ttcaccatcctatccctaaatcaccnnncccctnntccacnngtnactggatcccactntcaccctcgntncttacacatttcagacccttnagncnaacccttgcatagagtggtaganccatatctcagtgctcggtttcagtattcaactctccactccctgtgnccagttgggatttaaaaactcagattgctatggaaaggggctttgctgggaaaggcgactcctctaacttcac

SEQ ID NO: 6715 - DNA, 529 bp, Mus musculus
tgggatcctacaccttgcaggccgagcatggggactatgacccagaagaatatgacagtattgatcttggtgacttccagtttgccccggcccacaccaaggagttggaggaaaaggtgtcagaactgcataaaactcacaggggcttatctccagcacaagccgactctcagttcttagagaacgcaaagaggctttccatgtacggtgttgacctgcaccatgccaaggactctgaaggtgtggacatcaagctgggtgtgtgtgccaatggccttctcatttacaaagacagactaaggatcaatcgttttgcttggccgaagattttgaaaatttcctataagcgcagtaatttctacattaaagttagaccagcagagctggaacagtttgagagtaccattggattcaaattgccaaaccaccgggcagctaaacggctatggaaggtgtgtgtggaacatcacactttctacaggcttgtgtctccagagcagccaccaaagaccaagttcttgaccctggg

SEQ ID NO: 6716 - DNA, 285 bp, Mus musculus
gcctgtttctccagtgagcagctgagggtatgccgccatggctgtcactgacaaaaccaaaaggttaagatgtccctgacctagggagtcagtcacgacctcccaggagacgctatgttgaactattggaatggaacctttaaaagcaatgacggtgtggaatacttcccaagcactgagtcactgtgtgacgcacgaaccaaagcatcgaccagtgctacagcccctcttcatggataccactaggttttactgtactgggcgcccttccaattttatctaatt

SEQ ID NO: 6717 - DNA, 359 bp, Mus musculus
  misc_feature (135)..(135): n is a, c, g, or t
  misc_feature (178)..(178): n is a, c, g, or t
gccaccgccgagtgagactgaggactccgatcgagacgtctcatctgatagctccatgagatagaaaccagtgtctggcaccccagagctcactggggcaggggtgtgggtctgcaggggtgtgggtcttctgtnccactgcatgaagcctggccctgggctgtccctccccaggttntggggtgtctggagctaggctcagccccaccctccctgtacaacgcccatgacattgggacactccttcctgccttcctcacatgtgggtatctgctacttctccatcttcggaatgctgccaggacacttgtgagcctcccttttccactttgtaaggaatgtgatcacgggacctgcct

SEQ ID NO: 6718 - DNA, 266 bp, Mus musculus
cggtgctctgtctacgcaggataaatgaatgtttctagttcgctgacttaagacacaggctgtttacaaatcgctagctcgaaggtctacttgtcgcggctttgagttactctccatttctgcagaggtgaggtgcagtctcctgctcatcaactggagatttagtcataatgcctcctgagtttgtgtgaatagcttgctcactttgctggcctttgatatgtatgttctctgtggtaaactgtccatgtgtttgtattaagtgc

SEQ ID NO: 6719 - DNA, 203 bp, Mus musculus
  misc_feature (76)..(76): n is a, c, g, or t
  misc_feature (97)..(97): n is a, c, g, or t
  misc_feature (115)..(115): n is a, c, g, or t
  misc_feature (125)..(125): n is a, c, g, or t
  misc_feature (131)..(131): n is a, c, g, or t
  misc_feature (133)..(133): n is a, c, g, or t
  misc_feature (142)..(142): n is a, c, g, or t
  misc_feature (144)..(144): n is a, c, g, or t
  misc_feature (149)..(149): n is a, c, g, or t
  misc_feature (151)..(151): n is a, c, g, or t
  misc_feature (153)..(153): n is a, c, g, or t
  misc_feature (155)..(155): n is a, c, g, or t
gtagcaccgggcttttgatggacctggcagccaatgagaaggccgttcatgcagacttttttaatgattttgaagnacctttttgatgatgatgatntccagtgaggccgcccgntcctatgtgntccatntntgtgatgtntntggantntntncgggacacgaccagctgattgtagacaccgtgttgatatcactagaaa

SEQ ID NO: 6720 - DNA, 148 bp, Mus musculus
  misc_feature (80)..(81): n is a, c, g, or t
tgggccagttcatagcaaagttgtacttggaagacttcaacctttaaagaagactggtggaattgacctgtccatgatannccttaagtttgaacattagctgaccttctgtgttaaacatgggtctaatttatttactgtttcattt

SEQ ID NO: 6721 - DNA, 278 bp, Mus musculus
  misc_feature (83)..(83): n is a, c, g, or t
  misc_feature (89)..(89): n is a, c, g, or t
  misc_feature (103)..(103): n is a, c, g, or t
  misc_feature (129)..(130): n is a, c, g, or t
  misc_feature (132)..(132): n is a, c, g, or t
  misc_feature (212)..(213): n is a, c, g, or t
acaggttcttctgagtgcggctgaagcagcagaggtgatcctgcgagtggacaacattatcaaagcagcaccaaggaaacgtntccccngatcaccacccctnttaagcattcccatttgctgatgaanntntgggccagttcatagcaaagttgtacttggaagacttcaacctttaaagaagactggtggaattgacctgtccatgatannccttaagtttgaacattagctgaccttctgtgttaaacatgggtctaatttatttactgtttcat

SEQ ID NO: 6722 - DNA, 102 bp, Mus musculus
tcctacctcttccaagcagcatggtgtgaatgtcagtgtgaatgcctcggctacccctttccaacagccaagtggatatgggtctcatggatacaacactgg

SEQ ID NO: 6723 - DNA, 505 bp, Mus musculus
  misc_feature (299)..(299): n is a, c, g, or t
  misc_feature (316)..(319): n is a, c, g, or t
  misc_feature (405)..(405): n is a, c, g, or t
  misc_feature (467)..(467): n is a, c, g, or t
cagaaggcggagtagatcccctaaaagaagaagtccttctccccgaagagaaaggcataggagcaagagtccacgacgccatcggagcaggtctagagacagacgacacaggtcccgctctaaatccccaggtcaccaccgtagtcacagacatagaagccactcaaagtctcctgaaaggtctaagaaaagccacaagaagagccggaggggaaatgagtaatggatgcatcttgactttggtccaaatgacctcctgtggctatgagagcatctgtttaagtggaatgatcaagatntcctcttcaggcagctnnnnagtattttgggtttttcaaaatcaacttcttcttttgttgggttttgtttttattttaatattacagaggtgctaagttttgtatntctttggattataaccaacagctttgaagagtgtttttgaccaaatcaaggtcaagttttgncctaacccactatggttattcatacttagcagggtcaa

SEQ ID NO: 6724 - DNA, 201 bp, Mus musculus
  misc_feature (34)..(34): n is a, c, g, or t
  misc_feature (40)..(40): n is a, c, g, or t
agcgcgtgtgccaccttatttagctaagcagatngtgtanttcattgggatgctgaaggagatgaatgggcttcgagtgaatgtggcagttaaacataccttcattttttggacttgcatatttagctgtttggaacagagttgtttcctttctgaatttcaaagataagactgctgcagtcccatcgcaatatccagtgg

SEQ ID NO: 6725 - DNA, 87 bp, Mus musculus
aataaatacagccctcctcctcagtctccagagctgtatgtggcagctagtaagcactttcagcaggcaaaaatgatccttgaaaat

SEQ ID NO: 6726 - DNA, 380 bp, Mus musculus
aaatatccccaatccagaccgtgaggtcagtagaatcctgaaggttgccaagcccaactttgtggttatgaagctcttagcaggaggacacaaaaaagagtcaaaggttcctcccgaattcgacttctctgttcacaaatattttcctgttgtgaaactggtttgaaagagactgcaaagatgaccgtgtccactctagggaagacatcagtctgccacacatggtgacagaaagtggatctcttgaatgacagacagcttgctacaaggaagacttttcagtttaccacccttacctagagaggatgagaactgctgttttaaagtggtttattgtactccatggggtaactgggctggaatgcattggtgaacgctac

SEQ ID NO: 6727 - DNA, 213 bp, Mus musculus
  misc_feature (29)..(29): n is a, c, g, or t
  misc_feature (39)..(41): n is a, c, g, or t
  misc_feature (48)..(48): n is a, c, g, or t
  misc_feature (50)..(50): n is a, c, g, or t
  misc_feature (56)..(56): n is a, c, g, or t
  misc_feature (61)..(61): n is a, c, g, or t
  misc_feature (66)..(66): n is a, c, g, or t
  misc_feature (73)..(73): n is a, c, g, or t
  misc_feature (76)..(76): n is a, c, g, or t
  misc_feature (88)..(88): n is a, c, g, or t
  misc_feature (107)..(107): n is a, c, g, or t
  misc_feature (125)..(125): n is a, c, g, or t
gtcacattcttgaggagtttgctaccttncaagatgagnnnagagaangnttgatncagcncttcntactatnttnttgaaacaggancctcagagacaacatctgncctgcttaggaacctggnttctttaccataacctccggattatgatccagtatctgctcagtggctttgagctggagctgtacagcatgcatgagtactactacat

SEQ ID NO: 6728 - DNA, 256 bp, Mus musculus
aacatgtcggagtccgagctgggcagaaagtgggaccggtgcatggccgacacggtcgtgaagctaggtactgggtttggattaggaattgttttctccctcaccttctttaagagaagaatgtggccattagcctttggttctggcgtgggattgggaatggcctactccaactgtcagcatgactttcaggctccgtatcttctacatggaaaatacgtcaaagagcagtgacttatgctgagaacatcccagc

SEQ ID NO: 6729 - DNA, 310 bp, Mus musculus
aggccgccggattgattatgttcttcaagaaaagccaatcgagagtttcaatgagtatctcttcgctcttcagagtcacttatgctattggggatctgaagatactgccctcttgttacttaaagaaatttatcgaacaatgaacattagtccagagcagccccagcattgagcagacttgcattttacagggaagttccagcatgagtgtcattgctgagaggctccttggtggctgatccgtctttgcatctatgatggatgacagaaaagtgactcagcaacaattgctagcgtggacttctcagat

SEQ ID NO: 6730 - DNA, 197 bp, Mus musculus
tttaagaacaaacccaagactcaagcaaaggcaggcaaagtgccgagggacaggcagagaccggccgtcatacgtgaacctcatgagaggaaggtcctggctctgctagatgctctgagcacaatacacagtcagaaaatgaaaaaggccaaagagcagagacgcctgcacaacaaggagcatgtgaagatgaagca

SEQ ID NO: 6731 - DNA, 497 bp, Mus musculus
  misc_feature (451)..(451): n is a, c, g, or t
  misc_feature (464)..(464): n is a, c, g, or t
ggctctcgtcgatctcatttataacatgtttaagaaggtgcccactagtaacactgagggcggctggtcctgctctctggccgagtacatccgccacaatgacatgcccatctacgaagctgccgacaaagccctgaaaaccttccaggaggagttcatgccagtggagaccttctcggagttcctcgacgcagcaggtcttctatcagaaatcaccgatccagagagcttcctaaaggacctgttgaactcagtcccctgaccatccccatggaaatgagattgaagctagcttgcattctcccctcattcatctctccgtgtgcactcatttcccccacggatgctgcattagcaccccctcctccctcagttttctcggagtggtttggggtctgtaggcttcctgttctatcacgtgtgtgtgtgtgctgcgcaggctatgaagttntctgtagctcaanccattgaaggacctatacgtacctaggagctgt

SEQ ID NO: 6732 - DNA, 512 bp, Mus musculus
  misc_feature (27)..(27): n is a, c, g, or t
  misc_feature (321)..(321): n is a, c, g, or t
  misc_feature (325)..(325): n is a, c, g, or t
  misc_feature (332)..(332): n is a, c, g, or t
  misc_feature (402)..(402): n is a, c, g, or t
  misc_feature (423)..(423): n is a, c, g, or t
accagtatattgaccccgtggtataangaactgcatagagaggctgcagcagatcttcctacagcatcaccagaccatccagcagtacatggtgaccctggagaacctgctcttcacggccgagttagaccctcacatcctggctgtgttccagcaattctgtgctctgcaggcctaacactcgcgtttcttccctttttattatcttgaaataacttgtcttatttttgatggtttgaatgtttgctttcttgtagtagcctttcacttcctgatggaaatgggggaggagagtgaggaatatgacgtgacccttagttncccntgcaggncaagtgtggcttgctaacagcgatgttatgttgaccgtagagttgtacatatgtgagcacaactttcctntgataaatttgatactttttntccttagggcacaaaacaacagatttgaggtgtgtgaaatgcaaggtcgggcttgcaaaatagtagatacaaccgagggactatcccca

SEQ ID NO: 6733 - DNA, 441 bp, Mus musculus
  misc_feature (323)..(323): n is a, c, g, or t
  misc_feature (390)..(390): n is a, c, g, or t
  misc_feature (402)..(402): n is a, c, g, or t
agatgatgacagcaaccagcccatgcctgtgagtcgcttcttcgggaatgtcgagcttatgcaggatctgccaccagcctcttcatcttatccttccatgagcagaagagaattcagaaaaatgcacttcagagccaaagatgacgaggatgacgctgaggggtagagctgcgggcgccttgcagccggtgtcaagattctgtatggcatctttcagagaacacgctctgagaacaaggtggacatcagtgtcactggctggcacagacgcccaggcgcaccatgctggcacagggggctgggcagtggaaaacaaggaaaantcctgagagctttggctgtggtaacaggcttactttccatgccagactgatcaccggggatgaattntgctggaaggantcctgtttctgagtggcgctaaccatttgacctggtagt

SEQ ID NO: 6734 - DNA, 453 bp, Mus musculus
  misc_feature (258)..(258): n is a, c, g, or t
  misc_feature (270)..(270): n is a, c, g, or t
  misc_feature (275)..(275): n is a, c, g, or t
  misc_feature (280)..(280): n is a, c, g, or t
  misc_feature (286)..(286): n is a, c, g, or t
  misc_feature (302)..(302): n is a, c, g, or t
  misc_feature (327)..(327): n is a, c, g, or t
  misc_feature (391)..(391): n is a, c, g, or t
  misc_feature (393)..(393): n is a, c, g, or t
  misc_feature (395)..(395): n is a, c, g, or t
  misc_feature (399)..(399): n is a, c, g, or t
  misc_feature (403)..(403): n is a, c, g, or t
  misc_feature (408)..(408): n is a, c, g, or t
  misc_feature (425)..(425): n is a, c, g, or t
  misc_feature (427)..(427): n is a, c, g, or t
gtctctgctgctcacatgagctggtgggggcttcagctgagcagttctcgccttgcctggcatcctgacacccctcagttaccctgcaggctagtggcagaaaccctagtgttctccaaatctgttggagcatctttgcacctcagatcaccttgagcctcttctgttgggggaggtgggccaggggccatcccacagaatggacaaatctaggagcccggcttggggtctgttcgcagaagaaaaacatgttgaagntggtaacaaganccctnttttnatgggncatgtaccccatggantcctggacacactaagccaccaacncccaggaggcacggaactctgaactgacctccagagccctatgcttgtttcatcacggacaatntntnggtncctngggtnctttgaggaacaaaggntnttatgtacccttagggcctaccagga

SEQ ID NO: 6735 - DNA, 448 bp, Mus musculus
  misc_feature (30)..(30): n is a, c, g, or t
  misc_feature (33)..(33): n is a, c, g, or t
  misc_feature (58)..(58): n is a, c, g, or t
  misc_feature (61)..(61): n is a, c, g, or t
  misc_feature (85)..(85): n is a, c, g, or t
  misc_feature (89)..(89): n is a, c, g, or t
  misc_feature (102)..(102): n is a, c, g, or t
  misc_feature (107)..(107): n is a, c, g, or t
  misc_feature (134)..(134): n is a, c, g, or t
  misc_feature (140)..(140): n is a, c, g, or t
  misc_feature (144)..(144): n is a, c, g, or t
  misc_feature (162)..(164): n is a, c, g, or t
  misc_feature (166)..(175): n is a, c, g, or t
  misc_feature (192)..(192): n is a, c, g, or t
  misc_feature (223)..(223): n is a, c, g, or t
  misc_feature (243)..(243): n is a, c, g, or t
  misc_feature (251)..(251): n is a, c, g, or t
  misc_feature (267)..(267): n is a, c, g, or t
  misc_feature (292)..(292): n is a, c, g, or t
  misc_feature (294)..(294): n is a, c, g, or t
  misc_feature (298)..(298): n is a, c, g, or t
  misc_feature (312)..(312): n is a, c, g, or t
  misc_feature (354)..(354): n is a, c, g, or t
  misc_feature (379)..(379): n is a, c, g, or t
  misc_feature (381)..(381): n is a, c, g, or t
agccccggttgctgacatgctgcaccttgnacnaaacgaatggaagcgtctgtgtacngantgtgactgagagtgaggttgcacntgcnaaaaatcttctgnaaacnaacatgctgctgcagcttgatgggtcnactccnattngtgaagacattggtaggnnnannnnnnnnnntataataggagaattcntatccccgagcttgaagcaagaattgatgcntgtggatgcggagacggttngacgagtntgcaccaagtacattnatgacaaaagcccagctattgctgntntggntcctattgagcgantaccagattttaaccagatttgtagtaacatgcgttggattngtgactaatttttgtgatcaaatantntgcacatatatatttataaaactaagagactggaagttttcaaaactgccagtgttcaaatgaaaaa

SEQ ID NO: 6736 - DNA, 327 bp, Mus musculus
  misc_feature (61)..(63): n is a, c, g, or t
  misc_feature (65)..(69): n is a, c, g, or t
  misc_feature (71)..(74): n is a, c, g, or t
  misc_feature (77)..(80): n is a, c, g, or t
  misc_feature (85)..(85): n is a, c, g, or t
  misc_feature (87)..(88): n is a, c, g, or t
  misc_feature (91)..(91): n is a, c, g, or t
  misc_feature (93)..(93): n is a, c, g, or t
  misc_feature (95)..(95): n is a, c, g, or t
  misc_feature (100)..(100): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (124)..(124): n is a, c, g, or t
  misc_feature (132)..(132): n is a, c, g, or t
  misc_feature (148)..(148): n is a, c, g, or t
  misc_feature (158)..(158): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (182)..(182): n is a, c, g, or t
  misc_feature (282)..(282): n is a, c, g, or t
  misc_feature (299)..(299): n is a, c, g, or t
acttagctcagttctcggggcgttcctctgcctagggtctcagtcagttgtataggatacnnncnnnnncnnnnccnnnnacccntnnttntnantcatntccaccccncnancattggaaccnaactcttnccctgagtttccagtngttggtaggnacacaatttttntnttntcccccnagttcctcaccttgaagttgcataaggacccgtgtttcctttttcttttattattattattatttttttttttgagaccgggttcttaccctacaactcngactggctggctatctntacatagatcaggctagctttaaactca

SEQ ID NO: 6737 - DNA, 459 bp, Mus musculus
  misc_feature (298)..(298): n is a, c, g, or t
  misc_feature (311)..(311): n is a, c, g, or t
  misc_feature (326)..(328): n is a, c, g, or t
  misc_feature (332)..(332): n is a, c, g, or t
  misc_feature (409)..(409): n is a, c, g, or t
atcacatttcctctagcgcagataattctgtttttccaaagtgttagcagctaattaaatctggtggactgggggaggagagagctgttctgtactggttaacatggtattctttaaggagaaaaaagccaaagaaaactcatccggcatgttagccttaaagatggtactggccagaagccggggcttaatctcttcagagctgcatatctcttatgtttgggtttggcctctaagtcttgtagattaaattaattcttgctgtatttttaaatttgagtaagggttatgtgcattnaactgtgttcctntcttttatcatcccnnngggnacgttcttaccataggggtcttgacaaagcaaagctaaaatgtgttgttgataaatagttcctgtgtaggtcagganccgaaataacaatagctctgcagctcatcgggctctgatttactcgagtt

SEQ ID NO: 6738 - DNA, 170 bp, Mus musculus
  misc_feature (96)..(96): n is a, c, g, or t
  misc_feature (145)..(145): n is a, c, g, or t
tacaggaagggatccaggcctcccttcttgatgtgtcagttcagggttcccagagctctctgtggttgccaaagccctctgtgtcttctctaaggnctgcagcagctacagcacatgggattccccactgagcaggctgcagtgnccttggcagctacagggcgtgtaga

SEQ ID NO: 6739 - DNA, 173 bp, Mus musculus
ttacctggcttcctcagactcctggcctcacagtgatggctctgctcagctcccaccacgcctggggcctggacagctgacatggaagaactcggagaggggcttggactgggctgggtctagctttgcttcagcaacgacgatgtgggcagccctagacgagcagatgctac

SEQ ID NO: 6740 - DNA, 490 bp, Mus musculus
  misc_feature (196)..(196): n is a, c, g, or t
  misc_feature (331)..(332): n is a, c, g, or t
  misc_feature (343)..(343): n is a, c, g, or t
  misc_feature (353)..(353): n is a, c, g, or t
  misc_feature (386)..(386): n is a, c, g, or t
  misc_feature (454)..(454): n is a, c, g, or t
gtaaattagtcagggctcatggagatgagatgttcacggctcccttgctcctgtggaatctgtagctacgaatgtcatgaaaataaatacattgtttgcgtccctcattacatagcaactggcatagtcccagctacagcaggtgtgttcacaatgaactgtttggacacagacctaacagtggcaagtgtgcttntaaccatgtggtctggtttcacagttctgggaactgcaactcccagcctcttactccaggaacaatacccaacggtgtcatccttgcgcaggggccatggtgatctgtattgttccagctgtagtggatgctctnnctgaaggggantcagcttttntcctcctggtgggtcctgcaggaagcagtgttntccttggtgcccggggaaacctcccatgtctgtttcctataggccacttgttcctcacgaccatccgncctgacaatcagaattcctatctcattgcttgtcag

SEQ ID NO: 6741 - DNA, 247 bp, Mus musculus
aaacatgtatccacctagactttaaatgtgctttgtaactgttgatggcactgtacagagggccaaagtatttcccatcagatagcatttttctgaacccatgcctcttgggacgagatcacaggacttgacccatcatcaaataggaccaggtgacctacagagacatcacaatgatggcttcctacagtcaagtccatttccaataatgctctcatctaagagaacccatgaaccttatttgaat

SEQ ID NO: 6742 - DNA, 82 bp, Mus musculus
gggaccaacagacagcttcacccttccttgagctgttgctgtacccctgaagctcaggcagctctgactttataaaacctaa

SEQ ID NO: 6743 - DNA, 361 bp, Mus musculus
gcgtgggtgatctaactgaggtcaaaggacagaccagtggcagtgtctggagctcctaccgaaagagctgtgtggacatggtcatgaaatggctggtgccagagagcagtggccgctatgtgaacaggatgacaaacgaggcactgcacaaagggtgctcactgaaggttctggcagacagtgagcggtacacttggattgtgctgtgagggctggactgccctggaccctgactccaactacctccacgggcccggagaggaccgccttcctgggctggccctacaagggccacaaccggcactagtgttaggttgcaggatggatgggactggcacagcagcctctggtggcccgagag

SEQ ID NO: 6744 - DNA, 166 bp, Mus musculus
tggaaggccagctagatcccagctgccagctgatggctactaactggatccaggaaaaagtgtttctctcacaggaggtgagcaagctgagggttatgttcctggagatgaaaactgagaaggaacagctgatggacaagtatctgagccataggcacatcctgga

SEQ ID NO: 6745 - DNA, 418 bp, Mus musculus
  misc_feature (268)..(268): n is a, c, g, or t
  misc_feature (304)..(304): n is a, c, g, or t
  misc_feature (321)..(321): n is a, c, g, or t
  misc_feature (362)..(362): n is a, c, g, or t
  misc_feature (364)..(364): n is a, c, g, or t
tgtttctctcacaggaggtgagcaagctgagggttatgttcctggagatgaaaactgagaaggaacagctgatggacaagtatctgagccataggcacatcctggaggagaatcttcggcgctctgacacagagttaaagaaactcgatgacacaattcagcatgtctatgagactctgttgtctatcccagagactatgaagagttgcaaggagttacaaggattgctagaatttctgagctaagaaactgaaaatattggaatgcnagtggtgtgcacctgtagttccagctgctccagacnccaaagttggagtgctnccaaatcccaggaatttgggaacctaacacagacaacacancnaaaaccctgaaaaatgaattccactccactccagtttccttcagggctctttat

SEQ ID NO: 6746 - DNA, 496 bp, Mus musculus
  misc_feature (26)..(26): n is a, c, g, or t
  misc_feature (55)..(55): n is a, c, g, or t
  misc_feature (388)..(389): n is a, c, g, or t
gaggaaatgctagggctactgccacntgaggagtagggtgggcttctctgatgtnatagtgttagttgagacttaggtgtgtgatcccggcacaactgtgttgctcagatgtatttacagcaagccattccgtgtgctctgctggtccagtctaccaaagttcctagaagggtggataccttcacatagttgttggtgtttgttttgttttgtttttttctccccaaagaaggtagatgacttaaatacagtggggaaggtggaaggaactcatactgtgcattctagcttcagcagactgattgcaagactcaaatttgatgtatgtgctatgctatgatcaggtgaagaccctctcccctgactgggatgaaacctcatttagatnntcttgaattaatacattgtgtgtaaacctggtatagaatgtagaacctttatgactttctgatttttgtaacagttaaatgtgggagctgcttacgtgtgtttaacc

SEQ ID NO: 6747 - DNA, 544 bp, Mus musculus
gtggtaactgagtgtccctgcgttcctgcaactgaggatgtgagcggcagtgccgttccagagacctggcccacctggagctctgaggagcaggggaaccagagtagtggaaccagcattggaagtcagcccctctccccccacctgggacagggagactgtcagggtcaccagctgtggtccagttgctgcccctacttgtatccctgtcctataaacttaaaaggaaaaccacttccctccatctctccccgacccctatgggaagtgtgctggccaggcagaggacagcacctgcgcctggggctggctccccagggtccccaactcagctggtggctgtggaactgagcccctccccctagcctctgcaaggccagcacccacatcactacctgcacctacagtgacccacccctgaaggcctggggatctggctgcagctgggaaggccggcaaggcactgacagcacccaccagctcttctccccaaccaccttccctagcctgtggtggtgggtagctgtcagaacgtgtgtcatgt

SEQ ID NO: 6748 - DNA, 520 bp, Mus musculus
  misc_feature (304)..(304): n is a, c, g, or t
  misc_feature (307)..(307): n is a, c, g, or t
  misc_feature (312)..(312): n is a, c, g, or t
  misc_feature (321)..(321): n is a, c, g, or t
  misc_feature (331)..(331): n is a, c, g, or t
  misc_feature (335)..(335): n is a, c, g, or t
  misc_feature (341)..(341): n is a, c, g, or t
  misc_feature (357)..(357): n is a, c, g, or t
  misc_feature (359)..(359): n is a, c, g, or t
  misc_feature (361)..(361): n is a, c, g, or t
  misc_feature (372)..(372): n is a, c, g, or t
  misc_feature (374)..(374): n is a, c, g, or t
  misc_feature (378)..(378): n is a, c, g, or t
  misc_feature (385)..(385): n is a, c, g, or t
  misc_feature (387)..(387): n is a, c, g, or t
  misc_feature (390)..(391): n is a, c, g, or t
  misc_feature (410)..(410): n is a, c, g, or t
  misc_feature (412)..(412): n is a, c, g, or t
  misc_feature (415)..(416): n is a, c, g, or t
  misc_feature (488)..(488): n is a, c, g, or t
  misc_feature (494)..(494): n is a, c, g, or t
tgagagctgtcccaagtggtgtgcccctcgcgcctctagcgacgagagctgtcccaagtggtgtgccccgcgtgcctccacctaccagtcgccgctgcaaaagaagtttaggtctacagatacagtgggttttgtggagtcggagctgaagaagattctgtcagtgcaacgagaggctcgcctctggaaggtgggcaaccccgagggccgggagctgctgacccagccagacatcacactggaggaggctggcatggtggacggccagcacctgctcctggaggagatggacgagatgggaaantgnccccntccagattngaggcccgtnccgncaggancccaccgtgcccacantncntgggaccccantntggngtgtgcntnttnnttgggacacatgcaaggantnccnnggggccctgggttttgggatgagtagcatcctgtgtgtgtgcggttggcctgcctggcactgtccctacccntcagantcctgcagatgacgttattaataaaa

SEQ ID NO: 6749 - DNA, 527 bp, Mus musculus
  misc_feature (287)..(287): n is a, c, g, or t
  misc_feature (311)..(311): n is a, c, g, or t
  misc_feature (314)..(315): n is a, c, g, or t
  misc_feature (317)..(317): n is a, c, g, or t
  misc_feature (326)..(326): n is a, c, g, or t
  misc_feature (335)..(335): n is a, c, g, or t
  misc_feature (337)..(337): n is a, c, g, or t
  misc_feature (361)..(361): n is a, c, g, or t
  misc_feature (368)..(368): n is a, c, g, or t
  misc_feature (455)..(455): n is a, c, g, or t
  misc_feature (466)..(466): n is a, c, g, or t
  misc_feature (481)..(481): n is a, c, g, or t
  misc_feature (500)..(500): n is a, c, g, or t
tttcatttctctgtggcgttgcttcttgcttcctgtcggatgttctcctgttgtggtgactagagatgttgtcagacatcccagtagttcccgatgtagctgtgtttgtaaatcgagaccctcttactcccagttttgtgtaggtggacacgttcatgtatttgatgtatcaatttaactcaactgatttcagaaaaaaaaattctgtattagaacaagatctctagcctgaaacggaatgctgaatttgtacagattacacatagaaagtagtttgcttaactgangtgttatttagaacatatttcagnatnntncaaagggtngggggcttntntccatcaccaggaacattctggcnagaaaantctgtgctggactgatttatcacaggtgtagtgggactgagaacaagcagacaaggttttcctcatatagggagctagggatgtttntcatagtgttncaatgtttcccttantctagtgtggaatatgtanccacttgttttgaattgcttgcacatg

SEQ ID NO: 6750 - DNA, 424 bp, Mus musculus
  misc_feature (257)..(257): n is a, c, g, or t
  misc_feature (263)..(263): n is a, c, g, or t
  misc_feature (268)..(268): n is a, c, g, or t
  misc_feature (332)..(332): n is a, c, g, or t
  misc_feature (359)..(359): n is a, c, g, or t
  misc_feature (389)..(389): n is a, c, g, or t
gacccgggcgacaccatctgtaggggtggtgacgaaccgggtcagggaagaggacagcgcaaaagctcgcaaaccttgtcagcctggatccacgtcttattcaaaacgtgtcgcgatcattcacagcttaagatgtacgggattcgcgcgtgagaagggagagagaagcgccggtttgccgacgccaccccctctcatcagggctggcgcggcgagtggcagctccttaggtcacggcttccgccggcgccagtggncctagntcccntgcggctgtccttggtcgccttgtcaccaggctgaagcagtcaagatgaccttatttcagcttntacgtgagcactgggttcatatacttntccctgcgggatttgtctttggatgttatntagacagaaaggatgatgaaaagctaactgccttc

SEQ ID NO: 6751 - DNA, 374 bp, Mus musculus
  misc_feature (117)..(117): n is a, c, g, or t
  misc_feature (136)..(136): n is a, c, g, or t
agagctgtctactcaactgcagtttctgaaatccattgtttcttctaaaaggaaactgtgcaatagcttgttagcagtgaccatcttgcagcagctatgcaactttgaaaagttttngctggtccccgctccgggnccacagtgactctgtcctagcaggtgtcttttgtctttctgtaattacttcattgtgctttgcatttccaggaggtttccctatgtttgggtaaaatgtttagcaagttgtaaaacatcagaccttctgaaaagggtgaaataaacacttctgcagtgggacttggagtaatctgagggacattttatatacttttaaaaatcagaatttaattgggatgccagatttctagcaactt

SEQ ID NO: 6752 - DNA, 427 bp, Mus musculus
  misc_feature (298)..(298): n is a, c, g, or t
  misc_feature (321)..(321): n is a, c, g, or t
gaccaagatcctgcatcactttaagtaaaacactcgggaggtggtttgtgctgttaccagccgactagaaaagctgttcctttgtggtagtttgtctctagcttgagcaacccacttcctttggtgtgcactggaagagggaaattttgaagtactatcccagaaagtgttgactaacaccagtatttggaataaatacaggagcacagcatagcgccatacgttactttatagttacatacacctatagtgtgcacaaagcattggtcctggtgggtcggttgtgtatttatcctcncccacaaggggaaagtctgtcgncctttaatttctgtgagaaaggtgacatctaagatatgtgttacagaaataccagcttttgctcagaaacaactttgggggagataacgatgacaggtgacctcaa

SEQ ID NO: 6753 - DNA, 524 bp, Mus musculus
  misc_feature (279)..(279): n is a, c, g, or t
  misc_feature (287)..(287): n is a, c, g, or t
  misc_feature (320)..(320): n is a, c, g, or t
  misc_feature (327)..(329): n is a, c, g, or t
gtagaatgcaccaatgttcccttctgcatctctggccctgtggacagaacacttattgctaggttatctatcgtgtggcagggctggccagcaccgttgggtctcacctggcatgagatctgaagctaaagccctgggactgtggagccattgggcttggtttggtattgacagggtcatcctgaggggttagcagtggtagagagcaaggcaagtgatctctccagctacctgccagcagtagagagagagagagagagtgctgagggctggtagtgntctctggnctagggcttcacctttcggttttttgttttttnttttttnnnctggtccctgagtctggcatttctgtctgtgacttagctatgtttctgatgccaatcacactagcaccattacatgctgggcaggtgctgggcagcacagacgctggagacctgtttgccactgcttgtcccccattcatctttgtctacaaagttaattacgttctcatgttctggcatccacataattcttgt

SEQ ID NO: 6754 - DNA, 527 bp, Mus musculus
  misc_feature (412)..(412): n is a, c, g, or t
  misc_feature (446)..(446): n is a, c, g, or t
  misc_feature (497)..(497): n is a, c, g, or t
  misc_feature (499)..(499): n is a, c, g, or t
ttgacaaagctcatgctccattgcatgtgaatgctttttttcattcagaataactagcaacaaagctagcccatgagtagtacgttttcagaggtctacagtaagaaccctgagcgtccttacacatagttcagtggttgagcatcctgtaaggcaggggtaggtaactcaatgcagtaattaatttttggaaggaaaaaaaaaagcctaatccattactgtctttttgactgtatagcttagattctctacacctattcctttccagttggctttatttacctttagctatcttgatactttcttggccaaatatcctggactcagtgatcattgtgacacaatgtggtgtaagacaaagtggcttcttgctatgtaactgctagcattcacactaggtaacctcccttancctcctaccactgaggtggtgggtttagatggtntcgtagtgcctttgattaacttaagtatttagctttcatcttccttagatntnctttgtcctcccaattgaacacatttct

SEQ ID NO: 6755 - DNA, 221 bp, Mus musculus
aagactgcttgtgcagcaatcgctactctactctctgaattgtcttaattgtgaaaccttgctcttacagattgaacctttttacatttctgaaaatagcagaaagagcatatttgacttgtcctagctgtaagtggttggttcttgttgctgcccggcccctggatgccagcagggtgtgcatccgcccgtgtgcaactgtctccagtgcttccaagggt

SEQ ID NO: 6756 - DNA, 416 bp, Mus musculus
  misc_feature (282)..(282): n is a, c, g, or t
  misc_feature (300)..(300): n is a, c, g, or t
  misc_feature (303)..(303): n is a, c, g, or t
  misc_feature (317)..(317): n is a, c, g, or t
  misc_feature (362)..(362): n is a, c, g, or t
  misc_feature (375)..(375): n is a, c, g, or t
gaacagatttcttgatgaaggcagtttatgtggattgagcattgctgcatcaaagaatggacagtatgtggcttgtggttctaagagtggagtggtaaacatatacaatcaagattcctgcctccagcaaacaaacccaaagccaataaaagcaataatgaatctggttactggtgttacttccttggcctttaatcctaccacagaaatcttggcagtggcttcaagaaaaatgaaagaagctgtcagattggttcatcttccttcctgtacagtattttnctaactttccagtttttnaanaagagtactctttnctcgtgttcaaaccatggatttttctcccagaggtggatactttnccttagggaatgnaaagggcagggccctgatgtataggttgcatcattactcag

SEQ ID NO: 6757 - DNA, 326 bp, Mus musculus
  misc_feature (301)..(301): n is a, c, g, or t
atggctacgccggtacatcaagtggcctctgcttccgcctaagaatattaaagacctcatggatcttgaagctgtccatgacgtctttgatctttacctgtggctaagctaccgatttattgatatgtttccagactctagccttgttcgaagtctccagaaagagctggatgccattatccaagaaggcgtgcacaacatcaccaagctgattaaaatctctgagtcacgcaagcttttgaatctggagagcttaccatcgggggaccagtcacggttgtcaggagcctccaagagcccnagcgagaaggacacgtggcaccaaa

SEQ ID NO: 6758 - DNA, 464 bp, Mus musculus
aacttcacaccccatttatatgctgttgagaacccagtctccagggagccagaggcccccactcccagtctctctcagctaagctctctaagctggcctgggttctgagctacatggaaggcagagttctcaagcccttgttttatagtttcccccgaaaccccttgtaagggtctgagacaatacaagtcagactcttgagacagcacatctcagcctgaatctctcaccacctgcctggtgcctttgttcccagcatggtggctcctccccagcccacttcctcccaggcctcagatataggtctccttggcacaaggcgccaccacctcatttggcagccagcactgactgacctgtgctgtgagtcttggagacactccatgcatggccctgcctcttttctgctgttctcagggactttgcctcagtttccccttgtgatctttctgtgggttagccca

SEQ ID NO: 6759 - DNA, 425 bp, Mus musculus
  misc_feature (130)..(130): n is a, c, g, or t
  misc_feature (207)..(208): n is a, c, g, or t
  misc_feature (219)..(220): n is a, c, g, or t
  misc_feature (249)..(249): n is a, c, g, or t
  misc_feature (293)..(293): n is a, c, g, or t
  misc_feature (333)..(333): n is a, c, g, or t
  misc_feature (335)..(335): n is a, c, g, or t
  misc_feature (343)..(343): n is a, c, g, or t
  misc_feature (357)..(357): n is a, c, g, or t
  misc_feature (398)..(398): n is a, c, g, or t
gtgtcgtgagtacccgtcattctcagccccttcagtccccagctgacagggctgggtgggagtcgttctgaacaactgctgtcggcttggaatacctgtgcagtgcaggtgctgtacacactaagacttngacacctgtgcaggcaccatacacattaaggcttcaatacctgtgcaggcaccatatacactaagacttcagccccnngcccccccccnnagttggtattggttcccctagtttatttntagtacttgaactcagcctaactataaagcctttgctgggagcnacttgagacctgggaaaccagtaaaagaagttgactacancncagtcctnccttgtgtccatgntcctgggttccaggaccttcatggagactgatctatagatncctcagcacttacgaacagtaacctag

SEQ ID NO: 6760 - DNA, 310 bp, Mus musculus
tcttctctccaaaaataactgcctttaatgtgagtcagcccatctccccaggggctccagtgagtcctccaccatcacttgctgccagcagtgatagccttgaggtttccagctcgagccagaatattgggcacgaagagcaatcccgaggcccgctcgatgctctcgatgggcaccaggaaccgctccagagggatggtctcatccacgggggcattgggcatcacgtaggaacgtagctcgatctgcccaccggctgcctccaggatcagcaccttgaagaagtgtgtgggcactgccacgtggttct

SEQ ID NO: 6761 - DNA, 114 bp, Mus musculus
  misc_feature (65)..(65): n is a, c, g, or t
tccaccaccttatgagttctgtaactaattttaactaatttttttttgagggggttgctctggantccttgatatgtaaagggcacttcccactttccacctgtttggtggtct

SEQ ID NO: 6762 - DNA, 312 bp, Mus musculus
  misc_feature (98)..(99): n is a, c, g, or t
gggacctttccagtctagcctggatggaaaagccctgttcttttggcatacgtttgtgctgccaaaagctgaaccttcaaaatgaaacctaagggggnntggtgatgactcattaaataagttggtattgctgctgtcctgtcccattcacccgatgcagaggactcgggaatgggctaataacacacccggcaggtgaatgcaacccaggagctaaacagtggttgtggccacagtcgcctgtgaatgtgagtttcagaacagacacaaagccttaacttagattttctgttgttttggactcgtccactg

SEQ ID NO: 6763 - DNA, 414 bp, Mus musculus
  misc_feature (50)..(50): n is a, c, g, or t
  misc_feature (210)..(211): n is a, c, g, or t
  misc_feature (217)..(217): n is a, c, g, or t
  misc_feature (234)..(234): n is a, c, g, or t
  misc_feature (252)..(252): n is a, c, g, or t
  misc_feature (299)..(299): n is a, c, g, or t
  misc_feature (389)..(389): n is a, c, g, or t
tttttcttcatatggctctagtttggcaccttcactctttccaaaacgtngtctgtgcgccagagatgtcacagttcaagtgtctttctagtgtggctttgtatggcttcctttgaacattgtacatacattgtatctttgttttatggtaataagtaataaaaaatgtagacttcgtattttgtacaaaatgtcctatgtacagaatannaaaaanagttcatagaaacagcnaaaataggttaagtggcnacagttatttttctttagaaaatatctgtaactttatgctttagtgnaacgttaagtaccaacatattttttaacattttgtaattcaaaacttttttgttttgacattgtttatgaagaaagacttcatgcacttnccatttaatatgctcttttatctaa

SEQ ID NO: 6764 - DNA, 519 bp, Mus musculus
aggagaaccgccacgttggaatgacgtgttcatgttagttgcagaatcagtttttcacctacttacacatgatccttcaacaaggctctcgagtggataaagatcacaggatctaagaattccacattggtagaaagtgacagtaaactcagccccttggcctagtgcagcctgcagctgcctgtggcctgactgcgggccgcactgtgtgggcgccctcagtgagcctttctttctgttggaaaaagcacatgtcaccaagctcgcgaggaaaggcgcggtgcccgcgttcgcaccagtctccacatgctgctccggccttcacagaattcttgcatggattaagcttctgttttagatgggatagcacgaggagatacatccttaaacttagtgctttgtcttcttgtcctctcagggtggccagtattttgacttatttatcctgctcaaaagctgcttgaaatgtgtgctgctctctgaacagtggcgagtcttctcttgtctccagcatatata

SEQ ID NO: 6765 - DNA, 166 bp, Mus musculus
  misc_feature (77)..(77): n is a, c, g, or t
  misc_feature (81)..(81): n is a, c, g, or t
  misc_feature (101)..(101): n is a, c, g, or t
gggaaagatttcagcattcatcggcttgtcctgggaacacacacatctgatgaacagaaccacctggtgattgccantgtnccagctccctaatgatgatngctcagtttgatgcatcccattatgacagtgaaaaaggagaatttggaggttttggttctgtcag

SEQ ID NO: 6766 - DNA, 116 bp, Mus musculus
acccaaacttcacgtcagaatccagcaaacagccaaagttgttacatcgtgttgtggaacagttacaaaaagtccatttcattacagatactctgtcaaagggtgaaacaaagttc

SEQ ID NO: 6767 - DNA, 538 bp, Mus musculus
  misc_feature (154)..(155): n is a, c, g, or t
  misc_feature (159)..(162): n is a, c, g, or t
  misc_feature (164)..(164): n is a, c, g, or t
  misc_feature (169)..(184): n is a, c, g, or t
  misc_feature (513)..(513): n is a, c, g, or t
gaatccagcaaacagccaaagttgttacatcgtgttgtggaacagttacaaaaagtccatttcattacagatactctgtcaaagggtgaaacaaagttcatgggtgtttgccagcttcccagcgagaaggatggaaaggaatatccacacaggnnaatnnnnancaggnnnnnnnnnnnnnnnntgatccccaaagatcagtactactgtggtgttctctacttcactgggagtgacatctttaataagaacatgagagcgcacgccctggaaaagggcttcacaatcaatgagtacaccatccgccccctgggggtcactggagtcgctggggagccccttcctgtggacagtgagcaggacatttttgattacatccagtggcgctaccgggagcccaaggatagaagtgaatgatgccctgccagccccaggcacagcccactaggagtcctaatttatttcttaacctttgctatgtaagggtttttggtgttcttaagcgattgcttnttctctgtgcttaccatgtactata

SEQ ID NO: 6768 - DNA, 117 bp, Mus musculus
tgttagttaatcctgtttgtgtaaagcgaatgattgtttactagctaggaaccttaagtgttattgcacttggtttggctcttgagttagtggcccagtgaacacatgccttgtacg

SEQ ID NO: 6769 - DNA, 431 bp, Mus musculus
  misc_feature (210)..(210): n is a, c, g, or t
ccctgtggctaagaaggctgcacctggagctgaatacaaggccaagaaggcaaaaggcgatgtaaagaagaagggccgcctggatccctatgcgtacgttccactcaacagatccaagctcaaccgcaggaagaaggtgaagctccaggggcagtttaaaggtctggtgaaagccacccagcggggatcccaggcgggacacaaactccncagaaaggatcggcggcggccctgaatccctctggggaatggagctgttctctgctgtggtccagggcccctttctaactcccatgatgtttaacaccaactccaggtgtgagccttgctaaacctggacagagaatgactcattggaagcaggactcatttctaagagagatagatgcctaggattttggaaactattgtcctttggagacattgccaac

SEQ ID NO: 6770 - DNA, 414 bp, Mus musculus
aatgcaattgcgaaccagctacggtacccaaacagccacactcactacttcagctgcacaatgttgtacctttttgctgaggcgaacactgaggcaatccaggaacagatcacaagggttctcttggaacggttgattgtaaataggccacatccttggggtcttcttatcaccttcattgagctgattaaaaacccagcatttaagttctggaaccatgaatttgtacactgtgccccagagattgaaaagttatttcagtctgttgcacagtgctgcatgggacagaagcaggctcagcaagtgatggaggggaccggtgccagttagatgaactgtgtatatcccttgcagatgcatcagccttggtccgctgaaccaagttcataaactgaagattcctcctgactttcc

SEQ ID NO: 6771 - DNA, 430 bp, Mus musculus
  misc_feature (224)..(224): n is a, c, g, or t
  misc_feature (403)..(403): n is a, c, g, or t
  misc_feature (405)..(405): n is a, c, g, or t
attatgtgtgacttctacgtctccccacagggcctgacttgggaaggtttccggacagctgaaggctgttaccgcactgtatgggaacgcctgggcctggctttccagaccccagaggcatactgccagcaacaagtgttccgctccctggcctacatgcggccactgagcatctgggccatgcagctggccctgcaacagcagcagcataaaaagagccgcangccatcagtcacacaaggcacgggactaagcacacagcctgaatgtggaccaaagagatcgctggcaaacctcaattcagagtgatccctctgaactgtggaggcccagcctccacactggacctcctccttcctcccacaagtcctgcagccctgagccaataggacaatcgcgcccntnttccttcccagctgtgccagtaaaa

SEQ ID NO: 6772 - DNA, 424 bp, Mus musculus
  misc_feature (164)..(164): n is a, c, g, or t
  misc_feature (173)..(173): n is a, c, g, or t
  misc_feature (187)..(187): n is a, c, g, or t
  misc_feature (208)..(208): n is a, c, g, or t
  misc_feature (211)..(211): n is a, c, g, or t
  misc_feature (240)..(240): n is a, c, g, or t
  misc_feature (251)..(251): n is a, c, g, or t
  misc_feature (299)..(299): n is a, c, g, or t
  misc_feature (301)..(301): n is a, c, g, or t
  misc_feature (327)..(327): n is a, c, g, or t
  misc_feature (371)..(371): n is a, c, g, or t
atgttgaattatttttggagctgaaatctttgtaatattaaagcaactagtttctaattcccagtttctgtatagaatcgcacaagtggtttatggagtgtttggattgtaactataaatggttctttgatatgcaaattaatattttcagttgattttatttnatattcctnatggggtgttaaanccgttttttatttttttctanatnaaaagagaacccatgcttttatggacacntaggtaaaacnccttcagcttaaaatttttgttaaataatttagtttattttattgttntnttccaggtgtctaaatctccagtctntctgttgtactggtaatttaactctgtaatggaatagtttgctnccaactatttatattaagtaatttttaaatatttgtaatattgttgactgact

SEQ ID NO: 6773 - DNA, 518 bp, Mus musculus
  misc_feature (26)..(26): n is a, c, g, or t
  misc_feature (29)..(29): n is a, c, g, or t
  misc_feature (187)..(187): n is a, c, g, or t
  misc_feature (317)..(317): n is a, c, g, or t
  misc_feature (342)..(342): n is a, c, g, or t
  misc_feature (344)..(345): n is a, c, g, or t
  misc_feature (350)..(350): n is a, c, g, or t
  misc_feature (415)..(415): n is a, c, g, or t
  misc_feature (445)..(445): n is a, c, g, or t
aaaggaccaatttcctgggcatggcnagngaagggacccgagtgctcattggccggcgctttcacctggctccttggcctgttctgttttgcttgctgttggaatgagtgggctccccctctatttagcatgaaggagccccaggcagggtatgcacagactgactgccatccctccccacccaggntccacccagccctgtaaggagacaaggagccttgtgctcggtggtatttttatggacctcgatctgcaattagtagaaggaccccaccggctggccctccccggacacctgggaagtgggacattctttntgtatttattttcctcccccagaancnnggggntgggtgggtgggggaggagctgcaggaccagtttagcatgtgtttggttctgggggtctctccanccttattttgggtcaagatggaacctctgnccctccagctggcgactatgagatccagacctcttcatgttccctgacacttcccctttgcatcctgtgtaat

SEQ ID NO: 6774 - DNA, 102 bp, Mus musculus
gtgactctaccccagcagggaagcactgcagactgggcatctctgtctgtaggcgcaagcggcggaatttcagcaagcaggccacagacgtgctgaatgaat

SEQ ID NO: 6775 - DNA, 514 bp, Mus musculus
  misc_feature (286)..(286): n is a, c, g, or t
  misc_feature (288)..(289): n is a, c, g, or t
  misc_feature (298)..(298): n is a, c, g, or t
  misc_feature (407)..(407): n is a, c, g, or t
ttcgtgaaggcttccgctgtcgagtgcggagggccaaaaaagtgtgcgctcactggccagagtaagccctgcaggcacaggattaggctcggggactccagctgctgttactacatctctcctttctgcagatacaggatcacttctgtatgtaacttttttacatacattcgatacattcagcagggactcgtgaaacagcaggatgtcgatcagatgttttgggaagttatgcagttgagaaaggagatgtcgttggcaaagctgggatatttcaaagaggaantnntgatgcccntgtgtgcggggccgtgcgtgctgcccctccctggaccactgaaggatgacggaacatttttatggttactcaatatttatttctaaggagaggccacagacttccctcntcttgcacactacactgagaagtgctgtgatttcttttaagctgactgagctgtatcccttagtggagcacactatgaagaattgcaggcgctagtgatggtaattc

SEQ ID NO: 6776 - DNA, 103 bp, Mus musculus
  misc_feature (26)..(26): n is a, c, g, or t
gggttccacatattcatttgcgaaanctaactcctgactcctgagacatcagaggacttacgggtctgaaccactccattaagtcggtgaaactgtggaaaca

SEQ ID NO: 6777 - DNA, 453 bp, Mus musculus
  misc_feature (344)..(344): n is a, c, g, or t
tgtagtgtttatgccagaagtctctggggacatctactgcttgtgtctctttggtgcaataattaaaatggaaggaggagctgaactgggaaccctacagcctagtgattcttctacttgctcgctatagctttctgttggcaaattttctcaaaagcactctctttaatcagattaacttcttaaactgcttaattctcatcgcttcttaaaactagggtggtttgcaggtatccaaaaatatgctatgacagaacaaaattgtggtattcatgacccatttaatttactgaaaaatcataactgctgtcctgcctgctctccttgggtttcggttttaaaancctttgtggttgaaatgaataacgattcggttttctgaactgtacacatccttgttcagttttcttttgatgactaaggctcagtaccagcgagctgtaggccatgtca

SEQ ID NO: 6778 - DNA, 168 bp, Mus musculus
cttctcaggaagcagtaccgttcaagaggtaaagagaaatgtgtatgaccttacaagcatacctgttcgacatcagttatgggagggctggccagcttctgccaccgatgactcaatgtgtcttgctgaatcaggcctctcttatccctgccatcgattaactgtggg

SEQ ID NO: 6779 - DNA, 521 bp, Mus musculus
  misc_feature (47)..(48): n is a, c, g, or t
gttcatccatctattatgccgagttgcaatcaactgtgaaaaatttnnactgaaacattagttaagctgagtgtcctggttgcctatgaaggcttgccacttcatcttgcactgttccccaaactttggactgagctatgccagactcagtcagctatgtcgaaaaactgcatcaagcttctgtgtgaagaccctgtttttgcagagtacattaaatgtatcctaatggacgaaagaacttttctaaataacaatattgtctacacattcatgacacatttccttctaaaggttcaaagtcaagtgttctcagaagcaaactgtgccagtttgatcagtacccttatcacaaacctgataaatcagtatcaaaacctacaatctgatttcaccaaccgagttgaaatttcaaaagcaagtgctgctttaaatggggacctgagggcacttgctttgctcctgtcagtacacactcccaaacagttaaacccagctctgatcccaactctgcaagagctttt

SEQ ID NO: 6780 - DNA, 501 bp, Mus musculus
  misc_feature (387)..(387): n is a, c, g, or t
  misc_feature (422)..(422): n is a, c, g, or t
  misc_feature (436)..(436): n is a, c, g, or t
  misc_feature (476)..(476): n is a, c, g, or t
attcagacagccactgctttcagccccgattttggccagaaagaaaaaatacttatttttacagaaattctccagcaatatttttaaaaataccaacttgtatgcactttagaatgtaaaataacagtggatacttaagactcaaagagccaccactactttattttttatacacttggtctttccatgtatataccggcctctgttttttttttttccaatctctggctcttctgtcatcttccaagcagcgtctgagagctctgcacgggcacagatgctgggtacctcttatgggtgtggcagtattacacgaaacatgtttattttaatggggaaaggggtcatgtatgctcaaagatatgtatattttcattgtaaagaaanaaatccaactttattcctaagttttaattgttagnaagtattttcgganccagtgatgctctttaaaggagttatttcttccaaagaancaagacgagccaggttactgacata

SEQ ID NO: 6781 - DNA, 206 bp, Mus musculus
aaagcccagacgagcctttgagaagcagaaaggtgtttgttggacgttgtacagaggacatgactgctgaagagcttcagcagtttttctgtcagtatggagaagtggtagatgtcttcattcccaaaccattcagagcttttgccttcgtcacctttgcagatgataaggttgcccagtctctttgtggagaggatttgatcatt

SEQ ID NO: 6782 - DNA, 226 bp, Mus musculus
  misc_feature (112)..(112): n is a, c, g, or t
atgcctaataggtctttgtgcaaggggaggccccaaaccaaagccctctgggttagggccagggctaggcaggctttcttggggcgggtgagggagggcgagaggttttttnttttttgactacagaatctatccgatacccagcctacttgtgtataaagatataaatagaacgacagaactaagtttgctaaggacatagttttaaccagatgctatttagctc

SEQ ID NO: 6783 - DNA, 540 bp, Mus musculus
  misc_feature (75)..(75): n is a, c, g, or t
  misc_feature (213)..(214): n is a, c, g, or t
  misc_feature (217)..(218): n is a, c, g, or t
  misc_feature (377)..(377): n is a, c, g, or t
  misc_feature (396)..(396): n is a, c, g, or t
gaggccacttaggaaccttgtgtcctatttaaagcaaaagcaggcagctggggtgatcagcctccctgtgggagncaataaagacaaggaaaacaccggggttcttcatgccttcccaccttgtgagttctctcagcagttcctggattcccctgccaaggcactggccaaatctgaagaagattacctggtcatgatcattgtccgtgcaannaannctggtgaacagcggatgaagatacggaattcaaagctctaatggacctttttgaagagaagtggcttatgtggagtttacatgggcctctgatggaagaaagctaatctgtttagtattttgtgcattttactaaaatggcagcttaacattgtgtatntgctattgtgatgccaatnccggtgttttaagtggaaaaatgacctctttgctttgtgctgtgtacacaagatttctggaaaagtaaagaaaaaccctttttatggctcacacagcttaaaagtagctgtcactcaaacatgggctcacagttgagctgcttt

SEQ ID NO: 6784 - DNA, 524 bp, Mus musculus
  misc_feature (26)..(27): n is a, c, g, or t
  misc_feature (40)..(40): n is a, c, g, or t
  misc_feature (65)..(65): n is a, c, g, or t
  misc_feature (71)..(71): n is a, c, g, or t
  misc_feature (74)..(74): n is a, c, g, or t
  misc_feature (277)..(277): n is a, c, g, or t
  misc_feature (305)..(305): n is a, c, g, or t
  misc_feature (309)..(309): n is a, c, g, or t
  misc_feature (320)..(320): n is a, c, g, or t
  misc_feature (334)..(334): n is a, c, g, or t
  misc_feature (336)..(336): n is a, c, g, or t
  misc_feature (350)..(350): n is a, c, g, or t
  misc_feature (357)..(357): n is a, c, g, or t
  misc_feature (433)..(433): n is a, c, g, or t
gttcattcattggtttgactggtatnngtcttattagtcnaagggaggaggggtgaggaggatgnaggtgnaanacaaccaaagcactaaaagtttgccttaatgccagcttacaacgctacacgttaccttcatgtagcagtgcatgaacttgcagaatctgtgctcatttttactttatttatttttggctgatctagtagccttcccagtcctcttctgatttgtgaagctgagaattacttgtgtctagattccacccataccctcgatgtgnccagcgagaagggcttctcacctttttnctgnatgtggacatntatttcaggacttncngtcattgaaatggnaaacacnaactattcttctcataaaatttcttgcttcagttgattcaagtttgatttttcaagatgcacacccctagattccngactaatttagttcttttgttcagttaatttgggagtttaagtggttcttattgaattaaaaggttgaattgtacacccaaagtgctttac

SEQ ID NO: 6785 - DNA, 107 bp, Mus musculus
ttatgtttttctcacttgttcaagtattggcataccgggtaatggcaccccttctctcagttatgtgacctttacaggtgtcgtttcaaatgagctcagtcattggg

SEQ ID NO: 6786 - DNA, 455 bp, Mus musculus
gggattggttctatgcatggtcatttggacgcatgtaagattacttaaagttgttcatcttttctgcttcctgaaacataactatagtgcaacaaatatttttgaacaatatatttccattggttggaccttgatctcagtgagtgcatctaaagatttatgcatatacatgaagctgtgttcaaggctttcttgcatattcccaattagtccaaaccccaaatgattgccaaattttgctactgtgctcctgtgtttgtgtttgagctgttgtatgtttgtaaatgtcacacttaaagctggccaagagactgttgaagaagcgtggatgtgcataggagagcaccccccccacctgcatgtacttagtgcctcctctgtgtcccatggtgatagcttgcttgctgaatgctgtgactcatagtttactgttctcttaacagcttgcacttttc

SEQ ID NO: 6787 - DNA, 511 bp, Mus musculus
  misc_feature (315)..(315): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (405)..(405): n is a, c, g, or t
tcctctcagtctagcttctgagcagccctggagactggagggccatgttaaaagctttttcacagttttaaggagacgaggggggtgaggctagtggtggggggtctggcaccatctcattgctttaatctcagcgacacaggtggcagcttctcccccttcctgcccaccccaggtcctcttcccaccctctctcctagcttggtaatgaagtgtatttattggtgaaggaaacagctgctctgctgcttctcctgctgctgggacttgctcccctgtctcttcctcatgacctttctcaagccagggaggggnagcgagagtgntnagnctgggccctggggcacaagaactagccagggtccctttgctttcctgtgttcaagccacctgccatcccccctngtccatcctcctgtctcccgcccgcctgcctagcctggaccctgcagtgtggagagacacataagccttactgtcctctggggcaggagccgagccttttgttgct

SEQ ID NO: 6788 - DNA, 195 bp, Mus musculus
  misc_feature (92)..(92): n is a, c, g, or t
  misc_feature (97)..(97): n is a, c, g, or t
  misc_feature (112)..(112): n is a, c, g, or t
  misc_feature (125)..(127): n is a, c, g, or t
  misc_feature (133)..(135): n is a, c, g, or t
ccccatctgtcagtgaggatcacgtgggctgcgtttctgtaattgttctccatgtacccttgccctttgagatgtattgtttttgatggctnccttncccttccactccctntcccctccccccnnnaaaaannnggaaagaaaaaaaaaacagaaaaagctgaaaagaaaaccaagatttgttagtttactgtg

SEQ ID NO: 6789 - DNA, 182 bp, Mus musculus
  misc_feature (110)..(110): n is a, c, g, or t
  misc_feature (115)..(115): n is a, c, g, or t
  misc_feature (136)..(136): n is a, c, g, or t
  misc_feature (151)..(151): n is a, c, g, or t
cttcgagtgaatgtggcagttaaacataccttcattttttggacttgcatatttagctgtttggaacagagttgtttcctttctgaatttcaaagataagactgctgcantcccntcgcaatatccagtggggaantcttgtttgttactntcattcccattcttttcgtttagaatcagaa

SEQ ID NO: 6790 - DNA, 462 bp, Mus musculus
  misc_feature (32)..(32): n is a, c, g, or t
  misc_feature (292)..(292): n is a, c, g, or t
  misc_feature (346)..(346): n is a, c, g, or t
  misc_feature (355)..(355): n is a, c, g, or t
agagcccattttcatagcatcgtttgaggtcngtgaaatggtaccagtgttagttagtcattggggtaacttgatgtgagagatgtatttcttgggaaattaaatataagtaaaacattttaaattatattttatatgcacaggaagagctagctatcagaggaaatccttttaagacctgttctgaactctgctagttttggctatcgagatgcctcacgggtgaaagcacttgctgctgcatgacccttctgaccccaggtgggctctggagttcatggggaatgggtanacgtgatggtgcacatctgtattcctagtgctcagctgtgaacagctacccttnatcgtgatnccgcagaaacaacaagagagaccttgtctcagtgacgtggaagaagaatcagtccccagaagttgtatcctgaccttcttttgccatagcatgtgtgagcctgtact

SEQ ID NO: 6791 - DNA, 83 bp, Mus musculus
tggtccatggtctcccttgtgctcaatctcagcaccggctaggggaggtatcttggtatctcggtactctttctccactcttt

SEQ ID NO: 6792 - DNA, 399 bp, Mus musculus
  misc_feature (35)..(35): n is a, c, g, or t
  misc_feature (254)..(254): n is a, c, g, or t
agagcaagagtcctttctacctggtcaacaaaggnccctggtccatggtctcccttgtgctcaatctcagcaccggctaggggaggtatcttggtatctcggtactctttctccactctttatggggtaggcagaagccccatgagaccctgtggtcccacccacttacagcagcataagtgaaggatatcataataccaacatgtctgcaaagtggtgggtctagagtcagcactgagccatttcctttgganccttcctttaaccacgcaggactataaactgaatggtgtatacatgacagtcacagattggccttttgcggccagagagcccaacttggagacctgtaccccaggtgccagggtgctgtcaccatggctcccttgagcaaatgga

SEQ ID NO: 6793 - DNA, 384 bp, Mus musculus
  misc_feature (207)..(207): n is a, c, g, or t
  misc_feature (225)..(225): n is a, c, g, or t
  misc_feature (246)..(246): n is a, c, g, or t
  misc_feature (258)..(258): n is a, c, g, or t
  misc_feature (260)..(261): n is a, c, g, or t
  misc_feature (271)..(272): n is a, c, g, or t
  misc_feature (299)..(299): n is a, c, g, or t
  misc_feature (301)..(301): n is a, c, g, or t
  misc_feature (307)..(307): n is a, c, g, or t
  misc_feature (314)..(314): n is a, c, g, or t
  misc_feature (333)..(333): n is a, c, g, or t
ccatttcctctaaatcattagttatatgccaatttataaaataaatacacattagttctgtcatctaacatgtctcccaaatattctcattccaggcagagatcctgcaagagtcccggatgatgatcccagattgccagcgtcggttagaggctgcatatactgatcttcagcagatattagaaagtgaaaaagacttggaagaanccgaggagtataaagaancccgtgtagtgctggattccntaaagctagaancnngacatttttnnctgtatgggatgtttttttgcattaantnctgggntccattntacaattcattgttttcanccactgctgtgtttaataatatgaaaacgtggttctttttatgcagttgca

SEQ ID NO: 6794 - DNA, 485 bp, Mus musculus
  misc_feature (375)..(375): n is a, c, g, or t
aaactactcttacttcctctcataaccacctttatcatcaaccacgaggggtgggagaggtgcaccgtgtctctgcaataaacttgtgccgggttctacctccttgtgcaaagggtattttatacacgggctctgggcttccttcttgatctgacatggtgcatctggagacatctgaaggagtccaaataccttttgaagcaaagtcagatgtaaagtctggggggcttctgtcttcagttcccttttgtactgctgcgctgcataggactgtccatctgaatgaagagtgcacgctgttcccccgatgccacgttgctgccttcagcctctcccaggaacctgctcccaagtgtccagaatgcagtgctgccnatcattttgatatgtaactttcaaatccagtctcatgcaatacaagtgtgtcagcttcactgagcagggttcatttgcccacaagtagaaatgctcgatcctcacatgga

SEQ ID NO: 6795 - DNA, 119 bp, Mus musculus
  misc_feature (78)..(78): n is a, c, g, or t
  misc_feature (84)..(84): n is a, c, g, or t
ggctgcagttgaaatgtgcagttgtgtggtttggttactgcacagctgaggagtgaaggtggctggcaacagttcctntcctgntcatcacccatgatggtggatttctagacctgtca

SEQ ID NO: 6796 - DNA, 290 bp, Mus musculus
  misc_feature (53)..(53): n is a, c, g, or t
  misc_feature (59)..(59): n is a, c, g, or t
  misc_feature (61)..(61): n is a, c, g, or t
  misc_feature (100)..(100): n is a, c, g, or t
  misc_feature (102)..(102): n is a, c, g, or t
  misc_feature (104)..(104): n is a, c, g, or t
  misc_feature (123)..(123): n is a, c, g, or t
  misc_feature (127)..(127): n is a, c, g, or t
  misc_feature (129)..(129): n is a, c, g, or t
  misc_feature (136)..(136): n is a, c, g, or t
  misc_feature (142)..(142): n is a, c, g, or t
  misc_feature (151)..(151): n is a, c, g, or t
  misc_feature (153)..(153): n is a, c, g, or t
  misc_feature (155)..(155): n is a, c, g, or t
  misc_feature (158)..(158): n is a, c, g, or t
  misc_feature (249)..(249): n is a, c, g, or t
  misc_feature (255)..(255): n is a, c, g, or t
gtcagagttcggacagttcctgcctgaggcaaagcggtccctgtttacaggcnaatggntngtgcgagatgaacagtgggcagaagaatgaggagaagantntnggaacacaacaagaaacgntttngnccttcantcctgncgccctgtntntngcnccagccaaggtggggctgcagttgaaatgtgcagttgtgtggtttggttactgcacagctgaggagtgaaggtggctggcaacagttcctntcctgntcatcacccatgatggtggatttctagacctgtca

SEQ ID NO: 6797 - DNA, 281 bp, Mus musculus
gagaggcatgccaactactccaaaattctgagcaattttttttttcttttttacaaacacgaccattgaatgaattgtatttctactgttttcccgagatgtcagtattttgcattgctgtgtgtgcacactttacacagaagcacagccctgtgattcttacatggaaacatggtgaaatgttttcctgtacataccaatcgcagaaacaacgtaaggactagaaatatctttcaaagaatggaattaggtatttatttagtataaaaagcctgtgcagt

SEQ ID NO: 6798 - DNA, 399 bp, Mus musculus
  misc_feature (336)..(336): n is a, c, g, or t
  misc_feature (369)..(369): n is a, c, g, or t
agtgttgggtttctgtagtcattacagtcaaaccacacacacatgcagcagctttcgctgagcgctggggagtcttcagtgatgttagctttttgagtagtgggcagtaggaaggaatttttaatgatgtagaactgccaataatgttaaatatctgctgctttgaaagccagtggtggtggtcagtaaagcagatgatttgtgtctctgtgtctggccacactgccaagtgaagctggggtaagtggctgtcagaaacttcaggctctgcttggaaaacttggtaccacaaatgggtgtcaaaggtcatgtgtaacaaagtagtaattatccctnccgtgtgaccttgagctgaccctgaataatcanccttttaccttgtctgatattgtcctttcc

SEQ ID NO: 6799 - DNA, 79 bp, Mus musculus
atcctttgcaagtcatccatgtcattccttaggcatcttatctttgctcaactgttaaagaatggtggcttgttttcat

SEQ ID NO: 6800 - DNA, 231 bp, Mus musculus
  misc_feature (29)..(30): n is a, c, g, or t
  misc_feature (32)..(33): n is a, c, g, or t
  misc_feature (35)..(39): n is a, c, g, or t
  misc_feature (43)..(47): n is a, c, g, or t
  misc_feature (49)..(54): n is a, c, g, or t
  misc_feature (56)..(58): n is a, c, g, or t
  misc_feature (60)..(66): n is a, c, g, or t
  misc_feature (68)..(69): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (85)..(86): n is a, c, g, or t
  misc_feature (88)..(91): n is a, c, g, or t
  misc_feature (98)..(98): n is a, c, g, or t
  misc_feature (100)..(100): n is a, c, g, or t
  misc_feature (107)..(108): n is a, c, g, or t
  misc_feature (110)..(110): n is a, c, g, or t
  misc_feature (121)..(121): n is a, c, g, or t
  misc_feature (146)..(146): n is a, c, g, or t
  misc_feature (185)..(185): n is a, c, g, or t
gggaatcattcctttcgtgatttacctgnngnntnnnnngggnnnnnannnnnnannncnnnnnnntnngttttaancntanttnngnnnnaaaggantntttgaanntntggatttggangcgatccaacatggaaggtgtatantccagctggacaagaaaggagacgtcatttcaacgattntgtggcagagtggaggagcctatactgatttatgatagactatcaa

SEQ ID NO: 6801 - DNA, 390 bp, Mus musculus
  misc_feature (294)..(294): n is a, c, g, or t
ggacttcagtaagccagtgtctgcaatacttgtgggccaggaggcacttgggcctgcttctacttttattctggacgctggtgatcctgttccgtcctgtgaacactgcgaaattgcccattcttgctgaagctgcagaacttgaaccccctttgggaaatatgttggactttttctttccaacaaagcctacacaggtgctacgggtgtttggccttgctgcgatcagcattctagtcctgggatttctgcctatgtgctgctgctccatgtgctggaggaggaagaggatgnacaggatgttgaaggttttgaagaaacagaaatcaaaagggaagaagcctaaaggaaggaaggcgtcagaagagagagctttactgtcccattgaa

SEQ ID NO: 6802 - DNA, 520 bp, Mus musculus
  misc_feature (384)..(384): n is a, c, g, or t
  misc_feature (395)..(395): n is a, c, g, or t
  misc_feature (418)..(418): n is a, c, g, or t
  misc_feature (430)..(430): n is a, c, g, or t
taaagcaaggaccacaccacgttgtgtctctcagctgcaatccctgtgtgtatggctgtgccccagaagtcacaccatgctggtggtgaataagtgagggctgatttccagtgtgtgccaagaagtaacatgattgaggtaggtgaacctagagataaaagagttcttatgatttagtattgaaaaaattctggttttacgatgttgcatttgattcttttcacttgaaaagtcatgttttaaagctgtaaattgcctatgtctaaggatttagtaaaatgtcagagatcaatctataagaaaattcaaacattgtttttatatcttagtagtatgtcattattttagacctcacaatccctaatttaaccatttcggcaagtncctttgacacntacggagtattatgggagatgangcaaatgtagtnccacaccccgtttcccggcttctcaatgcctcgtgatggtatatgtttaacagtgctgcacagttcagttctttgtgttcatacgagatt

SEQ ID NO: 6803 - DNA, 437 bp, Mus musculus
  misc_feature (138)..(138): n is a, c, g, or t
atggagtgcgccagggtcccaaacagcctcagcccagggcaccattcttcctctcatggtcgctagcggcccagcccttctgctgccctgggccttggtgtctagtccttccagatgcttccagggtcgtcctgaaancacccacccatctcttcagttacctcctctggccagaaggtcacaccactgtcctccagagccactctggggcccatactggctgtctggaagcctaaagcagcagcctgcagccagagccgagggttctagggacttgtccataggaaggggtggcactatgtataccctcagtgagtccctttgctgcagcctcctgaaccagttcatgacactgagtgcaaaaggtattggatacctatccctccccagggcttcacaagacatgtctccatgaatagacacgtcactggcccaga

SEQ ID NO: 6804 - DNA, 106 bp, Mus musculus
  misc_feature (34)..(34): n is a, c, g, or t
  misc_feature (55)..(55): n is a, c, g, or t
  misc_feature (59)..(59): n is a, c, g, or t
cctcacagatccagttttgggaaaggatttggantcaaaactaactgaccaattntttnccctttgtaccaagagactgatacttaggcccaggaaataaatgctg

SEQ ID NO: 6805 - DNA, 554 bp, Mus musculus
  misc_feature (385)..(385): n is a, c, g, or t
  misc_feature (393)..(393): n is a, c, g, or t
  misc_feature (415)..(415): n is a, c, g, or t
  misc_feature (422)..(422): n is a, c, g, or t
gatacgtttgggtttccaagctagtttaagagactttgattttcttcttttagctccatagttttttgttcttttgtttttttttgtttttgttttgttttgttttgttttgttttgttttgtttttttctctcatattgagaccactagatgagactagagttctaactggtctactctggtgtaggtagattgttctgagccctctacccaggttctcactggttgctgctgggctcctgactattgtgtgttacttataaactgtctaaaatgcacctttgtgccggagaacaagttgtattttgtttttaattataacgagccagttttctaagctttgtctactaaaacaaaataaaaacattatagtctgattttcacnaaagtatnccaactccctttttttgtgagnatatatnccattcctttgacttttgtaacatttttaaaaatccatgatatagtatagcttccaggtttttcagctcttgtatgcccattggttagtaagtctgaacacactattatgtatccatccaatctcaactgaa

SEQ ID NO: 6806 - DNA, 480 bp, Mus musculus
  misc_feature (188)..(194): n is a, c, g, or t
  misc_feature (306)..(306): n is a, c, g, or t
tttcctgaattggacatgtgtttacaaacactgtcttgaagattatgctgtttatgcaataatttgtgaacatgtacagagttttatataaatttaaaccaatttttaaaacaaaactgaacacaaccaccataaaatggaatcaaaggaaagttaatttatgaaataaagaggtcaacagaatacannnnnnncagtgctggaagacacttgggagagtcttttcaattgaacgagaatgatcgtaatttaagactattatcctggttttacaacagttacctgtttacaacagactgtgccctntctcctctgcagctgaggaataatgaatggattctgattagagagaaggctgccgtgaggccagtaggcaagtccttggatcttatgcacgaccttagaccatttgaatctgttttatgcttaaatcaaagtgctttgatcaaatgtataatctgccatatctttacatatttg

SEQ ID NO: 6807 - DNA, 527 bp, Mus musculus
  misc_feature (182)..(182): n is a, c, g, or t
aaggagattctacactgcaggtttcttcaaggctgaatgaaaatcttactgtcaatggaggaggctggagtgaaaagtctgtaaaactctcctcacaattgagtgaggagaagtggaactctgtcccacctgcttctgcaggcaagaggaaaacagagccatcggcttggactcaagacacntggtgacactaatgcaaatgggaaagactggggaaggaattggagtgatcgctcaatattttctggcattggatctactgctgagccagtttctcagtctaccacttctgattatcagtgggatgttagccgtaatcaaccttatatcgatgatgaatggtctgggttaaatggtttgtcttctgctgaccctagctcagactggaatgcaccagcagaggagtgggggaactgggtagatgaagatagagcttcacttctgaagtcccaggaaccaatttctaatgatcaaaaggtttcagatgatgataaagaaaaaggggagggagctcttccaactggaaa

SEQ ID NO: 6808 - DNA, 544 bp, Mus musculus
  misc_feature (218)..(218): n is a, c, g, or t
  misc_feature (221)..(221): n is a, c, g, or t
  misc_feature (228)..(228): n is a, c, g, or t
  misc_feature (234)..(234): n is a, c, g, or t
  misc_feature (239)..(239): n is a, c, g, or t
  misc_feature (245)..(245): n is a, c, g, or t
  misc_feature (249)..(249): n is a, c, g, or t
  misc_feature (255)..(255): n is a, c, g, or t
  misc_feature (262)..(262): n is a, c, g, or t
  misc_feature (275)..(275): n is a, c, g, or t
tgcgtcttccttacctgagttacagcagacagcccaatccccgtcggtgcctctctccccccttagacatcagacaggatccctttatagaatagccaagtaagaaaccagtgtaaaagtaacttatgacctgcactcctgactcactccagggtgaagggcagacctatccaggctttctgtggaatggcctggaatcccaggaaaggcctgcactngangagctcncttccncagcngtaccnattnggatcnaggctcnactgtcccctggngtgttcacagacttgggtccatccaagcgtgagaactgtctagcatgggcttctccttttgactctggaagcaagagtcttggccctcaggcctgggacagatcttcctgccaaaatgatcataaggtctccagttagcctagtcccagtcccagccctagtcccagccccagccctagtcccagccccaggtcccatcctccaatctctctcaacagcagactgtggtggaaattatagctgtgtgcctctatttattatctgaactg

SEQ ID NO: 6809 - DNA, 563 bp, Mus musculus
  misc_feature (291)..(292): n is a, c, g, or t
  misc_feature (295)..(296): n is a, c, g, or t
  misc_feature (302)..(302): n is a, c, g, or t
  misc_feature (304)..(304): n is a, c, g, or t
  misc_feature (312)..(312): n is a, c, g, or t
  misc_feature (324)..(324): n is a, c, g, or t
  misc_feature (338)..(338): n is a, c, g, or t
  misc_feature (346)..(346): n is a, c, g, or t
  misc_feature (351)..(351): n is a, c, g, or t
  misc_feature (353)..(353): n is a, c, g, or t
  misc_feature (370)..(370): n is a, c, g, or t
  misc_feature (385)..(385): n is a, c, g, or t
  misc_feature (404)..(404): n is a, c, g, or t
  misc_feature (429)..(429): n is a, c, g, or t
  misc_feature (465)..(465): n is a, c, g, or t
  misc_feature (512)..(512): n is a, c, g, or t
  misc_feature (522)..(522): n is a, c, g, or t
  misc_feature (533)..(533): n is a, c, g, or t
acgcctagcacatctgattatccagctgctcctggaacagaaagtgggagtcatgaggatgagaggtgtgtgtggtgctgtcagcctgagtgcggggcccaggctgcgcctcgttcaaccacatgggcaggagagcagttacagcagggggctttagtgttcccatttgggtccctcaggtcacttgctgattctcagatcttgagacgctgttcctgacatcttacttatatctagggtggctgcgtagcatcttatttatttatttatttatgtaagagtaataaaatnnaannaggtgnancctcaggntcccagaatgtntctggtttctttantctctcancagancnattaggaaacaacagancatagctcagaacgnaaagtattctgaaccctgncttcgtgatccggtacagacctctncattcattgaaattcttagtgcagctgtgtgctttntccttcgacattttgaaaactgcttgcacatttaagatcttaggacntcagcaggantctcaactcantcatttcagaggctgaaacgtttttataaa

SEQ ID NO: 6810 - DNA, 179 bp, Mus musculus
  misc_feature (114)..(114): n is a, c, g, or t
tttgctctgtctcagtggcccttttctgacctgcgatgtctcgcctgctgctactctgctcttcgctcctccgccaccgtgcagtcctgttctcgaagcctggccacccaggcngcctcagccactcagaaagcccacaaaaaaaaatcctgtcgcccacggaatcagctgttgggatt

SEQ ID NO: 6811 - DNA, 539 bp, Mus musculus
  misc_feature (39)..(39): n is a, c, g, or t
  misc_feature (46)..(46): n is a, c, g, or t
  misc_feature (83)..(83): n is a, c, g, or t
  misc_feature (107)..(107): n is a, c, g, or t
  misc_feature (154)..(154): n is a, c, g, or t
  misc_feature (248)..(248): n is a, c, g, or t
  misc_feature (260)..(260): n is a, c, g, or t
  misc_feature (264)..(264): n is a, c, g, or t
  misc_feature (277)..(277): n is a, c, g, or t
  misc_feature (279)..(279): n is a, c, g, or t
  misc_feature (284)..(284): n is a, c, g, or t
  misc_feature (287)..(287): n is a, c, g, or t
  misc_feature (305)..(306): n is a, c, g, or t
  misc_feature (309)..(309): n is a, c, g, or t
  misc_feature (313)..(313): n is a, c, g, or t
  misc_feature (325)..(325): n is a, c, g, or t
  misc_feature (327)..(327): n is a, c, g, or t
  misc_feature (329)..(330): n is a, c, g, or t
  misc_feature (333)..(333): n is a, c, g, or t
  misc_feature (353)..(353): n is a, c, g, or t
  misc_feature (356)..(356): n is a, c, g, or t
  misc_feature (364)..(365): n is a, c, g, or t
  misc_feature (376)..(376): n is a, c, g, or t
  misc_feature (378)..(378): n is a, c, g, or t
  misc_feature (380)..(385): n is a, c, g, or t
  misc_feature (387)..(387): n is a, c, g, or t
  misc_feature (401)..(401): n is a, c, g, or t
  misc_feature (405)..(405): n is a, c, g, or t
  misc_feature (418)..(418): n is a, c, g, or t
  misc_feature (433)..(433): n is a, c, g, or t
  misc_feature (444)..(444): n is a, c, g, or t
  misc_feature (490)..(490): n is a, c, g, or t
ttggctttaacacagtctgacccagctagccagccaacntgacggntcacaccctcacttttccctgcaggtgagttaataangggaaggctttattggaaaccacnttcactcacctccaaagaggaggagaacccggactaatccgagtccncaccttacttccaatttgcccttcttcctcagcacgatcttccaaaccctcttgctgcaaagggtgtcccaacctgtcagcaatagaccagcantgtcctgccccntttnaaggtactggttncnacccntantcaggaccagaacttcannttntganggatgcataccnantnngantggggtggggctaaccaagncancaggaggnnagcacttggantncnnnnnntngttagctattctgncctntccctgtaggctntccattgatcatcancctagaggtcntcctgcctgctaaaacggtctgattattttctgggattttggtagnccaactggcgaaccatgggtgttccttacaatccgccacacatttgtgg

SEQ ID NO: 6812 - DNA, 206 bp, Mus musculus
  misc_feature (26)..(27): n is a, c, g, or t
  misc_feature (29)..(29): n is a, c, g, or t
  misc_feature (31)..(33): n is a, c, g, or t
  misc_feature (39)..(40): n is a, c, g, or t
tttttccttggctgcgaatgtggcgnngngnnnggagcnnagaatggaaagacggtagaatttgaatcaaacgagacgacctaactttgttcttgagtccgatgtctccaacaagccagagactaagtctggaagcccccagcctcccactgagaagctggcatccgtggaacaagactaagcagaagcaagaagccttgcctctg

SEQ ID NO: 6813 - DNA, 312 bp, Mus musculus
  misc_feature (100)..(100): n is a, c, g, or t
  misc_feature (105)..(105): n is a, c, g, or t
  misc_feature (117)..(117): n is a, c, g, or t
  misc_feature (122)..(123): n is a, c, g, or t
  misc_feature (127)..(127): n is a, c, g, or t
  misc_feature (137)..(137): n is a, c, g, or t
tccttgcacaggttcaggaacagcagcgccaagcccaggagcgctacaacgccacgcagaaaggccatgtgccccattacttgttggaacgcagggaccngtggncggaaggaagcnggaannctcngccagcgtanccagccagacccgtccatgcccccgggccacacactcatgcctgagaatcagcggctggagaccctgaacaatctgctacaaagccagagccagctgctacgtgagctagtactattacctgctggggcagactcgctgagagcccagggtcatcgtgctgaactggaccggaag

SEQ ID NO: 6814 - DNA, 544 bp, Mus musculus
  misc_feature (122)..(122): n is a, c, g, or t
  misc_feature (127)..(127): n is a, c, g, or t
  misc_feature (170)..(170): n is a, c, g, or t
  misc_feature (218)..(218): n is a, c, g, or t
  misc_feature (264)..(264): n is a, c, g, or t
  misc_feature (271)..(271): n is a, c, g, or t
  misc_feature (308)..(308): n is a, c, g, or t
  misc_feature (312)..(312): n is a, c, g, or t
  misc_feature (322)..(322): n is a, c, g, or t
  misc_feature (454)..(454): n is a, c, g, or t
  misc_feature (519)..(519): n is a, c, g, or t
ggaactgctgtcgtatggatccctccttgtccctgtcaaatgttcagcaaacttacagaggactgggccagcctgatcgatcaccctcccaactgcgatgtgtatgtgaacaccagtacacnggacngtggagtagaggctgctagttggagcacactttctctgaagangaggagggggtggggggtatgacattttccttcccttttccagtgaanataactcttaccccaccccaaggccctttccctttgcttccttctngcttganagaaagtggggtatttagtatcagctcctcctgttcntctnccctcccttntcccatcctttggagagcaggactagtacatgcactgagcaccgcactttcttaggtaaggaggcatgtttgaggcaggaggctgaggagtgaagtccagtcaagcaggtacaattccacctccccttctancccccaaaagacatgtccagacattatgattattatatttttttttcaatgccagtgctgctcanccctcagcataacttcagttttcat

SEQ ID NO: 6815 - DNA, 375 bp, Mus musculus
  misc_feature (80)..(80): n is a, c, g, or t
  misc_feature (86)..(87): n is a, c, g, or t
  misc_feature (140)..(140): n is a, c, g, or t
  misc_feature (166)..(166): n is a, c, g, or t
  misc_feature (184)..(184): n is a, c, g, or t
  misc_feature (190)..(190): n is a, c, g, or t
  misc_feature (203)..(203): n is a, c, g, or t
  misc_feature (210)..(210): n is a, c, g, or t
  misc_feature (217)..(217): n is a, c, g, or t
  misc_feature (226)..(226): n is a, c, g, or t
  misc_feature (267)..(267): n is a, c, g, or t
  misc_feature (350)..(350): n is a, c, g, or t
gggactgttcgctccgtcacctctggagctgacatactgttctggggtttgttctctaccctttccaaccaatcacaccncctttnnttttttttttttttaaaaggaaaagacaaaggaaggtggaagtggtgtccctnccctccctgcacccatgtgcctgggncttccccgtttcctgttnccactnaccctattgtgtntctacanccacctnaccactganccgtaagacaagtgtatagggacagggtctctggaacacancctttgtaagggattgaacactgctttcaggtgcattgaggggtaatcaatacttatggctttatgagggctcttaaattttntctgaaaaaccaaagggctgtgagt

SEQ ID NO: 6816 - DNA, 423 bp, Mus musculus
  misc_feature (207)..(207): n is a, c, g, or t
  misc_feature (220)..(220): n is a, c, g, or t
  misc_feature (267)..(267): n is a, c, g, or t
  misc_feature (370)..(370): n is a, c, g, or t
gatgtgtgtccgaggttatctggctgtgcgcccctatatggatgcagtcgtctccctggttacactcatgttggacacaggcctgccctgttttcgtggccagacaatcaaacttttgaaacacaggttcagcccgaacatgacagagcgggaggctgcgaattttatcatgaaggtcatccagaactgtttcctcagcaacaggangccggacctacgnacatgatccagtactaccagaatgatatcccctactgagaagcctancctagcacctgaagccttgagtgtcacagagcaactcgtcctgccaccgtaggcctggctgtgggggcaacgggcacatggaccgttgatgcacacgtgtgantctctttcacactggacacattccgtttgttcacccgtcatactacattggta

SEQ ID NO: 6817 - DNA, 478 bp, Mus musculus
  misc_feature (114)..(114): n is a, c, g, or t
  misc_feature (130)..(130): n is a, c, g, or t
  misc_feature (142)..(142): n is a, c, g, or t
cccaggctattgtgtggctctgatgggacaaatacccaggacaagttagaggaatttgccaaagacctgccccatgacagttgttgtccagtgtcttcaccctgagaataaccnaaagttgcagtagttntttttttctttnttaagtgcatttaagaatatgtgtggttttgttgtggaacagtggagctggccattattacatgtgctcagagatcaatgcctctggaatacatttgacatctgtttgtgtttgcttgctttgtttttaaggggatctttccctgtgggtggtgtcagaatttggacaccttggtttgggggtaggttgagctgggcagctgcaatcagcttgtttatgcaaactgggcgtgagcctctctgggctcctggttgatggctaatgctgggagggaagggtcagccccaagtagacccttcccgtgggctttggccaggccagacacaacatcgttta

SEQ ID NO: 6818 - DNA, 549 bp, Mus musculus
  misc_feature (409)..(409): n is a, c, g, or t
  misc_feature (416)..(416): n is a, c, g, or t
  misc_feature (446)..(446): n is a, c, g, or t
  misc_feature (464)..(464): n is a, c, g, or t
  misc_feature (466)..(466): n is a, c, g, or t
  misc_feature (517)..(517): n is a, c, g, or t
  misc_feature (519)..(519): n is a, c, g, or t
acagtgccattaccatatgtttgtatgttgcagttggatatagctgagactcctccatcttggttttctcttcactcatccatttcttcagctgcatgataagtctgtcagtaaagcatttaaccccaacaaggtcagactatggtaaagttagaaaaacatatttaccgaagtacacaattgatctcattgaaataagaagtgagaaccgctctgttgagcactgaggtgtaaacgtgcccagatgcacagcgtgagtagcttcgagtacgcatctgtttgcacatgttgtagaagcttaaaatgggaacatgaccctgctgtggagaaccttggtagaattgttgttagtactaaaggagatttccagcgcatacagggtggcactgaaaactgctgaagcccacanccctcanccccgaaggctcagcggccagtaccagcgnccttgctgtggttgtgtntntgcgtccctggcacacttgggcaggcagctcagtcactctgaacttgcttntnttctgtcttgtgagtgtgctgcttgagaca

SEQ ID NO: 6819 - DNA, 465 bp, Mus musculus
  misc_feature (44)..(44): n is a, c, g, or t
  misc_feature (85)..(85): n is a, c, g, or t
  misc_feature (161)..(161): n is a, c, g, or t
tgggctgctttcagattcaccataatgctcttcacattgcaggnaaagccaaaggattataaaacaaccaaccatccacttcctntgggctctgtcccatcatcctgtgctgaggacagtgtccagtcttgactcactgataaagtttctcccaactattntgggttttgacacagggtttccctgtgaggctttgactattctggaactctcagagatccaccagcctcttcctccccacactgagattaaagacccgcaccactaccaccctgctcctcccgattttaaatacactggaatgtcttgcagtgtgggtgcactgtcctggtgtttctgtttctcagtattagtgatgcccgtgggtaaaggatagactaggaaaccagccttcatccctaccacttgctgtagcagtcagtaaggtggccattctccagtgtcttttccaccaagtgcctaaag

SEQ ID NO: 6820 - DNA, 462 bp, Mus musculus
atattatacatctgcctccaactaatataaatgtttctgtaaatagcatatgcatgtaggaaaatgagcatgtaataatgtttacatctgtccatatcacatttagccttcatgccttaatccacaatgacaggactgatgcattctttgcggaatgggtgtgttgaattcactagtttgaattcgttaaatggaattgaacagtggtttggaaaccgatggagacagagcagagggcactgcactgttgggcttctgcagagagtttgcagagtagtattcaggtcacaagcccttcgcacgagtgcagtggagctccaggggctctcattggtcttttctctttatgatacaatgtgtgcgctgtgttagcatctcacttacacagacgctcatgacatttggtgttggtggtcagtgcctattgctttattcttagttacctattgtagctagctcttt

SEQ ID NO: 6821 - DNA, 507 bp, Mus musculus
  misc_feature (46)..(46): n is a, c, g, or t
gcagacatttttgagggatcctattaaggcagatgcagagaacagnaaaagctgcagggtacagttctctggaactagtgggtcacttgcaagggatgccttttgttgtggatctgcctttctggaagttacccagagagccagggaaagggttcagtcaacccctggagccttcttccatcccttcccaactcaacatcaagcaggccttgtatgggaagttgtctaaacttcagctcagtcccaccagctttaattactcctctagctctgctacctttcccaaaggccttgctggtggtgtggtgcagctgagccacaaagccagctttggtacaggccacactgcatcactgtccttacaaatgttcgctgacagcagtgcagtagaaagcatctctctccaatgtgcatgcagcctgaaagccatgatcatgtgccaaggctgcggagcattctgccatgatgactgcattggaccttcaaagctctgtgtattgtgccttg

SEQ ID NO: 6822 - DNA, 164 bp, Mus musculus
  misc_feature (29)..(29): n is a, c, g, or t
  misc_feature (55)..(55): n is a, c, g, or t
  misc_feature (79)..(79): n is a, c, g, or t
  misc_feature (100)..(100): n is a, c, g, or t
  misc_feature (121)..(121): n is a, c, g, or t
  misc_feature (123)..(123): n is a, c, g, or t
ggatcataaagctttgtagataatacttnttctggtccacttgcatggagaacanccccgtacttgtcacacagtgtcntcctttgtataattatatgcntcgttgtagtttgcagcttcntngggttttatgtgcatgtgaatggcctagagaacctattttt

SEQ ID NO: 6823 - DNA, 449 bp, Mus musculus
  misc_feature (253)..(253): n is a, c, g, or t
agtacatgatctgcattccacatcccagtctagcaggttagtgatgcaaagatacttccagtctgaacttcagtgcttacacaggccctgtctcaggaacatcttaacagatggcaaaaaaaagtgagcagactttacgaatttttctcctatgagtggcaactaaggttcctgttgtttggaaaaaacactagtggtatgtccgctactaattcagtgttggaggaggcaccagccatatagtaggggtgtntgtgtgtgtgtgtgtgtgtgcgcgcgcgcgcgcgcgtgtgtatttgtttaaattctactgtatatcaccatgaaatctgtctgtttgtcttgacaatgtttaaatgatgtagattgtcttagaatgaatactcagaagtactcagaactccgattccgatgccacccgagaggagtcagactcctgtcatgtatat

SEQ ID NO: 6824 - DNA, 259 bp, Mus musculus
catctccatgcgtctggcagaacatcgccgcatccacacgggtgagcgaccctactcctgtcctgactgtggcaagagctaccgttccttctccaatctctggaagcaccgcaagacccaccagcagcaacaccaggcggccgtccgacagcagctggcagaggcggaggctgctgtgggcctggctgtgatggaaactgcagtggaggctctgccccttgtggaggccattgagatctaccctctagctgaagctgat

SEQ ID NO: 6825 - DNA, 300 bp, Mus musculus
  misc_feature (121)..(121): n is a, c, g, or t
  misc_feature (143)..(143): n is a, c, g, or t
  misc_feature (145)..(147): n is a, c, g, or t
  misc_feature (149)..(154): n is a, c, g, or t
  misc_feature (156)..(159): n is a, c, g, or t
  misc_feature (162)..(163): n is a, c, g, or t
  misc_feature (179)..(179): n is a, c, g, or t
  misc_feature (181)..(182): n is a, c, g, or t
  misc_feature (185)..(185): n is a, c, g, or t
  misc_feature (187)..(187): n is a, c, g, or t
  misc_feature (191)..(191): n is a, c, g, or t
  misc_feature (194)..(194): n is a, c, g, or t
  misc_feature (201)..(201): n is a, c, g, or t
  misc_feature (226)..(228): n is a, c, g, or t
  misc_feature (230)..(232): n is a, c, g, or t
  misc_feature (238)..(238): n is a, c, g, or t
  misc_feature (243)..(243): n is a, c, g, or t
  misc_feature (246)..(246): n is a, c, g, or t
gctgcgacaaagagaacaagatgcttaaagacgagatgaacaaagagatcgaggcggcccgtcggcagttccagtcacagctggctgacctacaacagctgcctgacatcctcaagatcanggaggccaagctggctgagtgncnnnannnnnntnnnnggnntacgagaggaagaacntnnacntnacanccntcatttnagacctgcgcagccgggtaagggannngnnngaaggnatccncangaactggcccgagcaggggcccgcttaccgagatgagctgcacgccccccaagg

SEQ ID NO: 6826 - DNA, 506 bp, Mus musculus
  misc_feature (353)..(353): n is a, c, g, or t
gcctggccagcaaggcttgggacatcagcctggcccagcctgagagcatccgcagtgacctggagagctctgacacgcagtcagatgacgtgccagacatcacctcagatgagtgtggctcgccccgctcccatgctgcagcctgcccctccaccccccaagtccacggtgcaccgagcccaagtgcccacaagaacctcgctgctccagctgagggccagactgtcttgaagtcagaagagtatgaagtggaatgaaggcccctgttctgagaagcacacttgttgtaactgcatcttttggaatctttttcgggggagggtggggatttatgtattttgtttcaaagattntctggtcagggttcccccagggaagttctgagaaatttacaatttcttaccagataaaaaatgaaatttgcctctagtatccctccccctatcctctcatttttagttttaatttattggctaaactgatgttggcaatctgtgaggtgtgtc

SEQ ID NO: 6827 - DNA, 544 bp, Mus musculus
  misc_feature (184)..(185): n is a, c, g, or t
  misc_feature (188)..(191): n is a, c, g, or t
  misc_feature (194)..(198): n is a, c, g, or t
  misc_feature (201)..(204): n is a, c, g, or t
  misc_feature (207)..(209): n is a, c, g, or t
  misc_feature (213)..(230): n is a, c, g, or t
  misc_feature (362)..(362): n is a, c, g, or t
  misc_feature (365)..(368): n is a, c, g, or t
  misc_feature (370)..(374): n is a, c, g, or t
  misc_feature (376)..(379): n is a, c, g, or t
  misc_feature (383)..(383): n is a, c, g, or t
  misc_feature (385)..(389): n is a, c, g, or t
  misc_feature (424)..(424): n is a, c, g, or t
tatgagcagcgttgggagcagcccctgacagccctgcgggaggagctgggcatcagtcctcccccaaaacatatccagggcctggcctagcttgagctgccacacagggagaattaagcctttctctccacacactgccttcctcgggacaaaagagcctctcagctgcttttgtttcttctcnntgnnnnttnnnnntcnnnntgnnncttnnnnnnnnnnnnnnnnnngctgccttgtaccttcagggccagcccaggagagagaggcagagcaatggagccccaggctgctgtgagccatccggagagagcagtatgtatgcctcgaacagccatattggatcatactgatcattgcantcnnnngnnnnntnnnnttcntnnnnnggacagtgactctgacagggcgttttgtcaagctntcttcgaaagcttgactactacatcatgttaccaagccctgagcagactggtggggaggagaaggcgtctctggtgtctgaataaagctcccatcaggcctagagtctgctggttgtcct

SEQ ID NO: 6828 - DNA, 542 bp, Mus musculus
  misc_feature (61)..(66): n is a, c, g, or t
  misc_feature (68)..(68): n is a, c, g, or t
  misc_feature (71)..(73): n is a, c, g, or t
  misc_feature (141)..(141): n is a, c, g, or t
  misc_feature (146)..(146): n is a, c, g, or t
  misc_feature (273)..(273): n is a, c, g, or t
  misc_feature (294)..(295): n is a, c, g, or t
  misc_feature (297)..(297): n is a, c, g, or t
  misc_feature (299)..(301): n is a, c, g, or t
  misc_feature (303)..(304): n is a, c, g, or t
  misc_feature (306)..(307): n is a, c, g, or t
  misc_feature (309)..(309): n is a, c, g, or t
  misc_feature (312)..(315): n is a, c, g, or t
  misc_feature (318)..(320): n is a, c, g, or t
  misc_feature (324)..(324): n is a, c, g, or t
  misc_feature (328)..(335): n is a, c, g, or t
  misc_feature (337)..(337): n is a, c, g, or t
  misc_feature (340)..(340): n is a, c, g, or t
  misc_feature (372)..(372): n is a, c, g, or t
  misc_feature (413)..(413): n is a, c, g, or t
  misc_feature (423)..(423): n is a, c, g, or t
gccatcggccggagtggtatgattttacggagtccccggccagactttcggcctagggaannnnnncncgnnngagacccattccacagtttaaagagacccaggccaccttttgttagaggccctccgttctttgcaccnaaacncccattcttccctcccaggtactgatggaaatctggggaaggcattttgaacagtctatagagagcattggaagtagcagtttgggtttttgtttaaatttggttttcctttcttgttttttttttnccactttgttttttttttttnntntnnntnntnntnttnnnnttnnntttntttnnnnnnnnanggnccctccttccaaattcagaaagcatacatggntaacagtttgctattatccagtcctctctccacacttaggncctttccaanttgtttgtattttttctttaaaaaaacaaaacacacaggcataagtaaacataaccaaagccacattatttggctgggggagtggggaggataacagtatttatcccatctattgagag

SEQ ID NO: 6829 - DNA, 169 bp, Mus musculus
  misc_feature (100)..(101): n is a, c, g, or t
  misc_feature (106)..(106): n is a, c, g, or t
  misc_feature (128)..(128): n is a, c, g, or t
  misc_feature (130)..(130): n is a, c, g, or t
  misc_feature (133)..(133): n is a, c, g, or t
  misc_feature (136)..(136): n is a, c, g, or t
ccagttattccaggggtttcatctaaggcccacccactcacagctcagatcagccgtgcttagggtcccttctgactcttagctcacttggtctgttctnnagganccatcatggaagagcaggcagntnagntcntgggtgtgaagatgtgcaagtttattccggaac

SEQ ID NO: 6830 - DNA, 299 bp, Mus musculus
  misc_feature (43)..(45): n is a, c, g, or t
  misc_feature (47)..(47): n is a, c, g, or t
  misc_feature (52)..(54): n is a, c, g, or t
  misc_feature (56)..(56): n is a, c, g, or t
  misc_feature (110)..(110): n is a, c, g, or t
  misc_feature (120)..(120): n is a, c, g, or t
  misc_feature (181)..(181): n is a, c, g, or t
  misc_feature (186)..(186): n is a, c, g, or t
  misc_feature (212)..(212): n is a, c, g, or t
  misc_feature (215)..(215): n is a, c, g, or t
  misc_feature (254)..(254): n is a, c, g, or t
  misc_feature (272)..(272): n is a, c, g, or t
aggtggaagcacgaggcgccctctaggccccacggagccctgnnncncttcnnncnggaattgctacttggatgttgggtgttcaagcccagaagccccctccgggccanatggacaacnccgccctttgatccgcgcttccctaaccagaaccagacgcgtaactgctaccagaattttntggantaccaccggtgtgtgaagaccatgantcnccgcggaaagagcacacaaccctgcgagtactatttccntgtattccattcactgtntcccatcagctgggtgcagcgctggaa

SEQ ID NO: 6831 - DNA, 546 bp, Mus musculus
tttccagcagtcacattgcccaggtctccaacatgcctaacattaaaacagcatcaggtggatgaacaatgatgtctatttcacatcactagagttcaataactaagttaaaatctgactaagtcaaatacgtatgagtggatgaaaaagtacacatacattatcaactatgatggcttttccagaccggcaaaggtctggaaacacaaagttcaaaacaggtagctacaggataccttgacagacagttcttcaagtttaaaggtagtgctctgagaagagtcataatctggggctttagtaaagtatgccagctcctgagttagcaaaggtttgctcccaggcccccattctaaaaacaggctagcccttctttatttaggactttcctaaggtttcacatacaaatggaatctcaactagttttcattatctgcattagcgtcctattatacaatgatttactttgccagtgactgacagtactgttatccatgatattttctgtattggttccttttggcacttgtattagttcatcttcaa

SEQ ID NO: 6832 - DNA, 530 bp, Mus musculus
  misc_feature (347)..(347): n is a, c, g, or t
  misc_feature (443)..(443): n is a, c, g, or t
  misc_feature (457)..(457): n is a, c, g, or t
  misc_feature (486)..(486): n is a, c, g, or t
aaggtgacaacgcaagcctctcgagcagggagttggaagagcaggaggacctgtcatcacccaggttcatccaccccaatgatgttctcaagattctggaggcctttgtcacggggctgaagaagcctaaggacgctcagccagtactgaaattgaagaaagagactcgagataactcgaaggacacggagtactgggaatccctggctgcggttattcctttcttcaagcagaacctctgggatgcgctgtacaaggccttggagaaatactatctcgtgctgaccgagagggccaagctgctgatggagaatgagtctctggagcagcagaatgcagagatgcantccctgctgcagcagtatctccaggccaaggtaaacacagaactgcagatcccaccaactcagggcttccggatgccctcaaaatgaagaaggatnttcaaagcctggtntcatggagtctacacccatctcttgaganccagacccaccctgggtttttctgagctggatctttctgccaaa

SEQ ID NO: 6833 - DNA, 461 bp, Mus musculus
  misc_feature (251)..(251): n is a, c, g, or t
  misc_feature (257)..(257): n is a, c, g, or t
  misc_feature (265)..(265): n is a, c, g, or t
  misc_feature (276)..(276): n is a, c, g, or t
  misc_feature (349)..(349): n is a, c, g, or t
  misc_feature (410)..(410): n is a, c, g, or t
  misc_feature (413)..(413): n is a, c, g, or t
aggatgcttttatacacaacttggaaagatcaactagagataacagccaagaggaaagtctcatcaggaagacaggcctacacacagacttgctttactctgtggacaaactggggtgcaaaggctatctgtgatattttaaaaaatactgcacttttcgtatttcctagcaggtaagaaaacacttgtcacaacactactaggtttctcaccgtatcttgtttcagtctctccagcaattccttctcaanagcatngtccagcngggcagctatnaatgctttttcctgtaagaaaagaccaaaccattactccatcaggactcactttccagcctgtacacatacantcccctatgtttaataagggtatgacgtggttgtataccagcaaggcttttgcttttctanccnagatacacttctttctctctcaaagcctcttgggagcttttcaattag

SEQ ID NO: 6834 - DNA, 469 bp, Mus musculus
agcttaaggtctatcagtctatcagatagttgtgggaaattattaaaaataagaattcttttaagtatcaacttaagaatttttctaaataggatataaaagttttcatcaaaagtaatattttgtattttcaagatggcagggaggtgatgtgttggtggccaggatctcttgaagttgttgaagaaagggaactgttttcagtctgctctggtactatgatcttatgggtctaagcctcagttagcgggaatgcccatggaatgtgtgattctgcttaactgaagagaagtaaagactgtgtagtaaccattccttaaccagtgttgcatgccagaggtaagttagtgctttctgaccattggggcattcgcatgccttgtgctttactgaacaactgtaactgaatgtagtcatggaaggaacaagatacggaaccactcactgacattgggacatcacctggaat

SEQ ID NO: 6835 - DNA, 519 bp, Mus musculus
ttgggccagagaacacgaagcacctgctgatactggggccactcagggaaactccattccctctactgctcagcctgcggcaggtggccagctcagagcgcccagggcaggcttggacagccagtcatgccatgctgcctagactagcccaaacaggcctgagatgcaaagggcccaggggcctgcagcagcagaaaactatggctcttggttaagagtagccttggttgagatctcacggcctgcggggtctgggtaggccaggccatgtggctacagcagaggctgggtgggaagccccgtccctgaaagaaggactggctgcctaagaacccacacatccacggcaggacatgccagccacaggactgcagaggcaggtctgcctgctaagcgacagccctacaaacagccgggcagaatccacatcacagtgcaacattgaggacttggcactccccttgggcaggaccagataccatatacccacctgctggcttttctggcagctttgtatca

SEQ ID NO: 6836 - DNA, 291 bp, Mus musculus
  misc_feature (29)..(29): n is a, c, g, or t
  misc_feature (31)..(31): n is a, c, g, or t
  misc_feature (33)..(34): n is a, c, g, or t
  misc_feature (36)..(46): n is a, c, g, or t
  misc_feature (50)..(50): n is a, c, g, or t
  misc_feature (54)..(55): n is a, c, g, or t
  misc_feature (61)..(61): n is a, c, g, or t
  misc_feature (64)..(64): n is a, c, g, or t
  misc_feature (70)..(70): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (88)..(94): n is a, c, g, or t
  misc_feature (97)..(97): n is a, c, g, or t
  misc_feature (99)..(101): n is a, c, g, or t
  misc_feature (103)..(104): n is a, c, g, or t
  misc_feature (107)..(107): n is a, c, g, or t
  misc_feature (129)..(129): n is a, c, g, or t
  misc_feature (135)..(136): n is a, c, g, or t
  misc_feature (163)..(163): n is a, c, g, or t
  misc_feature (165)..(165): n is a, c, g, or t
  misc_feature (171)..(171): n is a, c, g, or t
  misc_feature (173)..(173): n is a, c, g, or t
  misc_feature (208)..(208): n is a, c, g, or t
  misc_feature (225)..(225): n is a, c, g, or t
  misc_feature (266)..(266): n is a, c, g, or t
tctttatgacgttcctcatatcctccgcntntnncnnnnnnnnnnnctcngagnnctacanacnaaaatnaatgaancnatnttaccnnnnnnnccntnnntnnctnatccaaagacagaccacagacntgggannaagttgggagatgagcacatgaggatntnagcttntnacctgcctagtgatgggaaccattacaccagcatntgcttggaaatcagatntcacactttgaagggagaaccccaggagattgactatgttntagagatttaccaccgctgcttttt

SEQ ID NO: 6837 - DNA, 278 bp, Mus musculus
  misc_feature (63)..(63): n is a, c, g, or t
atctcctccgacacttagagaaacaaagccagtgaacatgccagtaaaagaaaatacagtaangaacgttttgccagactctcagcaacaacacaaagttttaaaaacagtcaaagtaacggagcaattaaagcactgcagcgagattcttaaagaaatgcttgccaagaaacatttgccgtatgcatggcccttctataatcctgtggatgctgatgctttgggactccacaactactatgacgttgtcaaaaatcccatggatctcggaacgatca

SEQ ID NO: 6838 - DNA, 539 bp, Mus musculus
  misc_feature (127)..(127): n is a, c, g, or t
  misc_feature (382)..(382): n is a, c, g, or t
  misc_feature (401)..(401): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (438)..(438): n is a, c, g, or t
  misc_feature (470)..(470): n is a, c, g, or t
  misc_feature (503)..(503): n is a, c, g, or t
cttctggaggaacagcgtgctcagtgcagtgtgcagtctcaggtgaggtgggtaattctgctttttgcctcttttaaaacttggtggttatttgcggttatttcagaatggtgtagctgctttgggnctcttccccgctggcccctgtggcagctgcctgcctcagaacaggcgttcctggggagcagaggtgccccagcgatggatcagctatgtgaagaccctggagccacttgtagttttgcacatttctttttgagagtgttacttgaatctgtcttaactgcaggagagacttgaagatcatagagggaactcagacatcttagtgttagcgctagcagtgtcatgtagacagaggaaaggagcatgggacagaacnccggaggcgtgaggcgagntcttntnttntcttccttggtgactgtgtatccagtnaggggtggcgctgtgctgtatgagcattaaantctgtggccacctgtcactggatgccctgtgtntcttcatttctcactgtgcacttgatgttaccatat

SEQ ID NO: 6839 - DNA, 475 bp, Mus musculus
  misc_feature (32)..(32): n is a, c, g, or t
  misc_feature (314)..(314): n is a, c, g, or t
  misc_feature (410)..(410): n is a, c, g, or t
aagcggcccacggtgccaaagaagacccaganctcgtaagtgaccatggcaaccaggactctgagaggttgtgctgacgggatccctatttattattttcatctacttggtacgaagttgatgagccatggacagttttctacagcggttcctagagaacagagaagatgctctctcccctgcacacatggatgctgggcatgacatatgcaggagtgagtcctgtgctttcatgggcatggctgctgtggccctgctgaccactgagatcctcagaataagggacaccatggagtgagatcctggcctgtggncccctcacttgaagttcttcagaataagttaaatgtgatctgctctctggcctcccttcacccctgtgcacattgcctgatgccccatgttggccnagctgtaatcgtgcgtgattatagggccaaggctcattcgggtcagggtgtttgaatgtcttcat

SEQ ID NO: 6840 - DNA, 114 bp, Mus musculus
acccttgtaaaactgtctccctgcaccccacaccttccctttaaccaacttgcaatgctgttcatggagaatgttcagaaggttgagttacagatacagtaagattggttagaa

SEQ ID NO: 6841 - DNA, 141 bp, Mus musculus
tagatgaggcccctggtagtgattcatttatggatttcacagaggaatactaggtgacacagagagaaatggcaggctctcatggtaaccttttcagttacgtatgaaaaccctgctcataggccatgagaacgtgaaagg

SEQ ID NO: 6842 - DNA, 473 bp, Mus musculus
  misc_feature (242)..(242): n is a, c, g, or t
  misc_feature (246)..(246): n is a, c, g, or t
  misc_feature (275)..(275): n is a, c, g, or t
  misc_feature (278)..(278): n is a, c, g, or t
  misc_feature (281)..(281): n is a, c, g, or t
  misc_feature (303)..(303): n is a, c, g, or t
  misc_feature (315)..(315): n is a, c, g, or t
  misc_feature (327)..(327): n is a, c, g, or t
  misc_feature (331)..(331): n is a, c, g, or t
  misc_feature (334)..(336): n is a, c, g, or t
  misc_feature (339)..(339): n is a, c, g, or t
  misc_feature (384)..(384): n is a, c, g, or t
  misc_feature (437)..(437): n is a, c, g, or t
  misc_feature (446)..(446): n is a, c, g, or t
ttgttactcaagacacatcagctgtccctagacgcctttctggtcgctttgaagttcatgcacgtggaagacgtggacattgacgaggtccagtgcattctggccaacttgatatacatgggtcacattaaaggctacatctcccatcagcatcagaaactggtcgtcagcaagcagaaccctttccctccgctgtccacagtgtgctgatgcccaggccttgccaacagcgtgctcctgcnaccnctgcccgctggagctcacatctcctggtncantcnccagcacctgaggcactcactntggtttccagtntcctaactcatnccanccnnnccnagacctggagttctttttcaagatggaccaacaccctgctgctgncctgtggtgctcctgagcgtccgggaaggagacagctgggcttcggtttgttnatggaggcnacctttgtgacatcttgtagggtttcc

SEQ ID NO: 6843 - DNA, 114 bp, Mus musculus
  misc_feature (39)..(39): n is a, c, g, or t
  misc_feature (44)..(44): n is a, c, g, or t
cctttcctgtttaaaggagatcactagtgagagctgaancaatncctcttcattccttttgtcggtatcttgttatgttacttgatttgtcattactaagttattgtgttacaa

SEQ ID NO: 6844 - DNA, 159 bp, Mus musculus
  misc_feature (27)..(27): n is a, c, g, or t
  misc_feature (29)..(29): n is a, c, g, or t
  misc_feature (43)..(43): n is a, c, g, or t
  misc_feature (45)..(45): n is a, c, g, or t
  misc_feature (47)..(47): n is a, c, g, or t
  misc_feature (49)..(49): n is a, c, g, or t
tggccagcagtgcaccactggagaatntnttagaaatccaaantntntnatccccgcagaatcaggaaatccagaggtggagtacagcagcatgggctttacaaaccctcagggaagatgatgtgtgtagaacctggtgggccaccgttgtgcaaatta

SEQ ID NO: 6845 - DNA, 229 bp, Mus musculus
ggacagcaacgccacacgtagaaatgtaacctgggtagaagcactgcccaaggattctagaaaactctacacagtgcaaagctcagagacagctggggtcccctggcccctgccagggcgccttgaggccgcagacactccatggcagactagggtgctgcctctgccaggcgtgccaggccttcacgcagctcgctgagctcaaacagccgaacatccagcagctgcg

SEQ ID NO: 6846 - DNA, 513 bp, Mus musculus
  misc_feature (219)..(221): n is a, c, g, or t
  misc_feature (265)..(265): n is a, c, g, or t
  misc_feature (268)..(269): n is a, c, g, or t
  misc_feature (291)..(291): n is a, c, g, or t
  misc_feature (301)..(301): n is a, c, g, or t
  misc_feature (303)..(303): n is a, c, g, or t
  misc_feature (311)..(311): n is a, c, g, or t
  misc_feature (352)..(352): n is a, c, g, or t
  misc_feature (360)..(360): n is a, c, g, or t
  misc_feature (424)..(424): n is a, c, g, or t
  misc_feature (460)..(460): n is a, c, g, or t
gatcccaaggatcctagccagagcaccagcacgacagaagcccctgagggcccaaggcctagcaagtccaggtctaccctgagcgtaaaggagagaatcagaagagctaaggctgttcgcgcccagggctggaaactcaaggcccagcgcagcagccagaaagtaacaaagactcccagcctgacccacagcacgacccatagtgacattggtgagagnnncaatgataccccgggccagactccatggcccagcaaggctgctnatnncttaagcttcagtgagatctcntcaacagatntnagcagtantgaaagcttcttggaactgactaaccttttaactcaggaantccaacanatcccaggagacagagagaagctcacctctgacgattaactactccctcaaagggccaatgaancccttcctgagcaatgaacagatttcagccaagctncctcctcccaggacagtaagaaactttggtcaatgttctaataccaaggctaa

SEQ ID NO: 6847 - DNA, 296 bp, Mus musculus
  misc_feature (74)..(74): n is a, c, g, or t
  misc_feature (93)..(94): n is a, c, g, or t
  misc_feature (112)..(113): n is a, c, g, or t
  misc_feature (119)..(119): n is a, c, g, or t
  misc_feature (124)..(124): n is a, c, g, or t
  misc_feature (131)..(131): n is a, c, g, or t
  misc_feature (136)..(136): n is a, c, g, or t
  misc_feature (141)..(141): n is a, c, g, or t
  misc_feature (143)..(145): n is a, c, g, or t
  misc_feature (149)..(149): n is a, c, g, or t
  misc_feature (157)..(157): n is a, c, g, or t
  misc_feature (159)..(159): n is a, c, g, or t
  misc_feature (161)..(161): n is a, c, g, or t
  misc_feature (166)..(166): n is a, c, g, or t
  misc_feature (180)..(180): n is a, c, g, or t
  misc_feature (198)..(198): n is a, c, g, or t
  misc_feature (206)..(206): n is a, c, g, or t
  misc_feature (222)..(222): n is a, c, g, or t
  misc_feature (228)..(228): n is a, c, g, or t
ttcatattagtaatttagagcaagcatgttgtttttaaacttctttgatatacaagcacatcacacacatcccnttttcctctagtaggattnntgagtgcataattgtagnnctcagntgaanttccttntgctncactntnnncctntccctgantntntcctntggcccaagcttantaaggtgataatgagtgntccggatnctgggcacctaaggtntccagntccctggagagggagggatgtgggggggctaggaaccaagcgcccctttgttctttagcttatggatg

SEQ ID NO: 6848 - DNA, 428 bp, Mus musculus
  misc_feature (40)..(40): n is a, c, g, or t
  misc_feature (54)..(54): n is a, c, g, or t
  misc_feature (82)..(82): n is a, c, g, or t
  misc_feature (88)..(88): n is a, c, g, or t
  misc_feature (113)..(113): n is a, c, g, or t
  misc_feature (122)..(122): n is a, c, g, or t
  misc_feature (141)..(141): n is a, c, g, or t
  misc_feature (166)..(166): n is a, c, g, or t
  misc_feature (211)..(211): n is a, c, g, or t
  misc_feature (247)..(247): n is a, c, g, or t
  misc_feature (259)..(259): n is a, c, g, or t
  misc_feature (267)..(267): n is a, c, g, or t
  misc_feature (362)..(362): n is a, c, g, or t
gagaccatattgaagaatgtgtgtttgtgtctgtctgtcngtctgtgttcatgngcacctctgtggctttcccaagaaaacnctgttnctcaaccaagaaaatcatgtagggncagttcttntcatgtgtcgccagacacnctggacaacccctccttgggtattntgggggctgttgctgccaggaaggaggacaaggaggatgaccctnggcagctcactctcactctgctctctaccaacgttncccagggactcntaaaatcntcagggacagttgaggctcagcctccagtcccctctgtgtgccaagagctggcctcgattcaaggttgctcattacagttaatttgggccattgncctggcatcttccatcctgtatgccctccatccatggaagggggctcccttattgtgtttgcctgc

SEQ ID NO: 6849 - DNA, 576 bp, Mus musculus
gtttgggtaacttgtcctgtgcacaggtccttgaggctcctccctctgcctcccagcctcccacctaagattgttctgtggcttcatgaggtaggagacagcaaacccacccctccacatacattatctgtgactcttacccagtcatatgtctcccttttcctgtgtcagcttgcgtccccatccctgctttgtcttcccacttctgtcatggcagggcagcagaaagaggcccatctccaccaggtctccctccagcagcctccttccctctctcagccatggatgggtcccagacctatctcagcctcctcatcagtgtcttcatgagaggctgaggacacgtgacagagctagcccagcctccatgccctctggcacttcagagcttctctgttgccctctcactgcttcctagcagtgtggcacagaactgcactcagaacatagttttggcattcttcacatccaagactccagcccttcctgctgcccagccctactgtccagagtgtctcttgggcctgagaataagtggggtgggaagactggggccatgttgggttttttcattca

SEQ ID NO: 6850 - DNA, 534 bp, Mus musculus
  misc_feature (355)..(355): n is a, c, g, or t
  misc_feature (358)..(358): n is a, c, g, or t
agcggaattctttacaacacttgacgctccacactagagttaattatgaatattaggaacttgtgaaagcattttagtgtttaaatcttagaaactatgaagcatgtatgctggaaaatctctgaaaatgtgacaatggagaaaaattttcaaattgttcactagcaaatattccataataaagacaaagtagagaagccagaagaatctgtaacacttctatggagactgaaacaatccatttgagaggaaatctgaatatggcggataatatgactctcaaaagagtgataccagtaagcattctgtatgtttaatttaaatgaagaaactcagacaaatcatatttgttaanaangaggatttgataaactgagccatcaaaatgccagtattcctacagatagagattgccctcagtgtcaagtattcataatctgtatcatatgctggtttcaagtttcaggatagaaactgtctttgagtcccttgggctctgatcaccaactccttccccacagtcgtgtatatata

SEQ ID NO: 6851 - DNA, 174 bp, Mus musculus
ctggctccagtttgttcctgttcctggatgtgcgtcgtgcaagttgattctgtacctggtaaaacctagaacacacttgtgatgtcacctcttggatgtagttgtgtttgtaaggatctaagaagtcatggtgttgtcggtgttgagtgcttggaataaatgaagagcagaccc

SEQ ID NO: 6852 - DNA, 459 bp, Mus musculus
aagaacgtgggcttccagatgctgcagaagatgggctggaaggaaggccatggcctgggctcccttgggaagggcatccgagagcccgtcagtgtgggtgctctttcagaaggagagggcctgggagctgatgggcctgagcagaaagaagacacctttgacgtcttccgccagcgcatgatgcaaatgtacagacacaagcgggccagcaaatagatcagagccactggcgacagagataagcctcgaagcagccttgcccttcccgtcaccctgccccggacgcctgcagcctgagcctcgttccagggtcacatccacaaggaccatggattccaaaagttgtgctggcctggcctgccctggctccagtttgttcctgttcctggatgtgcgtcgtgcaagttgattctgtacctggtaaaacctagaacacacttgtgatgtcacctcttggat

SEQ ID NO: 6853 - DNA, 251 bp, Mus musculus
  misc_feature (68)..(68): n is a, c, g, or t
  misc_feature (72)..(73): n is a, c, g, or t
  misc_feature (75)..(86): n is a, c, g, or t
  misc_feature (88)..(88): n is a, c, g, or t
  misc_feature (90)..(95): n is a, c, g, or t
  misc_feature (98)..(101): n is a, c, g, or t
  misc_feature (104)..(107): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (122)..(122): n is a, c, g, or t
  misc_feature (125)..(125): n is a, c, g, or t
  misc_feature (127)..(127): n is a, c, g, or t
  misc_feature (133)..(133): n is a, c, g, or t
  misc_feature (152)..(152): n is a, c, g, or t
  misc_feature (156)..(156): n is a, c, g, or t
  misc_feature (158)..(158): n is a, c, g, or t
  misc_feature (168)..(168): n is a, c, g, or t
  misc_feature (170)..(170): n is a, c, g, or t
  misc_feature (175)..(175): n is a, c, g, or t
  misc_feature (185)..(185): n is a, c, g, or t
tataatactctctcacctccatcatcatttaagatttctatcttcattattggaaagagacagcccantgannannnnnnnnnnnncngnnnnnnggnnnnggnnnntcctngntncntccnttnancacacnttccatttgctaaaccccnacantntcccccagantntagantcggaagcancctcattttgggttgtgttttgtttttgtataggagcccaggcagggctggtaacactttttaaat

SEQ ID NO: 6854 - DNA, 92 bp, Mus musculus
  misc_feature (35)..(36): n is a, c, g, or t
  misc_feature (39)..(40): n is a, c, g, or t
tccccgctacatgacatacaattgagccccagggnnttnngagtgaaagaacttcctgtgcttttgtaacttgttgccaccgcacaaaaata

SEQ ID NO: 6855 - DNA, 355 bp, Mus musculus
ggacctttgagtacacctcgggatagtgaggagcccggcgaaaagcacagactatggcgctgaaacggattaataaggaacttagtgatttggcccgtgaccctccagcacaatgttctgcaggtccagttggagatgacatgtttcattggcaagccacaattatgggacctaatgacagcccatatcaaggtggtgtattctttttgacaattcattttcctacagactaccccttcaaaccacctaaggttgcatttacaacaagaatttatcatccaaatattaacagtaatggcagcatttgtcttgatattctaagatcacagtggtctcctgctttaactatttctaa

SEQ ID NO: 6856 - DNA, 556 bp, Mus musculus
  misc_feature (29)..(29): n is a, c, g, or t
  misc_feature (36)..(37): n is a, c, g, or t
  misc_feature (399)..(399): n is a, c, g, or t
gtgttcatattgacattggagccgatggnagagcannaggcgaggcagatgtagagtttgtgacacatgaagatgcagtagctgccatgtctaaagataaaaacaacatgcaacatcgatacattgaactcttcttgaattctactcctggaggtggctctggaatgggaggttctggaatgggaggctatggcagagatggaatggataatcaaggaggatacgggtctgttgggagaatggggatggggaacagctacagcggaggctacggtgctcctgatggcttgggaggctatggtcgtggtggtggaggcagtggaggttactatgggcaaggtggaatgagtggaggtggatggcgtgggatgtactgacaacaccaccccaacgtacacntcctaacacacctgctctactagactttcttacagatttcatttcttttgtatttcaagaactttataacgactgaaggaatgtgttatattatttggtaaagcaacagactgcgatgggaaaatctgttttctgtaggttgtttcatttgttgcat

SEQ ID NO: 6857 - DNA, 214 bp, Mus musculus
  misc_feature (83)..(83): n is a, c, g, or t
cgaaggaaatattgccaccgagggcttggaatgttattccctgaagcacaacgcctcgaaagcactggaaggctgttacagtnggcagacattgatccaactctccggcccacccacctctcgctcatgcattttaagagtttgtgtgatgtatacagaaaaatgtgtgatgaagacccacaactctttacttataacttcagagaggagctca

SEQ ID NO: 6858 - DNA, 552 bp, Mus musculus
  misc_feature (31)..(31): n is a, c, g, or t
  misc_feature (92)..(92): n is a, c, g, or t
  misc_feature (161)..(161): n is a, c, g, or t
  misc_feature (181)..(181): n is a, c, g, or t
  misc_feature (244)..(244): n is a, c, g, or t
  misc_feature (287)..(287): n is a, c, g, or t
  misc_feature (320)..(321): n is a, c, g, or t
  misc_feature (338)..(338): n is a, c, g, or t
  misc_feature (342)..(342): n is a, c, g, or t
  misc_feature (344)..(348): n is a, c, g, or t
  misc_feature (352)..(353): n is a, c, g, or t
  misc_feature (374)..(374): n is a, c, g, or t
  misc_feature (382)..(382): n is a, c, g, or t
  misc_feature (441)..(441): n is a, c, g, or t
  misc_feature (443)..(443): n is a, c, g, or t
  misc_feature (477)..(477): n is a, c, g, or t
aggacagactgagactgggccccaggccccnaggagccctcgcaccaaggactcagggaagccgctacacatcaaaccacgcctgtgaggcncccctgaggaccagcccgcacctacctcagaccctcacccctggagaggatgaaggctctacccacaantgctcctgaggagaagcagnctgccactgagcccagctggggctctaaccaggagtcatagctcctcccacttggctcctagncctctggaggcctttgtgtgcccaggccttgttctccctcaanccaaggccctgtccattccctgttcctctcccnnccccttctcccctcctncccncnnnnncccnncctcccctccaaggcacccancctcactntaggacttgtccctggctccccatccatcagggtgccatgtgaggttcatcccagcctntntcctgtggtggcattggcagctgtaggactggtncccccaaccctccctacccaggactcctgcccagggaagaggctaatggccaggcctctctggtgggtattttat

SEQ ID NO: 6859 - DNA, 273 bp, Mus musculus
acattttcacaaagctcattgccaatcactgtccccccgaagcaataaaccgtgacagttgctttaaatgtttgtgggcaactgctttcatctgttcacatattttgaatagctacactaataactgttatttggtaaatatttaaaggaaaaaaaatagatctgtatattgatggtagaatgtcaagacaattcttttccaaacatgttcattttggtcactaatacaactgcgcaggcaaaacatcgaaacactgtgtcctttgtttaagg

SEQ ID NO: 6860 - DNA, 514 bp, Mus musculus
  misc_feature (59)..(59): n is a, c, g, or t
  misc_feature (113)..(113): n is a, c, g, or t
gctgtagatctttacttgctggagaattaatcattgtgtatacttgcatctgctgttancactcagtaaacatatctcccttgacttattttcaggaaaaaggtgaaggtttngaggaagaagaggtagctttcatctttgggaaaaatgaaggtatggctcccacagagttatttagctactccataggccagaactacctcatgatgcacttcactatttatagttctgccaaaatcaagagactgcattccacaagcatctcatagcttgtacttaatgccttcagatgaggtataaagggcccagcgggtcctttgtaagtccttgataaacttactgagtctttaacagtgaagacaagtatttggattcagtgaggagccactgtttagtgtcatgtttttattgaaacagtttattttctatgttttattttaacatatatagggcctcgtctcagaatcatttatttgaccactactggatacctatgttgtgtcaggcatgcttt

SEQ ID NO: 6861 - DNA, 343 bp, Mus musculus
  misc_feature (118)..(118): n is a, c, g, or t
  misc_feature (120)..(121): n is a, c, g, or t
  misc_feature (198)..(198): n is a, c, g, or t
  misc_feature (200)..(201): n is a, c, g, or t
  misc_feature (203)..(204): n is a, c, g, or t
  misc_feature (206)..(207): n is a, c, g, or t
  misc_feature (210)..(212): n is a, c, g, or t
  misc_feature (214)..(222): n is a, c, g, or t
  misc_feature (225)..(227): n is a, c, g, or t
  misc_feature (229)..(230): n is a, c, g, or t
  misc_feature (242)..(242): n is a, c, g, or t
  misc_feature (273)..(273): n is a, c, g, or t
  misc_feature (317)..(317): n is a, c, g, or t
gctgcattccagtatggcatcaagatgtctgaaggacggaaaaccagacgattcaaagaaaccaatgataaggcagagcttgatcgacagtggaagaaaataagtgcaatcattgagnannggaagaggatggaagcagatgggtaagcggcatccctctttgtctttgggcctggtgagaactgttcaggatactgntnntnngnngannnannnnnnnnntgnnntnngggtcgaagtgnaaaagaccaaagtactaatctctagttccanctgtcaccacgtggctgttcttagttgcttgcttctacaattcntcagacggttgcaaactgttgttgtt

SEQ ID NO: 6862 - DNA, 520 bp, Mus musculus
  misc_feature (93)..(97): n is a, c, g, or t
  misc_feature (99)..(103): n is a, c, g, or t
  misc_feature (105)..(105): n is a, c, g, or t
  misc_feature (108)..(108): n is a, c, g, or t
  misc_feature (111)..(112): n is a, c, g, or t
  misc_feature (123)..(123): n is a, c, g, or t
  misc_feature (152)..(152): n is a, c, g, or t
  misc_feature (284)..(284): n is a, c, g, or t
agaataagattgtttacccacctcaactgcctggcgaacctcggagaccagcggaaatttaccattgtcggagacaaataaaatacagcaagnnnnngnnnnngnacntgnnaaagatgatancgaggcatgtccattgatcaggctttggncgcagctggagttcaatgataaaaagggggctcaaatcattaaagaggttctcttagaagcacaagacatggcagtgagagaccataatgtggaattcagatccaacttacacatagctgagtctacctcangccgaggccagtgcctgaagcgcatccgttaccatggccgaggtcgctttggcattatggagaaggtctattgccactattttgtaaagctggtggaaggaccccctcccccacccgaagtacccaagacagcagttgaccacgccaaggactatattcagcagcttcgcagccggaccatcatccatactctatgagatctgtgcaggtcatcctggctccacggtgtatatagc

SEQ ID NO: 6863 - DNA, 342 bp, Mus musculus
ttagcttagggcatgggcatttcatgaatctcagtctctacgtttgtcattgctcacacaatcacattgttgcacagatcctgattcagaccaagctgtgtttatgctcatagaagcctcagtgttatgtttccctggagctttggattgattctaccgtgtttatgttaaatgtgtgcattgatttttctctgctagtatatttctgtaaaaataatggtcttggaaaatgatggccaaaaatgatagtcttggaaaatggtggctttccattaacatgtattttaacagtcatgtattttcatttgtgttactttgttttggaggtgcacttatgccagt

SEQ ID NO: 6864 - DNA, 505 bp, Mus musculus
  misc_feature (56)..(56): n is a, c, g, or t
  misc_feature (92)..(92): n is a, c, g, or t
  misc_feature (96)..(98): n is a, c, g, or t
  misc_feature (102)..(102): n is a, c, g, or t
  misc_feature (104)..(105): n is a, c, g, or t
  misc_feature (108)..(108): n is a, c, g, or t
  misc_feature (137)..(137): n is a, c, g, or t
  misc_feature (145)..(145): n is a, c, g, or t
  misc_feature (173)..(173): n is a, c, g, or t
  misc_feature (184)..(184): n is a, c, g, or t
  misc_feature (198)..(198): n is a, c, g, or t
  misc_feature (206)..(206): n is a, c, g, or t
  misc_feature (216)..(216): n is a, c, g, or t
  misc_feature (301)..(301): n is a, c, g, or t
gagcatcgagaactacggccagagcagcttcctgcagtctccgctaccatagagcncgggcccagggcgccgccggcgggtgggggacgttnccannncggnannggncgagagtgtgtcgaagggagggcgaggcnggagcccnaaaagcgaccgggagaaggagcgggtancgggcccaggncggggcgcagagcngggcagcncaggtgcccngtgctccagccagcttgcctcctcactttcctgggcattcctccgagatctcctgcctctcaacctttgctagtgctattctctngtgcctgggacgatacctttgactcatcttcgactgacctaatggagagagcttgggctttggaggcagagagacctgggttcggattttggcttcacagcttattatttggacaagtcctttggaaaagtatttaacattctggagccccagcttcctaacctgtaaaaatggagatgataacacctaccttgcagggttgtt

SEQ ID NO: 6865 - DNA, 580 bp, Mus musculus
  misc_feature (135)..(135): n is a, c, g, or t
  misc_feature (474)..(474): n is a, c, g, or t
  misc_feature (499)..(499): n is a, c, g, or t
ttattgccactgacgtggcctcaaggggcctggacatccccaccgtgcaggtggtcatcaaccacaacacccctgggcttcccaagatctacatccatcgggttggccgcacagcccgtgcagggaggcaggggnaagccatcacactggtgacgcagtatgatatccacctgttgcatgccatcgaggagcagatcaagcagcagctggcagagctggtggtggaggaggctgaggttctacaaatcctcacgcaggtcaacgtagtgcgaagggagtgcgaaataaaactggaggcttcgcattttgatgaaaagaaagagatcaacaagcggaaacagatgatcctggaggggaaggacccagacctggaggccaaacgcaaagctgagctggccaagatcaagcaacaaaaccgacgcttcaaggagaaagtggggcagacacttcggcggcagaaagcagggagcactntccgacggtcgcgtcctcccagatntcggccccaagagccagcccaggctgaggctcaggactgagctgtaaacctggtgctggtggcccctgacttcagtaaaca

SEQ ID NO: 6866 - DNA, 275 bp, Mus musculus
  misc_feature (90)..(90): n is a, c, g, or t
  misc_feature (100)..(106): n is a, c, g, or t
  misc_feature (111)..(111): n is a, c, g, or t
  misc_feature (115)..(116): n is a, c, g, or t
  misc_feature (121)..(121): n is a, c, g, or t
  misc_feature (132)..(132): n is a, c, g, or t
  misc_feature (147)..(147): n is a, c, g, or t
  misc_feature (204)..(204): n is a, c, g, or t
  misc_feature (245)..(245): n is a, c, g, or t
tttgaaacaggcagtgatatgcactatatgtccaacatttccatgcaagatgtgaaagaacccttctgcacaatccatcagtgttacacnggtcaagatnnnnnnngcccnctcnncccanctctgaaaaanacattagtttttccngaatagaccatgttctatactagactttttatattgcccataaatatgactctgtgnccagtttattaagtctaacaaagcaggcaaagaaacaagancctgtcaaacctgtggtgttaataagatag

SEQ ID NO: 6867 - DNA, 354 bp, Mus musculus
  misc_feature (90)..(90): n is a, c, g, or t
  misc_feature (100)..(106): n is a, c, g, or t
  misc_feature (111)..(111): n is a, c, g, or t
  misc_feature (115)..(116): n is a, c, g, or t
  misc_feature (121)..(121): n is a, c, g, or t
  misc_feature (132)..(132): n is a, c, g, or t
  misc_feature (147)..(147): n is a, c, g, or t
  misc_feature (204)..(204): n is a, c, g, or t
  misc_feature (245)..(245): n is a, c, g, or t
tttgaaacaggcagtgatatgcactatatgtccaacatttccatgcaagatgtgaaagaacccttctgcacaatccatcagtgttacacnggtcaagatnnnnnnngcccnctcnncccanctctgaaaaanacattagtttttccngaatagaccatgttctatactagactttttatattgcccataaatatgactctgtgnccagtttattaagtctaacaaagcaggcaaagaaacaagancctgtcaaacctgtggtgttaataagatagaataagatgtttacagtgcttgggctccactatggggcaggcagaatggacaagacagacctgggcttgagaaagtagt

SEQ ID NO: 6868 - DNA, 104 bp, Mus musculus
cgactgtgcccttatgtgccagaaacttcggtttcgtccacgtcaaccttatcagaaaaagtctactaatgacatcgatgacagagaataattttgtacttatt

SEQ ID NO: 6869 - DNA, 403 bp, Mus musculus
  misc_feature (357)..(357): n is a, c, g, or t
tttatcactgtaaccacaactccttccctagcagttctagtccactaggtgatagtattcttcctggggtcctctggcttccctactctcttgtcttcccgtttgacagtgctaggaaccatacccaggaccttgtatacttgacacatgctttatcttcagttcatacgtctttagccacacctataatcctttgtttgcgttgttttctccttactgtagagttcaactgactggattgtaagaatctgttaatgtgagctatcttgactgttggatcatatatgcttgaggatggggtgaaagctgatgttgtatgtaggttaataggggagaaggcatactggagaagacagnctataacttaggagaggaaacaagcttacttttggctctgttactg

SEQ ID NO: 6870 - DNA, 448 bp, Mus musculus
  misc_feature (342)..(342): n is a, c, g, or t
  misc_feature (399)..(399): n is a, c, g, or t
tgaacctcacgccactgcaatagtggtcattggccggctctagagatgagacttgtagcattattttgcacagcagctcatggtggctggagtcttccctctccatggtatgggttcagcattgagacacatgaaggaagttttgaaaatctccccgatgatgatggtcattcagtaaatgctaacttttatatccctccagcattaacaataagagttttggaaactgttctacaggaagccagcatggctgtgatatggtggggtgctgttttgggcctttctggctatacagtctgttatagtatttggggaaagtagctgctactgggtggtaactgnttgctaactgttgctctccacttggctcagaacaatttcctttgtttcagaggaatntcctggaactcagcacttgacacacattctccctcctaaagttttacag

SEQ ID NO: 6871 - DNA, 442 bp, Mus musculus
  misc_feature (51)..(51): n is a, c, g, or t
tgcacctgctgtgtctgtctactaaccacctgtgcagagtagccaggtgcnagtctcggcaacaccagcttctcagcatggtgagaatgctagaaagtgggaatgtaatgagcctgtagttgttacgaagatttgcccctaagagtagttacccttttatctgtcattttatcagtgaaatgtggattttgtttgtattttcccactggaaggaaatttctaacctcacagtggagctgaagttggttcagctccacactttagggccacagctgtactcctgttttacagaatttgtgcttacatcccagttccatgctagtaaaaagcagtgtgagaaacctttccttggctttgcccaactgagtccacatcctaactgggacctctgaagaaaagggaaaaacattaaaaccccattctgtcttgttccaaagctcta

SEQ ID NO: 6872 - DNA, 498 bp, Mus musculus
tgtggaactctttctgtcattctgaggacccctacaaccttttaaattttaaggctccttttcaaccgtcagggaagaattggaaaggccgtcaggactcaaaggcctcttctgaggctacagtggccttctctggccatcataccttactttcttgtaaggcccagctgttagagagccaagaagataattgtccaggctgtgggctgggtgaggctcttgctggagaaagatacacccatatcaagagaaaaaaggtaaccttcctggaagaagttactgagtattatataagtggtgatgaggatcgcaaaggaccatgggaagaatttgcaagggatggatgcaggttccagaaacgaattcaagaaacagaagttgccattggctactgcttggcctttgagcacagagaaaaaatgtttaatagactgaggatcgagtcaaaggacttactgttgtacagcaatgttaagaagtgaacagcctgcaacccgt

SEQ ID NO: 6873 - DNA, 165 bp, Mus musculus
cagtagtggtgttcaggtttttccaggaattaccagcctcagattcagcgtttaaagctgttcctgtatccaacatagcacctgcagcagttggccgggaaagacactcctgtgatgcactgaaccgctggttgggtgaacagttgaaacagttggtgcctcagt

SEQ ID NO: 6874 - DNA, 51 bp, Mus musculus
gtgaacaaatagaccctgaaaatctccacttcaaccctgatgaaggaggtg

SEQ ID NO: 6875 - DNA, 449 bp, Mus musculus
  misc_feature (337)..(337): n is a, c, g, or t
tcagccgcccctgaggaaggaatgagtagtgacagcgacattgaatgtgacactgagaacgaggagcaggaagaacacaccagcatgggcgcgttcaacgatccgttcctggctcagccccccgatgaagattcacattccagttttcctgatggtgaacaaatagaccctgaaaatctccacttcaaccctgatgaaggaggtggaagactgcttgttcttggaacccagcagccatactgtgaggaagtccaaaccagccaacctggagagacggcatgcacagggtcccacggatatgagctgaggcccctggccccagctaacagccaccatnagctgtctgacgtgtaagtgcacagggcttcagacaacaccagtcttcagcctgaggctcccaatcccatggaacagaaatgggaacgtgctgctccagtctgaaatcctga

SEQ ID NO: 6876 - DNA, 199 bp, Mus musculus
  misc_feature (39)..(39): n is a, c, g, or t
  misc_feature (80)..(80): n is a, c, g, or t
tcctgggtagaatcatcttggaggatgggtccagtcctntatgatttgtaaaggaaagagtcaccttacctgtgaatgtnccatccacctcataaatatccatttttaaaacaagctacttaaaatccacaacagaggactccctgtgccgctatccccccttgggacaatccacttcaatctgtttggctggcttgct

SEQ ID NO: 6877 - DNA, 293 bp, Mus musculus
  misc_feature (76)..(76): n is a, c, g, or t
  misc_feature (134)..(134): n is a, c, g, or t
  misc_feature (175)..(175): n is a, c, g, or t
cctgcaagatgctgcgcgcccgcgggtgcctcgggtgcctcgggtgcctcgctatgggggccagagcttgaccatnatcaggttttgctagagcatcctgggtagaatcatcttggaggatgggtccagtcctntatgatttgtaaaggaaagagtcaccttacctgtgaatgtnccatccacctcataaatatccatttttaaaacaagctacttaaaatccacaacagaggactccctgtgccgctatccccccttgggacaatccacttcaatctgtttggctggcttgc

SEQ ID NO: 6878 - DNA, 109 bp, Mus musculus
  misc_feature (35)..(35): n is a, c, g, or t
  misc_feature (61)..(61): n is a, c, g, or t
ccagttcaccttaccaaagactctatccattgaantcaactgtgctgttttaacaggggtntctctggggctggacatcatactataataaagcagagctgtgacatca

SEQ ID NO: 6879 - DNA, 216 bp, Mus musculus
  misc_feature (53)..(53): n is a, c, g, or t
  misc_feature (105)..(105): n is a, c, g, or t
  misc_feature (115)..(115): n is a, c, g, or t
  misc_feature (153)..(153): n is a, c, g, or t
cgtgcagctcgccttaagacatttccttgcaaacgattcaaagagggtacctntcaactaggggaccagtgctgttattcacacagtcctgcagctcctgtggcntctggtgatntccccatcgaagaatgtccagagactaccaccaagatntcccctggaccaaaggctgctgctgggggtattcctgggccaggtgtagactgagacaataaa

SEQ ID NO: 6880 - DNA, 416 bp, Mus musculus
  misc_feature (47)..(47): n is a, c, g, or t
  misc_feature (256)..(256): n is a, c, g, or t
agcggcgcgcgcacaagagcaagaaggcggcggctgctgccagcgcnaagaaagtgaagaaggcggccaaacccagcgtgcccaaggtgcccaagggccgcaagtgacgcccctacggtctggcgacatcgtcgagttttccatctgtctctatccctatccgccccccccaccctcggtgtaccggttccgtagggttccgcctggcccaggtccctgatccctgtcccctcccccgcccctcccccagcgatgntgcgttctgtttgctttaggtttttgaaacggccctggcgacgcccccattggctctcacccttggcaacggccgtcgccatggttaccggcccggcggcgccaatggcctggtggcgcctgcctactgtgcccgctgatggccaccaggcgcttgggtt

SEQ ID NO: 6881 - DNA, 73 bp, Mus musculus
aggaatatggcgtccgctactcgcgttatccaaaagctgcggaactgggcgtctgggcaagacctgcaggcga

SEQ ID NO: 6882 - DNA, 129 bp, Mus musculus
acacccgcatcctgtctatatagagcagtcaagatcctttcttggatccgaatttttgtggggtatctatccacagactgtctctctttccccttgctttgtttggactaaggcagaacttatctttat

SEQ ID NO: 6883 - DNA, 61 bp, Mus musculus
tttgcctgcagcttttacttaaccctgtagtttctggacgtttgtgcagtattgaaaagac

SEQ ID NO: 6884 - DNA, 305 bp, Mus musculus
  misc_feature (45)..(45): n is a, c, g, or t
  misc_feature (52)..(52): n is a, c, g, or t
tgtctcttctctgttgcaggctgcctcaggccggccccccacggnctcgctntgcccccgccttttctcctatttcctgtactctatctgactccccatcccggatttgttacagcagggggctcttgaaccaatgtgaggtttgttttgtccctaaatcaccaccactcactatttctcccagggtctgataatgcctttacctccatgtccaggatgtagccctaaggtgagggaacacagtgaaatgatacgttagtcccgtcttccagctgctggtaccatgtgacaaccatagctccttg

SEQ ID NO: 6885 - DNA, 101 bp, Mus musculus
ccagagcaatacgttccttattccaccactagaaagaagattcatgaatgggttccacctttgacaccttacaagtgaccgcagtgaagactgttcctgca

SEQ ID NO: 6886 - DNA, 499 bp, Mus musculus
  misc_feature (254)..(254): n is a, c, g, or t
  misc_feature (257)..(257): n is a, c, g, or t
  misc_feature (261)..(261): n is a, c, g, or t
  misc_feature (267)..(267): n is a, c, g, or t
  misc_feature (289)..(289): n is a, c, g, or t
  misc_feature (311)..(311): n is a, c, g, or t
  misc_feature (341)..(341): n is a, c, g, or t
  misc_feature (344)..(344): n is a, c, g, or t
  misc_feature (347)..(347): n is a, c, g, or t
  misc_feature (353)..(354): n is a, c, g, or t
  misc_feature (366)..(366): n is a, c, g, or t
  misc_feature (384)..(385): n is a, c, g, or t
  misc_feature (392)..(392): n is a, c, g, or t
  misc_feature (395)..(395): n is a, c, g, or t
  misc_feature (409)..(409): n is a, c, g, or t
catcgaggttggtgcatttgaagctatggccatgaagggccttgctcagaagtgatccatctcagtggagcacacgagagggcataaagaataaagaggaaaatccctctgcttgtccaaaattcagtgacatcttccagaagaaaaacaagagctgcaggacagggtgagcacaaaaaatgctttgtttgccctcaaataatacatgattcacgttgaactgtgaaggaaggcaaaaggggagaaactattgngantgangtcccngtgtcaccagtgagggccaggnaactcgccacaggtctctgccnaactgaaagacttgaggtaacctggatttnctnttnccatannttgctgaaagangtaaaggacacaaatttnntgatgantcngtatgaacagaacntgagcacccggaagtagagaggaacatgaagaaaagaagctttgtgaccttgaagaatccatggaggttagcctaaattccaaaagctgt

SEQ ID NO: 6887 - DNA, 197 bp, Mus musculus
  misc_feature (52)..(52): n is a, c, g, or t
  misc_feature (72)..(72): n is a, c, g, or t
  misc_feature (105)..(105): n is a, c, g, or t
  misc_feature (111)..(111): n is a, c, g, or t
  misc_feature (160)..(160): n is a, c, g, or t
  misc_feature (162)..(162): n is a, c, g, or t
tcaggaccggtttgaagtgaatgtagctgagcttccagaggaaatagatatntccacatacattgagcaganccggtaaccgtatgtgtagccagggcaacatgnccactntctttcccacctgctgcttcagaacctctttctaggtgacaaatcgatntntctttttattgttccaaagctttagtgatgtaaga

SEQ ID NO: 6888 - DNA, 506 bp, Mus musculus
  misc_feature (263)..(264): n is a, c, g, or t
  misc_feature (288)..(288): n is a, c, g, or t
  misc_feature (320)..(320): n is a, c, g, or t
  misc_feature (322)..(322): n is a, c, g, or t
  misc_feature (324)..(324): n is a, c, g, or t
  misc_feature (331)..(331): n is a, c, g, or t
  misc_feature (334)..(334): n is a, c, g, or t
  misc_feature (353)..(355): n is a, c, g, or t
  misc_feature (457)..(457): n is a, c, g, or t
atggcagcgtcagtgacggactcctggattggatttggctatgttttctttttcacaatggggctttaaaaatgagctggaagagtcttgacaccatcaccagaggtttttcccagctccccctacccccaccatgatctacactgcctggcacacagacactgaatctgtgtgcctagaaatttgtcccagtgtgtaatgtacagagtcccttccttttggtggggagtcttgtgatactgtggctaggcccctgctctgcnngtctttgctgcagaactgcccctnccttgacttgcaagatttgacgtttattcagncnanaaagtgntcnaaatggttactgtgtgatnnnttgtttcccaaggttcgaaaagtcagtgaaactttctaagattttgcatgatgtattttattttatttttattttttagaaagttattgttggcaaataatntctttttataccaggaaatagttctgaatgacgttgaagacctaccctt

SEQ ID NO: 6889 - DNA, 360 bp, Mus musculus
  misc_feature (204)..(204): n is a, c, g, or t
  misc_feature (212)..(212): n is a, c, g, or t
  misc_feature (225)..(225): n is a, c, g, or t
  misc_feature (231)..(231): n is a, c, g, or t
  misc_feature (240)..(241): n is a, c, g, or t
  misc_feature (245)..(245): n is a, c, g, or t
  misc_feature (250)..(250): n is a, c, g, or t
  misc_feature (256)..(256): n is a, c, g, or t
  misc_feature (262)..(262): n is a, c, g, or t
  misc_feature (268)..(268): n is a, c, g, or t
  misc_feature (273)..(273): n is a, c, g, or t
  misc_feature (282)..(282): n is a, c, g, or t
  misc_feature (329)..(329): n is a, c, g, or t
ttgaaagccagatgaagcagctcttactaaggagtaagatcagcgaggaggaaaggcaggcgctgtgggatctcattagggaatattcagatatcgaggatgtcgaggatgtggagggtgactttgaaatgcttagaaaactgacataggaagcctctgcttcccagacgaacatctggatcggcgatggagatgctgcttctnatcatctntcccactggagcntcagtntggaacgtnntccntcctnggcttnttgatngatgtntcctnccaggtgantccttccactttatatgtgtatacatatactttatatgcagttcatnttttattctgtaactttgaactggacaaaac

SEQ ID NO: 6890 - DNA, 545 bp, Mus musculus
  misc_feature (452)..(452): n is a, c, g, or t
  misc_feature (456)..(458): n is a, c, g, or t
  misc_feature (461)..(461): n is a, c, g, or t
agcatccaggcttctgaggtttctgtaccgcaagcaaattccagtgaaagcccagggggtccatcgagcgaaagcattcctcaaactgccacacagccagccatttctccaccaccaaagcctacagtctccagagttgtctcctcaacacgactggtaaacccatcgcctagaccttcaggaaacacagcaacaaaagtccctaatcctatagtaggagtcaagagaacgtcctcacccaataaagaagaaagtcctaagaaaaccaaaacagaagaggatgaaacaagtgaagatgctaactgtcttgctttgagtggacatgataaaacagagacaaaggaacaagttgatctggagacaagtgcggttcaatcagaaactgttccggcatcggcttctctgttggcctctcagaaaacatccagtacagacctttctgatatccctgntctnnnccntgcaaatcctattcctgttatcaagaattcaataaaactgagactgaatcggtaaaaccacctcagggtccataaacagtatct

SEQ ID NO: 6891 - DNA, 50 bp, Mus musculus
ccacctgcaagatggacgcgagccacaagctgcactgtgaaacccgggca

SEQ ID NO: 6892 - DNA, 471 bp, Mus musculus
  misc_feature (26)..(26): n is a, c, g, or t
  misc_feature (279)..(279): n is a, c, g, or t
  misc_feature (301)..(301): n is a, c, g, or t
  misc_feature (310)..(310): n is a, c, g, or t
  misc_feature (313)..(313): n is a, c, g, or t
  misc_feature (438)..(438): n is a, c, g, or t
  misc_feature (446)..(446): n is a, c, g, or t
caaacaagttgtgtattttccaggcncaaaacaagaaactccattttaatcctcaggccaggcttacatagtgcagtgcgttgttctccctccctttcctgctttgtgtctttgcatgcatacagtggagggctgtatttgatgttcgctactaccatagcatctgtgagctttatcaaactagtttatttgacttatgtcctacctgctatctccaatttgttgttttcatattttagtggataatttagtttaaaatacccagagattgggaacatncaaccgtgtaacgtgatttttntagtaagtntcnctcagaaggaagttatagtatttctgtttgtattaatttgtaagttaaaactttggttagtaagagaaaaaaaatcccaataaataagctataactcttatgtagttagagataatgctaccatnataaactncccagactgtggaggtactctgtat

SEQ ID NO: 6893 - DNA, 138 bp, Mus musculus
  misc_feature (27)..(27): n is a, c, g, or t
  misc_feature (45)..(45): n is a, c, g, or t
  misc_feature (50)..(50): n is a, c, g, or t
  misc_feature (61)..(61): n is a, c, g, or t
  misc_feature (66)..(66): n is a, c, g, or t
  misc_feature (98)..(98): n is a, c, g, or t
  misc_feature (100)..(100): n is a, c, g, or t
catcatcaagaacgcgcacaagaaggnccagtgagggtgcagggntcttntcattccaagnccccntccctgcatgggcgagctgatgacctctagcntnttagagttacctgtgttaggaaataaaacctttcagat

SEQ ID NO: 6894 - DNA, 74 bp, Mus musculus
ttgggaatcccatgaatttcccctgcaggagaaatcatttaacttttcaaccctatcagtagtaccgtattttg

SEQ ID NO: 6895 - DNA, 220 bp, Mus musculus
  misc_feature (26)..(26): n is a, c, g, or t
  misc_feature (81)..(81): n is a, c, g, or t
  misc_feature (87)..(87): n is a, c, g, or t
  misc_feature (157)..(157): n is a, c, g, or t
  misc_feature (192)..(192): n is a, c, g, or t
cgaggaaagaaatacgattccgattntgatgatgactagactgtgctgtactttaaaaccttccgtctgtctgtctgtctntctgtntacttcagagttaagtgtgttttctaaattcctaaattccactgatttcggcccattgaccatctgacantcttatcccagcctgtacactgtttgaccattttntctgcagtcattgtgtataacttgagag

SEQ ID NO: 6896 - DNA, 185 bp, Mus musculus
  misc_feature (110)..(110): n is a, c, g, or t
  misc_feature (123)..(123): n is a, c, g, or t
  misc_feature (149)..(149): n is a, c, g, or t
cctgtccttctgtagaggctgttgagactgagatcctgtgggacagtcagttggtccgtgtccaaatccccgcttaccactgatgttttagctgatggtgactggcatantcccaattccctntctctccaagtaggtggtgttagaantcttaattcttttcccttcttttgtatggactacaa

SEQ ID NO: 6897 - DNA, 440 bp, Mus musculus
  misc_feature (226)..(226): n is a, c, g, or t
  misc_feature (238)..(238): n is a, c, g, or t
  misc_feature (256)..(258): n is a, c, g, or t
  misc_feature (289)..(289): n is a, c, g, or t
  misc_feature (351)..(351): n is a, c, g, or t
  misc_feature (397)..(397): n is a, c, g, or t
  misc_feature (415)..(415): n is a, c, g, or t
aacaagccttgcctagaaattggtatcaaatattttatataaagaaatgcttgtgtgtatatgccatatttattaataattgtaactaaagtcactgacctatagacagtaccaggttaaatattgggatatgtatgggcaatcagaaatgttactttaaatgccatctgcctattttgaggccatgtttggcactttttagactagggtaagtctgataataccnggtggggttttntctttttttttttttttnnntctgaactctcaaagtttgttactggaaatnatttgcatggtaggagagattgaattatttattttttatatgtagaaaaatctctctaaccnacaaatagctcattgttactgatttgtttgttttcctaacttattntcctggacagaacggtancaaagttttgttcagctgaataaat

SEQ ID NO: 6898 - DNA, 95 bp, Mus musculus
  misc_feature (53)..(53): n is a, c, g, or t
  misc_feature (63)..(63): n is a, c, g, or t
  misc_feature (65)..(65): n is a, c, g, or t
aaacaaatcttgttgctgatttgtccatttctttccctgcactttgttacatntgggatacantnctaactcatctgacttaatatgcatttaaa

SEQ ID NO: 6899 - DNA, 102 bp, Mus musculus
  misc_feature (33)..(34): n is a, c, g, or t
  misc_feature (42)..(42): n is a, c, g, or t
  misc_feature (44)..(44): n is a, c, g, or t
tgcgtgagaattttaccagacttcaagagcatnntcgccacntncttgaaaaatgccaccttccgatgaaaaacaggagcctgctaaggaacaatgccacct

SEQ ID NO: 6900 - DNA, 114 bp, Mus musculus
  misc_feature (34)..(34): n is a, c, g, or t
  misc_feature (75)..(75): n is a, c, g, or t
caattgtatacatctcacgaaaccatttcccttntcaaagatgtaatttgtaaacctcaaatagttgtgtatctntcctgttacaagtagatgacttcgattaaacaaatttat

SEQ ID NO: 6901 - DNA, 333 bp, Mus musculus
  misc_feature (99)..(99): n is a, c, g, or t
  misc_feature (132)..(132): n is a, c, g, or t
  misc_feature (260)..(260): n is a, c, g, or t
gggagggtgtcctgatcattttcgatgaacccccagtagataaaacttatgaagctgctctgggtgtcctgatcattttcgatgaacccccagtagatnaaacttatgaagctgctctggaaactattcagnacatgagtaaagtagtggactccctctacagcaaagccaagaagctgacatagagttggatctgtagcggtcctttggagagtgtgtgtggcgggagagtgaacccttggggaaatgctaggagattnttttctttctgttccacttttcgctcggaaagtttttaaccctcattggtgcatctgtatccagcgataggcg

SEQ ID NO: 6902 - DNA, 398 bp, Mus musculus
  misc_feature (28)..(28): n is a, c, g, or t
  misc_feature (32)..(32): n is a, c, g, or t
  misc_feature (36)..(37): n is a, c, g, or t
  misc_feature (47)..(60): n is a, c, g, or t
  misc_feature (62)..(62): n is a, c, g, or t
  misc_feature (68)..(68): n is a, c, g, or t
  misc_feature (145)..(147): n is a, c, g, or t
  misc_feature (149)..(155): n is a, c, g, or t
  misc_feature (157)..(165): n is a, c, g, or t
  misc_feature (168)..(168): n is a, c, g, or t
  misc_feature (170)..(172): n is a, c, g, or t
  misc_feature (174)..(176): n is a, c, g, or t
  misc_feature (178)..(181): n is a, c, g, or t
  misc_feature (183)..(186): n is a, c, g, or t
  misc_feature (192)..(192): n is a, c, g, or t
  misc_feature (196)..(197): n is a, c, g, or t
  misc_feature (232)..(233): n is a, c, g, or t
  misc_feature (235)..(235): n is a, c, g, or t
  misc_feature (257)..(257): n is a, c, g, or t
  misc_feature (262)..(262): n is a, c, g, or t
  misc_feature (264)..(264): n is a, c, g, or t
  misc_feature (323)..(323): n is a, c, g, or t
  misc_feature (361)..(361): n is a, c, g, or t
ccctgtggtcaagagctaaaggattgantgcntctnnttgcgcatgnnnnnnnnnnnnnngntggtgnggagggggtggtgtggtgggtgggggtgggtggggtgggggtgtggggtggtgggtggggggtgtggtgtggggggnnngnnnnnnnannnnnnnnnttncnnnannnannnncnnnntttttngctnntcagaaagaggcagatttggcagcccaggcagaanntnccaagaagtgaccccaactttntacantntgagaatttgaagtgagaggctgagaaagggggccacagaggaagctgagccaaagganttcatggcaacccgatttctagtttcctgacatgtttntgtacatttgctgtgccaggggatcaagcctgaataa

SEQ ID NO: 6903 - DNA, 136 bp, Mus musculus
  misc_feature (29)..(29): n is a, c, g, or t
  misc_feature (58)..(58): n is a, c, g, or t
  misc_feature (65)..(65): n is a, c, g, or t
  misc_feature (68)..(69): n is a, c, g, or t
  misc_feature (72)..(72): n is a, c, g, or t
  misc_feature (103)..(103): n is a, c, g, or t
  misc_feature (106)..(106): n is a, c, g, or t
  misc_feature (109)..(109): n is a, c, g, or t
aagctggcatttccaagtcgagcagaaantccttacggacccggcagcactagctgtntcctgcnttnnttntgggctgaccctcacagtccatttaggactnccngtncctcctttgttatttgttcttaacacg

SEQ ID NO: 6904 - DNA, 163 bp, Mus musculus
  misc_feature (27)..(27): n is a, c, g, or t
  misc_feature (30)..(30): n is a, c, g, or t
  misc_feature (51)..(51): n is a, c, g, or t
  misc_feature (86)..(86): n is a, c, g, or t
  misc_feature (88)..(89): n is a, c, g, or t
  misc_feature (96)..(96): n is a, c, g, or t
  misc_feature (119)..(119): n is a, c, g, or t
  misc_feature (121)..(121): n is a, c, g, or t
tctagcagagagagactgaacactctnatncagcttaccagatccttgatncctgtgcctatgtgtttggtaacaacaaactgacntnnatagagnccctggattgaagatggagactntncccactcctcctgccactgactggttaggactctgtataaat

SEQ ID NO: 6905 - DNA, 141 bp, Mus musculus
  misc_feature (40)..(40): n is a, c, g, or t
  misc_feature (43)..(43): n is a, c, g, or t
  misc_feature (48)..(48): n is a, c, g, or t
  misc_feature (73)..(73): n is a, c, g, or t
tgtgtggctggatattcttagattccacccgtaaggtttntantcatntttgaggagctatgcatcattaatntccaggctagctgctttttttcctaccctatttatgacagtaactactaactctagatggtacagtta

SEQ ID NO: 6906 - DNA, 62 bp, Mus musculus
tcaggacatggcttgttagcttgggctaatgggagagggctttgtaccagtgagtatttttt

SEQ ID NO: 6907 - DNA, 495 bp, Mus musculus
  misc_feature (48)..(48): n is a, c, g, or t
  misc_feature (103)..(103): n is a, c, g, or t
agaatcttacacttagctccacttccaactgtcccacagtttctccantgcattcttgtgatcttgggtgagtcacaccacagagcaagggtaccttgatcangaccaggtggccaagcacctccagaagcgggatgcagtctctgaagagcaatgttctgcatgtggcctgatgtctgcctgcatttacaagttctctggcattatcccccacacaccagatgggacaggcatctgtatttaaactttattacaaaattataaagcagagctctgtaacaaaaaaatacacatttgggtatgcttttaacacccaggtgagaaaatcttaatgtaagccacttggagctacacatttacatccgagagatctcaacaaatttgtacaacatagactattaattcctttacagcttattagtttagaaccggctatttccaacctatgaaacagcatctttgaaaactaagtctcaactgaaatcttggtgcaat

SEQ ID NO: 6908 - DNA, 476 bp, Mus musculus
  misc_feature (167)..(169): n is a, c, g, or t
  misc_feature (384)..(384): n is a, c, g, or t
atcttgctgtggatcttggtcactttcctgctgccggatgttattttactgactgttactctaagtagcaaaggttcatcgctattgagacactacagaactccttcatattatgcatagctgattgccattttattctagcatgaacctttttttttttttttttnnngctgtatactaaacagaaaacactggaggcatgtatgttggactgtattacagagttaaagctaactttaaactatgtaaccttttatgactcaatgtgccttattgtgtattgctgtgatatagcaaaatatgcttagaaattaaaacatacatttgaagcttggttatgatattatttttcttataatatcatatgtatttttttaaaatttncctttcagggactaaaaaaattgaaaaaaaataaagttgaaaattttattagaccatctgaatttgtatttcaggaggtatttgcattcagt

SEQ ID NO: 6909 - DNA, 394 bp, Mus musculus
  misc_feature (326)..(326): n is a, c, g, or t
  misc_feature (332)..(332): n is a, c, g, or t
  misc_feature (368)..(368): n is a, c, g, or t
tgctactcattaaggcaagttcattatttaacataaaaaccagaataatcttttgaaatgaaaaaaaaagtactatttttattttaacagtatacttcttaagctcttattaccagctctagagaattttttggaataattatgcattccctaatgtgtgctttacaaactgtgtatcatcataacccagtagccgtgacagaaatctcttttctttgcacccccatcctcctctttttgtttctctctcgcccccactctctgtaatagtcactagcaggttgtgtttatagcaaccattggaaagaccgtcaataaaaacgacnaaaaancatttagttgttcagaaattgaaagttagagaactnggatttatttaactcagtgctgccag

SEQ ID NO: 6910 - DNA, 148 bp, Mus musculus
  misc_feature (59)..(59): n is a, c, g, or t
tgtttgctctcactagctagtctattctttcacttgcattagagcttacatacgggttntggcatctatcacctgagacatcctgcctcgtgaactgaacaactactggatttttggggattcttagaccttccactaataaacagcc

SEQ ID NO: 6911 - DNA, 258 bp, Mus musculus
  misc_feature (41)..(41): n is a, c, g, or t
  misc_feature (67)..(67): n is a, c, g, or t
  misc_feature (99)..(99): n is a, c, g, or t
  misc_feature (166)..(166): n is a, c, g, or t
atttaagctgaatatacctttgaggaatttttttcttaatntggattgcaccttctactggcaaccnatataaaggacatggaagaaagaagcttgccntctttgcctgtttgctctcactagctagtctattctttcacttgcattagagcttacatacgggttntggcatctatcacctgagacatcctgcctcgtgaactgaacaactactggatttttggggattcttagaccttccactaataaacagccatt

SEQ ID NO: 6912 - DNA, 121 bp, Mus musculus
  misc_feature (41)..(41): n is a, c, g, or t
  misc_feature (70)..(70): n is a, c, g, or t
tctggctgagatgcttgaagaccttcatatttctcaagatnccactggtgaagaaggtgcatcaatgatntcatgatgagtcatattatatgttgcttgcatatctgtgccctcaggaagt

SEQ ID NO: 6913 - DNA, 144 bp, Mus musculus
  misc_feature (41)..(41): n is a, c, g, or t
  misc_feature (54)..(54): n is a, c, g, or t
tgttaatttacccagattttcagtttgtactgcctggtatntctgtgtaagaanccaatttttgtgtatttgttacagtttcaagttatttatatttgatgttttgtaaactcaaacaacaaatatactgtacttatggaccaa

SEQ ID NO: 6914 - DNA, 129 bp, Mus musculus
  misc_feature (26)..(26): n is a, c, g, or t
  misc_feature (30)..(34): n is a, c, g, or t
  misc_feature (95)..(95): n is a, c, g, or t
atgttctattgaaaccagtgtaacancacnnnnnaagagctctaatgtgtaacacttcctctgaaatggatataaagatgtaaattttataacancactgtttattctgatgcattctgatgggtcagt

SEQ ID NO: 6915 - DNA, 67 bp, Mus musculus
ccagttcctgaacaaagggtgaattcctcacattccagcgctttcccatcatacaccttttcccttg

SEQ ID NO: 6916 - DNA, 553 bp, Mus musculus
  misc_feature (44)..(44): n is a, c, g, or t
  misc_feature (56)..(56): n is a, c, g, or t
  misc_feature (64)..(64): n is a, c, g, or t
  misc_feature (272)..(272): n is a, c, g, or t
  misc_feature (473)..(473): n is a, c, g, or t
  misc_feature (494)..(494): n is a, c, g, or t
  misc_feature (502)..(502): n is a, c, g, or t
  misc_feature (506)..(506): n is a, c, g, or t
  misc_feature (509)..(509): n is a, c, g, or t
  misc_feature (512)..(512): n is a, c, g, or t
gagtcggccagaactgacgattctcagccccacttccgaaaacnacaagaagcttntcaacgantctgtttaagaataatgcaaaccgcgctgagaacacagagcgaaagcaaaatcagaactacttcatggaggtgatgactgtggacggagtctatgattacctgatgtatgtagggcgagtagtttttcaagtcccagactggcttcatcatcttctaatgggaactcgaatcctctttaagaacaccctggaaatgtacacagactantacctccagtgcaagctggagcagctgtttcaggagcaccggctggtctccctcatcacccttctcagagatgctatattttgtgaaaatactgaacctcgctctctccaagataagcaaaaaggagcaaaacagacttttgaagaaatgatgaattacattccagatctgatagtcaagtgtatcggtgaagaaaccaantacgaaagcatcagactcctntttgatgncctncancanccagtgctcaacaagcagctgacctatgtgttgctggacat

SEQ ID NO: 6917 - DNA, 276 bp, Mus musculus
gaagaagcctggagatttatctgatgagctaaggatttccttaggaatgccagtaggacctaatgcccacaaagtccctcctccgtggctgattgccatgcagcgatacgggccacccccatcctacccaaacctgaaaatccctggactgaattcacctatccctgagagctgctcctttggataccatgctggtggctggggcaaacccccagtggatgagactgggaagccgctctatggggacgtgtttggaaccaatgctgctgagtttca

SEQ ID NO: 6918 - DNA, 82 bp, Mus musculus
tagtgatgggaaccattacaccagcatgtgcttggaaatcagatgtcacactttgaagggagaaccccaggagattgactat

SEQ ID NO: 6919 - DNA, 508 bp, Mus musculus
  misc_feature (40)..(40): n is a, c, g, or t
  misc_feature (43)..(45): n is a, c, g, or t
  misc_feature (185)..(185): n is a, c, g, or t
  misc_feature (221)..(221): n is a, c, g, or t
  misc_feature (233)..(233): n is a, c, g, or t
  misc_feature (255)..(256): n is a, c, g, or t
  misc_feature (274)..(274): n is a, c, g, or t
  misc_feature (290)..(290): n is a, c, g, or t
  misc_feature (295)..(295): n is a, c, g, or t
  misc_feature (310)..(310): n is a, c, g, or t
  misc_feature (324)..(324): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (394)..(395): n is a, c, g, or t
  misc_feature (397)..(397): n is a, c, g, or t
  misc_feature (406)..(406): n is a, c, g, or t
  misc_feature (431)..(431): n is a, c, g, or t
  misc_feature (464)..(464): n is a, c, g, or t
  misc_feature (478)..(478): n is a, c, g, or t
ccgcgtttgcggtttctcagttggttctgtccagcaacgnagnnncgaaatgccagttaaaagatcactgaaactggatgatcagtttgaaaaaaatattcatggtgttgctatctaaaattgagatatcatcagagaaaaccatggagataatgaaaaatctaagtagtatacaggctttgganggcaacagacaacttgaagatctcattggtgtttcnctagtaccatgntccttaaaaagtgaagcaaggnnaaccaaagaactaatganctaaagtaataaaacnaaagnttgtttgaaaagaanaaatcaagaattantcccaaagatcntcntncttgacagctttgaattccttaaagccattttgaactgagtgttaccttcaanntntgacaactntcaacctacctggatactagtcaanccgtaagaatgcagaccagcctgaagtaaagantcagtgaaagactntcacatttgcaacctttcttaaaagacgat

SEQ ID NO: 6920 - DNA, 563 bp, Mus musculus
  misc_feature (89)..(89): n is a, c, g, or t
  misc_feature (127)..(127): n is a, c, g, or t
  misc_feature (161)..(161): n is a, c, g, or t
  misc_feature (359)..(359): n is a, c, g, or t
tattcagcttttcactattgcaggaaaaatgcttttcattttaaattctttattgaattgatagggaggactcaattgtgttgttaagncaaagggatttattggaagttgatgagaagataaattnatctgtagtcgtaactggcctactgctaaagagntttataaggaaggaaaagtaattttttaaggagaaaaaattttggctttagacttaaattcagatgttttaaaggaaaaagatattcacagattcaatacctatccttataagagctgaattctatgtgatttcctcagtctttctcctctgtcagaatcttttttttttctttgaccataagtccacctgacagggncactctgagccagcactgctctggggccatcagatcaccaacagaagcaaatctctgacctctttgcctgcagcttttacttaaccctgtagtttctggacgtttgtgcagtattgaaaagacaggagaaaagaaaacaaacctggttataacctgatgctaaaactaaaaacaaggaaatgtacctctctcttcagaattaaa

SEQ ID NO: 6921 - DNA, 509 bp, Mus musculus
  misc_feature (237)..(240): n is a, c, g, or t
  misc_feature (243)..(243): n is a, c, g, or t
  misc_feature (245)..(245): n is a, c, g, or t
  misc_feature (251)..(251): n is a, c, g, or t
  misc_feature (254)..(254): n is a, c, g, or t
  misc_feature (256)..(256): n is a, c, g, or t
  misc_feature (258)..(258): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (276)..(276): n is a, c, g, or t
  misc_feature (288)..(288): n is a, c, g, or t
  misc_feature (293)..(293): n is a, c, g, or t
  misc_feature (295)..(295): n is a, c, g, or t
  misc_feature (300)..(300): n is a, c, g, or t
  misc_feature (308)..(308): n is a, c, g, or t
  misc_feature (321)..(321): n is a, c, g, or t
  misc_feature (323)..(325): n is a, c, g, or t
  misc_feature (327)..(329): n is a, c, g, or t
  misc_feature (334)..(336): n is a, c, g, or t
  misc_feature (342)..(342): n is a, c, g, or t
  misc_feature (346)..(347): n is a, c, g, or t
  misc_feature (358)..(358): n is a, c, g, or t
  misc_feature (360)..(361): n is a, c, g, or t
  misc_feature (365)..(365): n is a, c, g, or t
  misc_feature (367)..(368): n is a, c, g, or t
  misc_feature (396)..(396): n is a, c, g, or t
  misc_feature (399)..(399): n is a, c, g, or t
  misc_feature (402)..(402): n is a, c, g, or t
  misc_feature (427)..(428): n is a, c, g, or t
  misc_feature (458)..(458): n is a, c, g, or t
  misc_feature (462)..(462): n is a, c, g, or t
aaccctacactagagttcttggcctccccgctgaaggaaacccctggtctgggtaagctctccacgatttccccagcacccagcttcggttccactaaggagatcccatccaccagcgaggacgtcccaacgcccaacagaatcttgatccgtgtgatgtactgtggcctctgaagctatggccttcggtacattatactgaaaaggaccctggagcatcaattcccaaaccttctnnnnttngnggaggnaanancnacncngnttacaggggantttgaagtgttngtggntnggaanctgatccnttccaagaagaangnnnannnctttnnngatgantccnntctgaagaaantnntggntnntattgacgaagagatcaagaagaggtancancancaacggaggggacatgagtgaggtnntgtggagggccaggaggaagcatgcaagancctnagcaggatgatgagaagggctgaaatgctgccaaaccaggtcctttt

SEQ ID NO: 6922 - DNA, 520 bp, Mus musculus
  misc_feature (128)..(128): n is a, c, g, or t
  misc_feature (201)..(202): n is a, c, g, or t
  misc_feature (206)..(206): n is a, c, g, or t
  misc_feature (208)..(209): n is a, c, g, or t
  misc_feature (214)..(214): n is a, c, g, or t
  misc_feature (217)..(217): n is a, c, g, or t
  misc_feature (224)..(224): n is a, c, g, or t
  misc_feature (226)..(228): n is a, c, g, or t
  misc_feature (230)..(231): n is a, c, g, or t
  misc_feature (234)..(234): n is a, c, g, or t
  misc_feature (236)..(236): n is a, c, g, or t
  misc_feature (243)..(243): n is a, c, g, or t
  misc_feature (245)..(245): n is a, c, g, or t
  misc_feature (257)..(257): n is a, c, g, or t
  misc_feature (263)..(264): n is a, c, g, or t
  misc_feature (272)..(273): n is a, c, g, or t
  misc_feature (284)..(284): n is a, c, g, or t
  misc_feature (286)..(286): n is a, c, g, or t
  misc_feature (310)..(310): n is a, c, g, or t
  misc_feature (331)..(331): n is a, c, g, or t
  misc_feature (333)..(333): n is a, c, g, or t
  misc_feature (339)..(339): n is a, c, g, or t
  misc_feature (364)..(364): n is a, c, g, or t
  misc_feature (427)..(427): n is a, c, g, or t
  misc_feature (435)..(435): n is a, c, g, or t
  misc_feature (437)..(437): n is a, c, g, or t
  misc_feature (452)..(452): n is a, c, g, or t
  misc_feature (454)..(454): n is a, c, g, or t
gcaagtagtgactgtacagcactcaggtgacctctcttggcaactgatagttcagcactcacactattcagatctgctgtcaggatttcagatcataattaaggaactggtgggcaccggagaagacnctatgcaagaaattaagtctctggtggcgaagctgcagtacagggatgagaaaattgagtccatcagcacctnnctcntnnggggnttngaaaggntnnntnntcntntggaagngnactcaccggccngccttnntaaagagnntctccagaagntnggaaagaagcaaaagaatcaaganatacttcgtttttccccatcntntcatgntaggagactcacattaagcaggatntgcaaaatgttaaagaaacaatcaagaagccggaagaagaagcacaggccacgaacaataatntgaacatntnttcaaccaaactgtntntaaacagaaagttcgttatataaattatgctttatttttgaaatattactaaacactgtattggtg

SEQ ID NO: 6923 - DNA, 342 bp, Mus musculus
  misc_feature (93)..(93): n is a, c, g, or t
  misc_feature (102)..(102): n is a, c, g, or t
  misc_feature (124)..(124): n is a, c, g, or t
  misc_feature (132)..(132): n is a, c, g, or t
  misc_feature (146)..(146): n is a, c, g, or t
  misc_feature (158)..(158): n is a, c, g, or t
  misc_feature (165)..(165): n is a, c, g, or t
  misc_feature (182)..(182): n is a, c, g, or t
  misc_feature (184)..(184): n is a, c, g, or t
  misc_feature (186)..(186): n is a, c, g, or t
  misc_feature (200)..(201): n is a, c, g, or t
  misc_feature (211)..(211): n is a, c, g, or t
acataggcttccctggtagtaccagaccctttgactccagagtagagaggaaagctggagaggtggggagacacggctagggctcagggcaangagaggctnccctggtctagaagccccttgncccttccngtgtgtattctcancctcaggatgantactcantcctgtttgaagacacntntnatgcagatggctanntcccctcccntcaatgtggcccagaggtacgtggtggcttgtaaggagcccaagaaaaagtgaatcgggctggtaggcttgaatctgccactgccaacctcatgggagaaggctacaaaggagttcctatgatcaaataaa

SEQ ID NO: 6924 - DNA, 313 bp, Mus musculus
  misc_feature (26)..(28): n is a, c, g, or t
  misc_feature (30)..(30): n is a, c, g, or t
  misc_feature (49)..(49): n is a, c, g, or t
  misc_feature (52)..(54): n is a, c, g, or t
  misc_feature (69)..(69): n is a, c, g, or t
  misc_feature (71)..(71): n is a, c, g, or t
  misc_feature (74)..(74): n is a, c, g, or t
  misc_feature (76)..(77): n is a, c, g, or t
  misc_feature (85)..(85): n is a, c, g, or t
  misc_feature (87)..(87): n is a, c, g, or t
  misc_feature (89)..(90): n is a, c, g, or t
  misc_feature (92)..(93): n is a, c, g, or t
  misc_feature (97)..(97): n is a, c, g, or t
  misc_feature (99)..(99): n is a, c, g, or t
  misc_feature (108)..(108): n is a, c, g, or t
  misc_feature (112)..(112): n is a, c, g, or t
  misc_feature (118)..(118): n is a, c, g, or t
  misc_feature (120)..(124): n is a, c, g, or t
  misc_feature (129)..(129): n is a, c, g, or t
  misc_feature (132)..(133): n is a, c, g, or t
  misc_feature (137)..(137): n is a, c, g, or t
  misc_feature (139)..(139): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (151)..(151): n is a, c, g, or t
  misc_feature (166)..(166): n is a, c, g, or t
  misc_feature (168)..(168): n is a, c, g, or t
  misc_feature (176)..(176): n is a, c, g, or t
  misc_feature (178)..(178): n is a, c, g, or t
  misc_feature (188)..(188): n is a, c, g, or t
  misc_feature (193)..(193): n is a, c, g, or t
  misc_feature (195)..(195): n is a, c, g, or t
  misc_feature (243)..(243): n is a, c, g, or t
cattcagctttagacacccactgagnnncntcgattttgattcacgtcnatnnntttgtctcccttttntntantnncaattcanantnnannttanancacacaccnaccngggggntnnnnnaccanctnntttngncngncnggctgntttttgaaggacagncnaagacatnancagctccctntgctntnctgaggggtcaaggtttggggcccactttcctataggttgtttttttnttttttttttttaatttattttcccttttcccctcctgttgagatcaacagctttctgatctaaataaat

SEQ ID NO: 6925 - DNA, 203 bp, Mus musculus
  misc_feature (37)..(37): n is a, c, g, or t
  misc_feature (51)..(51): n is a, c, g, or t
  misc_feature (57)..(57): n is a, c, g, or t
  misc_feature (174)..(174): n is a, c, g, or t
ctgtgaggtgcgtgctctggaagagaggcggagcttntccgcttcctgctncctctncctgcagtaccaccctcggtctaagcactcatgattttatactttcagaaaaaagttttaagacttctttgggttttttgtttttgttttgaagcctaagaaagtcactagttcttncctttatgtatttatatgctgtacctaac

SEQ ID NO: 6926 - DNA, 221 bp, Mus musculus
  misc_feature (26)..(28): n is a, c, g, or t
  misc_feature (34)..(34): n is a, c, g, or t
  misc_feature (37)..(37): n is a, c, g, or t
  misc_feature (44)..(44): n is a, c, g, or t
  misc_feature (49)..(49): n is a, c, g, or t
  misc_feature (58)..(58): n is a, c, g, or t
  misc_feature (95)..(95): n is a, c, g, or t
  misc_feature (148)..(148): n is a, c, g, or t
gaaacctccatcccagtgaggaaggnnnatctgnccntggtttnttctntgccctttncctgcccccattcccaaggaacagaggagagcttggncccagagaagaagaatgagaacaagatgaaaatgtttaaccctaagggccctntcttcaggacttacatggaattttattttttacaagttccactttagccacagtttataaatgaacaggacat

SEQ ID NO: 6927 - DNA, 569 bp, Mus musculus
  misc_feature (324)..(324): n is a, c, g, or t
  misc_feature (332)..(332): n is a, c, g, or t
  misc_feature (335)..(335): n is a, c, g, or t
  misc_feature (337)..(337): n is a, c, g, or t
  misc_feature (360)..(360): n is a, c, g, or t
  misc_feature (387)..(387): n is a, c, g, or t
  misc_feature (413)..(413): n is a, c, g, or t
  misc_feature (421)..(421): n is a, c, g, or t
  misc_feature (442)..(442): n is a, c, g, or t
  misc_feature (472)..(472): n is a, c, g, or t
  misc_feature (495)..(495): n is a, c, g, or t
  misc_feature (541)..(541): n is a, c, g, or t
tttcgtgtccaccaaagcagagatgatttgcaatgggatcctccctatcgaccagatgagagaccacgttccacccgtatcactagtttgccagaatatcccacggcgagttttggaagtgacatatggtattaacattataaagcctagagaagatgaagacccctaccgacctccaacctcagaagaactgttgacggcttatggatgcatgagaggattcatgacagcacatgggcagccagaccagcctcgatctgcacggtacatcctaaaggactatgttggaggtaaactactgtattgccaccctcctcctggaanagaccctntgncngttccagcaccaacaccagcagntcctagagagcaaagtaaaaggtggangaactgagacttcagccgggcaaagnccgaaaanccaaacagatcgaaaatgtantcgacaaaacttttttccatcaggagaacntcagagcactgaccaaaggtgtnccaggctgtcatgggttacaagcccgggcatggcctggtgactgcnggctgctgcgagcgctgagaatgtacct

SEQ ID NO: 6928 - DNA, 232 bp, Mus musculus
  misc_feature (29)..(29): n is a, c, g, or t
  misc_feature (34)..(34): n is a, c, g, or t
  misc_feature (80)..(80): n is a, c, g, or t
  misc_feature (82)..(83): n is a, c, g, or t
  misc_feature (88)..(88): n is a, c, g, or t
  misc_feature (94)..(94): n is a, c, g, or t
  misc_feature (106)..(106): n is a, c, g, or t
  misc_feature (108)..(108): n is a, c, g, or t
  misc_feature (116)..(116): n is a, c, g, or t
  misc_feature (118)..(118): n is a, c, g, or t
  misc_feature (145)..(145): n is a, c, g, or t
  misc_feature (147)..(147): n is a, c, g, or t
aaagcatggactgtgccaaacacccagtnatccntccaaaaacaaggactgcatccaaattccaaataccagagactgantnnttcanccttgntaagggaacacntncgtttgantntgttgtgttgtgtacagggcttcattntnctgtacaagtctgtggttataaaattagtaaaacagcttacatttgtatttattttctagtccatacttctgtacccccattttt

SEQ ID NO: 6929 - DNA, 59 bp, Mus musculus
gaatgggaaacagcacatcgtcgttttgggggaagtctacaactactcctgtgaaccag

SEQ ID NO: 6930 - DNA, 534 bp, Mus musculus
  misc_feature (100)..(100): n is a, c, g, or t
  misc_feature (275)..(276): n is a, c, g, or t
  misc_feature (279)..(288): n is a, c, g, or t
  misc_feature (290)..(294): n is a, c, g, or t
  misc_feature (296)..(296): n is a, c, g, or t
  misc_feature (299)..(304): n is a, c, g, or t
  misc_feature (306)..(308): n is a, c, g, or t
  misc_feature (311)..(313): n is a, c, g, or t
  misc_feature (315)..(320): n is a, c, g, or t
  misc_feature (324)..(325): n is a, c, g, or t
  misc_feature (331)..(331): n is a, c, g, or t
  misc_feature (337)..(337): n is a, c, g, or t
  misc_feature (341)..(341): n is a, c, g, or t
  misc_feature (347)..(347): n is a, c, g, or t
  misc_feature (359)..(359): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (370)..(370): n is a, c, g, or t
  misc_feature (381)..(381): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (410)..(410): n is a, c, g, or t
  misc_feature (413)..(413): n is a, c, g, or t
  misc_feature (416)..(416): n is a, c, g, or t
  misc_feature (421)..(421): n is a, c, g, or t
  misc_feature (473)..(473): n is a, c, g, or t
  misc_feature (498)..(498): n is a, c, g, or t
gaatgggaaacagcacatcgtcgttttgggggaagtctacaactactcctgtgaaccagatccaaggaaacaatttctaacaagttgtgtgggtgatctntctcgaagaagacgatcctgccttcgttactgggttccaagtgggccccaaggaaaagcaatttttttccccaattggaaacaattggaagtggttccaaaactttaccaaagggcctttgatggggagctctggggaacttaattggcctgggggaaactaatgggcccaaccnnctnnnnnnnnnntnnnnntncannnnnntnnntgnnngnnnnnnaccnnttcccnggatantttntcaatngacgatttattngagncncancngacactcacangcttcacaaagaagggaaattnctncntntgnttnatcantgttatttaaaaaaaaaacaagaggaaagacattgaatgatgtggatattcnccataccagtaaatgctagttagtncattcgtacctttgacttgaggctgttttcagtgtg

SEQ ID NO: 6931 - DNA, 251 bp, Mus musculus
  misc_feature (35)..(35): n is a, c, g, or t
  misc_feature (38)..(38): n is a, c, g, or t
  misc_feature (58)..(58): n is a, c, g, or t
  misc_feature (63)..(63): n is a, c, g, or t
  misc_feature (65)..(65): n is a, c, g, or t
  misc_feature (70)..(70): n is a, c, g, or t
  misc_feature (76)..(76): n is a, c, g, or t
  misc_feature (162)..(162): n is a, c, g, or t
agtgttgtcctgagtaaggcgcgtttatttccagnaantggaagagaatgacgatgantcctntntgaantccccngtgggctgacaacacggctttgaaaagacattttcatggcgtaaaagacataaagtggcggcccaggtgaagccaacacttgactntcagaacctcaacccaccaaattcctaccttcctggttttcctttagtttgaatttttgaaataagtcattcacagttttagaacttaa

SEQ ID NO: 6932 - DNA, 536 bp, Mus musculus
  misc_feature (40)..(40): n is a, c, g, or t
  misc_feature (101)..(101): n is a, c, g, or t
  misc_feature (110)..(110): n is a, c, g, or t
  misc_feature (112)..(113): n is a, c, g, or t
  misc_feature (122)..(122): n is a, c, g, or t
  misc_feature (133)..(133): n is a, c, g, or t
  misc_feature (146)..(146): n is a, c, g, or t
  misc_feature (201)..(201): n is a, c, g, or t
  misc_feature (215)..(215): n is a, c, g, or t
  misc_feature (218)..(218): n is a, c, g, or t
  misc_feature (293)..(293): n is a, c, g, or t
  misc_feature (301)..(301): n is a, c, g, or t
  misc_feature (306)..(306): n is a, c, g, or t
  misc_feature (324)..(324): n is a, c, g, or t
  misc_feature (338)..(339): n is a, c, g, or t
  misc_feature (348)..(348): n is a, c, g, or t
  misc_feature (355)..(355): n is a, c, g, or t
  misc_feature (359)..(359): n is a, c, g, or t
  misc_feature (383)..(383): n is a, c, g, or t
  misc_feature (398)..(398): n is a, c, g, or t
  misc_feature (404)..(404): n is a, c, g, or t
  misc_feature (428)..(428): n is a, c, g, or t
  misc_feature (431)..(431): n is a, c, g, or t
  misc_feature (433)..(433): n is a, c, g, or t
  misc_feature (437)..(437): n is a, c, g, or t
  misc_feature (474)..(474): n is a, c, g, or t
  misc_feature (482)..(482): n is a, c, g, or t
gtacaccttaggtactctaaggaaggcaggggtgaagccnaggatgaaggatggcatttgggaatacataaataacagcccaggggttcaagagtagttanggttgaaantnnctgtttaangtgtacagttnctagttgctaaanttagcacggccaggaaatgcaatggcatttttattttcctgtgtactttaaatantcctttgttagtantcntcctcaatgaaatgtagtggcagccttgggagtcactagtcagtattcatgcttagtactgtgatgtagaggatntgaatggntccanataaatggtatcaggaanccatagaagaaatnntctatattntttaatncaancaggttttgaaaaaccatggatantgagtagagaattantttttnttatgatggggagtgtgaagatanccncngatntgatatttgaaactaaagagtacagagaaatagttcntcaacgantaggcattgatggaatttccatgtataatgacggaacagtaaactaatgtgtac

SEQ ID NO: 6933 - DNA, 348 bp, Mus musculus
  misc_feature (62)..(62): n is a, c, g, or t
  misc_feature (138)..(138): n is a, c, g, or t
  misc_feature (188)..(188): n is a, c, g, or t
  misc_feature (200)..(200): n is a, c, g, or t
  misc_feature (220)..(220): n is a, c, g, or t
  misc_feature (225)..(225): n is a, c, g, or t
  misc_feature (227)..(227): n is a, c, g, or t
  misc_feature (244)..(244): n is a, c, g, or t
  misc_feature (246)..(246): n is a, c, g, or t
  misc_feature (262)..(262): n is a, c, g, or t
  misc_feature (266)..(266): n is a, c, g, or t
  misc_feature (271)..(271): n is a, c, g, or t
  misc_feature (273)..(273): n is a, c, g, or t
  misc_feature (312)..(312): n is a, c, g, or t
  misc_feature (315)..(315): n is a, c, g, or t
  misc_feature (317)..(317): n is a, c, g, or t
  misc_feature (323)..(323): n is a, c, g, or t
ttatccctttaactccgctgcttttattatcaatctcaatgtaacctgatatttttatacanggattgttccttcagtatcttgtgtgattttaaaaaaagcaaaaacaaaaaccaaaagtcaagccaagtgcagccnccttaagatagctccatataccctgctactgtgattgttcaagcagaaantggagagaagcnactgagacagacaactgggnaactntnatcttttataaaccagnantaattcaagtgctttntctntcctntnctggtttgtgttttgattttaaatagggaatttcagatnctncntcctgnctgtatccaaacttgttgagtagta

SEQ ID NO: 6934 - DNA, 124 bp, Mus musculus
  misc_feature (26)..(27): n is a, c, g, or t
  misc_feature (39)..(39): n is a, c, g, or t
  misc_feature (47)..(47): n is a, c, g, or t
  misc_feature (88)..(88): n is a, c, g, or t
tgggaccctgacttcactgggatatnntcggggaggggncacttgtnccctccaggtttcttccaagatggctaagaacaaggacttnccagaaagttcatctgcacccatcagagtttaataa

SEQ ID NO: 6935 - DNA, 363 bp, Mus musculus
  misc_feature (96)..(96): n is a, c, g, or t
  misc_feature (113)..(113): n is a, c, g, or t
  misc_feature (147)..(147): n is a, c, g, or t
  misc_feature (151)..(151): n is a, c, g, or t
  misc_feature (156)..(156): n is a, c, g, or t
  misc_feature (177)..(177): n is a, c, g, or t
  misc_feature (183)..(183): n is a, c, g, or t
  misc_feature (185)..(185): n is a, c, g, or t
  misc_feature (216)..(216): n is a, c, g, or t
  misc_feature (225)..(225): n is a, c, g, or t
  misc_feature (248)..(248): n is a, c, g, or t
  misc_feature (271)..(271): n is a, c, g, or t
  misc_feature (276)..(276): n is a, c, g, or t
  misc_feature (281)..(281): n is a, c, g, or t
ggagcatgtccgcagcgacagctttaaaacaccaggcacagccttgctgaaaacccacagctttaattaggttactccagaaagggttgtctctgntagatagggaggtctgnccaatcgtgccaggagcggagctcagcctgtagnagtncctcntcttgatcctaccttttcagnccctcnanccatccatctatccatccctctgtcaccatnccttcctgnctccaggctggggggagggaganccaaaagtgggtccgatctgaantcttnccctntctcaaatgcctgggtagagggtagcacctttcagggaaagggttaagaaatgaaagactggaacggacataattttggtgt

SEQ ID NO: 6936 - DNA, 477 bp, Mus musculus
  misc_feature (330)..(330): n is a, c, g, or t
  misc_feature (337)..(337): n is a, c, g, or t
  misc_feature (350)..(350): n is a, c, g, or t
  misc_feature (438)..(438): n is a, c, g, or t
gtgctggctgtagagtgactcacgccccttctgaattgtggctttacagaaactcgagtgaaccctgttttgtcaacaaattgttcaaagctcttagtcaccaggacataaagtcttgtgtagttgggttatcaactcgtgaatgaagcctgtggcttacatagctaaaaatctgttcttcccttggagataagagcaataagaaagagatgatatgaaatcaaataatggaatatgggagtgagggagacacacagagtagtgctggaaattaagccaaaactggtaagctttaaaaggatcaagaaataaagtactttttctcattanttctatntaatgctgatacngactagtaatggtcatgaacatcaacttctaacccgtctaagacacttgttagattactttaaattagaccctaagtaatttaggatntcattcactcacagaaatgctatttgtgacactgtgtca

SEQ ID NO: 6937 - DNA, 250 bp, Mus musculus
  misc_feature (107)..(107): n is a, c, g, or t
  misc_feature (127)..(127): n is a, c, g, or t
  misc_feature (131)..(131): n is a, c, g, or t
aaacacagacttttatagatgtgactttattgtatcttaacagttaaatttggtcctcaaaatgtttgagcttttattatcccctttgctaaccaccgtttacactntaatttttaaaacaacacgntttngaaatcagttgtctgttatttagttctaaaacatgacacatcttgccttaacagtttcaaaaaccacacataaaactccatagtacagtaggccaagtttcatcctattgtcaagttta

SEQ ID NO: 6938 - DNA, 318 bp, Mus musculus
  misc_feature (67)..(67): n is a, c, g, or t
  misc_feature (81)..(81): n is a, c, g, or t
  misc_feature (142)..(142): n is a, c, g, or t
  misc_feature (156)..(156): n is a, c, g, or t
  misc_feature (214)..(214): n is a, c, g, or t
  misc_feature (237)..(237): n is a, c, g, or t
tacagcatgtctctctgttgtccgtcactgatacactggtagacatgctgtagagtgtttgcctagnttgacaaagctgcnttttgaatgctggtggttctgttcctttgacactacgcacttttataatatgtgttaatgnctctatgacaaatnctctgattcctagtgccaaaggttcacttcagtgtatataactgaacactcatccatnctgtgctcttttttttttttttnaatggtgcttaaagagcccatcctttgcaagtcatccatgtcattccttaggcatcttatctttgcatctttctgcatcaa

SEQ ID NO: 6939 - DNA, 299 bp, Mus musculus
  misc_feature (30)..(30): n is a, c, g, or t
  misc_feature (37)..(37): n is a, c, g, or t
  misc_feature (67)..(67): n is a, c, g, or t
  misc_feature (73)..(73): n is a, c, g, or t
  misc_feature (77)..(77): n is a, c, g, or t
  misc_feature (79)..(79): n is a, c, g, or t
  misc_feature (82)..(82): n is a, c, g, or t
  misc_feature (156)..(156): n is a, c, g, or t
  misc_feature (158)..(158): n is a, c, g, or t
  misc_feature (168)..(168): n is a, c, g, or t
  misc_feature (170)..(170): n is a, c, g, or t
  misc_feature (199)..(203): n is a, c, g, or t
  misc_feature (205)..(205): n is a, c, g, or t
  misc_feature (254)..(254): n is a, c, g, or t
  misc_feature (258)..(258): n is a, c, g, or t
ataagtatcgctgcgtggtgaagcctatgntcccatngaggagccccaggtgatagagaaggacctnccgtgntatntntangctagccctacaagtgtgtgcccctacaccgagcccccctgccctgtgacccctggagccttccaccccggcantncatgaaggtntngcctgaaaaccagcctgctggtggggcannnnncntgaggacctggcgtgcatccctgccggaggaaggtccagaggcctgtgncccntgggctcgagcttcaccctggctgccttgtgggaataaaat

SEQ ID NO: 6940 - DNA, 57 bp, Mus musculus
tcgctttacattgcttcctagtttacagcatgatgcaaatgattttctaacttagtg

SEQ ID NO: 6941 - DNA, 396 bp, Mus musculus
aatgtcacagccaggtgttgtctctgacactctgcttctgcccaacgtacaatagctccaaaaagtcgactttctcggatactcagtgtgtctctttctagaactgcacagagtgtatctatgtcaatatcagtaaacccctccgcactgattgcatccactgtgctcttgtctatggtgtccagacaaagactagccagctggggctcatcgaacaaccgcgcctgagtaagcaacataaaggcattatctgccctaagatgtttggtgagaaattctacgcaatgtgcttccaaggcagggactgcatatttcttagcagtataaagagtggtcataacggtttctggaccaatttgaacttcgtctgaatacaaaaatctcagcagcgccagg

SEQ ID NO: 6942 - DNA, 138 bp, Mus musculus
tgcccggatggcagcagtagttctagggggagacaccatgggccctgagcgtatcttccccaatcagactgaggacttagggccacatcagggtcctacagaaggaactggggattggagcagtgaagaacccgagga

SEQ ID NO: 6943 - DNA, 148 bp, Mus musculus
  misc_feature (29)..(29): n is a, c, g, or t
  misc_feature (66)..(66): n is a, c, g, or t
  misc_feature (93)..(93): n is a, c, g, or t
agacgtgggtgaaaggctgcactgaggantgctacgcacaaaaggaggtgggggtggacgagaatntccagacccaccccccaccctccactntccttccttctttccatcatgctgggtaaagctgctgtgtaatttaacttgtaaa

SEQ ID NO: 6944 - DNA, 211 bp, Mus musculus
  misc_feature (27)..(27): n is a, c, g, or t
  misc_feature (29)..(30): n is a, c, g, or t
  misc_feature (57)..(57): n is a, c, g, or t
  misc_feature (64)..(64): n is a, c, g, or t
  misc_feature (71)..(71): n is a, c, g, or t
  misc_feature (82)..(82): n is a, c, g, or t
  misc_feature (121)..(121): n is a, c, g, or t
  misc_feature (124)..(125): n is a, c, g, or t
  misc_feature (127)..(127): n is a, c, g, or t
  misc_feature (161)..(161): n is a, c, g, or t
  misc_feature (165)..(165): n is a, c, g, or t
aaggaactgaaagacaacggtgaattncnncctatactgaaaggagaaaattagtgnacataancatggtntccaaggactncaagaagtaactaattaccttggaacagttgatgatttngtnncntgagaagtggactaacagtagagatacaacacantcanccatgctcgatgcgcttcaaaaggtgtgctgaagaaacatgctacg

SEQ ID NO: 6945 - DNA, 546 bp, Mus musculus
gaacatctttttgctcattcctgagaacaggaagctaatactaattaaatattatccaaataagataaccagccaagcaggtggaaaattaaaagggtataaaattggaagaatattctagaaagaacctattcttcagtttgtcgatggtgacaggagcacatgtggcaagatagccttgtcacagattggaagttgtgacaatattatagagttttgacattggaaacagcacattcttctgtaataaaggctggactgtgataatttaccacttgaagaaatatgctgggttcaactctgttactcagtgaacatctgttttaaagaaaggcgtacaaatacagatcacatcaaacgctttcattgagaggttgacatggacgcttatacagtttatggtagatggtctcagaagctttcctgtgtatgagaaacagaactacaggcttttttgtataagttcctgtacatcttgtccatgctgttctcaaagacgggtcggtgggatttccctttacaagaggctgctctgttggaccagca

SEQ ID NO: 6946 - DNA, 358 bp, Mus musculus
  misc_feature (177)..(177): n is a, c, g, or t
tgcagcccagttctcagtgattgatagtgggtcatgggctcaggtccttatcccaggatcctctaagccttaggtgttgtggcaagagtctgtacagatatataactagaggtattcagctgagagggtcctggatcacctaggtgagctgggtatcactccagggagccctggagnaggaggcaggaggtgactggcaccatgtggatgtgagatgttgagaaagaagctgggagccggcagaggacaggcagtgggtccctcggaacctccagcagggactggctctgctgacagatacaccagagcccagccagacatgtttttatttctggcctccacaattgtgaaaagaaat

SEQ ID NO: 6947 - DNA, 75 bp, Mus musculus
  misc_feature (28)..(29): n is a, c, g, or t
  misc_feature (31)..(31): n is a, c, g, or t
  misc_feature (33)..(34): n is a, c, g, or t
tcataacctgagatttaagttgtgcagnntntnntctttacctactgcttggctgtaaaggtgtagcagtttcct

SEQ ID NO: 6948 - DNA, 48 bp, Mus musculus
aataaatgaccgcagcagtacttattaaccaacggaagtaggaagcat

SEQ ID NO: 6949 - DNA, 104 bp, Mus musculus
agcagtttcccagcagcacaacagacagtcttcaccatccaccttgtcatgttcagccgcatacaccaccccaccccacatgggcccacgtacctcagtacaag

SEQ ID NO: 6950 - DNA, 108 bp, Mus musculus
  misc_feature (58)..(58): n is a, c, g, or t
ttgctgaagtagacaagtgcttggcagatggtgcagatgaacacctgcagttgatgancctttgtgcaactgtgatgcagcagctaactcagaactgttagaggcttc

SEQ ID NO: 6951 - DNA, 250 bp, Mus musculus
  misc_feature (26)..(26): n is a, c, g, or t
  misc_feature (28)..(28): n is a, c, g, or t
  misc_feature (34)..(34): n is a, c, g, or t
  misc_feature (52)..(52): n is a, c, g, or t
  misc_feature (57)..(57): n is a, c, g, or t
  misc_feature (63)..(63): n is a, c, g, or t
  misc_feature (66)..(66): n is a, c, g, or t
  misc_feature (79)..(79): n is a, c, g, or t
  misc_feature (103)..(103): n is a, c, g, or t
  misc_feature (105)..(105): n is a, c, g, or t
  misc_feature (125)..(125): n is a, c, g, or t
  misc_feature (158)..(158): n is a, c, g, or t
  misc_feature (213)..(213): n is a, c, g, or t
  misc_feature (215)..(215): n is a, c, g, or t
ctgccaatcacttttctatccgatgnanatgatnccaaaatccttaatgatnttcangaccgnttngaagtgaatgtanctgagcttccagaggaaatagatntntccacatacattgagcaganccggtaaccgtatgtgtagccagggcaacatgnccactttctttcccacctgctgcttcagaacctctttctaggtgacaaatcgatntntctttttattgttccaaagctttagtgatgtaaga

SEQ ID NO: 6952 - DNA, 171 bp, Mus musculus
  misc_feature (27)..(27): n is a, c, g, or t
  misc_feature (29)..(29): n is a, c, g, or t
  misc_feature (50)..(51): n is a, c, g, or t
  misc_feature (76)..(76): n is a, c, g, or t
  misc_feature (131)..(131): n is a, c, g, or t
gggacccaccaggataaaccaagtgantntttatccactcacaccctttnngtgaccctacatttccatgcacagntcagaagctgcaccaatgagaattcttcaggcgatgtagaaatgactgtggattntaatacacaccgaaattctgactgagaatttaaattgcag

SEQ ID NO: 6953 - DNA, 134 bp, Mus musculus
  misc_feature (28)..(28): n is a, c, g, or t
  misc_feature (31)..(31): n is a, c, g, or t
  misc_feature (95)..(95): n is a, c, g, or t
  misc_feature (98)..(98): n is a, c, g, or t
tgcacagtaactgatgtaacttgggctncantctgtaatccaccttttcagctataagtaggggacatgttaaaaaaaaaaaaaaaaaaaaaaangantttgctggagaagatcatggcccagacctgagcttt

SEQ ID NO: 6954 - DNA, 415 bp, Mus musculus
agtcagatgtttggaactgtttcccctggcataaagtgtactggagtcattcgctactggaggtgcgggaggagggagagtggagcctctgctctgctctgtgctcctctcccagccccacctctgccctcgggaccaggcactcagaaggaggaggtcccagacttgattgtagaaatggggactgaagggattgtgggcaggatgtgatcaaaggggccatttctcacttttctttcctcatcctcactgcccctcaagctaggtggatttttctcttgttgacaaagagtatttggtagggaaagcaggttaaaaataaagacagcccttccctgccctttgtgtccccttcctggtgacagcaagaaaccatcaacaccaacaagtttccacgttccttttacagcaaaag

SEQ ID NO: 6955 - DNA, 249 bp, Mus musculus
ggcaaagcctttcatccaacttatgaagaaaaactgaagttcgtggcactgcataagcaagttcttttgggcccatataacccagacacgtcccctgaggttggattctttgatgtgttggggaatgataggaggagagaatgggcagctctgggaaacatgtccaaggaggatgccatggtagagtttgtgaagcttctaaataagtgttgtcctctcctctcggcatatgttgcgtcccacagaata

SEQ ID NO: 6956 - DNA, 109 bp, Mus musculus
  misc_feature (50)..(50): n is a, c, g, or t
gctgtactttagaaagtggtgtttcatacgtatgctttgctttttgattnaaatgttcagttttactagaactagtgatggtttttcatcaacctttatgcacaaaaaa

SEQ ID NO: 6957 - DNA, 401 bp, Mus musculus
  misc_feature (70)..(70): n is a, c, g, or t
  misc_feature (191)..(191): n is a, c, g, or t
  misc_feature (294)..(294): n is a, c, g, or t
  misc_feature (320)..(320): n is a, c, g, or t
tcgccagctttatgagatggtccttacatacagctttcatcagcccaagagcggagaagtaacacctagnttgtccactcctttgtgaattgttatatgagtcagaatttgacagtcagttgtggattattttcgaccagaacaaaagacagatgggctcaggcgatgcctatccacatcagtattctctnaaattggagaaaggagattatacaattcgattacagattcgtcatgagcaaatcagtgatttggatcgtctcaaagatcttccgtttattgtttcacataggnttgtctaataccttgagcttagatanttcatgaaaatcatagccttgcacttctaggaaagaagaaatcaagcagcttaacattaccacccaaatacaatcagccat

SEQ ID NO: 6958 - DNA, 298 bp, Mus musculus
  misc_feature (59)..(59): n is a, c, g, or t
  misc_feature (64)..(64): n is a, c, g, or t
  misc_feature (67)..(67): n is a, c, g, or t
  misc_feature (124)..(124): n is a, c, g, or t
  misc_feature (141)..(141): n is a, c, g, or t
  misc_feature (149)..(149): n is a, c, g, or t
  misc_feature (160)..(160): n is a, c, g, or t
  misc_feature (178)..(178): n is a, c, g, or t
  misc_feature (202)..(202): n is a, c, g, or t
  misc_feature (204)..(204): n is a, c, g, or t
  misc_feature (268)..(268): n is a, c, g, or t
ggaggaggtcccactgccgcagactccccagtacactgacacctttaatgatacatctntccantgnttcccactattgaagctggaaggactgcctggggacctgtgggcatcccaggaagancctgactaccaggactntgaggacntggagatcatnaggaaagctacagatcgntcagctggagtaacaggacagttntntccacctgggccaggagccacggtgcacaccacaccagatcctttgcccggccaggaatacagnccgactggggacactgagtcacatcctgcc

SEQ ID NO: 6959 - DNA, 68 bp, Mus musculus
  misc_feature (27)..(27): n is a, c, g, or t
ctgcacttgtgaggccacgtgtgatgntcacaagagcctagtgaacctggctagaatgctgattggat

SEQ ID NO: 6960 - DNA, 132 bp, Mus musculus
  misc_feature (41)..(41): n is a, c, g, or t
  misc_feature (80)..(80): n is a, c, g, or t
acgcttctaattcatgtacctgcacatgtgacctttgtgancagaaatttgcatgtataatctgtgtttacttgtaactntctggttatatactgcttatatctgtggattcaagttactgaagtgaatacc

SEQ ID NO: 6961 - DNA, 266 bp, Mus musculus
  misc_feature (28)..(28): n is a, c, g, or t
  misc_feature (41)..(42): n is a, c, g, or t
  misc_feature (45)..(45): n is a, c, g, or t
  misc_feature (48)..(48): n is a, c, g, or t
  misc_feature (53)..(53): n is a, c, g, or t
  misc_feature (56)..(57): n is a, c, g, or t
  misc_feature (66)..(70): n is a, c, g, or t
  misc_feature (72)..(73): n is a, c, g, or t
  misc_feature (75)..(75): n is a, c, g, or t
  misc_feature (78)..(79): n is a, c, g, or t
  misc_feature (82)..(82): n is a, c, g, or t
  misc_feature (85)..(86): n is a, c, g, or t
  misc_feature (95)..(95): n is a, c, g, or t
  misc_feature (106)..(106): n is a, c, g, or t
  misc_feature (109)..(110): n is a, c, g, or t
  misc_feature (122)..(122): n is a, c, g, or t
  misc_feature (129)..(129): n is a, c, g, or t
  misc_feature (137)..(138): n is a, c, g, or t
  misc_feature (140)..(140): n is a, c, g, or t
  misc_feature (157)..(157): n is a, c, g, or t
  misc_feature (162)..(162): n is a, c, g, or t
  misc_feature (192)..(192): n is a, c, g, or t
  misc_feature (194)..(194): n is a, c, g, or t
  misc_feature (197)..(197): n is a, c, g, or t
caccatatagcgcattatactcattccntggagacctctcnntgnggnagtgnacnnagaccacannnnntnntnccnntantcnnaccccaggncacaagggatnctnntcctgattcctntccatcnaaattggnntntccttaccatttccgtnccccntacagtgagagacaagatgtccatccatgntnttntactgcattttcccttcccttgcagattgtgagatgtaatgaaaagtattgctatttcccagaaataaa

SEQ ID NO: 6962 - DNA, 43 bp, Mus musculus
ctgttgtgctgttctgttgtgatcaaccctcttttaaaaacat

SEQ ID NO: 6963 - DNA, 297 bp, Mus musculus
  misc_feature (38)..(38): n is a, c, g, or t
  misc_feature (40)..(40): n is a, c, g, or t
  misc_feature (43)..(43): n is a, c, g, or t
  misc_feature (46)..(46): n is a, c, g, or t
  misc_feature (49)..(49): n is a, c, g, or t
  misc_feature (51)..(54): n is a, c, g, or t
  misc_feature (59)..(59): n is a, c, g, or t
  misc_feature (61)..(62): n is a, c, g, or t
  misc_feature (64)..(64): n is a, c, g, or t
  misc_feature (73)..(73): n is a, c, g, or t
  misc_feature (78)..(78): n is a, c, g, or t
  misc_feature (80)..(80): n is a, c, g, or t
  misc_feature (89)..(89): n is a, c, g, or t
  misc_feature (94)..(94): n is a, c, g, or t
  misc_feature (96)..(96): n is a, c, g, or t
  misc_feature (100)..(100): n is a, c, g, or t
  misc_feature (104)..(104): n is a, c, g, or t
  misc_feature (111)..(112): n is a, c, g, or t
  misc_feature (114)..(114): n is a, c, g, or t
  misc_feature (118)..(119): n is a, c, g, or t
  misc_feature (123)..(123): n is a, c, g, or t
  misc_feature (131)..(131): n is a, c, g, or t
  misc_feature (137)..(137): n is a, c, g, or t
  misc_feature (149)..(149): n is a, c, g, or t
  misc_feature (160)..(160): n is a, c, g, or t
  misc_feature (172)..(172): n is a, c, g, or t
  misc_feature (204)..(204): n is a, c, g, or t
  misc_feature (209)..(209): n is a, c, g, or t
  misc_feature (227)..(227): n is a, c, g, or t
  misc_feature (229)..(229): n is a, c, g, or t
  misc_feature (254)..(254): n is a, c, g, or t
accaccagcagtcatgggtgtctttctagcgcactatncntgntgncancnnnnatgantnntnaacagtgtnatccntnccccagacncctcncncatncacncagatcnntntggnntagnacatttcntgaacntttgcaagattnacagtcctgcntaggttagtggntcctttgatggcaaaggtcagctggaacttgnctttnaggtggcaggcccatgcnantggccacctcctccaccagtgaccncgacagaagggactggtagcttgaacttggaccctccagtaca

SEQ ID NO: 6964 - DNA, 361 bp, Mus musculus
  misc_feature (104)..(104): n is a, c, g, or t
  misc_feature (118)..(118): n is a, c, g, or t
  misc_feature (141)..(141): n is a, c, g, or t
  misc_feature (166)..(166): n is a, c, g, or t
caaagcctgcaccaggtgtggctgtgtcaccatgctgaagtctcccaacaagacaaccgctgtgacacagtgggaacagcggtggatcaagaattgcctgtgtnggtgggctgtggcnggcgagtgcctctcagctgttcntgagccacagcccaccagcctgcgntatgtacaaccagtctctgaacattgacattgctgtgctcactgaggcacaagtacccaccaatggcccctgggtctgccccttctagggacatgcggcatctctagggcctgaagtcccatggtcatatccaagccagtgtgaaggagctgggctgtgtattcatcctttaaaagatccacagtggccgggcgt

SEQ ID NO: 6965 - DNA, 455 bp, Mus musculus
  misc_feature (190)..(190): n is a, c, g, or t
  misc_feature (205)..(205): n is a, c, g, or t
  misc_feature (234)..(234): n is a, c, g, or t
  misc_feature (239)..(239): n is a, c, g, or t
  misc_feature (241)..(241): n is a, c, g, or t
  misc_feature (255)..(255): n is a, c, g, or t
  misc_feature (286)..(286): n is a, c, g, or t
  misc_feature (292)..(292): n is a, c, g, or t
  misc_feature (298)..(298): n is a, c, g, or t
  misc_feature (301)..(301): n is a, c, g, or t
  misc_feature (305)..(305): n is a, c, g, or t
  misc_feature (351)..(351): n is a, c, g, or t
  misc_feature (356)..(356): n is a, c, g, or t
  misc_feature (358)..(358): n is a, c, g, or t
  misc_feature (371)..(371): n is a, c, g, or t
  misc_feature (380)..(380): n is a, c, g, or t
  misc_feature (385)..(385): n is a, c, g, or t
  misc_feature (390)..(390): n is a, c, g, or t
  misc_feature (395)..(395): n is a, c, g, or t
atcaacatcagtgctatccctgacactgaggatcagtttcttctctgttactatagcaacaacctgcactctgtagtggggataagtcaacccttcaaggtaaggggttgctgttgggagagggggaaggtgactctgaaggatctggaagcacactgcctgtggacttgtgtggtgggtggggcattangaaagtagagaaganctctgttcacatcttctgctacatgttcnacccntncagatcccgattcnctcctttttgagagaggacacactgtatgancctganccacanatntgancccagatggaagtgaatgaatccagggcggaggctagagctggaanccagntntgcttcagcactnccagcagcnctggntctgncccancccctgaggaggctcctgactatcctccagctccccacctcccagaggagctcagctaga

SEQ ID NO: 6966 - DNA, 475 bp, Mus musculus
  misc_feature (313)..(313): n is a, c, g, or t
  misc_feature (382)..(382): n is a, c, g, or t
aggcagggtcttctgttttgtctcttcattctccaggtctgcacactttaactacttctgttttggcctcctgtctcactaggaaccctgggatgcaggtgtgtagcacactgtgggctctgagaattgaactcaggtcgtcaggcttgcagagcaagggcttttacccactgaacatctttctaggccctccttaaattttaagaaaaaaatctctccctgaacgtggagctcactgcttcagggccacctatctaccccagcagcaccaagatgcacacatgtgctgcactgcaccagcttttattatatnccgtcctcatgcctgcatgtcaggcactttacccatggagctgtttccctagctcctgaaaagattttntgaagcactgttctataattatattttaatgtgtttttattttgagtaatgtggaaagctgaccttatgttacctatctggatttaccaccca

SEQ ID NO: 6967 - DNA, 258 bp, Mus musculus
  misc_feature (36)..(36): n is a, c, g, or t
  misc_feature (52)..(52): n is a, c, g, or t
  misc_feature (55)..(55): n is a, c, g, or t
  misc_feature (60)..(60): n is a, c, g, or t
  misc_feature (71)..(72): n is a, c, g, or t
  misc_feature (74)..(74): n is a, c, g, or t
  misc_feature (76)..(76): n is a, c, g, or t
  misc_feature (83)..(83): n is a, c, g, or t
  misc_feature (88)..(88): n is a, c, g, or t
  misc_feature (145)..(146): n is a, c, g, or t
  misc_feature (163)..(163): n is a, c, g, or t
  misc_feature (166)..(166): n is a, c, g, or t
  misc_feature (168)..(168): n is a, c, g, or t
  misc_feature (176)..(176): n is a, c, g, or t
  misc_feature (192)..(192): n is a, c, g, or t
  misc_feature (233)..(233): n is a, c, g, or t
tcaaaactaaggaaacgggacgatgaatctacttcncaattaccaatcccanttntgatncggcaatgagnntntncccctgntgttnttcaaacaacacggggcaggagcatgaggacatcagagggggactgccaaagagatnntgaagttagaccaaaanccnanagatcctntcagagtgggtaaatnccattcgtgacgaaattcggaatgtatatgttggctgtttntccccaacatctcaataacattttg

SEQ ID NO: 6968 - DNA, 133 bp, Mus musculus
  misc_feature (64)..(64): n is a, c, g, or t
tcatttcctactatatcagaagacttcaacaatgtggaagagggctaagggaagccagcagtgnccgccattcaagagcaacacacagttcagttgtatcagtttaattggagcagtgttcaattaaaagtac

SEQ ID NO: 6969 - DNA, 164 bp, Mus musculus
  misc_feature (29)..(30): n is a, c, g, or t
  misc_feature (32)..(32): n is a, c, g, or t
  misc_feature (63)..(63): n is a, c, g, or t
  misc_feature (65)..(66): n is a, c, g, or t
  misc_feature (80)..(81): n is a, c, g, or t
  misc_feature (85)..(86): n is a, c, g, or t
  misc_feature (103)..(103): n is a, c, g, or t
  misc_feature (105)..(105): n is a, c, g, or t
  misc_feature (138)..(139): n is a, c, g, or t
agatcaggtggctgcgtaggtatcaagtnntntaaagaacagtgctgctgtggagagagaccntnnttaagccccttgcnnttcnnagtggggtaggcaaaantncacctgagctgccgagtgtgttgatcctccttnntcaagtacaaataaaaaggcattgc

SEQ ID NO: 6970 - DNA, 126 bp, Mus musculus
  misc_feature (29)..(29): n is a, c, g, or t
  misc_feature (36)..(37): n is a, c, g, or t
  misc_feature (42)..(42): n is a, c, g, or t
  misc_feature (46)..(47): n is a, c, g, or t
  misc_feature (96)..(96): n is a, c, g, or t
tgtgggcaagggtgtgccaagacagggtnccttatnnctttngttnntagtgcattccaaggtgtttcagggcttcagcacctggaatcccatatntcaaagccagtattaaatcaagtttatgca

SEQ ID NO: 6971 - DNA, 126 bp, Mus musculus
  misc_feature (26)..(26): n is a, c, g, or t
  misc_feature (34)..(34): n is a, c, g, or t
  misc_feature (38)..(38): n is a, c, g, or t
  misc_feature (40)..(40): n is a, c, g, or t
  misc_feature (43)..(44): n is a, c, g, or t
  misc_feature (70)..(70): n is a, c, g, or t
  misc_feature (84)..(84): n is a, c, g, or t
accgatcataggaccacagaccatgncccccagncccntncanntctctaactgagcacccatatgcctntgagtgtggggctnccatgctcgagaaacagtatgtgctactgattgaaaacaaat

SEQ ID NO: 6972 - DNA, 493 bp, Mus musculus
gctgcctcctgtgtagccgggagtttggtaaggcgttgcagctgacccggcaccagcgttttgtgcaccggctagagcggcgccataagtgcagcatttgtggcaagatgttcaagaagaagtctcatgtgcggaaccatctgcgtacacacactggggagcggcccttcccctgccctgactgctctaagcctttcaactcaccagccaacctggcccgccaccggctcacacacacgggggagcggccctaccggtgtggggactgcggcaaggccttcacgcagagctccactctgaggcagcatcgcctggtgcatgcccagcacttcccctaccgctgccaggagtgcggagtccgttttcaccgcccttatcgcctgctcatgcaccgctaccaccacacaggcgagtacccctacaagtgccgtgagtgcccccgttccttcttgctacgccggctgctagaggtccaccagcttgtgatccatgc

SEQ ID NO: 6973 - DNA, 143 bp, Mus musculus
tattggaaaatgcagtgccattttaaaactttgctaagaattttccagagacttcttttaaagctccttttgcccataaacattttcgcagtacattgctttaatgcccacatttccatattgtgaggcagtgctttatgtgt

SEQ ID NO: 6974 - DNA, 122 bp, Mus musculus
  misc_feature (50)..(50): n is a, c, g, or t
  misc_feature (72)..(72): n is a, c, g, or t
aatggtacaccgatatttaagaaggaacgtgaatccatgcagttgagatntaaagaatcactaagcctcaanccttatgtttcccaatgttatgctcgcttgcctagctttatgaattgctt

SEQ ID NO: 6975 - DNA, 342 bp, Mus musculus
  misc_feature (32)..(34): n is a, c, g, or t
  misc_feature (36)..(37): n is a, c, g, or t
  misc_feature (39)..(39): n is a, c, g, or t
  misc_feature (42)..(47): n is a, c, g, or t
  misc_feature (49)..(49): n is a, c, g, or t
  misc_feature (51)..(51): n is a, c, g, or t
  misc_feature (53)..(54): n is a, c, g, or t
  misc_feature (56)..(57): n is a, c, g, or t
  misc_feature (68)..(68): n is a, c, g, or t
  misc_feature (84)..(84): n is a, c, g, or t
  misc_feature (110)..(110): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (123)..(123): n is a, c, g, or t
  misc_feature (137)..(137): n is a, c, g, or t
  misc_feature (142)..(142): n is a, c, g, or t
  misc_feature (153)..(153): n is a, c, g, or t
  misc_feature (155)..(161): n is a, c, g, or t
  misc_feature (163)..(165): n is a, c, g, or t
  misc_feature (167)..(169): n is a, c, g, or t
  misc_feature (175)..(175): n is a, c, g, or t
  misc_feature (186)..(188): n is a, c, g, or t
  misc_feature (190)..(190): n is a, c, g, or t
  misc_feature (207)..(207): n is a, c, g, or t
  misc_feature (210)..(210): n is a, c, g, or t
  misc_feature (219)..(219): n is a, c, g, or t
  misc_feature (223)..(223): n is a, c, g, or t
  misc_feature (236)..(236): n is a, c, g, or t
  misc_feature (298)..(298): n is a, c, g, or t
  misc_feature (302)..(302): n is a, c, g, or t
  misc_feature (306)..(306): n is a, c, g, or t
  misc_feature (308)..(308): n is a, c, g, or t
cggcatgacccaacaaagcctgtatttctccnnncnncngannnnnngncntnngnnccaccatctcnttgagtgacagcgacntgcttcggctggaaggtgattcacgnactntncngnttnctaagggagtttcntcganccctaggacgnannnnnnngnnngnnncctccncagcgagttannntncacttcctcttagtgtncancaagaacancggncagctgcttgcantgctggcagagttgcttcgaggaccttgtggcagctttgatatgcgcaagacagctgatgantgancctntnttccgctggggctatgtacagagtgcaaatgttt

SEQ ID NO: 6976 - DNA, 358 bp, Mus musculus
  misc_feature (91)..(91): n is a, c, g, or t
  misc_feature (111)..(111): n is a, c, g, or t
  misc_feature (128)..(128): n is a, c, g, or t
  misc_feature (132)..(132): n is a, c, g, or t
  misc_feature (135)..(135): n is a, c, g, or t
  misc_feature (148)..(148): n is a, c, g, or t
  misc_feature (180)..(181): n is a, c, g, or t
  misc_feature (197)..(197): n is a, c, g, or t
  misc_feature (223)..(223): n is a, c, g, or t
  misc_feature (226)..(226): n is a, c, g, or t
  misc_feature (232)..(232): n is a, c, g, or t
  misc_feature (254)..(254): n is a, c, g, or t
  misc_feature (256)..(257): n is a, c, g, or t
  misc_feature (260)..(260): n is a, c, g, or t
  misc_feature (287)..(290): n is a, c, g, or t
  misc_feature (294)..(294): n is a, c, g, or t
  misc_feature (332)..(332): n is a, c, g, or t
ctcagctgtcttgctgttttgcagttctttgccagtatgttgacatatccctttgtgcttgtatctaatcttatggccgtcaacaactgtngggcttgctggtggatctcntccttattccccaatanacanttnttggatagattgntggtgcatgctacaaaaagcgggaaatatgannccgaggaaacagcttntttttccggaaggttccttgtggganganttactnttatgacctaagaatgttaatntnngangatgtggggcagggacagtgacatttnnnnatantcccaatgcacagaattatgggagagaatgttgatttntatacagtgtggcacgcttttttaat

SEQ ID NO: 6977 - DNA, 336 bp, Mus musculus
  misc_feature (26)..(26): n is a, c, g, or t
  misc_feature (78)..(78): n is a, c, g, or t
  misc_feature (105)..(105): n is a, c, g, or t
  misc_feature (107)..(107): n is a, c, g, or t
  misc_feature (159)..(159): n is a, c, g, or t
  misc_feature (171)..(171): n is a, c, g, or t
  misc_feature (191)..(191): n is a, c, g, or t
  misc_feature (221)..(221): n is a, c, g, or t
  misc_feature (249)..(249): n is a, c, g, or t
gtttgaaggccaaaattagatcatancagtctgcaaggaggcggctctcctagctctggaagaaaacattaaagctgnctgcattatgaagaggcatttcactcnanccttgagcattgtgacacccaggatcccagagtcactgagacgcttttatgnagattaccaagnaaagagtggactacacacantctaaaaaatacttatgtgcatatattttntagagaaaagtttgttttcaaatttttntcttgagagtgtttactgtttcttaataggtaaatgtttgaaataccttcactggagttgaagagccaatgttttgactcatttgag

SEQ ID NO: 6978 - DNA, 83 bp, Mus musculus
agcactgcaggtcgcatttggatcactgtatcgagatgacgtcttaataaagcccagcagggtcgttgccattttggcagcag

SEQ ID NO: 6979 - DNA, 419 bp, Mus musculus
  misc_feature (97)..(97): n is a, c, g, or t
  misc_feature (104)..(105): n is a, c, g, or t
  misc_feature (111)..(111): n is a, c, g, or t
  misc_feature (114)..(114): n is a, c, g, or t
  misc_feature (116)..(116): n is a, c, g, or t
  misc_feature (134)..(134): n is a, c, g, or t
  misc_feature (136)..(136): n is a, c, g, or t
  misc_feature (155)..(155): n is a, c, g, or t
  misc_feature (176)..(176): n is a, c, g, or t
  misc_feature (178)..(178): n is a, c, g, or t
  misc_feature (182)..(182): n is a, c, g, or t
  misc_feature (207)..(207): n is a, c, g, or t
  misc_feature (212)..(212): n is a, c, g, or t
  misc_feature (223)..(223): n is a, c, g, or t
  misc_feature (230)..(230): n is a, c, g, or t
  misc_feature (258)..(258): n is a, c, g, or t
  misc_feature (266)..(266): n is a, c, g, or t
  misc_feature (272)..(272): n is a, c, g, or t
  misc_feature (322)..(322): n is a, c, g, or t
  misc_feature (335)..(335): n is a, c, g, or t
tccccagaatgggaatttcttttatattttaatttttttcctggctccccccccacccccccaccccccacacttaaggttttttggaggtgatacnaccgacnnctgatntcngncggcgcgtttttcttttnanatgcgagggaggccagganagggttactttagctatttcntntgtncccagctatgccaccagtccagggnccctncctgtccttcngtagagnctgttgagactgagatcctgtgggacantcagttgntccgtntccaaatccccgcttaccactgatgttttagctgatggtgactggcatantcccaattccctntctctccaagtaggtggtgttagaaatcttaattcttttcccttcttttgtatggactacaaataaaacttggggcgattcgtg

SEQ ID NO: 6980 - DNA, 324 bp, Mus musculus
ttcagccactccagtactactgtgagggtggataggtgctccagacgagagactcacctggggtggagacaggcttctgtgcgtctctaattcctgtcaagcccgtgtcctccagaggctctggcacatagagtggagtcaccaaagcaccacttttgcactggctacctctcactcctatcttgtgcgcttctgtggcagggactgactgctgatacgtctttgaggccaaagtggatgcagatttgcttctgaatatcccagtgtcaaacctatcttagatccacagtggtgaagctggcagtcatgtctattttatttctc

SEQ ID NO: 6981 - DNA, 248 bp, Mus musculus
  misc_feature (33)..(34): n is a, c, g, or t
  misc_feature (40)..(40): n is a, c, g, or t
  misc_feature (42)..(42): n is a, c, g, or t
  misc_feature (45)..(45): n is a, c, g, or t
  misc_feature (47)..(47): n is a, c, g, or t
  misc_feature (53)..(53): n is a, c, g, or t
  misc_feature (61)..(61): n is a, c, g, or t
  misc_feature (63)..(65): n is a, c, g, or t
  misc_feature (67)..(67): n is a, c, g, or t
  misc_feature (69)..(69): n is a, c, g, or t
  misc_feature (78)..(78): n is a, c, g, or t
  misc_feature (88)..(88): n is a, c, g, or t
  misc_feature (90)..(90): n is a, c, g, or t
  misc_feature (141)..(141): n is a, c, g, or t
  misc_feature (169)..(169): n is a, c, g, or t
  misc_feature (171)..(171): n is a, c, g, or t
  misc_feature (178)..(178): n is a, c, g, or t
  misc_feature (217)..(217): n is a, c, g, or t
  misc_feature (223)..(223): n is a, c, g, or t
atacactcttttcacgtacttctagtaccctcnngaggtncnatntntacttntgacacancnnntntnccttgagantgaggaaggnancaggcaagcaaggagccatgaaccacagggccccagccagcacaggatttntcctcattccgtgggtgatggatgaatntnattggantcctgaataaatgctgttttttggcttccaaaaccctgntttttntggccttgggtcatgagggtataag

SEQ ID NO: 6982 - DNA, 68 bp, Mus musculus
ttggagacctgtaccccaggtgccagggtgctttcaccatggctcccttgagcaaatggaacaaataa

SEQ ID NO: 6983 - DNA, 134 bp, Mus musculus
  misc_feature (30)..(30): n is a, c, g, or t
  misc_feature (43)..(43): n is a, c, g, or t
  misc_feature (94)..(94): n is a, c, g, or t
  misc_feature (98)..(98): n is a, c, g, or t
  misc_feature (105)..(105): n is a, c, g, or t
cagcaagaacacgggcagctgcttgcactnctggcagagttgnttcgaggaccttgtggcagctttgatatgcgcaagacagctgatgactgancctntcttccnctggggctatgtacagagtgcaaatgttt

SEQ ID NO: 6984 - DNA, 156 bp, Mus musculus
  misc_feature (44)..(44): n is a, c, g, or t
  misc_feature (83)..(83): n is a, c, g, or t
cttcgagtgaatgtggcagttaaacataccttcattttttgganttgcatatttagctgtttggaacagagttgtttcctttntgaatttcaaagataagactgctgcagtcccatcgcaatatccagtggggaaattttgtttgttactgtcatt

SEQ ID NO: 6985 - DNA, 102 bp, Mus musculus
  misc_feature (77)..(77): n is a, c, g, or t
ctttaccttcaagaacgatgacattttgcaggttcaatatgaagttgtttccaggcaaccagagttccacattgaantcctatccatttaaaggcccgcagc

SEQ ID NO: 6986 - DNA, 457 bp, Mus musculus
  misc_feature (49)..(52): n is a, c, g, or t
  misc_feature (54)..(54): n is a, c, g, or t
  misc_feature (56)..(60): n is a, c, g, or t
  misc_feature (62)..(62): n is a, c, g, or t
  misc_feature (64)..(65): n is a, c, g, or t
  misc_feature (67)..(68): n is a, c, g, or t
  misc_feature (71)..(74): n is a, c, g, or t
  misc_feature (76)..(76): n is a, c, g, or t
  misc_feature (78)..(78): n is a, c, g, or t
  misc_feature (80)..(80): n is a, c, g, or t
  misc_feature (82)..(85): n is a, c, g, or t
  misc_feature (87)..(87): n is a, c, g, or t
  misc_feature (92)..(94): n is a, c, g, or t
  misc_feature (96)..(98): n is a, c, g, or t
  misc_feature (100)..(100): n is a, c, g, or t
  misc_feature (102)..(103): n is a, c, g, or t
  misc_feature (106)..(107): n is a, c, g, or t
  misc_feature (110)..(115): n is a, c, g, or t
  misc_feature (317)..(317): n is a, c, g, or t
  misc_feature (331)..(331): n is a, c, g, or t
  misc_feature (375)..(375): n is a, c, g, or t
  misc_feature (382)..(382): n is a, c, g, or t
  misc_feature (419)..(419): n is a, c, g, or t
  misc_feature (422)..(422): n is a, c, g, or t
  misc_feature (425)..(425): n is a, c, g, or t
ggatgagcaggcgaagctccccgaccagggcttgcgtttacatccactnnnncntnnnnntncnngnnccnnnngntncngnnnngnccccnnngnnntngnnggnnggnnnnnncctttcttaggacgatgtctcaccttgctgtctctgacaggtttgagcatggcagaaggggacaccttggtctcagtggattacgaaatttttggaaaggttcaaggggtgtttttccgcaagtacactcaggctgagggtaaaaagctaggtttggtgggctgggttcagaacaccgaccggggcaccgtgcaagggcaantgcagggccccgtntccaaggtgcgcttcatgcagcagtggctggagaccagaggaantcccaantcgcacattgacagagcaaacttcaacaatgagaaantcntcncaaacttggattattcagacttccaaattgta

SEQ ID NO: 6987 - DNA, 142 bp, Mus musculus
  misc_feature (35)..(35): n is a, c, g, or t
  misc_feature (43)..(43): n is a, c, g, or t
  misc_feature (54)..(54): n is a, c, g, or t
  misc_feature (59)..(59): n is a, c, g, or t
gactatgaccgaagggcagacaagccatggacccncctcaccnctgcagacaanagctnccattcggaaggaactcaatgagtttaaaagtaccgagatggaagtccacgagttaagtagacacttaaccaggtttcatcga

SEQ ID NO: 6988 - DNA, 480 bp, Mus musculus
  misc_feature (56)..(58): n is a, c, g, or t
  misc_feature (247)..(247): n is a, c, g, or t
  misc_feature (253)..(253): n is a, c, g, or t
  misc_feature (256)..(256): n is a, c, g, or t
  misc_feature (258)..(258): n is a, c, g, or t
  misc_feature (304)..(304): n is a, c, g, or t
  misc_feature (359)..(359): n is a, c, g, or t
  misc_feature (367)..(367): n is a, c, g, or t
  misc_feature (378)..(378): n is a, c, g, or t
  misc_feature (383)..(383): n is a, c, g, or t
aatggacggaggactccagctgctgaccctgcctaatgtatctgctagggccgtgnnnctcaccggccccaggaggatatgacatggtccaaaaacttttcttggattttttccgtaggcggctgagccagagaccaactgcagaggaactggaacagaggaacattttgaagcctcggaatgaacaagaagaacaggaggagaagcgggaaatcaagaggaggctgactcgcaagctcagccaaangcccancantngaagaactccgggagaggaagatccttatccgcttcagtgactacntggaagtggcagatgcccaagactatgaccgaagggcagacaagccatggacccncctcaccnctgcagacaanagctnccattcggaaggaactcaatgagtttaaaagtaccgagatggaagtccacgagttaagtagacacttaaccaggtttcatcgaccttaacagtggga

SEQ ID NO: 6989 - DNA, 541 bp, Mus musculus
gaatgctggagaacgcggctgtttctgtcttgatttctctcacaatggaaggatattagcagcagcctgtgccagccgagacggatatccgattatattatatgaaattccttctggacgttttatgagagaattgtgtggccacctcaatatcatttatgatctcgactggtcaaaagacgatcgctatctcgttacttcatcctctgacggcactgccagagtttggaagaatgaaatcaatagcacgagcacgttcagagtcttacctcacccctccttcgtctacacggctaaattccacccagccacacgggagctggtggttacaggatgctacgactctatgataaggatttggaaaattgatgcaagggaggatgctgccatattagtgcgccagttggatgtgcacaagagctttgtcaactccatctgttttgacgatgaaggtcaccacatgtactcaggagactgcatcggggtcatcgttgtctgggacacgtacgtcaaagtgaatgatgtgcaacactccgtgcgc

SEQ ID NO: 6990 - DNA, 228 bp, Mus musculus
  misc_feature (30)..(30): n is a, c, g, or t
  misc_feature (38)..(38): n is a, c, g, or t
  misc_feature (41)..(41): n is a, c, g, or t
  misc_feature (49)..(49): n is a, c, g, or t
  misc_feature (54)..(55): n is a, c, g, or t
  misc_feature (57)..(57): n is a, c, g, or t
  misc_feature (62)..(62): n is a, c, g, or t
  misc_feature (70)..(71): n is a, c, g, or t
  misc_feature (74)..(75): n is a, c, g, or t
  misc_feature (81)..(81): n is a, c, g, or t
  misc_feature (84)..(84): n is a, c, g, or t
  misc_feature (88)..(89): n is a, c, g, or t
  misc_feature (92)..(92): n is a, c, g, or t
  misc_feature (94)..(94): n is a, c, g, or t
  misc_feature (97)..(97): n is a, c, g, or t
  misc_feature (101)..(101): n is a, c, g, or t
  misc_feature (108)..(108): n is a, c, g, or t
  misc_feature (115)..(115): n is a, c, g, or t
  misc_feature (121)..(121): n is a, c, g, or t
  misc_feature (123)..(123): n is a, c, g, or t
  misc_feature (136)..(136): n is a, c, g, or t
  misc_feature (139)..(139): n is a, c, g, or t
  misc_feature (141)..(141): n is a, c, g, or t
  misc_feature (183)..(183): n is a, c, g, or t
aaaatttcacccattaattcagccaatctnttcataancangaaccccntccannangaccntcaccagnnttnngaaganctnccgnncancnctncagncacaganctgagtncacagncncccacagctgcanttntnttcagagcacacacttcaccaattcctaccacaacgttcctnctgtaaatacttgaaatcacgacactcaatgtgaacttttaaaag

SEQ ID NO: 6991 - DNA, 374 bp, Mus musculus
gaagctcttgatggacatggccctattcatgggacgttcatttcgggttggttggggtcccaactggactcttgctaatagtggagaacaactgcatggctcccatgaactggaaaatcatcaggttgccgattctatggaatatggattcctgcccaatccagtagctgttaaatcgtgagttatgtttattgatgctttgggggaatgtccacattatagttggggctgttctgttatcaagaaacccaaggtcagcaccctgctttttgatctctctatataaatttttaacccaagtataagtatttcatatgttatgtacatagtatcatatatgttcctatgtagtccctacaattaagtcctctggt

SEQ ID NO: 6992 - DNA, 229 bp, Mus musculus
  misc_feature (36)..(41): n is a, c, g, or t
  misc_feature (43)..(45): n is a, c, g, or t
  misc_feature (52)..(54): n is a, c, g, or t
  misc_feature (77)..(77): n is a, c, g, or t
  misc_feature (83)..(83): n is a, c, g, or t
  misc_feature (92)..(92): n is a, c, g, or t
  misc_feature (100)..(100): n is a, c, g, or t
  misc_feature (105)..(105): n is a, c, g, or t
  misc_feature (109)..(109): n is a, c, g, or t
  misc_feature (114)..(114): n is a, c, g, or t
  misc_feature (139)..(141): n is a, c, g, or t
  misc_feature (169)..(169): n is a, c, g, or t
  misc_feature (171)..(171): n is a, c, g, or t
  misc_feature (174)..(174): n is a, c, g, or t
  misc_feature (202)..(202): n is a, c, g, or t
tgacttctctccagagatcatcgtcagtgacgtttnnnnnngnnngctcttnnnccgttggaggcaggggacccacnaggatnaaccaagtngagtgttnatccnactncacancctttcgtgaccctacatttccatnnnacaggtcagaagctgcaccaatgagaantnttncaggcgatgtagaaatgactgtggattntaatacacaccgaaattctgactgaga

SEQ ID NO: 6993 - DNA, 179 bp, Mus musculus
  misc_feature (32)..(32): n is a, c, g, or t
  misc_feature (100)..(100): n is a, c, g, or t
  misc_feature (114)..(114): n is a, c, g, or t
tcaccacgtggctgtttttagttgcttgcttntacaattcctcagacggttgcaaactgttgttgtttgtgaaagtttataaatgtttattgtataactntttatagatctgtntcccacatgctaagattaatggcaatgcaacaccatgtccagcatgttccattaaatgtagttaa

SEQ ID NO: 6994 - DNA, 379 bp, Mus musculus
  misc_feature (191)..(191): n is a, c, g, or t
  misc_feature (208)..(208): n is a, c, g, or t
  misc_feature (288)..(288): n is a, c, g, or t
  misc_feature (303)..(303): n is a, c, g, or t
  misc_feature (315)..(315): n is a, c, g, or t
gtctcgaactcccatcaagcagagagcacggagcagatcccgaatctccagcaaggagaaccagcgtggccactctagaacccacagtaggggtagagccctcagccaatctagaacttccagcaaggacagagagcccacccaagatgcaacccctaagagcctccatgggaagccatctcccaccaggncgaagacttctagtcanaagagaactggtagcaaggcaggcggccactcctcaacacagcttcccaaggaggtccaaccccaggatgacagcttttncaagactgctacttntaaggccacctnacctggggaaaggtcttcatcatcttcctccaagctggcgtagcctccagtctcagtgggttca

SEQ ID NO: 6995 - DNA, 361 bp, Mus musculus
  misc_feature (207)..(207): n is a, c, g, or t
  misc_feature (281)..(281): n is a, c, g, or t
  misc_feature (289)..(289): n is a, c, g, or t
  misc_feature (292)..(292): n is a, c, g, or t
  misc_feature (303)..(303): n is a, c, g, or t
  misc_feature (306)..(306): n is a, c, g, or t
  misc_feature (334)..(334): n is a, c, g, or t
  misc_feature (336)..(336): n is a, c, g, or t
atcatcatggaaggattcatacagtagagaaaccatatgaacaaaagaaatgtggtaaagcttttgctcatcacagttatctcttattatagaaaaaaggagatattagagaaagatcctacaagtatgatagaagtgatgaagccattgcacaacacagttatctctgactacattaaaggaaagataatgatgacaaacactatnaatgtaataagggggggggggtaagcccattatataacatggtcaactttgaatacagaaaaagacatactatntaaagggnctncaatatatgtnccnccactagatggtgctaaacctctttgtncncagctgcgagagcatagcaagccaa

SEQ ID NO: 6996 - DNA, 451 bp, Mus musculus
  misc_feature (207)..(207): n is a, c, g, or t
  misc_feature (281)..(281): n is a, c, g, or t
  misc_feature (289)..(289): n is a, c, g, or t
  misc_feature (292)..(292): n is a, c, g, or t
  misc_feature (303)..(303): n is a, c, g, or t
  misc_feature (306)..(306): n is a, c, g, or t
  misc_feature (334)..(334): n is a, c, g, or t
  misc_feature (336)..(336): n is a, c, g, or t
  misc_feature (370)..(370): n is a, c, g, or t
  misc_feature (374)..(374): n is a, c, g, or t
atcatcatggaaggattcatacagtagagaaaccatatgaacaaaagaaatgtggtaaagcttttgctcatcacagttatctcttattatagaaaaaaggagatattagagaaagatcctacaagtatgatagaagtgatgaagccattgcacaacacagttatctctgactacattaaaggaaagataatgatgacaaacactatnaatgtaataagggggggggggtaagcccattatataacatggtcaactttgaatacagaaaaagacatactatntaaagggnctncaatatatgtnccnccactagatggtgctaaacctctttgtncncagctgcgagagcatagcaagccaaagtcaccantctntctcccggggcttttgcccagcccctgggggctttaacctatccccagggtgcatgaggatcatgggtgttgctacc

SEQ ID NO: 6997 - DNA, 267 bp, Mus musculus
  misc_feature (72)..(72): n is a, c, g, or t
  misc_feature (78)..(78): n is a, c, g, or t
  misc_feature (86)..(86): n is a, c, g, or t
  misc_feature (99)..(99): n is a, c, g, or t
  misc_feature (101)..(101): n is a, c, g, or t
  misc_feature (107)..(107): n is a, c, g, or t
  misc_feature (121)..(121): n is a, c, g, or t
  misc_feature (125)..(125): n is a, c, g, or t
  misc_feature (127)..(127): n is a, c, g, or t
  misc_feature (130)..(130): n is a, c, g, or t
  misc_feature (134)..(134): n is a, c, g, or t
  misc_feature (136)..(136): n is a, c, g, or t
  misc_feature (155)..(155): n is a, c, g, or t
  misc_feature (168)..(168): n is a, c, g, or t
ttttttcagggtagctgtgaaaccagatggacaagggaagagcttggggtatttagcaggatggggactttntcccantgcttccntcacaggggttgntngcagtntcagaaggccccancccnangantccntntcgggtgaggcctggcctnctgttctaagtantccactggcattgccttccaagccactttaggtccttttgttttgttttgtttttgtttttaaatcagtgttcttacttcctgtacataagcctaagat

SEQ ID NO: 6998 - DNA, 112 bp, Mus musculus
  misc_feature (44)..(44): n is a, c, g, or t
  misc_feature (47)..(47): n is a, c, g, or t
ctgctttgagatggaccctgcccttcggcgtgagcgggaaaaanccnagtgtagctaaaagtaccctcatccaccaaggcatccgttgaacaaacgcatttcctttcttgtt

SEQ ID NO: 6999 - DNA, 151 bp, Mus musculus
  misc_feature (34)..(34): n is a, c, g, or t
  misc_feature (40)..(40): n is a, c, g, or t
  misc_feature (82)..(83): n is a, c, g, or t
  misc_feature (93)..(93): n is a, c, g, or t
  misc_feature (110)..(110): n is a, c, g, or t
ggtgtaaaaaatactagatgcacagaatagcaantccatncaaaattcctgcgtgagaattttaccagacttcaagagcatnntcgccacatncttgaaaaatgccaccntccgatgaaaaacaggagcctgctaaggaacaatgccacct

SEQ ID NO: 7000 - DNA, 256 bp, Mus musculus
  misc_feature (27)..(27): n is a, c, g, or t
  misc_feature (36)..(36): n is a, c, g, or t
  misc_feature (61)..(61): n is a, c, g, or t
  misc_feature (122)..(122): n is a, c, g, or t
  misc_feature (126)..(126): n is a, c, g, or t
  misc_feature (134)..(134): n is a, c, g, or t
  misc_feature (137)..(137): n is a, c, g, or t
  misc_feature (173)..(173): n is a, c, g, or t
  misc_feature (177)..(177): n is a, c, g, or t
catatttcaatttccacttaaattttntaaggcttnaactggctctataaattaaatgagntttgtgctttccttgaaatgcacttattcttattacaggcattttataattttgtatgaantgtnctattttnctnctaaatattttgctttcagtaagtactctccagctntccntgggggttggttggtggaattactctgtattgacaagtacaagttaccgcctatgctttgtaccttaggctacaaaact

SEQ ID NO: 7001 - DNA, 93 bp, Mus musculus
  misc_feature (33)..(33): n is a, c, g, or t
gggaaacacattgtttgtgaactggagtttctnccctcacttgacagatggttttactttaggacgtcacgaaataaaggatcacttttcaga

SEQ ID NO: 7002 - DNA, 163 bp, Mus musculus
  misc_feature (93)..(96): n is a, c, g, or t
  misc_feature (111)..(111): n is a, c, g, or t
  misc_feature (127)..(127): n is a, c, g, or t
gctcagtaatactgtcaagcaggagtttgtttgcaaatgaaagctgtgtaagcatttttgtttatttcaaataaaatatatttgtattatttnnnncattcatactatccntccatgccacactttnttctgtaccaggtagcccaatagaaatacacctgtt

SEQ ID NO: 7003 - DNA, 79 bp, Mus musculus
aagttaattgttcatgcacattcattttattttgaagaaagactgatgtaacagatgtttgccattaaacctcaacttt

SEQ ID NO: 7004 - DNA, 81 bp, Mus musculus
  misc_feature (55)..(55): n is a, c, g, or t
gagtagaaaagaaagcagcccctatactgggccctattcagtggcagcttcttgntccatagggttaaggaagactttgag

SEQ ID NO: 7005 - DNA, 262 bp, Mus musculus
  misc_feature (80)..(80): n is a, c, g, or t
  misc_feature (99)..(99): n is a, c, g, or t
ttttggtgtgacagatgtgcccagtgactggtactttgtacccattttctgatcatcggttgctgatgtctacttcattncctgtgccttcctgtgccncctgtgtcttgctggcctgttttaggctcatcccagtttctctcttctgaccgtagcgtaccagcagttcttgacagtcccaaagttaccagtggcatcatcagactgagagcctgggctccttcttagatcttgttcagagccaggcaaatctgtctgcctt

SEQ ID NO: 7006 - DNA, 177 bp, Mus musculus
cgcggctctttacgctgagatgtttcactgacttctgcctgagatctggaaaaggaacactgcccaatagatgaacatgtgtgaaaaataacttccaaggaacatcatgtgcgcagggactgtgctaaacagaaaactgtcagtcactgcgggaatgtgcctccctgatcgccgcga

SEQ ID NO: 7007 - DNA, 103 bp, Mus musculus
ggctcacagcaattatagtccagttccagggcatccaacaggtccccctccctcctctggcactcacaggcactgcacacacttggtaaacagacatgcatgc

SEQ ID NO: 7008 - DNA, 280 bp, Mus musculus
ccctgtcacccatatgatattttacaaaaatgatcacccaaatattgaccaacaaagacgaaaacgaggaaaagaattgaacagtgatatttctggaagtgaagtttggatcagtcctgaatggaattgtagacatcgccgctggtcatgggagtgttggttaccattgctgttctggagacagatgcatcagaggaacctgatgatggaaacttaacccacattgctgagggaagcagctgggatgagcaagaagacggtcctagacaaagttatggta

SEQ ID NO: 7009 - DNA, 405 bp, Mus musculus
  misc_feature (97)..(97): n is a, c, g, or t
  misc_feature (321)..(321): n is a, c, g, or t
gagggctttgaactcctaagcactacaaaatactttgacgtggaagaagagagggcaacctatccacagaaagagacttattctgtcactcccaganatcagctgctttggactccctggactcctgtaggccagcaggggacttatgcctctgggcagctaagctctttgacctacagcactgctacagccagaaagaaccccgtttacgatccccaggcgatggagttggagtctgaggagtagtgggaaatcatccaggcccaagctacgggacccaagatcaattcaaacatcaggactccctagtgctggcttcanagcggatgttttctatctctgttgtctccatcccatagcgtaggcattcacagcccacttgagttcctatctaactgcccagta

SEQ ID NO: 7010 - DNA, 455 bp, Mus musculus
  misc_feature (269)..(269): n is a, c, g, or t
  misc_feature (275)..(275): n is a, c, g, or t
aggcaagaattttgctccctggattgtatgaaattagaaagtgtcatgtcagacgactgcctaacccaaaggaaaaaatgtcagggttcaggactcttctgggaggtgagtccctgtgccgctccattctctggataggtgagaaggaaaagccagtctgtgggtgtggataaaagactctgaataaataaatatctccctgtatctcaggccaatagggagtctcaaaggaccaggaagaagttggccatcaaggtctgaggaggggnggcagncaggtcacccccagcattctgtgtgcccacctgcctcctgaactcaggaccatcttccagacctcctctgtcccagagctccaggagaccgaaacttgctgcatggatgcagcaaaagatgatgccttcctcctaactaggaagggtgggtggccagctctccgccatgtggagtgagtt

SEQ ID NO: 7011 - DNA, 149 bp, Mus musculus
actgtaaagaggcttgttgcccagagtgtagcacttatggatctgtggtgtttggggagccaggttagagcaattggctgcactggcctcccactaatataacctgctgtcagaagcctgactcaagcctcactccttgcatagctcct

SEQ ID NO: 7012 - DNA, 131 bp, Mus musculus
gcggccaatgcacttccaagtaaaccatggaccacagccttctaaccgaagtgtgagccttatacagatcatatggtccaaaagttctctctaagaacgttttcagagctgggaatacagatggctcaatg

SEQ ID NO: 7013 - DNA, 377 bp, Mus musculus
tgcttctgccaaccggaagcacagaaaactagaacttcattgattttgttttttaaaagatacactgatttaacatctgataggaatgctaacagctcacttgcagtggaggatgttttggaccgagtagaggcatgtagggacttgtggctgttccataattccatgtgctgttgcagggtcctgcaagtacccagctctgcttgctgaaactggaagttatttattttttaatggcccttgagagtcatgaacacatcagctagcaacagaagtaacaagagtgattcttgctgctattaccgctttaaaaaaaaaaaatcaagacttggaacgcccttttactaaacttgacagaagttcagtaaattcttacc

SEQ ID NO: 7014 - DNA, 168 bp, Mus musculus
ggatgtgacccatccaaggatgcgccgctatattaagaatcctcgaattgtgctattggattcttctttggagtacaagaaaggagaaagccagaccgacatcgagattacccgggaggaggacttcacgcggatcctgcagatggaggaggagtacatccatcagct

SEQ ID NO: 7015 - DNA, 274 bp, Mus musculus
gggcacagactcttgcattagtccattatctctcgctgggttttccagagcccgggctctgagctcaaacccagatcctaagctacctgccggccgtttcatccagagagagatggttttgtcatgggtgagggagctgctgtgctggtgctggaagaacatgagcatgctgttcagagaggagctcggatctacgcagaaattttgggttatggactctcgggtgatgccggtcacataactgcccccgatcccgaaggagaaggtgctttaa

SEQ ID NO: 7016 - DNA, 442 bp, Mus musculus
aattcagcttcgagcaggttttcccttcagcagcggcactcatctcttccgactccagctgagagcccttcttctcctgtatctattagggaagtagaagtgcgccactattctcaatggagaggacaatgccttttttgacaggaaaactaattgaccggcgtacatatgcaagacaacacttggtcctccagtcagttttcttaattaattttgtcctggaatatatacaagttattggtggcagctacagcaataatgctctccatggggtgccaggctgtgtggaggatcttctattgaagtccaaactgtccacgctaatctcgtcttcttctctaccccctgtacataactttccgggggttcagggtgggctcgggtttgctgttctctcttgagggcttccagtgtaacattccctccgagtgtttctatcaaa

SEQ ID NO: 7017 - DNA, 346 bp, Mus musculus
attattcatgttcttggcttattggatctcttacaagtgcatctcactaaagtgttgtcaaaagaaaacagcattttaaagcatgtttaatataaaaagtcttaattatataagatacaaataatggacttgttcaaaaagtccaataatttagcctgggaagaaaaacttagctgcccttttgaaacttctttttgaagttaccagttctagtccaagcgaatatctcaaaatccgctgctcttctgaattattttgggtaataaatgctgttgtcaacacagacctttttactgcttagacttcagccaacaagttacagaatgtttcctaaaatactccaaag

SEQ ID NO: 7018 - DNA, 280 bp, Mus musculus
agctacagagtccaggccactggaccagccaacatctgggctgctgcagggaggcctggcctattttttcttaaaacatattttataaaactacaacctgatctaccctccagggcctcctcagttccactgattgaaattttcttcttccatggactaagtccatctaggaaggaaaaatgaggagaaagagtgtggtatcctccttctaagacagtgaccgatttctctgggttgggccaagactttatttactgcatcatgcatgactcactcaggg

SEQ ID NO: 7019 - DNA, 348 bp, Mus musculus
cactgaactttctcataagactgaatataagtggattaaggaacatgtagaagtgacagtttggaagtattttcttcataagtaaagcaaatgtgtgttgaattgtagtccgcagcccacctttcacagaactagacccccgagatacatagtgctgttcaacttgagttaccatgtacactgcctgcaggttcctgagttatgtgtaatttcagatgctcttgatttttctctgctgtttccctttatatcccctccacagttcacaggttgatgaacagaacaaaagcagttatgatcacttgtgctgttgtgatgactgttctgtgaagacgtaaggacacttga

SEQ ID NO: 7020 - DNA, 37 bp, Mus musculus
acgtatagcatcatgtagcgtctcaggactgttattg

SEQ ID NO: 7021 - DNA, 348 bp, Mus musculus
ggagaagtccagtaacggtccattctcgtctgttgttctcgttgtaaacgttagaatgcgaatgctaggaagaagctctgtaatgcatttgatgtttgatagtaggttttgctgtagtcatcaagggtgccttggagggagagctacacagtgatagagcagacaggaggtctacagaggagcagggagctccacacactccaggccccagtgtactgtgtgtccagtatagttaaggaagaaacattaaaattgtttaactgttttaacatgtatcccacagttgtagtttgtaaagaattgagccaccttgaacagtctgattcagaataaacgtatagcatcatg

SEQ ID NO: 7022 - DNA, 130 bp, Mus musculus
ggctactagctacctcaggtgtccactgtctctttgttagatgtcatatagccatctggcagccattgcctactgagacttttagcaggtgtactataggtgaactgtactgagcgcctcgtgcacgtgc

SEQ ID NO: 7023 - DNA, 232 bp, Mus musculus
gacccagaaagctgcgggttctaattgctgccttagggctcccgcctgccaggccctgtggacagtgtgcatccccacagatgagtgtgcatctccctacctctctgtaaagacagataccgatgaccttgtgactttactatccagcttggtaagaaaagaaataccaagtagatacagtgcaagctttcctttaatgtatatactgcataggtacgacatgtttagtaaa

SEQ ID NO: 7024 - DNA, 112 bp, Mus musculus
gacctcaccagattatttaattttctaagtgtttagaccttgttggtaggtgtggcatgtagtttcctctccttgcatttatttaagatactgttagagagatattgttttc

SEQ ID NO: 7025 - DNA, 168 bp, Mus musculus
gaaagcaagtagcttcccgtggcttcaaatgaccttcccacaaggtggaaagaagaaaaacagaaatcacgttgtagaaggtagagatgatggctacagggacgaccagataaacaagcttattagatggatgaacttaggtttcacccatgatatttttgtaacttg

SEQ ID NO: 7026 - DNA, 162 bp, Mus musculus
agagcgttctgcatcagtttggagaggtagcactttgaaaccatgagactcaaggggctaagtgaagaggtctcaggggacacggagtcttcgtgccaacagtggaatgtaagggcactcactgttcaccataatgtggctctcatgtgcttcctccagctt

SEQ ID NO: 7027 - DNA, 136 bp, Mus musculus
atgcagatggctgttttttgagagctgatgttggcatctatgctagcatctttcactacttcccctggattgaagataccatgaaaaataactgagctcccacaacaggaggaattctgaaacatgtgacaaggca

SEQ ID NO: 7028 - DNA, 331 bp, Mus musculus
tgaggaaataccgtactttgtcttaatttaaaaaaaaaaaaaaaaaaaaacactttaaaaaaggaaagaaacccacagtatacctttcccagaggctagcctgatgaggtcagtccagttttggaagcactgccccagccagacccttattctttcgtaagatcactggctggaggggtgcccccagcaggcagagctcagtgctgtttgctttgataatcgttaagccatatcatctgaggtttccggcttgagatgtgaatttgttttatagactataaatatacagtgtatgtataaagcagaatgcctgtccttctgattatttttt

SEQ ID NO: 7029 - DNA, 264 bp, Mus musculus
aggtctacagcaatgaaacttttatagtattttcccttgcattgtgacttttagttgtcattttgtagtatatgtgtgaagctaagaacgttttagagaatctgagccttgtataaagtgatgacatggttacctggttgttggatgactgaatattgacagtcgacttactacagggtaaagctggttagtttctggctctgacttcttggagcatacctaccatgagcactctttccatgtaaagatgttagaggctcctca

SEQ ID NO: 7030 - DNA, 366 bp, Mus musculus
ttacatggagctgcacttcactaaggacattgtggaggcaggactggccggagacaccaatctctactacctggcgctaattgaaaggggaacagctaaacttcaggctgctgtggtactaaaccctggctactcctccatcccaccggttttccgactctgtctaaactggaaaggggagaaaaccaacagcaacgatgacaatattcgggctatggagagtgaagtcaacgtgtgctataaggagttgtgtggccctcggcccagtcaccagctcctgaccaaccagctgcagagactgtgtgtgctgctggacgtctacctggagaccgagagccacgatgacagcttcgagggccccaagga

SEQ ID NO: 7031 - DNA, 373 bp, Mus musculus
  misc_feature (217)..(217): n is a, c, g, or t
  misc_feature (227)..(227): n is a, c, g, or t
  misc_feature (233)..(233): n is a, c, g, or t
  misc_feature (293)..(293): n is a, c, g, or t
ggagtttctcatttatacttagacacctgtgtacgatggggaactaaaaacaaaagtacctgcaagttataagggactactctgttaattgtaaaggtgctatgaaagtgactttgtatatgaaacgagttcccaaaagggttgagtcatgacttgtcaataacctacatgaagtattttgacttacttgttttggaagaaaagttgggtatttttnctgtgaaatncaattntccaaatttgagcattttgtatagggtttctgttaaatgttttcaactaaattcctcagntcttaccctaagaatattgtgtataaattctacaacccaagttatgaagtaagctgtaagcataactttaccactgagtt

SEQ ID NO: 7032 - DNA, 430 bp, Mus musculus
  misc_feature (204)..(204): n is a, c, g, or t
  misc_feature (207)..(207): n is a, c, g, or t
  misc_feature (210)..(225): n is a, c, g, or t
  misc_feature (265)..(265): n is a, c, g, or t
  misc_feature (268)..(269): n is a, c, g, or t
  misc_feature (285)..(285): n is a, c, g, or t
  misc_feature (292)..(292): n is a, c, g, or t
  misc_feature (296)..(296): n is a, c, g, or t
  misc_feature (306)..(306): n is a, c, g, or t
  misc_feature (339)..(339): n is a, c, g, or t
  misc_feature (341)..(341): n is a, c, g, or t
  misc_feature (378)..(378): n is a, c, g, or t
  misc_feature (398)..(398): n is a, c, g, or t
  misc_feature (401)..(401): n is a, c, g, or t
agtgtccaggtgtgtaaccgggcttgctgctcctaagtgaaggaagtgtgttgcttcaagcatccagacaccggcccgcctcaacacctgagatctagaggaaggagaacctgattcagagtcacagtggaaaagcccagagactccgatcttggaacagaagggctggcgtttttaatccagctaaaagaaatgcgtgtgctngantcnnnnnnnnnnnnnnnntttcgagcctcaagttgctatcccagcatctcttaaaacngtnngttctgagaaatcttnataggcnaagnaacttctgcnttgtgagaaagttgacaaacatggatttggaantntaccttttcttgtgtccagaagctggactatcacccnttatccccaaatattgacanccnataaggtaggactcgcctaagtgaaactt

SEQ ID NO: 7033 - DNA, 475 bp, Mus musculus
  misc_feature (308)..(308): n is a, c, g, or t
  misc_feature (329)..(329): n is a, c, g, or t
  misc_feature (334)..(334): n is a, c, g, or t
  misc_feature (341)..(341): n is a, c, g, or t
  misc_feature (449)..(449): n is a, c, g, or t
gacacatgaagaatagcctccctcccaccatcccagaaaggctcagggcagccgtgatcctcctagggtcacagtcggtcagcttggctgctccattctttcataggcaggattcctaattcctgccactccccctaagagcaggacttccctatgccagcacatgtgccccaggtggggctgagtacaggtaaccttgagctcagcttgggccagctttgaacagtgcttctgaggtccccagagaccaaagccagatcgtctgtcccccacaccttaggtgggcacaggagggccgagcttgtttntacccactggcagctgctgantcaantctgggntccctgccatctgtggagtacttttttcctgttgtgttgaatactggagaaatagaaggttcaagatagaggcagacctgactgtttcttgagggtccatcaggcatntccaggagctggccagttatcttaga

SEQ ID NO: 7034 - DNA, 501 bp, Mus musculus
  misc_feature (79)..(79): n is a, c, g, or t
  misc_feature (146)..(146): n is a, c, g, or t
  misc_feature (308)..(308): n is a, c, g, or t
  misc_feature (371)..(371): n is a, c, g, or t
  misc_feature (420)..(420): n is a, c, g, or t
  misc_feature (461)..(461): n is a, c, g, or t
gagaatacagttcttggccttgacctcagtggagatccaactataggacaagctaacgacttcttggagcctcttttanaagctaaaaaagcaggtctgaagttggcattgcatcttgccgagattccaaacagggaaaaagaaantcagatgctgctgagtctgctccctgacagaattgggcatgggacattccttagcgcctctgaggcaggggccctggaccaagtggacttcgtgaggcaacaccagatacccctcgaactttgtttgacctcaaacatcaaaagccagacagtcccttcttnatgatcagcatcactttggattttggtacagcattgctcatccttctgtgatctgtactgatngataaaggtgtttttgcgacatacctttctcaagaatatcaactggcancagaaacatttaatttgaccccatttcaggtgtgggatctntcctatgaatccatcaactacatctttgcttgtgacaaca

SEQ ID NO: 7035 - DNA, 444 bp, Mus musculus
  misc_feature (94)..(95): n is a, c, g, or t
  misc_feature (332)..(332): n is a, c, g, or t
  misc_feature (344)..(344): n is a, c, g, or t
gagctgaacagtttctaacgcgcaagcagttctgttcttgtgtatgacttgtaaccttaatttactgtgtaaagatggttacattatttccttnngctttgtttgttggagacagatagcgaatgcttgttaagtatgtcaacataatctccccttgtgaacttttgttaatgtcttatacgagctctcttttccatttgcccagaaaggtggcttgtataacgctttggaagtttctgctccgtccgtcttagagctgacagtctgttaggtttgttttctcttcatgctaaagtgtcggtggttttgtgaactggtcagaaattcacagntcttaaatgttngggggaaatttatattggacactgctctttgtctagcaaataaaagatgttaatatattcctgttattggcatgtgcacgactgttattagaagccactt

SEQ ID NO: 7036 - DNA, 302 bp, Mus musculus
  misc_feature (128)..(128): n is a, c, g, or t
  misc_feature (133)..(133): n is a, c, g, or t
  misc_feature (151)..(151): n is a, c, g, or t
aggtccagttcctggctgacttccgtccagctgctcagtgaagtcaccacactggaggagactccacccatgctcccagtctacaaaggctcaagcagcctcactgacgtccctgttcctttccaccntcccncaccccaccccatccctntaggtcacataccttctagagctcctgagtccgctgtcattactcaccaaatacccatgtctgtttatttgaggagccggagcagggggtgtggtgaaagcactttgtcacttacagtatctgaggatcccctgctacactgatgggaggt

SEQ ID NO: 7037 - DNA, 255 bp, Mus musculus
aggacgatttcctgcgaagcctggagcatgcgggaccccagctcacctgcatcctcaagggtgactggctgggcctctacaggcggtttttcaagtccccccattttgatggctggtatcggcaacgacacaaagagatggcccagaagctggaagctctgcacctggaagctatttgtgaggcgaacattgaggcttggatgaaggacaagtccgaggtggaagtggtcgacctggtcctgaaacttcgggaga

SEQ ID NO: 7038 - DNA, 393 bp, Mus musculus
  misc_feature (326)..(326): n is a, c, g, or t
  misc_feature (332)..(332): n is a, c, g, or t
  misc_feature (335)..(335): n is a, c, g, or t
  misc_feature (338)..(338): n is a, c, g, or t
gagtgctatttaaacatctgtcttaaactgtcctgagcttctacttttcttccatttaccccctttgggagaacattctagttggtaagtttattacctttcaaaatgtgcttggcacctgccttaaatagcacgaacatattgtgcacatctttaaattaatttaactggcaaaaaaacaattacattttaaactaaaactgagactgagaacagtacccaatctgtcttttaaagcttataaaagtgaatcgggtacaattagcaaaaagaagaaagaagacactgaatttatgacgttttacagtaatgaagctatactttgntctttnttnccnagaactgcgatttttctctgtatgaattataacttagtctgtgttggaactttga

SEQ ID NO: 7039 - DNA, 515 bp, Mus musculus
gaaagccaggacatcgtgaatcaagttcttgatgaaattgggattgaaatctctggaaagatggccaaagctccatcggctgcaagaagcttaccgtctgcctccacttcaaaggctacaatttctgatgaagagattgaacgtcaactcaaagctttaggggtagattagatcaaaagccatacatactgttctcacttgagtctaaagtgagtccggtgtagattccttttacaaaacacattcattttgcaaaaatgaagaccatgagtgaacagttatttcctgacccatggctactttgaatcctttgccaaagagtgccaatgatgcaaaaaacaatgggagcagtttggctcttaggtagaagcaccctggtctgaggggtgtgcaagctgagttcttttgtgcatggcatagggagacgacggtgtcactgcttagtgttgggttgggttctaagttgttttacactgaaatcagacttcatgtttaatgccattaggcgtcaacgt

SEQ ID NO: 7040 - DNA, 243 bp, Mus musculus
cgaggactcggacagtttacttctttactccagtgtttaatgagcagatgtatgtatgcatggttatttgtcaatgtgcagtttcctcatttctgtctttaaatatgctattatcatttcaggtatttgtaaatttgaggatagatttgttctgcttgacttttctaagttctactactgggttataattaaatattgtgtagtattactctgggtttggatatgctcatttgatttctatag

SEQ ID NO: 7041 - DNA, 534 bp, Mus musculus
  misc_feature (54)..(54): n is a, c, g, or t
  misc_feature (112)..(112): n is a, c, g, or t
  misc_feature (353)..(353): n is a, c, g, or t
  misc_feature (370)..(370): n is a, c, g, or t
  misc_feature (399)..(399): n is a, c, g, or t
  misc_feature (417)..(417): n is a, c, g, or t
  misc_feature (426)..(426): n is a, c, g, or t
ttagcagctgttgcaactgccaaggacacatacaacaagaagatggaagaggtntgtggtggtgataaaccatttttggcccctaacgacctgcaaagcaagcacctgcagnctaaaagaagaatctgtgaagttattccgaggcgtgaagaagatgggcggggaagagttcagccggcgttacctgcagcagctggagagtgaaatagatgaactctacatccagtatattaagcacaatgacagcaaaaatatcttccatgctgctcgaaccccagccacactgttcgttgtcatctttatcacatacgtgattgctggtgtgactggattcattggtttggacatcatanctagcctgtgcaacatnatcatgggactgacgcttatcaccctctncacctgggcatatatccnctactctgncgaatatcgagagctgggtgctgtaatcgaccaggtagctgcagctttgtgggaccagggaagcacaaatgaggcgttatacaagctttacagtgcagcagcaaccca

SEQ ID NO: 7042 - DNA, 484 bp, Mus musculus
  misc_feature (71)..(71): n is a, c, g, or t
  misc_feature (287)..(287): n is a, c, g, or t
  misc_feature (289)..(289): n is a, c, g, or t
  misc_feature (303)..(303): n is a, c, g, or t
  misc_feature (330)..(330): n is a, c, g, or t
  misc_feature (335)..(335): n is a, c, g, or t
  misc_feature (340)..(340): n is a, c, g, or t
  misc_feature (349)..(349): n is a, c, g, or t
  misc_feature (412)..(412): n is a, c, g, or t
  misc_feature (442)..(442): n is a, c, g, or t
ttcatgacaggccagtttccagaggggactcagaagtgtcctgagagggtgtttatttcaaggagaccttnaaagaacatgatctctattctcagataactggggacagtcattgagctggttcaggggacaatcaacttgttctctctgctgctaaaagatcctgtctatgggggacaggttgcaggaggctgtgctttgtgatgggatactgtagctggattgactagacagtggctcagagtcccgtggccacagagcaggaggctacagagcaggaagctatncnaaggagttaggccnttcagaaggcagcctggtttctatgantctcnaggcnaggtggctnccttggttctattgaaattacagctccacctctttgatcttgccaagccaaaatgtatcgctnataggagtggagacaccccagcccgacctntaccttcaagtgcaggtgttgctaacagtgctcaattgagac

SEQ ID NO: 7043 - DNA, 127 bp, Mus musculus
tttgctttactatactgctgacttgaaggacagagaactccagcatttaactgcatctagctgctgtaggtaggaactgctgtttggttttagttttgtaccttgtggcctggtttgtaaataaaat

SEQ ID NO: 7044 - DNA, 361 bp, Mus musculus
acctcctctgcttatcgtattttatcagcagcattccaccattgaccctatgtggaatgtccgccatcttggttccagtgctggaaaacggtactcaccccagtttgtaaaagctgccaagttacttcactggaatggtcacttcaagccttggggaagaactgcttcatatgctgatgtttgggaaaagtggtatattccagacccaacaggaaaattcagtttaatccgaagacatatggatacctcaaacataaagtgaactacaatttaagctaattgcgtcactcaggaaactctggaagacacactatgtgggaaggtaacagttgtagggcttgagtttctctataccaaccac

SEQ ID NO: 7045 - DNA, 525 bp, Mus musculus
  misc_feature (293)..(293): n is a, c, g, or t
  misc_feature (347)..(347): n is a, c, g, or t
  misc_feature (405)..(405): n is a, c, g, or t
  misc_feature (411)..(411): n is a, c, g, or t
  misc_feature (494)..(494): n is a, c, g, or t
ctgctggcatgattgagacacactttggaagagcatgagttccatgtaaggtgagactgtgactttgagtgcagatgacacagcacttcaggggagggtcaggggctccagacagtaagcataaggcacttaccgcaagcagtggatggcaccaacttttaaaggtgactttattaatcaatggtttcaccgctaaattatatttttacagatatgcacctatgcaacttaatgtggctcttctaagcaggtgaggacctcctcctcaatgctctataaagtgtttgtgttcntgtatagtgagtttcccagtaaatgtggcttaatactttaattcttaggatgtntctttctacgtgatgcagctactaaattctgttttgtttgtggaatgactagcacagnccgacnccctctttccctcacttaccagaagaccaatgagctgttaatgagcggttatctccatggtattactgctaaatgcactgatntcataagtatgtggaatccttttccttttga

SEQ ID NO: 7046 - DNA, 464 bp, Mus musculus
  misc_feature (357)..(357): n is a, c, g, or t
aaaagatgcagcgtcaagcctcccttcctgactgtggcccgccttttcccaggaggagcttcccaaagccttgtcctgcagccactgcagtgtgatggaagcctcaggcacacagtagtcattggtgatctcaagtcatagtgaacatgccagtgcaggatgcaccccccctcacccccgagtccttacaggcagatccctgcaggctatcaagagaagtggtggatgatcatctgttagaccagggatagtatacaggacccatctgaaagcatttttttttcctctcaccactcaacaaatggacagtttattcccaaggacggtgttggggagaggcaggcagggccaggaggntcttggaggactttgaacaggtggaacccatctgtccctccctatttctcaagggccacaaatgactccacaggtggttataggattaactaccagttcattctcaa

SEQ ID NO: 7047 - DNA, 364 bp, Mus musculus
  misc_feature (74)..(74): n is a, c, g, or t
  misc_feature (96)..(96): n is a, c, g, or t
  misc_feature (147)..(147): n is a, c, g, or t
  misc_feature (293)..(293): n is a, c, g, or t
  misc_feature (319)..(319): n is a, c, g, or t
  misc_feature (332)..(332): n is a, c, g, or t
ggtttgatctattttcggatgtacatgctgtctgtctctgggatgataaaggctcatcaaaaattcatcaggcntttaaaagaagatattcttgantttattaagcaagcacaggctcgtgtactgagccatcaagatgacacagcntttgctgaaggcatatattgttgaatggcggaaattcttcacacagtgtgatattttaccaaaacctttttgtcaattagaggtgactctattgggtaaacaaagcagcaataaaaaatcaaatatggaagacagtattgttcganagctcatgcttgatacgtggaatgantcgattttttcanatataaagaacagactccaggacagtgcaatg

SEQ ID NO: 7048 - DNA, 420 bp, Mus musculus
  misc_feature (60)..(60): n is a, c, g, or t
  misc_feature (205)..(205): n is a, c, g, or t
  misc_feature (323)..(323): n is a, c, g, or t
  misc_feature (345)..(345): n is a, c, g, or t
  misc_feature (358)..(358): n is a, c, g, or t
  misc_feature (371)..(371): n is a, c, g, or t
  misc_feature (375)..(375): n is a, c, g, or t
  misc_feature (380)..(380): n is a, c, g, or t
atgcagcttcaggtcttttatgccgccctggatcaaatctaccatggccagcatcccctngaagaagtcaaccacagatatcctcatggaaacacaagagcagttctatggcttgccctatgttcctgacactgcctggcagctgaggttcagccacctcgtgggatatggtgccaagtattactcatacctgatgtccagggcngtggcatccatgatctggaaggagtgcttcctacaggatccttttaacagggccgctggggaacgctaccgcagagagatgttggcccatggtggaggcaaggagcccatgcttatgnttcaaggcatgctgcagaagtntccttccatcgangactttgtggatncccntcgtntctgacatgaatctggactttgaaacgttcttcctggatt

SEQ ID NO: 7049 - DNA, 319 bp, Mus musculus
  misc_feature (293)..(293): n is a, c, g, or t
gtgtctcctatcatctgagtcctgaggagaacagtgcccctgatgccctcgtccgggacaaggcccaccacacactggcagaactgaaacgccagcgagcggctgcaaagcttcagcgacctgcccctgaagggcctgagacttttgagcctggcctgtctgttgatgctgggacctcccagcctgactgtggcttcagcacaattggggacccgcccctgctcaagctcactgctccctcggaggaggcgtctgtggagaagaggccgtgttgcttgctcatgtgaaatgtngattcctcagtatggcagggttcaac

SEQ ID NO: 7050 - DNA, 503 bp, Mus musculus
  misc_feature (46)..(46): n is a, c, g, or t
  misc_feature (181)..(181): n is a, c, g, or t
  misc_feature (311)..(311): n is a, c, g, or t
  misc_feature (352)..(352): n is a, c, g, or t
  misc_feature (432)..(432): n is a, c, g, or t
  misc_feature (474)..(474): n is a, c, g, or t
tggtggtgggacagttacccgtacttgctcatggattgtgttaccntttgaccggcctgttgaagggtgtgaccctagtagacactacagaggtttaagcactacagtgacatgggctgtcctgaacgaacttttatacttgaactcagacactgcatgtggatatcagtgctggcatttntgtggtatacagaagccaggctggaggctagctggtcaggacagcgagggtcagtgggagcagctgtttgatggtgggttttgatatgctagagttacagactgcagcgtgtggcagttagcatcagtanccttaaggttgttgtgaccttcctgtgcttgggaatcttantggtttcctttccttgttggagccctggagtgagtgaggaagctgagacttggggtgcatggaaagctgcacagcttctntcctggcacctccccatccgcagggatgagtcactctgggtnccgtgctcagttctcatgtttgtgttttt

SEQ ID NO: 7051 - DNA, 337 bp, Mus musculus
  misc_feature (291)..(291): n is a, c, g, or t
  misc_feature (297)..(297): n is a, c, g, or t
atgtgaatgtcactcaggtatttgtggacactgtaggaatgccagagacataccaggctcgattacaacagcactttcccgggatagaggtgacagtcaaggccaaagctgactccctgttccctgtggtcagtgctgccagcatctttgccaaggtggcccgagacaaggctgtgaagaactggcagtttgtggaaaatttacaggatctggactccgattatggctcaggctatcccaatgatcccaagaccaaagcctggctgaggaaacatgtggaccctgtgtttnggcttnccccagtttgtacggttcagttggagcacagcccaggcca

SEQ ID NO: 7052 - DNA, 188 bp, Mus musculus
ccaaggctgaggatgtgtctgccatggaggaggccaattttttagaggagccactagccaaagatgagaggaccctaaacaaggcactccccaaaaagctgccttctgaaagggcgggtccccaaaagcaggtgcttccccaagagtcagcccccaccccccaagtgccacacactatccagcagatg

SEQ ID NO: 7053 - DNA, 533 bp, Mus musculus
  misc_feature (119)..(119): n is a, c, g, or t
  misc_feature (330)..(330): n is a, c, g, or t
  misc_feature (364)..(364): n is a, c, g, or t
  misc_feature (407)..(407): n is a, c, g, or t
  misc_feature (427)..(427): n is a, c, g, or t
  misc_feature (498)..(498): n is a, c, g, or t
  misc_feature (508)..(508): n is a, c, g, or t
ggacatctgggcagacccctatcagctgcctgagtccagtcagcagccagttgacttcagagacgtgggctgcctccctttcctctggggaaagctagaggaagcagacagcccccctncttgctgaagccatggttcatgattgaagtgtttgtactagtgaacccatctcagaaccaccttgggacagttcaaagtggtgggtcagactgtaggtcagtatttttatcagtgtcttcctaggtaagggctaagaagatcttaaaactcgggggagagggactccactgtgacaatcctttgaccctgcctcatttcagccctaccttnggcgttctgtagacaccttgttcattgttcaaanccaaagttattccatatgaaagggcatgctcctttcttcccancctacacagacgaacccttncccaggttaggataaacacaatgggcccggaaaggagctttgtgtccagagacagagggggaggagggtancccttgattntcaactgttgctgctctttagaaaa

SEQ ID NO: 7054 - DNA, 534 bp, Mus musculus
  misc_feature (393)..(393): n is a, c, g, or t
  misc_feature (424)..(424): n is a, c, g, or t
  misc_feature (487)..(488): n is a, c, g, or t
  misc_feature (497)..(497): n is a, c, g, or t
cagcctcatgcagcagaccagaatatccagactgtcttttgggggctggatagaggaacctctcaattttgcgctgataagaaaatagccaattcatgggaattacacacttgagagtgtggtgacccgcagctgaaaggtgagcttggagaccaagccagaaggttggtaacatgctggggcttgcgttgtagtcctgccgggcttgcaggccagttccttccatagggttaagattaactggtacaaaacaatcactgcaccactgcgaaagacctgaaggagttccagaaagggcaaagcagcttcccagtgtcctcctggccttggcagtgtccccagccaggagcccttccactcccaacactgggagcaggcttcaccaggctgctntcataagccatttgttgagggggcctggatntcagggttcccatggtggtggtgactgtgggaagagagcagtactacttcctactttcctatnnaagtatttntctgtatgttttatatacctcattctgacacctgtgt

SEQ ID NO: 7055 - DNA, 231 bp, Mus musculus
aggtgatgtctatggctcggccacagctgtcacacacgatcctcactgagaagaattggttccactacgctgcccgcatctgggatggggtgaagaagtcctcagccctggcagagtacagccgcctgctggcctgatgccgagggagcagcagcatgcagggaactgccctgtcctgtgggctgtcctgtggacagtgagggcacagccaccctccagcaagggaggaga

SEQ ID NO: 7056 - DNA, 542 bp, Mus musculus
  misc_feature (61)..(61): n is a, c, g, or t
  misc_feature (76)..(76): n is a, c, g, or t
  misc_feature (274)..(274): n is a, c, g, or t
  misc_feature (282)..(282): n is a, c, g, or t
  misc_feature (299)..(299): n is a, c, g, or t
  misc_feature (349)..(349): n is a, c, g, or t
  misc_feature (353)..(353): n is a, c, g, or t
  misc_feature (355)..(355): n is a, c, g, or t
  misc_feature (362)..(362): n is a, c, g, or t
  misc_feature (376)..(376): n is a, c, g, or t
  misc_feature (378)..(378): n is a, c, g, or t
  misc_feature (390)..(390): n is a, c, g, or t
  misc_feature (414)..(414): n is a, c, g, or t
  misc_feature (458)..(458): n is a, c, g, or t
  misc_feature (460)..(460): n is a, c, g, or t
aaaggaccctctattctgatgtgattgaaagtggcttgcagaaaaggcccttttttttttnctcatcagatcaccntaatagtttatgccccgtataaaatgtaactgatctaaaaataataatagagaatttatacttatttttactttaaaagccatggaagacggttatgtatcttaaactgtctagagcatttttgaaagcacttgtcttgtgtacgtgcatattataccgtgacagctttcatcgtcttgtctctcgtcagtagacctncagtacantctgtgggagatgtcantcaagttgttcagcaccagcatctgtccagatgttcagtatctgtggctnaggntnctgtatntgagggatgtgttncnattttctttacnaacactagagcacacagtagaagnatagtagtttcattagtaatatgacacatgtatatagtgagatntnttcattgtgtgctttgcatattttgtaaatattttgcacgtcattattttccttttttgtttgagcagtgtttggcctggaa

SEQ ID NO: 7057 - DNA, 416 bp, Mus musculus
  misc_feature (113)..(113): n is a, c, g, or t
  misc_feature (131)..(131): n is a, c, g, or t
  misc_feature (291)..(291): n is a, c, g, or t
  misc_feature (339)..(339): n is a, c, g, or t
  misc_feature (357)..(357): n is a, c, g, or t
ccagcagcaggctcggttcatccagccccggccaactctcaatcagcctcctccacctctcattcgccctgctaactccatgccaccccgcctaaacccaagaccagtgttgnccacggttggcggtcagnagccaccttcactcattgggattcagacagattcacagccttcactgcactaattacgctggacaaaggctcacctatcattgtaccagtgctcatctgactgatccaaacaaggcaaactagtccttcctgtggcgggggtctagcctaagagggtgcncacacacgggaagtgtggcggtggactagtgtaagtggtgtgacacancaggaggcctctgtttgncctcctttctagtgcccactgtgatctcatgggaagaaaagtattctgtctaccaaggg

SEQ ID NO: 7058 - DNA, 547 bp, Mus musculus
  misc_feature (36)..(36): n is a, c, g, or t
  misc_feature (62)..(62): n is a, c, g, or t
  misc_feature (67)..(67): n is a, c, g, or t
  misc_feature (129)..(129): n is a, c, g, or t
  misc_feature (161)..(161): n is a, c, g, or t
  misc_feature (253)..(253): n is a, c, g, or t
  misc_feature (330)..(330): n is a, c, g, or t
  misc_feature (356)..(356): n is a, c, g, or t
  misc_feature (405)..(405): n is a, c, g, or t
  misc_feature (409)..(409): n is a, c, g, or t
  misc_feature (422)..(422): n is a, c, g, or t
  misc_feature (516)..(516): n is a, c, g, or t
ttgggtctctctagggtcatgctcgggcggcacaancgtcactgatgtggcttttggctttnttctngggctacatgcagtacagcattgtggattattgctggctgtcaccccacaatgttccagttnctttttgtactgtggaatcaacagtgacaccnatctcattgattattgacaccttgaggtctgaaggattccacactcgaggatgctgacctaagccagagccatctagttgcccctctgggcnaactttgggaattctgggatcccactgtcttgacaggttcctagaccggagcgcatgctggctattactgaacacgnccatacttgagaaacaaagtctactntgtatttgacagctatttatcaccaagacaactgtaaagaaatcaagcnggcngactgtatgattnctatttacttaaagttgacaacgttaatgagtaattcccctcaccccccaaaaaaacaatgttattacttgtaaattaaaatttaagagccatnagctagataaaccatgtgctattcccaccct

SEQ ID NO: 7059 - DNA, 588 bp, Mus musculus
  misc_feature (92)..(92): n is a, c, g, or t
  misc_feature (139)..(139): n is a, c, g, or t
  misc_feature (143)..(143): n is a, c, g, or t
  misc_feature (149)..(149): n is a, c, g, or t
  misc_feature (228)..(228): n is a, c, g, or t
  misc_feature (292)..(292): n is a, c, g, or t
  misc_feature (308)..(309): n is a, c, g, or t
  misc_feature (311)..(312): n is a, c, g, or t
  misc_feature (315)..(317): n is a, c, g, or t
  misc_feature (320)..(320): n is a, c, g, or t
  misc_feature (339)..(339): n is a, c, g, or t
  misc_feature (341)..(341): n is a, c, g, or t
  misc_feature (343)..(343): n is a, c, g, or t
  misc_feature (346)..(346): n is a, c, g, or t
  misc_feature (353)..(353): n is a, c, g, or t
  misc_feature (358)..(358): n is a, c, g, or t
  misc_feature (368)..(368): n is a, c, g, or t
  misc_feature (374)..(374): n is a, c, g, or t
  misc_feature (376)..(376): n is a, c, g, or t
  misc_feature (378)..(378): n is a, c, g, or t
  misc_feature (392)..(392): n is a, c, g, or t
  misc_feature (397)..(397): n is a, c, g, or t
  misc_feature (402)..(402): n is a, c, g, or t
  misc_feature (414)..(414): n is a, c, g, or t
  misc_feature (452)..(452): n is a, c, g, or t
  misc_feature (469)..(469): n is a, c, g, or t
  misc_feature (508)..(508): n is a, c, g, or t
  misc_feature (510)..(510): n is a, c, g, or t
  misc_feature (514)..(514): n is a, c, g, or t
  misc_feature (534)..(534): n is a, c, g, or t
  misc_feature (551)..(551): n is a, c, g, or t
cttcatttagcctgggctggtgacccgggctcctgcacctggcctcttgctgtccttaggcggcatcagggtgcctctcctcagcactcctngacatctttgtttgcctaatttatatatataatatacaaatatatantaancataanctattttgcttaaatttctatgatacgtgaaagtgaaaaatgatgaagacaggagtgcctgtctgagtttggcctcctngtcggccctgccctcaccttgtagtcctcccagtggcttctgccaaccttagacctgaaacctntccctcagaccctcanncnnccnnnccnatttcacttcagtttgatntngnaanttccttncaggncctttctttntactcncngncctggttttgattnttttnttttnttttttatttanaaaaagattgagaaagagaaaacaccacgtatgaaatnccttacaacacccactntagagacggggtggggaaggagagggagagggcacctgntntccntcagagctgggctgtacctnttcccagcaggcgtgancaaacaccttctgaccacaataaaacccttgttctgg

SEQ ID NO: 7060 - DNA, 550 bp, Mus musculus
  misc_feature (323)..(323): n is a, c, g, or t
  misc_feature (342)..(342): n is a, c, g, or t
  misc_feature (352)..(352): n is a, c, g, or t
  misc_feature (355)..(359): n is a, c, g, or t
  misc_feature (362)..(362): n is a, c, g, or t
  misc_feature (381)..(381): n is a, c, g, or t
  misc_feature (383)..(383): n is a, c, g, or t
  misc_feature (389)..(389): n is a, c, g, or t
  misc_feature (396)..(396): n is a, c, g, or t
  misc_feature (399)..(400): n is a, c, g, or t
  misc_feature (402)..(402): n is a, c, g, or t
  misc_feature (508)..(509): n is a, c, g, or t
  misc_feature (511)..(511): n is a, c, g, or t
  misc_feature (514)..(514): n is a, c, g, or t
  misc_feature (522)..(522): n is a, c, g, or t
aaggcccactacgtgctgtcaggttcgtgggatgaccagatggaatgttctaagattgtgcacagcagccccagctctgatgggagacagaaaaccgtgtaccagacactgcccgccaaactgctctggaggaaatacccactgccggagaatgcggagaacatgtactatttctccgagctagccctgaccctcaacgagcaggaggacggcgtggcgcccaccgacagtcgcctgcggccagaccagcggcttatggagaggggacgctgggacgaggccaacaccgagaagcaacggctggaggagaagcagcgcctgtncaggcgacggcggctggantcatgcacgncannnnncgntggggaggaagagaaggantnagatgnctatgtnccnntntggttcgagaagaggctggacccgctgactggggagatggcctgcatgtacaagggcggctactgggaggccaaggagaagaaggactggcacatgtgccccaacnntnttntgagccantcctgcggcaaatacaggcgcctgcact

SEQ ID NO: 7061 - DNA, 487 bp, Mus musculus
  misc_feature (267)..(268): n is a, c, g, or t
  misc_feature (271)..(271): n is a, c, g, or t
  misc_feature (273)..(282): n is a, c, g, or t
  misc_feature (285)..(285): n is a, c, g, or t
  misc_feature (287)..(290): n is a, c, g, or t
  misc_feature (329)..(329): n is a, c, g, or t
  misc_feature (350)..(350): n is a, c, g, or t
  misc_feature (398)..(398): n is a, c, g, or t
  misc_feature (408)..(408): n is a, c, g, or t
  misc_feature (415)..(415): n is a, c, g, or t
  misc_feature (454)..(454): n is a, c, g, or t
gacagatctgatggcctgggctcgagccactttgctgttccctgatgcacagttctcattctcctttgacacctttcctaaatggcatctatttaatcagatcatttatttacagattccaagtttttcagaaaaggaggcacatctcattttgtattagatataatgagttcataaattattactggcaaatgttatcaaacttagtcataacccgaattctcttactgaacaagagaaataagtcaatgttctgctgtcctcctnnttnannnnnnnnnnaantnnnnctttgaagttcttttcaatgtgttacattgtatcctttntccttcaagcatcttcccttnatgtgtttttgctcaggcaaccatgggcatagagtattgaaaaacatncagtgctttngtatagnccatctgtacataaaagtgtaattatttatttaattttntcatttgtaccatattaaagctttgtacagtgt

SEQ ID NO: 7062 - DNA, 423 bp, Mus musculus
  misc_feature (265)..(265): n is a, c, g, or t
  misc_feature (270)..(270): n is a, c, g, or t
  misc_feature (303)..(303): n is a, c, g, or t
  misc_feature (309)..(309): n is a, c, g, or t
  misc_feature (332)..(332): n is a, c, g, or t
  misc_feature (339)..(339): n is a, c, g, or t
  misc_feature (343)..(343): n is a, c, g, or t
  misc_feature (348)..(348): n is a, c, g, or t
  misc_feature (352)..(352): n is a, c, g, or t
  misc_feature (356)..(356): n is a, c, g, or t
  misc_feature (363)..(363): n is a, c, g, or t
  misc_feature (366)..(366): n is a, c, g, or t
  misc_feature (371)..(371): n is a, c, g, or t
  misc_feature (378)..(378): n is a, c, g, or t
  misc_feature (382)..(382): n is a, c, g, or t
  misc_feature (392)..(392): n is a, c, g, or t
  misc_feature (394)..(394): n is a, c, g, or t
gagtaggccatgacaaacacttgcttaacaccaactgatagaatcctttgtcagtatgaatttttctgtttctctttcatgatggatgttctagtcagaatgaacctgtcattagccgctaagcaagacaggcaccatcagggacagaatcctaggttgatgcaccttcagggtatcctttctttatttgcagctaaggctctatggcttaagagcattccttggggcgtgtctactcattagtttttgctctgcaagctccagnatgtntctactatagcctcttttaaaactatgaccttnaactgnatctgctcagggatgtactcctnaactaancctnccccnttgntcantcctggnccnatccntacgtgnatgngtataggctntncggaatacaattcccatgcttgctttatt

SEQ ID NO: 7063 - DNA, 353 bp, Mus musculus
  misc_feature (65)..(65): n is a, c, g, or t
  misc_feature (69)..(69): n is a, c, g, or t
accaactggtgcagcgctgtcagcaggcatacatgcagtacatccatcaccgcttaattcacctngacntcctgccgactacgacgactttgtgaatgcaatccgcagcgctcgcagcgccttctgcctgacacccatgggcatgatgcagttcaacgacatcctacagaacctcaaacgcagcaaacagaccaaggagttgtggcagcgggtctctctggagataaccaccttctccccctgagtctggtccctggagggccctatttagggacacaggcctgtggctatggggagccctcacacagagggtcaggcgactcttggctggacagatcatccccactcaattc

SEQ ID NO: 7064 - DNA, 101 bp, Mus musculus
cgaagtgctctgaaggtgagtccaagatccctcctccattcttctgcatggaggcctccctctccccttcctctccacttcaacaccatctccaggaggcc

SEQ ID NO: 7065 - DNA, 322 bp, Mus musculus
  misc_feature (252)..(252): n is a, c, g, or t
cagtgcttcagagaggacgcgccaggctgcagcagtgctgtggcagcaggtcgcagtctcatgcttggttaggaggatctgccacaaggtggattactgaccctgcactggcttggccacatggccaggttcaggtcaggtgggcgctggactgaccttctgcagagaacacgccccaccctactgcagcctgtgggccacatggcagccttctgacggtgtggatttttaaactgtgtttataatgtattnctaagttattttgtaaggtcctgtttgaagtgctgctgctagccctagttgctctcccagtttttattgt

SEQ ID NO: 7066 - DNA, 444 bp, Mus musculus
  misc_feature (68)..(68): n is a, c, g, or t
  misc_feature (70)..(70): n is a, c, g, or t
  misc_feature (72)..(72): n is a, c, g, or t
  misc_feature (156)..(164): n is a, c, g, or t
  misc_feature (179)..(179): n is a, c, g, or t
  misc_feature (284)..(284): n is a, c, g, or t
  misc_feature (388)..(388): n is a, c, g, or t
acacccggctgaaacactgtgtggcagacagcaacatcgtcaggtggttctggcaggcggtggagacntncnatgaggagaggagagccagactcctgcagtttgtgacaggatccacaagagttcctctccaaggcttcaaggctctgcaaggcnnnnnnnnngcggcagggccccgnctgttcaccattcacctgatagacgccaatacagacaacctgcccaaggcccatacctgctttaatcggatcgacatcccaccctatgagtcctatgagaagctntatgagaagctgctgacagcggtggaggaaacctgtggctttgcagtggagtgaagagcagccagtggccacagagtcttgctcacaaccaccagacccaaagncatatggcgtctgcacgcctcccgcgtggcgggctgaggcctgagattccagaaac

SEQ ID NO: 7067 - DNA, 357 bp, Mus musculus
  misc_feature (310)..(310): n is a, c, g, or t
  misc_feature (328)..(328): n is a, c, g, or t
agttctttcggatctccttggacacgaaaaccatgagatccagccgtatgtgaatggagccctgtacagcatcctctccatcccgtccattcgagaggaggccagagccatgggaatggaggatatcctgcgatgcttcatcaaagaaggcaacgctgaaatgatccgccagatagagtttatcatcaagcagctgaattctgaagatttactcgatggtgttcttgaatccgacgatgatgaagatgaagatgatgaagaggatcatgacatcatggaagctgacctggacaaagatgaactgatccanccccagctgggagaactntcaggcgagaagcttctaaccacagagta

SEQ ID NO: 7068 - DNA, 487 bp, Mus musculus
  misc_feature (26)..(26): n is a, c, g, or t
  misc_feature (305)..(305): n is a, c, g, or t
  misc_feature (338)..(338): n is a, c, g, or t
  misc_feature (349)..(349): n is a, c, g, or t
  misc_feature (356)..(356): n is a, c, g, or t
tagaacgtgaactcgatgagggccgntacggtgtgtatgaagacgaaaactatgaagtagaaagtgatgatgaggagataccattcaaatgtttcatctgtcgccaaaccttccagaatccggttgtcaccaagtgtaaacattatttctgtgagacctgtgcactgcagcatttccgaaccactccacgatgctatgtttgtgagcaacagacccatggggttttcaatcctgcgaaagaactgattgctaaactggagaagtatcgaaaagcagagggtggtgcttccagcaccccagaagancgccgatgggatctaattgccattacttagatntcccataattntcaaatntcaaagtactttttgttttggtcatctcaaaccaaagcaatcacagttgaagaaatactaagttttctaggaagaatatccaagttttgttttatatgacatgctggagatggaatcaatacagttaactt

SEQ ID NO: 7069 - DNA, 554 bp, Mus musculus
  misc_feature (153)..(153): n is a, c, g, or t
  misc_feature (211)..(211): n is a, c, g, or t
  misc_feature (379)..(379): n is a, c, g, or t
  misc_feature (412)..(412): n is a, c, g, or t
  misc_feature (440)..(440): n is a, c, g, or t
  misc_feature (466)..(466): n is a, c, g, or t
  misc_feature (468)..(468): n is a, c, g, or t
  misc_feature (480)..(480): n is a, c, g, or t
ggatcacacattggagccttcatagcagccatgaaggctgttgagatcccagagaaggtgccgcactcccaagcccgaaaactggcggataagcagcttagttcggttgtcaaggaagcgggcattcggcagttcctgctcactaacctggtnagaggtgggtgggcgattctcctggagactgaacttggatacgttagctcagcacttnggacaagataatgacctttcctcagcaacgtgaaccctactcggggccaactctcttcctgcttggtggaaattctacatatgtacaacccagccaccactcagagattaggcgactcttccctcaagcccagattcagaccgtgcctaacgctggccactgggtccnacagcgacaaaccccaagacttcatggatgctntcaccagcttcttggcttaagaagtagntccttggaagagcagccaggggactntnaggcttgggatntgtgccatcttgcttctgcacagaaaaactcaggggcacggagagggtccaggagtacagaagtggcccaacac

SEQ ID NO: 7070 - DNA, 306 bp, Mus musculus
gggaatgttggacttcatatcagatatggtgagtccaaatcagtgtcttgaatcctttgaaaacaggcagtgggacgcgcaggcttcagcacctgcagcattagctgcagacataagtgtgcatccagaccagagacaacttagaaatgtcagagaacatcctttcggatcctgtggagtaagagagagagcactaagcgatagaaccgtgaagccgagcaccaggaccgcgcatccacttgggaaccgagttgagcaaacagcatgaactgtttgcagttgatgccttacttcctaatgtgtact

SEQ ID NO: 7071 - DNA, 71 bp, Mus musculus
ccattgtggcattggtgtacaacgtgttgaaggcatttatggaaatgaacagcactatgtttgatgagctg

SEQ ID NO: 7072 - DNA, 547 bp, Mus musculus
  misc_feature (96)..(96): n is a, c, g, or t
  misc_feature (268)..(268): n is a, c, g, or t
  misc_feature (278)..(278): n is a, c, g, or t
  misc_feature (288)..(288): n is a, c, g, or t
  misc_feature (292)..(293): n is a, c, g, or t
  misc_feature (296)..(296): n is a, c, g, or t
  misc_feature (298)..(298): n is a, c, g, or t
  misc_feature (301)..(302): n is a, c, g, or t
  misc_feature (309)..(309): n is a, c, g, or t
  misc_feature (318)..(318): n is a, c, g, or t
  misc_feature (331)..(331): n is a, c, g, or t
  misc_feature (333)..(333): n is a, c, g, or t
  misc_feature (345)..(345): n is a, c, g, or t
  misc_feature (350)..(350): n is a, c, g, or t
  misc_feature (360)..(360): n is a, c, g, or t
  misc_feature (398)..(398): n is a, c, g, or t
  misc_feature (402)..(402): n is a, c, g, or t
  misc_feature (422)..(426): n is a, c, g, or t
  misc_feature (428)..(430): n is a, c, g, or t
  misc_feature (432)..(432): n is a, c, g, or t
  misc_feature (465)..(465): n is a, c, g, or t
atcaatggctttgctttaccactcaaggcagaacacaaacagttcctggtgaaagtgttgatccctctacacactgtcaggagcttgtcactcttncatgcacagctggcgtattgtatagtacagtttctggagaaagacccttcccttacagaaccagttattagggggctaatgaaattttggcctaaaacatgcagtcaaaaagaggtcatgttcctcggggagctggaagaaatcttggatgtgattgaaccgtcacaatttnttaaaatccnagaacctttntttnnacnanttnnccaagtntgtttctancccccattttcangntggcagaaaggncactntattattggnataatgaatacatcatgagtttgatagaagaaaactcnaacntcatccttcccatcatgttnnnnncnnncntttataggatttcaaaagagcattggaatccgnccattgtggcattggtgtacaacgtgttgaaggcatttatggaaatgaacagcactatgtttgatgagctgacagccacata

SEQ ID NO: 7073 - DNA, 487 bp, Mus musculus
  misc_feature (50)..(50): n is a, c, g, or t
  misc_feature (144)..(144): n is a, c, g, or t
  misc_feature (210)..(210): n is a, c, g, or t
  misc_feature (281)..(281): n is a, c, g, or t
  misc_feature (306)..(306): n is a, c, g, or t
  misc_feature (318)..(318): n is a, c, g, or t
  misc_feature (321)..(321): n is a, c, g, or t
  misc_feature (346)..(346): n is a, c, g, or t
  misc_feature (348)..(348): n is a, c, g, or t
  misc_feature (350)..(350): n is a, c, g, or t
  misc_feature (353)..(353): n is a, c, g, or t
  misc_feature (422)..(422): n is a, c, g, or t
  misc_feature (441)..(441): n is a, c, g, or t
aacctgaatggacgaacaggagcagaccagcaaccatgagacccaacaanttcaggactcagcgactccagcaagagctgaaatgtccacatcccaggaagagagcctcctgcagaatgagtttccacctcaggagccccctgntgaactccatccccaacatccacagtctaccttgaatgaatcttcttacactcagtacatttacanggtgtgaatgggaggaagccagtgagccagctgattcagggtgttgttccctttcctgttctggcaacacntcttgagaaacaactgaggtgactncccctccaacancantccaagaggagatacaggctgtagntntntantccttaacatgcagtgaaagggtgctgatgttcaatcattttctgttcaagttttggttaaagttttgntctttattgttttatttantttttaggttttgctgaagttatatgttcttatttggttttcatgg

SEQ ID NO: 7074 - DNA, 520 bp, Mus musculus
  misc_feature (79)..(79): n is a, c, g, or t
  misc_feature (100)..(100): n is a, c, g, or t
  misc_feature (284)..(284): n is a, c, g, or t
  misc_feature (341)..(341): n is a, c, g, or t
  misc_feature (368)..(368): n is a, c, g, or t
  misc_feature (373)..(373): n is a, c, g, or t
  misc_feature (418)..(418): n is a, c, g, or t
  misc_feature (438)..(438): n is a, c, g, or t
tgttcggccccgagagaagcctctaggccgcagccagagccttcgggtggtcaagaggaagccattgactcgagagggncacctcacgctccctgaaggntccgaacccggaaaaaggccatgccctcagacatggacagctagagtctgcagattgaggccaccttacctctggagccagcaggggacctttcgctgctacaccagctaccggggttctgctccgtctggcttgtgcctaaatggcacatggcgtggtaccctgcacagggagacattcactntaccaaagcagcccaggcctggggcctatttattgccttcctctgccttttactttntcagacacgggaccagagccccaccantcccnaccgacgaaaccaaaagtccaaccagctgtgttcattccttcttntccttcaaaatacttgacanccttttccaaggcctggtgtgtgtgtgtgtgtgtgtgtgtgtgtgtgtttacgtacactagctgcatgtttcgtgttggtga

SEQ ID NO: 7075 - DNA, 562 bp, Mus musculus
  misc_feature (325)..(325): n is a, c, g, or t
  misc_feature (414)..(414): n is a, c, g, or t
  misc_feature (527)..(527): n is a, c, g, or t
ggatcaagactgtattttgcttcaaaggtgttgacgccctattactacactatagatgttgaagttaaattagatgaagatggatttgtattgccgtgtacagtggatgaggatatccacaaaagggtggcgctgtgtattgatgggccacagcgattttgcttggacagtaaacacttacttggaaaagaggctactaagcagagacacctgcggttacttggttaccaggttgttcagcttccctatcatgagctggagctgcttacatcaagacttgagttggtggactatttacaaaggaagctgttttctcaaagctccnctgtccactggtaatagaggaaactggcttcaggattctcggtgaaaaagatgatatttgtaagagagacagtttaatctgtgaattanccactctatggaaattatgtttacagacttgggatctgaaaagggtctgcggtttttcttataccatgtatatgtgtattggtggtaaatttggaattaatttaatgctagtntcttagatgccttcaccgcatcgagcaggattatt

SEQ ID NO: 7076 - DNA, 122 bp, Mus musculus
gaaacattagaaagctctcgagccgcctcgcccagatctgcagcagcatacggacgggccgatgagaggacaacaggacacacagtggcagcagggactgtggtagcagagtgcacacatct

SEQ ID NO: 7077 - DNA, 139 bp, Mus musculus
gtggagtgactgagaaccgtctatggttcaaggtcccactggggataaactgcttagagcactgtcctagagggcaagtgtagccttcgcctccgggcccaggcaggctatgcagtcagcagtagggtctgtgctccat

SEQ ID NO: 7078 - DNA, 488 bp, Mus musculus
  misc_feature (40)..(40): n is a, c, g, or t
  misc_feature (73)..(73): n is a, c, g, or t
  misc_feature (124)..(124): n is a, c, g, or t
  misc_feature (150)..(150): n is a, c, g, or t
  misc_feature (155)..(155): n is a, c, g, or t
  misc_feature (161)..(162): n is a, c, g, or t
  misc_feature (172)..(172): n is a, c, g, or t
  misc_feature (187)..(188): n is a, c, g, or t
  misc_feature (204)..(204): n is a, c, g, or t
  misc_feature (214)..(214): n is a, c, g, or t
  misc_feature (216)..(216): n is a, c, g, or t
  misc_feature (244)..(244): n is a, c, g, or t
  misc_feature (259)..(259): n is a, c, g, or t
  misc_feature (261)..(261): n is a, c, g, or t
  misc_feature (265)..(265): n is a, c, g, or t
  misc_feature (269)..(270): n is a, c, g, or t
  misc_feature (287)..(287): n is a, c, g, or t
  misc_feature (309)..(309): n is a, c, g, or t
  misc_feature (319)..(319): n is a, c, g, or t
  misc_feature (321)..(321): n is a, c, g, or t
  misc_feature (327)..(327): n is a, c, g, or t
  misc_feature (331)..(331): n is a, c, g, or t
  misc_feature (350)..(350): n is a, c, g, or t
  misc_feature (360)..(360): n is a, c, g, or t
  misc_feature (363)..(363): n is a, c, g, or t
  misc_feature (454)..(454): n is a, c, g, or t
  misc_feature (457)..(457): n is a, c, g, or t
aaaggtgttggcacgctgtatttaaaatccacagccaatnagaagacgaagctcttagtgcgggatactaagntaggcagcatactcctgaatattctgatcccacccgatatgccatgttccnggatggggaaaaataacgtccttatngtctntgtacnngacccaccgnttgataagaagaacnncaccatcaaggtcacnatgctaattngngtaaaaacaagtaaggatgcggatgaantgcacaaaattttantncagnaaannggatgcctgaacacatngaatccacccggaaacttgccnaagttcctgntnttttgntccntccccaaacgtaatttttnatccttttanttntgataccctaagcgcttccaataacaaaaatgttgtgagcacaattaagaccaacaaaaacttcagtgttcagttgagtgtggagaaaggntcntcccttttaagagccacctaacatgcaaaat

SEQ ID NO: 7079 - DNA, 386 bp, Mus musculus
  misc_feature (70)..(76): n is a, c, g, or t
  misc_feature (277)..(277): n is a, c, g, or t
  misc_feature (296)..(296): n is a, c, g, or t
  misc_feature (300)..(300): n is a, c, g, or t
  misc_feature (303)..(303): n is a, c, g, or t
  misc_feature (305)..(307): n is a, c, g, or t
  misc_feature (312)..(315): n is a, c, g, or t
  misc_feature (348)..(348): n is a, c, g, or t
tagagtgataaaggcgagcatcgctattgacaatggaagagcagctgagttcatccggagacgaaactannnnnnnctttgataaatctaagtgttatgaatgtggggaaagtggacacttaagttatgcctgtcctaaaaacatgcttggcgagcgtgagcctccaaagaagaaagagaagaagaagaaaaggaaactccctgaaccggaagaagaaattgaggaagtagaagtgagtgaagaggaaggagaggacccggctctggacagtctgantcaggccatagcgttccancagnccnannnttgannnnagagcaaagcaaatggagacccaacccaggggntccctcgacctcagatgattccagacgaccaaggataa

SEQ ID NO: 7080 - DNA, 551 bp, Mus musculus
  misc_feature (43)..(43): n is a, c, g, or t
  misc_feature (299)..(299): n is a, c, g, or t
  misc_feature (311)..(311): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (333)..(333): n is a, c, g, or t
  misc_feature (338)..(338): n is a, c, g, or t
  misc_feature (340)..(340): n is a, c, g, or t
  misc_feature (355)..(355): n is a, c, g, or t
  misc_feature (358)..(363): n is a, c, g, or t
  misc_feature (369)..(369): n is a, c, g, or t
  misc_feature (375)..(375): n is a, c, g, or t
  misc_feature (379)..(379): n is a, c, g, or t
  misc_feature (394)..(395): n is a, c, g, or t
  misc_feature (401)..(401): n is a, c, g, or t
  misc_feature (403)..(404): n is a, c, g, or t
  misc_feature (410)..(410): n is a, c, g, or t
  misc_feature (415)..(416): n is a, c, g, or t
  misc_feature (418)..(418): n is a, c, g, or t
  misc_feature (526)..(526): n is a, c, g, or t
agagcaaccagagtcatcccgtttactccagctaccagggtcntcatccaagtcacttgagcccccagagttatccaagttactcaagtcaccagagtcatccgggccactccaaccaccagggtcattcaggcctctcaagccaccagactcatctgggccactccaaccaccagggtcatccaggtcactcgagtcaccagagtcaccagggtcagccaggtcacccaagccaccagagccataatctgcccaaccgcagaaacccaatctatggctcttgaaaccatgtgtccctnccccccacaggnctggntntnatacataggcctnttttntnttctatggggaaacntannnnnntcaggntaaganactnccaaccaaattcctnntgcttntnnccccancaganntncatgagggaaggaggaaaggacgcagcttcaacagcccaaaggccctgatgacccacgagagaagacaggaggcagattacaggagcaaccacaagccccacactgantccacatgcctgaatggagccaata

SEQ ID NO: 7081 - DNA, 402 bp, Mus musculus
  misc_feature (323)..(323): n is a, c, g, or t
  misc_feature (359)..(359): n is a, c, g, or t
  misc_feature (369)..(369): n is a, c, g, or t
gaaggacggcatgttccacggagaaggaaccctgttcttccccagtgggagccgattcgacgccatctggaagaagggattggtggtgaagggcaagtataccttcaatgatgggctgcagtatgaggacaaacactggcactactgtgacagctatgaccggaggttctacaccgagatctgctatggcctgaagccctcaggtatctctcagctcaccaacatggacccacccagaagaattcccctgggctactatgactgtggagatggcttctataaccccacgaccagggtcatcaaggattaccggaaccgctttntgagaaatgctgatgatgacgaacatgagtggattntcaggacctnccgcaagggctggttgccaatgcccaaacagaa

SEQ ID NO: 7082 - DNA, 507 bp, Mus musculus
  misc_feature (62)..(62): n is a, c, g, or t
  misc_feature (68)..(68): n is a, c, g, or t
  misc_feature (102)..(102): n is a, c, g, or t
  misc_feature (106)..(106): n is a, c, g, or t
  misc_feature (108)..(113): n is a, c, g, or t
  misc_feature (115)..(115): n is a, c, g, or t
  misc_feature (310)..(310): n is a, c, g, or t
  misc_feature (347)..(347): n is a, c, g, or t
  misc_feature (350)..(351): n is a, c, g, or t
  misc_feature (379)..(379): n is a, c, g, or t
  misc_feature (386)..(386): n is a, c, g, or t
  misc_feature (397)..(397): n is a, c, g, or t
  misc_feature (399)..(399): n is a, c, g, or t
  misc_feature (403)..(403): n is a, c, g, or t
  misc_feature (422)..(422): n is a, c, g, or t
  misc_feature (482)..(482): n is a, c, g, or t
agggcactgcctaatgtcatactcagctcagtatcccgttcctaaaaccttcgttgggcatnttgctnctgttacctcaggggctcctcccaggtccgtggnactngnnnnnntnccagaactctatcctgcttatgttggactaggggtgctgccaaggaggcctccgccttggagcttagcagctcaggtccctcctcttcccactttgcagggcaggagcgtctcgaaagttccttggtggggacgaagttcggctgatagcaggagtctggaacccctgacgcttacaacttccagcctccctctnaatgagactcttgggagctgtgcacaaagggtgggtncanntgcaacaccaccataaagaagagtggtntcggtgntctcacgatgntnttcnctggctactttatcctgtnctgtaactggagcttcaagcatctgaagctgcagcactggcgtaagtaatggcgagcatntccgggagccacagagagtgacaga

SEQ ID NO: 7083 - DNA, 474 bp, Mus musculus
gggccatgtgattgtactgctccagcaggagtggccacggggagagaaccttttcctgaaagccatcagtaagatttgccagcaaggaaatttccagtatgagaacttcttcagctatgttacaaacattgatatgctggaggaatttgcttatttaagaacccaagaaggagggaagattcatctggaattactcccaaatcaaggaatgctgatcaagcaccacacagtcactcgaggcatcaccaaaggtgtgaaggaggacttccgcctggccatggagcgccaggtctcccgctgtggtgagaacctgatggcggtactacatcgcttctgcattaatgagaagatcttgctcctgcagactctgacctgatagacctcctggccaccagcggctcagccatgacaagcgctgccagaccagggctgatgaagaagaaaaacaccaagttctaactcccttagttgctt

SEQ ID NO: 7084 - DNA, 330 bp, Mus musculus
aggaggacacgctaacacgcgaactggagccccagctgcggcgccggcgctacgagtacgaccactgggacgcggccatccatggcttcagggagacagagaaatcctgctggtctgatgcaagccaggtcatcctgcagcgggttcgggcggctgcatttggtcctgaccagagcctgctatccccagtacatgtgttggacctggaacctcggggctacatcaagcctcatgttgacagtgtcaagttctgtggatctaccattgctggcctttccctgttgtctccaagtgttatgaagctggtgcatacacaggaacctgagcagt

SEQ ID NO: 7085 - DNA, 533 bp, Mus musculus
  misc_feature (503)..(503): n is a, c, g, or t
gcagcgtttaattgaagtccaggatgaactgattcgattagaaccacaactgaaacaactacaaacaaaatatgatgaccttaaggagagaaagtcatcacttaagaagtccaagcatttcttatctaatttaaaacagctgtgtcaagattattcaaacgttcaagagaaaggaccaaagggaacgggaaagtatgattcatctagccttccagctctgttatttaaagcaagaagcattctgggcgccgaaaaccacctgagaaccatcaactatcagctggggaagcttctcgagctggactgagaactgagcctcctgctgccttttctgctcctgaagccatgctcctgacagcagcggcctgtggtgacagtagtgagacctgcttatcagggtgtactaccgttttgtcattcaaactaaattacaccaattcagttgtctaataactcagaaggcatagccatatttttgagtattgtgttaataaatttcagtntcttgacaggttagtcatcaccaggcataa

SEQ ID NO: 7086 - DNA, 300 bp, Mus musculus
  misc_feature (86)..(86): n is a, c, g, or t
  misc_feature (91)..(91): n is a, c, g, or t
  misc_feature (98)..(99): n is a, c, g, or t
  misc_feature (102)..(102): n is a, c, g, or t
  misc_feature (104)..(104): n is a, c, g, or t
  misc_feature (111)..(111): n is a, c, g, or t
  misc_feature (113)..(113): n is a, c, g, or t
tgtgggttcaactcctctataacactaccagtctggcccagcacacctgtgagagatctctgtgccatttctcaggagttacacanttctnctgtcanntgntnttggctntnaggccactggagaaagtacaaggggtgacagggagatagacaggaccctgtgaatctgacatggttcatgtgtggatacagtcagtactgcgccctgctaacacattggtctttccactagtattaagctgagccctgcttcatgccacgcccctactttcctgactgtcaccacatggccaagggc

SEQ ID NO: 7087 - DNA, 274 bp, Mus musculus
gagccctttgtcttttacattctgacagaagtagataggcaaggggctcacattgttggctacttttctaaggagaaggaatccccagatggaaacaacgtggcctgcatcttgaccctgcctccctaccagcggcgtggctatgggaagtttctcatcgccttcagttatgagctctctaagctcgagagtactgtaggctccccagagaagccactgagtgacctgggcaaactcagctacagaagctactggtcatgggtcttgctggaga

SEQ ID NO: 7088 - DNA, 513 bp, Mus musculus
  misc_feature (376)..(376): n is a, c, g, or t
  misc_feature (381)..(381): n is a, c, g, or t
  misc_feature (409)..(409): n is a, c, g, or t
  misc_feature (423)..(423): n is a, c, g, or t
  misc_feature (449)..(449): n is a, c, g, or t
gagctgatggcacatcccggataccccagtgtgcctccagcagggggctgcggtgagggcccagatgcgttctcttgttcttgggagcggctgcatgagctgcacgttctcacagcacccactttgcgggcttggctggcccaaaatggtgtgcagctctgcgccattgatgacctggattccaaaaggcctggggaaggggtccccttgtgaggcaactctggaacctttcctggagccttcctcactcagacaccgaaggccagctacaaactgcctaaaactatggaggaaggccaaggctaaagttccagttcagtcaggccttggagcagggtctgacttcctagagtgaaaagccactaaatcctgtttnccagntcctctaggctgagtagtgagtagtagnccgaccttgggcanccttacctggctgcagggaggcccantctgtgacatctggacgtaaggacagctgagcgattatttggtgccagttcgtgttgtagttac

SEQ ID NO: 7089 - DNA, 308 bp, Mus musculus
  misc_feature (213)..(213): n is a, c, g, or t
tttctttcacgggacttcaacatattactgataagctaataacacacaaggaaaaagaagaaggcattgagaaggggcaaatcctgtcatcagctgcagacattgctgctgcggtacagcatgcaacagcgtgccaccttgcgaaaagaacacatcgcgctattctgttttgcaagcagaaaaatttgctctctccagctaacgcagtattangttgtatctggaggtgttgcaagtaacttgtacatccgaaaagcattggaaattgtcgcaaatgcaacgcagtgcacgttgttgtgtccacctcc

SEQ ID NO: 7090 - DNA, 81 bp, Mus musculus
ttttactatcaatccacctatgcagaatgctaagaattgcgatttttctttcacgggacttcaacatattactgataagct

SEQ ID NO: 7091 - DNA, 381 bp, Mus musculus
  misc_feature (199)..(199): n is a, c, g, or t
  misc_feature (203)..(203): n is a, c, g, or t
  misc_feature (297)..(297): n is a, c, g, or t
  misc_feature (299)..(299): n is a, c, g, or t
aacaggtgggattgttcctccagtagctcaacaacttcacagagaaaatattcaacgaatagtagaagaaactctttctgcctgtagaatcaccccaagcgatctctcagcaattgcaactaccatcaaaccgggactggccctaagcttgggagttggcttatcctttagcttacagctagtaaatcagtttaaaaangccnttcatcccgattcatcacatggaggctcacgcactgactattaggctcaccaataaagtagaatttccttttttagttcttttgatttctggcngntcactgcctgttggcattagtccaaggtgtttccgatttcctgctccttgggaagtctttggacatagcaccaggcgacatg

SEQ ID NO: 7092 - DNA, 399 bp, Mus musculus
  misc_feature (114)..(114): n is a, c, g, or t
  misc_feature (139)..(139): n is a, c, g, or t
  misc_feature (144)..(144): n is a, c, g, or t
  misc_feature (160)..(160): n is a, c, g, or t
  misc_feature (178)..(178): n is a, c, g, or t
  misc_feature (180)..(180): n is a, c, g, or t
  misc_feature (207)..(207): n is a, c, g, or t
  misc_feature (244)..(244): n is a, c, g, or t
  misc_feature (276)..(276): n is a, c, g, or t
  misc_feature (297)..(297): n is a, c, g, or t
  misc_feature (308)..(308): n is a, c, g, or t
  misc_feature (310)..(310): n is a, c, g, or t
gaagataacatgacggctggatactcaagagcttgctcatgaatttggaaggaacttggcttccgggacactgaacacagatatcttcaaacaaattccgaaaggtcattcctnctgtgcaacctcgcccgaatcctanctgtntagtgaaggccatggntccatactgatgttgtgntnatagaagggactttgtgccacccaccnatgagagaccataaaggctgttgctacccggcctggnccaccaggctccacaccatggtgtttcccctnctggccatccagcacaggtcnccaagcgcatntnttttcactgataatcttttgatagtttttatatgacacaatccttattgtatttataacatggtcatagggccacataaaggaattacc

SEQ ID NO: 7093 - DNA, 549 bp, Mus musculus
  misc_feature (26)..(27): n is a, c, g, or t
  misc_feature (32)..(32): n is a, c, g, or t
  misc_feature (35)..(35): n is a, c, g, or t
  misc_feature (41)..(41): n is a, c, g, or t
  misc_feature (44)..(44): n is a, c, g, or t
  misc_feature (47)..(48): n is a, c, g, or t
  misc_feature (53)..(53): n is a, c, g, or t
  misc_feature (56)..(56): n is a, c, g, or t
  misc_feature (59)..(59): n is a, c, g, or t
  misc_feature (63)..(63): n is a, c, g, or t
  misc_feature (67)..(67): n is a, c, g, or t
  misc_feature (70)..(71): n is a, c, g, or t
  misc_feature (76)..(77): n is a, c, g, or t
  misc_feature (120)..(120): n is a, c, g, or t
  misc_feature (203)..(203): n is a, c, g, or t
  misc_feature (277)..(277): n is a, c, g, or t
  misc_feature (279)..(279): n is a, c, g, or t
  misc_feature (296)..(296): n is a, c, g, or t
  misc_feature (304)..(304): n is a, c, g, or t
  misc_feature (306)..(306): n is a, c, g, or t
  misc_feature (309)..(309): n is a, c, g, or t
  misc_feature (319)..(319): n is a, c, g, or t
  misc_feature (321)..(321): n is a, c, g, or t
  misc_feature (324)..(324): n is a, c, g, or t
  misc_feature (329)..(329): n is a, c, g, or t
  misc_feature (352)..(352): n is a, c, g, or t
  misc_feature (354)..(354): n is a, c, g, or t
  misc_feature (360)..(360): n is a, c, g, or t
  misc_feature (372)..(372): n is a, c, g, or t
  misc_feature (374)..(375): n is a, c, g, or t
  misc_feature (378)..(378): n is a, c, g, or t
  misc_feature (386)..(386): n is a, c, g, or t
  misc_feature (388)..(389): n is a, c, g, or t
  misc_feature (392)..(392): n is a, c, g, or t
  misc_feature (456)..(456): n is a, c, g, or t
  misc_feature (458)..(458): n is a, c, g, or t
  misc_feature (460)..(460): n is a, c, g, or t
  misc_feature (469)..(469): n is a, c, g, or t
  misc_feature (503)..(503): n is a, c, g, or t
  misc_feature (516)..(516): n is a, c, g, or t
ccagcgtggcccttgctgaacggaanntcaangtnggccanctnctnnaccangtngangctngctncannggganntgaggtgcagggcaatggctgtgagcaaccaagtttccaaatnaaaggtggatgcccaaggtttcgctccggaggacttggtggtgcggatagacggccagaatctgacggtgaccggccagcggnaacacgagtcgaatgacccgagcaggggccgctaccgcatggagcagagtgttcaccgacaaatgcagctcccncngaccttagatcctgcanccatgacntncancctgaccccntntgnccatntgtggctcaggggacaaaacaantncctacntccccctgaagntnnaancaggccantnnccnagaaacccaggaggggagggcctaagagctccttacaaaacgaaagtgtgaagaatccttagantntnttagcgttnttcctgcgggagaagagttgaagcccaaacagantcggccctgagantcaggaggggaggccctaggcactacaacctac

SEQ ID NO: 7094 - DNA, 312 bp, Mus musculus
  misc_feature (114)..(120): n is a, c, g, or t
  misc_feature (123)..(125): n is a, c, g, or t
  misc_feature (128)..(128): n is a, c, g, or t
  misc_feature (130)..(142): n is a, c, g, or t
  misc_feature (144)..(151): n is a, c, g, or t
  misc_feature (154)..(154): n is a, c, g, or t
  misc_feature (156)..(157): n is a, c, g, or t
  misc_feature (159)..(162): n is a, c, g, or t
  misc_feature (164)..(164): n is a, c, g, or t
gccgagctagactacaaggtctgctatctgtgccacagcctcctgacactagctggggtcgtggtcagtagccaggacattactcccaatcaatggggtgagctacagctgttnnnnnnncannnggncnnnnnnnnnnnnncnnnnnnnnggnanngnnnncnggccatgcaccggaccaaactcaaggacctagctacccagacttacatccgctggcaggacttgctggcccactgtcagccccagggtcagtacttcagcccttggaaagacatttaaagggataagagcaaagtggcccaaggctgt

SEQ ID NO: 7095 - DNA, 520 bp, Mus musculus
  misc_feature (116)..(116): n is a, c, g, or t
  misc_feature (171)..(171): n is a, c, g, or t
  misc_feature (180)..(180): n is a, c, g, or t
  misc_feature (183)..(183): n is a, c, g, or t
  misc_feature (198)..(198): n is a, c, g, or t
  misc_feature (229)..(229): n is a, c, g, or t
  misc_feature (244)..(244): n is a, c, g, or t
  misc_feature (259)..(259): n is a, c, g, or t
  misc_feature (261)..(261): n is a, c, g, or t
  misc_feature (295)..(296): n is a, c, g, or t
  misc_feature (300)..(301): n is a, c, g, or t
  misc_feature (315)..(315): n is a, c, g, or t
  misc_feature (339)..(339): n is a, c, g, or t
  misc_feature (390)..(390): n is a, c, g, or t
  misc_feature (393)..(393): n is a, c, g, or t
  misc_feature (405)..(405): n is a, c, g, or t
  misc_feature (409)..(409): n is a, c, g, or t
  misc_feature (460)..(460): n is a, c, g, or t
ttccttcctgtgctcatagtggtcatgacttttgaagcagcagctccctggcttcccacgggagagaccttcctgtgggcctgtgaaccacccgctgtccctacagttgccctctncagggccatgtcgccatgccaaacccaaggtttcagagagcacttgttctcaaantttcctganccnttttttttttttttngtttgtttgttaattggttttttttttgttnttgtttttttttttngtatttttttttttnanctccgggcctgggcactggggagcaggtgtgccnncccnnggcctggctgtgtncctctcaaaggatccatgggcatnttgggcacatcctactttcctgagacgggcattgcacgtggggaccccaanccncctcagaccctntggncctcccttccccagaggggagcccgggcacacttgcatgcttctggggatntgctccttaacgtttttgagcaatttctgttccagctttgacctccatttgcagctgttt

SEQ ID NO: 7096 - DNA, 202 bp, Mus musculus
acccgagacgaaggtgttctgtggtcatgagcatacgctgagcaatcttgagtttgcacagaaagtggagccctgcaacgaacacgtgcaagctaagctgtcctgggcccaggagagggatgacgaggatattcctactgtgccttcgacgctgggcgaggagctcatgtacaaccctttcctgagggtgacagaggatgca

SEQ ID NO: 7097 - DNA, 436 bp, Mus musculus
tgctgatgattttgttcgaggtctcatttgtatttcttacccactgcaccatccaaagcagcagcataaactcagagacgaagatctctttcgtataaaggatcctgtactgtttgtgtcgggctcagcagatgaaatgtgtgaaaagaacttgttggagaaagtagcacagaaaatgcaagcccctagtaaaattcattggattgaaaaggcaaatcattccatggcagtgaaaggacggtctacaaatgatgtattcaaagaaataaacacacagatcttgttttggatccaagaaatcactgaaatggacaagaaataattgtcattaaaagccatgttctgaataaaagtacggttggttaatttgataaagtatacctctcactcagcattgtgagatgtatttcagactaatgttctttaatgttgccct

SEQ ID NO: 7098 - DNA, 559 bp, Mus musculus
  misc_feature (348)..(348): n is a, c, g, or t
  misc_feature (363)..(363): n is a, c, g, or t
  misc_feature (440)..(440): n is a, c, g, or t
  misc_feature (442)..(442): n is a, c, g, or t
  misc_feature (460)..(460): n is a, c, g, or t
  misc_feature (500)..(500): n is a, c, g, or t
gactgttactggatcagccgatgcttcgtgaagcagttaaataacaagtacagggacgctttacctcagctgcccaaggctttcgagcagtacttgaatctggaagacagtaggctgctgagtcacctgaagacgtgttctgcagtgtccaaactgccttacgacctctggttccaaaggtgcttcgcgggatgcctccccgagtccagtttacagagggtctgggataaagtcgtaagtggatcctgtaagatcctagtttttgtagcggtagaaatactattaacctttaaaataaaggtcatggcattgaacagtgcagagaagataacgaagttcctggaaaanattcctcaggacagnctcagatgccatcgtgagcaaggccatcgacttgtggcacaaacactgtgggaccccagtgcattcggcctgacagntngtgactacatgggcagtntgcaggccctccctgagcacttcgttcacatcacctgctntaccaactggttagaaacaatagtctcactgtggtgctcaaaatgtaactaccacccct

SEQ ID NO: 7099 - DNA, 111 bp, Mus musculus
aaactatggcccctagctaagtggccaagtggctgggagcgggaggcggagcagctgggagagctgtgggcgggtcggactcgcgtgcctccacagggtcaggaacctgtg

SEQ ID NO: 7100 - DNA, 439 bp, Mus musculus
  misc_feature (236)..(236): n is a, c, g, or t
  misc_feature (242)..(242): n is a, c, g, or t
  misc_feature (244)..(244): n is a, c, g, or t
  misc_feature (253)..(253): n is a, c, g, or t
  misc_feature (257)..(257): n is a, c, g, or t
  misc_feature (259)..(259): n is a, c, g, or t
  misc_feature (262)..(262): n is a, c, g, or t
  misc_feature (281)..(281): n is a, c, g, or t
  misc_feature (286)..(288): n is a, c, g, or t
  misc_feature (296)..(296): n is a, c, g, or t
  misc_feature (310)..(310): n is a, c, g, or t
  misc_feature (321)..(321): n is a, c, g, or t
  misc_feature (330)..(330): n is a, c, g, or t
  misc_feature (355)..(355): n is a, c, g, or t
  misc_feature (380)..(380): n is a, c, g, or t
  misc_feature (383)..(383): n is a, c, g, or t
ttcctgccctcgaataaaagtctgttgctctgtcccaggctaagaagccagcatccaatggggcatcgggcctccctcccagtgcccagctcagagtgggtccacgcagagaggactcaagctgcctgttgcctctccccttccgtctagcaatggccacaggtttcgggaccagctgggtcactctcaaagatgaggcccacatgaacctgctgggatcccacgaacacatattngacctnancacagggantgancnggntttgaattcagagaaaatngaggnnntctagacnagaggggtggggtncttggtatccncacacgaancaatggaatggagacattgaagctnttcctggaggtcactcagggcaccnctntccagggcacagccaggagacctgtgttctagcaccaatgctgattgtcactaatt

SEQ ID NO: 7101 - DNA, 555 bp, Mus musculus
  misc_feature (275)..(275): n is a, c, g, or t
gaataggccctctcagtaaagtcagtgaatttaaaacgtgtactcctggtttccctggagccccatctacagtccgcatctctaagaatgttgacggtatccacctttcctgggagcctccaacttcaccttctggaaatattttggaatattcagcctacttggctatccgcacagcacagatgcaagataatccaagccaacttgtattcatgaggatctactgtggtcttaaaacctcatgtacagtgactgctgggcagcttgcaaatgcncatattgattacacatccagacccgccattgtgttcagaatatccgcaaagaatgaaaagggctatggaccagccacacaagtccgatggcttcaaggtaacagtaagaaagctcctttgagttgagttgttttttattaaagctgttgtgatagttatttattagtaactggttatgaacatctgttctttgagagtattctctgactgtatttctagcagttatgaatttgagtttgtaagttgttcttaaaatgtatttgctcacttctagatccaa

SEQ ID NO: 7102 - DNA, 480 bp, Mus musculus
  misc_feature (160)..(161): n is a, c, g, or t
  misc_feature (163)..(164): n is a, c, g, or t
  misc_feature (166)..(167): n is a, c, g, or t
  misc_feature (169)..(169): n is a, c, g, or t
  misc_feature (191)..(191): n is a, c, g, or t
  misc_feature (244)..(244): n is a, c, g, or t
  misc_feature (252)..(252): n is a, c, g, or t
  misc_feature (309)..(309): n is a, c, g, or t
  misc_feature (319)..(319): n is a, c, g, or t
  misc_feature (343)..(343): n is a, c, g, or t
  misc_feature (345)..(345): n is a, c, g, or t
  misc_feature (374)..(374): n is a, c, g, or t
  misc_feature (441)..(441): n is a, c, g, or t
  misc_feature (444)..(444): n is a, c, g, or t
  misc_feature (446)..(446): n is a, c, g, or t
gacagttccagacagtatcatcaccaaagttctggctgatcgaatggagcaacaagattgcatccagaaagggtgggtgctgcacggcttcccaagagacctggaccaggcccggatgctgaactccatgggctacaatcccaacagggtcttcttcctnngnntnncnctggattccattctggagcggntgacgctgagaaggacagaccctgtcacaggagaaaggttccacctcatgtanaagccccntcccaccatagaggtccaggtccgcctcctgcagaaccccaaggattcagaggagtncatcaagctncaaacggacctgttctacaggaantntggggatctggagcagtactacgatcganccatcattgtcaacggagaccaggacccatacacagtttttgagtatatagagagcgggatcattantcntntgcccaggaaagttacctgatatgtgcgaagcca

SEQ ID NO: 7103 - DNA, 204 bp, Mus musculus
  misc_feature (66)..(66): n is a, c, g, or t
  misc_feature (89)..(89): n is a, c, g, or t
  misc_feature (99)..(99): n is a, c, g, or t
acccgagacgaaggtgtttctgtggtcatgagcatacgctgagcaatcttgagtttgcacagaaantggagccctgcaacgaacacgtncaagctaagnctgtcctgggcccaggagagggatgacgaggatattcctactgtgccttcgacgctgggcgaggagctcatgtacaaccctttcctgagggtgacagaggatgca

SEQ ID NO: 7104 - DNA, 474 bp, Mus musculus
  misc_feature (301)..(301): n is a, c, g, or t
  misc_feature (316)..(316): n is a, c, g, or t
  misc_feature (341)..(341): n is a, c, g, or t
gtattacccaccaaagacatcagaaggatgtgcaagtcttccaggctacctctggatgatgactttctagattgcttactgtccaggtttgaagacaaagaccatcaaataaattatgagatatttttctccgtcctgaactggagaatgaatccaacaccggatttgcaagccccgccataccttaaagagaaatgtgaagacgtttgggtgggaatgccatcacctattcctgtgaaatacgttagatacttagactttttgattgatgtatatggcttagaggacaacatgctatganggttttgatcaactntctttgatttactgttctcattatnccatgtttattttaataaatataatttcatttaaaacaaacaaaaaataagaaacaaggtttgtattaaatggaaattcataaaccacaattaattttctttgtcactgtagttcctcagaacagcttgttat

SEQ ID NO: 7105 - DNA, 343 bp, Mus musculus
  misc_feature (275)..(275): n is a, c, g, or t
  misc_feature (317)..(317): n is a, c, g, or t
cgcgccctggactgtaatgtttagatgtgctctaccaccaggagcccggtgaaaatgccagtggtccatcccctcccaggcttctaactccatgttcaaaactagatgtcactgtatgtcatgtgttagagattgcaggccttgagggactagagatggacatgatgggtcagcatcctacctcttcctcctgggagtgcacacttgttaggcagctggttaatcttgccagagcagtgaccaaaaaaatgtcacctttgaatgcatggaaactntcaaagtgttttctcagagtagcttcttgctgccccggaggnctgcctgcagcatgggagtttagatc

SEQ ID NO: 7106 - DNA, 565 bp, Mus musculus
  misc_feature (274)..(274): n is a, c, g, or t
  misc_feature (288)..(288): n is a, c, g, or t
  misc_feature (290)..(290): n is a, c, g, or t
  misc_feature (305)..(305): n is a, c, g, or t
  misc_feature (312)..(312): n is a, c, g, or t
  misc_feature (323)..(323): n is a, c, g, or t
  misc_feature (328)..(328): n is a, c, g, or t
  misc_feature (338)..(338): n is a, c, g, or t
  misc_feature (343)..(343): n is a, c, g, or t
  misc_feature (356)..(356): n is a, c, g, or t
  misc_feature (372)..(372): n is a, c, g, or t
  misc_feature (447)..(447): n is a, c, g, or t
  misc_feature (467)..(467): n is a, c, g, or t
  misc_feature (471)..(471): n is a, c, g, or t
  misc_feature (474)..(474): n is a, c, g, or t
  misc_feature (476)..(476): n is a, c, g, or t
  misc_feature (520)..(520): n is a, c, g, or t
  misc_feature (530)..(530): n is a, c, g, or t
ggaagaccaggcatcctctggagatggcgttcctagtggccttgctcgtagttctgggcttacagttggtgcagagtaacgcgctcacctgccatgtgtgtgaggcgcagaacagctatgcctgctcgaatccgtcccagtgccctggagaaaagaaattctgtttgttggccgtcacacgaatttttgaacgtttcttctatgtgtcgaaacagtgcacccgaaggtgtccaacccccgtagtcagcccgcctagcactaatccaccatctgngcctaaggagtttntnatagaaaaacccatncccttcntattttataantgctntcaatgggantcatntaatggtgagggnccacccactgaccagntcttaaaggaacaacctgggaaagccagtgggagaagacatagatacattgagctgttactgactggcttcatgntccttactgctaatggcctntcanccntntgcctgctgtaagtcacagaaggacctggatcatgccttgtggntcatgaattntctgtacccctgctggatccttctaattaaatttg

SEQ ID NO: 7107 - DNA, 588 bp, Mus musculus
  misc_feature (329)..(329): n is a, c, g, or t
  misc_feature (366)..(366): n is a, c, g, or t
  misc_feature (394)..(394): n is a, c, g, or t
  misc_feature (412)..(412): n is a, c, g, or t
  misc_feature (439)..(439): n is a, c, g, or t
gcttactgttgagtggcattgatgatttgacacattcttaggggagcaacagaacatgcatttccatcctaaataaggaccctcccacttccacctttgacctttaataatgattgtattacatttccccataaccttttgctgatgtggttcaatttatttctctcagtcatgaaaattatttatttatttatttatttttatttatttgtttgtttatttatttatttattacttgtgagtcaccagctgccaagtatttgcattagtctggtggagactttgagaggactgtgcttttctgttcccctcccccagaaaagaaggcnggttggttggttggtttgaaccacctctcttcccacntgctgtttccctcaccatggcttacttngggggaggggagggcttntaccagctgattcccttgttgtacacnagatggctagacatttttgtatattagtgtgttttaagttattgatttgttttatatgaaataatttatttttcaggtaccattttttttttcattttaactttgtttttacatgggtttgttttcaataaagtctgacattgctgtcc

SEQ ID NO: 7108 - DNA, 314 bp, Mus musculus
  misc_feature (76)..(76): n is a, c, g, or t
  misc_feature (137)..(137): n is a, c, g, or t
  misc_feature (200)..(201): n is a, c, g, or t
  misc_feature (206)..(206): n is a, c, g, or t
  misc_feature (229)..(229): n is a, c, g, or t
  misc_feature (235)..(235): n is a, c, g, or t
  misc_feature (242)..(242): n is a, c, g, or t
  misc_feature (247)..(247): n is a, c, g, or t
  misc_feature (281)..(281): n is a, c, g, or t
  misc_feature (287)..(287): n is a, c, g, or t
atccagaagatttcagattaacgaagctttgaaagaaccatttttcgaaatttcagtgacgtgtgaatattttttntcaatggctttctcaaagagaatgaaacttttgcaccattttcagagtttttatagagatnccaaattgatatatttacatgtaatggaaacataaaaaaagttttattaaacaattgttcatnnctgtntagacattttaattcagcttccnaagctnttcaaantcgtnttttggagatgcggggtgttaactgacgattccnaaccantcagttgtctgaagactcggttccttc

SEQ ID NO: 7109 - DNA, 362 bp, Mus musculus
ttgtgtgctacgtgtggatcccatggaacccaccgggactgctcctctcttagaccaaacagcaagaaatgggaatgtaatgagtgtttgcctgcttcaaccacgagttaggctggaaggatggtctgctattacatatctgaagactcaggcaacaccccctgttgcagcagcaccttctgcccccatgtgtatttcttaagggctggctaccagcctggaagagaatcccagctcttctggactgattggctacaaacttccctcttagaaaagcccgagtcctctggtggaagaagctgcccgtcctggtgatccaaaggattgcaaaaaatccaagtaatagcttcagggcggttcct

SEQ ID NO: 7110 - DNA, 262 bp, Mus musculus
  misc_feature (155)..(155): n is a, c, g, or t
  misc_feature (200)..(200): n is a, c, g, or t
tggacaaagcccgtcacaagcagttcttcagccatctcaagaggaagaagccaagttggcgagaggctcctgaccctgcccgtgtgggtgagaacccccgcatcaaggctgggaaaaccaagatcgtgctgcttttcccgctggacaagcggcancagctggccgaggcagcggcgggcccatttgtgaggccggtgcgncaactgaggacccgctcggcgccccaacgtgcttcccagcggtggcgcctatgctacgtggg

SEQ ID NO: 7111 - DNA, 543 bp, Mus musculus
  misc_feature (78)..(81): n is a, c, g, or t
  misc_feature (83)..(87): n is a, c, g, or t
  misc_feature (89)..(91): n is a, c, g, or t
  misc_feature (93)..(97): n is a, c, g, or t
  misc_feature (99)..(100): n is a, c, g, or t
  misc_feature (102)..(103): n is a, c, g, or t
  misc_feature (105)..(105): n is a, c, g, or t
  misc_feature (107)..(109): n is a, c, g, or t
  misc_feature (114)..(116): n is a, c, g, or t
  misc_feature (119)..(122): n is a, c, g, or t
  misc_feature (124)..(127): n is a, c, g, or t
  misc_feature (129)..(130): n is a, c, g, or t
  misc_feature (133)..(134): n is a, c, g, or t
  misc_feature (136)..(139): n is a, c, g, or t
  misc_feature (141)..(142): n is a, c, g, or t
  misc_feature (282)..(282): n is a, c, g, or t
  misc_feature (298)..(298): n is a, c, g, or t
  misc_feature (306)..(306): n is a, c, g, or t
  misc_feature (340)..(340): n is a, c, g, or t
  misc_feature (367)..(367): n is a, c, g, or t
  misc_feature (386)..(386): n is a, c, g, or t
  misc_feature (427)..(427): n is a, c, g, or t
  misc_feature (463)..(463): n is a, c, g, or t
  misc_feature (465)..(465): n is a, c, g, or t
  misc_feature (475)..(475): n is a, c, g, or t
  misc_feature (482)..(482): n is a, c, g, or t
  misc_feature (484)..(484): n is a, c, g, or t
ctttgccacagatctgacagactatgagaaaatgccagtaagtccatttgggaaagtgaagcccagcggagaggggannnnannnnngnnnannnnnannanngncnnnccatnnncannnntnnnngnnaanntnnnncnncacacacagcagatccgcactcgaagtttcctgggtacaaacccaatgcaagacattaagacagccaaccaggacctggaaaccactaagaaacttcaggaggagttaaggaaactgaaagtggagatgaccttgaacanagaccatccatttccntctttcantggaaacctttcacttcacccaccagcatcacancctcaaaatatattttttaacacgaantcctaggaaggcagcgctntcagcaggagtgacaagtaccttccacacgaggagctgctntcccccatgtgtgtggggactggcctggatgacaantncgcgggtaantcgcggntnttcagctgccacacaggctatggcttttaatagacctgattccttcctgaggctataga

SEQ ID NO: 7112 - DNA, 514 bp, Mus musculus
  misc_feature (85)..(85): n is a, c, g, or t
  misc_feature (236)..(236): n is a, c, g, or t
  misc_feature (242)..(242): n is a, c, g, or t
  misc_feature (272)..(272): n is a, c, g, or t
  misc_feature (280)..(280): n is a, c, g, or t
  misc_feature (297)..(297): n is a, c, g, or t
  misc_feature (302)..(302): n is a, c, g, or t
  misc_feature (304)..(304): n is a, c, g, or t
  misc_feature (307)..(307): n is a, c, g, or t
  misc_feature (309)..(309): n is a, c, g, or t
  misc_feature (365)..(365): n is a, c, g, or t
  misc_feature (367)..(367): n is a, c, g, or t
  misc_feature (370)..(370): n is a, c, g, or t
  misc_feature (377)..(377): n is a, c, g, or t
  misc_feature (390)..(390): n is a, c, g, or t
  misc_feature (398)..(398): n is a, c, g, or t
  misc_feature (404)..(404): n is a, c, g, or t
  misc_feature (415)..(415): n is a, c, g, or t
  misc_feature (422)..(422): n is a, c, g, or t
  misc_feature (475)..(475): n is a, c, g, or t
ggttgaaaacactgcatggaagattaaaacaaagactgagctaagggaaaaagttttcttatttcggaagagcatcctctctaanctggaaggacctgaccagcttttcccttttctttaagctttggtcacagacatgacacctgagtgcatttatggtttttcccagggcaagtctcctgggagtcttatctccaagtccccacacatcttgccagatatgccaagaatatagnccctanccactcatatgtgtgaaccccattcacatngaagtcangagggcagccataggantcacntntcntntgggtgatgggagtggaacgcaggccataaggcttggtggcaagtaaacccatgantnatntcactgnttccgggaaccantctgtagnctaggnccatgccagtntcatgcntccttaaaggcctaacgtaatacttggagggaaaactcgctaagtgctttctntcaaagatgtagagttcctgattcagtgcccctttatta

SEQ ID NO: 7113 - DNA, 513 bp, Mus musculus
  misc_feature (365)..(365): n is a, c, g, or t
tcaggacctcatcggcctgcgattggctcaggagaaggccctgaagaggcagctggaggaggaacagaagcagaagcccacaggcatcggagcgcccgctgcctgtgtgtcctcaacgccctcggtgccagcagcagcccgagctgggcccaccccagctgaggaggtcatggaataccgggaggagggtcccgaatgcgagaccccggccatcttcatcagcatggacgacgactcggggctggctgaaaccacactgctggactctagtctcgaggggcccctgcctaaggaggcagcagcagtcgggtcgagctccaaggatgagcggagcccccagaacctcagccatgctgtggaagaanccttgaagacctccagcccagaaaccagggaacccgagagcaaggggaacagctgacagctgcgggagtttggggggaggggaggggcgggacggggcctcctggagctttgccttaacacaaataaaagagggcgtagctgcgccag

SEQ ID NO: 7114 - DNA, 169 bp, Mus musculus
cagtattttaactaggatcctttctgtcagcacaaaactgattagtgtgtaatgccaactgctacgtaaaatgcaaggtgaaaatatttaaaaccataattagctcactttattagcattggcaatactgtttgtatacatgaagcacttgaatgttgtatcttttaaa

SEQ ID NO: 7115 - DNA, 402 bp, Mus musculus
gaaaagcaagcctgactggtactatacaaagcatccttttggccaaattcctgtctttgagaacacccactgtcagctggtctatgaatctgtcattgcttgtgagtacctggatgacgtctacccgggaagaaagctgtttccgtatgacccgtatgaacgagctcgccagaagatgttattggagctattctgtaaggtcccgcctttaagcaaggaatgtctgatagcgctgagatgcggaagagactgtacggatgtgaaggtcgccctgcgtcaggagttgtgcaacatggaagagattcttgaatatcagaacactaccttgttcggcggagactgtatatccatgattgattacctcgtctggccctggtttgagcgcctggacgtatatggact

SEQ ID NO: 7116 - DNA, 526 bp, Mus musculus
  misc_feature (201)..(201): n is a, c, g, or t
  misc_feature (232)..(232): n is a, c, g, or t
  misc_feature (237)..(237): n is a, c, g, or t
  misc_feature (261)..(261): n is a, c, g, or t
  misc_feature (266)..(266): n is a, c, g, or t
  misc_feature (309)..(310): n is a, c, g, or t
  misc_feature (327)..(327): n is a, c, g, or t
  misc_feature (331)..(331): n is a, c, g, or t
  misc_feature (336)..(336): n is a, c, g, or t
  misc_feature (338)..(338): n is a, c, g, or t
  misc_feature (340)..(340): n is a, c, g, or t
  misc_feature (348)..(348): n is a, c, g, or t
  misc_feature (352)..(352): n is a, c, g, or t
  misc_feature (357)..(357): n is a, c, g, or t
  misc_feature (359)..(359): n is a, c, g, or t
  misc_feature (369)..(369): n is a, c, g, or t
  misc_feature (372)..(372): n is a, c, g, or t
  misc_feature (375)..(375): n is a, c, g, or t
  misc_feature (397)..(397): n is a, c, g, or t
  misc_feature (406)..(406): n is a, c, g, or t
  misc_feature (416)..(416): n is a, c, g, or t
  misc_feature (498)..(498): n is a, c, g, or t
  misc_feature (500)..(500): n is a, c, g, or t
tacagatccttgctcatagtacgcaaaacgaagaagacagctcatggaggatggccagtcctaaacctgtagaagtccacgaggagacagcccaagaccaagagcgcccatcaagcaggacctaataccctcctcagcctggaggacttactgacttcagacatcacttgcggatgttttgtgtagcctgcttcatctgantatgtgccgagtggaagaatgggtgttgggnccaancccctcaagtctttgaacctgganatgtnttggctcaattttgagtttcacctagcttagggtccacactgnnagacccttagtaaatgntttnccctntntnttgctcanccantagtntntgacacacgnttnttntcttgagcagaggatgctgatntgaaccttntcacaggatntgaagccacttggtaatttagttccctcatgtaggcccagaatagcatatactttgaaacaaaaggaagacacatcaccagntnttaattctcactataaaccacctcat

SEQ ID NO: 7117 - DNA, 307 bp, Mus musculus
  misc_feature (146)..(146): n is a, c, g, or t
tagggcctgtcagacacccagtttagcctaatacagaaaagcacggaggtgagaaacaacagggtgaatccaaggaaattcaacaggagcatgtgagaggcaggagccagggagagttagacatggcccgaaacaagttctccccntccaccctgaggaattctggtgcttcagcactggctcctgaagaattggggaaacttcccagaaggttgtcagcctctctccggcaggagctttacagaggtctgtggacacttcagagcacccacacgggccagagaagtaactggtcacgaggcttccc

SEQ ID NO: 7118 - DNA, 438 bp, Mus musculus
  misc_feature (159)..(159): n is a, c, g, or t
  misc_feature (255)..(255): n is a, c, g, or t
  misc_feature (257)..(257): n is a, c, g, or t
  misc_feature (291)..(291): n is a, c, g, or t
  misc_feature (298)..(298): n is a, c, g, or t
  misc_feature (302)..(302): n is a, c, g, or t
  misc_feature (306)..(306): n is a, c, g, or t
  misc_feature (314)..(314): n is a, c, g, or t
  misc_feature (321)..(321): n is a, c, g, or t
  misc_feature (340)..(340): n is a, c, g, or t
  misc_feature (346)..(346): n is a, c, g, or t
  misc_feature (353)..(353): n is a, c, g, or t
  misc_feature (412)..(412): n is a, c, g, or t
aaagtagaaggtgccttggtcctgccggggagcagtgcagaaacacagtgggatgcttcctaccgtgccaggacagctgacagagtgccctacagtgttgtccccagctgggtgacagaggctcctgtagcccctttacaagtccggtttactcctcangcagagatggatctgaggaagctcaattcaggagatgctagtcagccgtcatttaagtacttccactccgcagaggaagccaagcgtgccattgangnctgtgctgtcagcagatcctcggtctgtgtaccnccggaanctcntgcngaggaccnccttttnttcttcactgtggacacancacatntcacctnctggtttggtgatggcttcgcagaggttgtgaggattaaactggcttctgagtctgttncaggtggctgaccctgaggaatcctt

SEQ ID NO: 7119 - DNA, 420 bp, Mus musculus
aagatggccctgacctaagccttggtcaaaggaaagagacgtgcagcttgaagccactcccctcccctatagcaaatgaggcccagccccacagtcaccttcgccagggccagagggatgcactctgggctccagaagcaggcaggtacccgagtctatgctaggaccttaagcaccataaattaataatttatacctaattatgtaagttgccttgctaaagtgacaggtgttttgcattttcgatcgcttgttttcctgtttaagtataaacatctcctgcctagagttctaaatgttaagtccttgctgacagtacttgttagatttcatactaggaacaacactgggtagtgtacctggtagaagagcctgttgctgtgttgaatgtgagaaagtcacttcagatgtcattctttg

SEQ ID NO: 7120 - DNA, 531 bp, Mus musculus
  misc_feature (390)..(390): n is a, c, g, or t
  misc_feature (404)..(404): n is a, c, g, or t
  misc_feature (428)..(428): n is a, c, g, or t
  misc_feature (433)..(433): n is a, c, g, or t
  misc_feature (435)..(435): n is a, c, g, or t
  misc_feature (448)..(448): n is a, c, g, or t
  misc_feature (465)..(465): n is a, c, g, or t
  misc_feature (467)..(467): n is a, c, g, or t
gcagaggagggaccttttctcagtaaaacagaactacaaaaagatacgcaaggagcatgtgacagcaaagtcgttggacaaggtcgtgaattgtcccctccaacaacaaagagcatccgaatatacgacgcgagccccttttcttcttacccgttgcaggctgagaagatgagtcctcacagaagggcacgtatggcccgtctgccccagcagggccctttccggcaccttatggacatgaaggcagagaagaggctggcggggtggaaggaacgccgtagccgctttggtgacatcaacgtgcacaaatgctatcagtttgggcaggtcttctctcctttccaggctctggccaccacagagatgcgaaggctggtgctgcccagaganttgcccatgagttntcacaggcggagaataaacccttnatccntnggtgacatgaacntccaggattcacccctntntccagagctgacattgggaaacgatgatggccatcatgagaaggacaagccagtgagccacatt

SEQ ID NO: 7121 - DNA, 491 bp, Mus musculus
  misc_feature (30)..(30): n is a, c, g, or t
  misc_feature (44)..(44): n is a, c, g, or t
  misc_feature (298)..(298): n is a, c, g, or t
  misc_feature (324)..(324): n is a, c, g, or t
  misc_feature (329)..(329): n is a, c, g, or t
  misc_feature (406)..(406): n is a, c, g, or t
  misc_feature (408)..(408): n is a, c, g, or t
  misc_feature (411)..(411): n is a, c, g, or t
  misc_feature (424)..(424): n is a, c, g, or t
  misc_feature (437)..(438): n is a, c, g, or t
  misc_feature (465)..(465): n is a, c, g, or t
catcataggagcatggtgacaggcagaccnagtgctggagcagnacttaaatctgatccacaagcagtaggccaagagatagggagagacagacagactggtcttggcacactggtctaggcaagggcttctgaaacttcaaagcccacccccagtgacacacctcttccaacaaagccacacctcctgatcctttctaaacattccatcaatcaggaaccaaacattcaaataagtatatgagcctaagggggcaattctcattcaaaccaccacattctgctcacggacatgatcnacaaccaatcctcacactgaaatagnccttnttgaagttcacagatcagcttactgaaggttagagagattaagtaaaataccctacatgacacaaggagaaatgagntnttncagtatgaatctnccttcagtatttnntactatagattacactctaaaattttntcttataattggcatacctgaactat

SEQ ID NO: 7122 - DNA, 423 bp, Mus musculus
  misc_feature (325)..(325): n is a, c, g, or t
  misc_feature (356)..(356): n is a, c, g, or t
  misc_feature (366)..(366): n is a, c, g, or t
  misc_feature (368)..(368): n is a, c, g, or t
  misc_feature (375)..(375): n is a, c, g, or t
cagcgactactaccgcattagcgagaagctcccagtcaggttcaacaacccggggtggtttcatggctacgggaccaaggaagctgtttccatgtacaggaccagtaaccaaacctacggaagcagagcccccacggtgcatgagatgccaaaagtattttatccatcttcaaataagttttccagacaacacgcagcttttggaatgttccagagtcataatattaatgtcaccctggagaagagcttagtgaccgggcctgacaatcacatcacccactatgaccgtttgaactttcaccccagttacaatgtcaacaggccntccatctgtgactaagggagctgggttcctntcctcagggntntcctgantcagggctgcttcggggagcacggatgcccttgatccttgacaggtgc

SEQ ID NO: 7123 - DNA, 136 bp, Mus musculus
gagtgtctgctgacagttttgtgcggcagcaagaggcacatgccaagctggacaacctgaccttgatggagatcagcagcagcggggccttcctcacccaggccctcaaccacatgtacaagctccgcacaaacct

SEQ ID NO: 7124 - DNA, 351 bp, Mus musculus
ttttcaggcgcaaaagactgcatccagcactttacagatggcagaagtgaagtcgatgttccgagaagtccttccaaaacaagggcagttgtctgtggaagatgtaaccacaatggtgctgtgtaaacccaagctcttgcccttaaaatctctgacgctggaaaaactggagaaaatgcagcaagcagcacaggatacagtccgtcaacaagaaatggcagaaaaggcaacgagcaaataagccactagttaccaccactgtaggggatgccccatcttaacccctaactgttcgtaactagaaactattctgcatctgcaggctagaaatgcttaaactagaccgtcaac

SEQ ID NO: 7125 - DNA, 531 bp, Mus musculus
  misc_feature (340)..(340): n is a, c, g, or t
  misc_feature (366)..(366): n is a, c, g, or t
  misc_feature (369)..(369): n is a, c, g, or t
  misc_feature (420)..(420): n is a, c, g, or t
  misc_feature (454)..(454): n is a, c, g, or t
tatggccccgctcacatgaacagtgtggagcgttacgatccgagtaaggactcctgggagatggttgcgcccatggctgataagaggattcactttggcgtcggagtcatgctaggttttattttcgtggtaggtgggcataacggtgtctcacatttgtcaagcattgaaagatatgatcctcatcaaaatcagtggactgtgtgtagaccaatgaaagagcccaggacaggagttggtgctgcagtaatcgataactacctgtatgtagtcggtggtcactcagggtcttcctatctgaacacagtacagaaatacgaccctatctcagatacatggnctggattcagcaggcatgatatactntcnctgcaattttggattaactgcactttgacaagtgtgaacttgtggaaatcncacaaggaggtactacaggaaagagtgcccagtntcctgaacctgacagctagctgcactgctttctttgtaacgtaaagtgacatgaagactcagttttgttgggtactt

SEQ ID NO: 7126 - DNA, 475 bp, Mus musculus
atgccccaaaggatgtctacacgttcctgccaaccaaacttggggaatccaggacactgaaaatcaatttgagaaataattctttttccactcatgcactgaagtttttgagccccagagaacctttccacattagacactccaagtacactttgagggcccgacattatatccacatcccggtgcacttcagaccagaggcagtgggcagatttgaagctttacttgtgatccaaacagatgaaggcaagagtattgctattcgactaatcggtgaatcccttggaaaaagttaactagaatacatattgtgtaaatgacctgcttatattttggcaatctcatttttctacaccaaaattatgctgttgtatatattttgtacgataaattcaatgtgtataaattatagatttgttttataaagaatttatttctgaagccctcactaaatatcatgtacctagctcacagt

SEQ ID NO: 7127 - DNA, 230 bp, Mus musculus
aggctctttggctatttgcatctggcttttgctgcttttccagattgaaatattaagtttattttattttgtacaagcttcagatcccaacatcaaccaccaaacttgatcttccctttcccgagagtgtggggggtggggagccaacagcaccggctccccagagtggggaggcaagtaggcggctgccatggtccaggcgccatttggaattactgacttctaagatt

SEQ ID NO: 7128 - DNA, 472 bp, Mus musculus
  misc_feature (436)..(436): n is a, c, g, or t
ataggtctgaaactcgtgctgcattgcagctgcccactgggaccaccctttggatttcggagtttttgttcttacatatcacccagtgaaatgaaacaaatgagtagaagagcttagacctactgattcctacagcagttactttttgtttttgaaaggtgaggtctaacaatgtagccttggctgacatggactcgctatgtagatcaagctaaccttaaacttacaaagttgctcctgcgtctgcctggaatgaacgtatgcaccaccactaccagctgcggttgactttgtaacaccggttttcccaagaactctcaaatacaagtaccataggtttgcagtcttttacatttaagaactattttgagaggttgagaacatagctcagtgattaagaatattggctgcttccactttgagaggacattctatntccacactaaagaagctcctaacagttattccagtt

SEQ ID NO: 7129 - DNA, 131 bp, Mus musculus
  misc_feature (46)..(46): n is a, c, g, or t
ctcttcaaactcatcgtccagcaaactcctgtctgctgaaagcaangcagaaccagagaaaagctccgagactgtaggccatgcatcagtggctaaaaccactctgaaatccactaccttgtttcgaggca

SEQ ID NO: 7130 - DNA, 184 bp, Mus musculus
  misc_feature (63)..(63): n is a, c, g, or t
  misc_feature (70)..(70): n is a, c, g, or t
tgttctccatgtcctgcgtgtatatcctacataagtacgagggcgagccagagcacgcagtgnctaccgntctgcgtcgtggtggccatctacttcatgacggggcccatgggctactggcggggcagccccggtggcctttgcagccccagtgtggaggagaagctggaacacctggagaacc

SEQ ID NO: 7131 - DNA, 513 bp, Mus musculus
  misc_feature (366)..(366): n is a, c, g, or t
  misc_feature (405)..(405): n is a, c, g, or t
  misc_feature (423)..(423): n is a, c, g, or t
  misc_feature (451)..(451): n is a, c, g, or t
  misc_feature (457)..(457): n is a, c, g, or t
aggtgaaagagtccctccgcagcatcgagcagaagtataagctcttccagcagcaacagttcaccttcattgcggctctggagcactgccgggagaatgcccacgacaaaatccggcccatctccagtatcgagcaggtgcagagctacatggaacactactgcaataactccacccaccggcggattctgatcatgttcatggacatctgctccgagctcagcaagctctgtcagcactttgaggccctgcactctggcacccctgtcaccaacagccttctcgagaaatgtaaaaccctggtcagccaaagcaatgacttgagcagcctcagagccaagtatccgcacgaagtggttaaccacntcagctgcgatgaggccaggaaccactatggaggcgtgntcagcctcatccctatantcctggactttatgaaagagtggattgntcattntgagaagctgcctcgcaaagtgctgcagcatgggacgacatagcttctgtactgtt

SEQ ID NO: 7132 - DNA, 515 bp, Mus musculus
  misc_feature (300)..(302): n is a, c, g, or t
  misc_feature (305)..(308): n is a, c, g, or t
  misc_feature (310)..(310): n is a, c, g, or t
  misc_feature (312)..(313): n is a, c, g, or t
  misc_feature (315)..(316): n is a, c, g, or t
  misc_feature (318)..(321): n is a, c, g, or t
  misc_feature (419)..(419): n is a, c, g, or t
  misc_feature (488)..(488): n is a, c, g, or t
gcttgtgaaacagctgcctctgagttctatctgcttagaaacagattcacctgcgctaggaccagaaaagctgacacggaatgaaccctgcaacatttccatcgcagcagagttcattgcccaggtgaaagggatttcagtggaagaagtccgagaagtgacgacgcggaatgcattcagactgtttcccaagctgcagagcctgcttcagaaagagcttcaaagtcaccccctgcaagccaagtcagcccagggcagcgctggggaaagcaagggcttgctttagtggcctcagagaannnagnnnncntnncnntnnnncatggctagcagtcacagttttacagaaatgttcctcttaaaaacaaatttggagctggagagatggctctgccattaagagcactcagttgctgctnttccagaggactcgtgttcagttcccagcagctatgttgggtggttcaactgcctgtaattccctccanccttctctgacactagcacactggtgg

SEQ ID NO: 7133 - DNA, 401 bp, Mus musculus
  misc_feature (112)..(112): n is a, c, g, or t
gaacactgtcttaaatgctacggaaagagatacgtggacaaagatgatgtctattttgaattggacgctgacaaaatatgcagagtgaccgcggagatgctgctgcagaatnccgtgaagtttaatcttgcagagtttcaggaagtgtggcagcagagtgttcccgagggaatgacgactcggcttgatcagctcaagggtttagcactggttgacagaaactcaagaccagaaatcatatttttgctcaaagtagatgatttgcctgagggaacacaggatcgttttaatagtctgttctctctaagagaaaagtggacagaggaagacatcactccatatatccaagatttgtgcggagagaagcaaactataggtgcgttgcttactaaatattctcg

SEQ ID NO: 7134 - DNA, 326 bp, Mus musculus
  misc_feature (301)..(301): n is a, c, g, or t
gctggtcaccaagtgtggccgcctgcgtcacaaggagcccagcggaggcggcggcggcgtttactgggtggactcgcagcagaagcggtatgtacctgtgaaaggggaccacgtgattggcatagtgatcgctaaatctggagatatattcaaagttgatgttggagggagtgagccagcgtctttgtcttacctggcatttgaaggggcaactaaaagaaacagaccaaatgtgcaggttggagatctcatctatggccagtgtgtggtcgctaataaagacatggaaccagagatggtntgcattgacagctgtggccgcgcca

SEQ ID NO: 7135 - DNA, 283 bp, Mus musculus
  misc_feature (99)..(99): n is a, c, g, or t
gaaagggttgccatggtacttgataagaccttccctggtcggtcctgattcacagccgtattgctgtcatcctcctggattgggttgttgtcatatttntggtaacagactcttcttaaagtgctaaataatatttaaaacttttctcaaaagaagattttaggtcttctgtgaataagcatttactatattgcaaatcattgtaatatatgtaaacatgttatttgtgacacagttcttgataaagcattatgtaatgttaattttgttcatggctgtaagt

SEQ ID NO: 7136 - DNA, 247 bp, Mus musculus
gacagctttcacaagagcttgacagagccaattcactgttgaatcagactcagcagccctacagatacctcatagagtctgtgcgacagagagatgccaagattgactcactgatgaagtctacagctcaacttgagaaagatgtcagcaacttaaataaagagaagtcagccctgctgcagacgaagaaccagatggcactggatctggagcagctcctcagtcaccgcgaggaatttgcagctat

SEQ ID NO: 7137 - DNA, 221 bp, Mus musculus
tagaagcttctgtccaaaacaaactacagaaagtgaattttaacagctgtcaaaagttacctccatagtctctggacttcactgatccactttatagcatcgaatgaactaacttatgtaaaattatgtgccttcttcaaactcaatctaacattcagaatacatttatgcactggcatcttgctgtgttttggaagatacaggagtcttggttttttgga

SEQ ID NO: 7138 - DNA, 554 bp, Mus musculus
  misc_feature (331)..(331): n is a, c, g, or t
  misc_feature (382)..(382): n is a, c, g, or t
  misc_feature (394)..(394): n is a, c, g, or t
  misc_feature (402)..(402): n is a, c, g, or t
  misc_feature (418)..(418): n is a, c, g, or t
  misc_feature (422)..(422): n is a, c, g, or t
  misc_feature (435)..(435): n is a, c, g, or t
  misc_feature (440)..(440): n is a, c, g, or t
  misc_feature (444)..(444): n is a, c, g, or t
  misc_feature (462)..(462): n is a, c, g, or t
  misc_feature (464)..(464): n is a, c, g, or t
gaaggtatctcattggacacgtattcaaccttcatagagccattgccaacgccggacatggaacagaaggtgctggatcaagagcaagggactcaggaagccctgctggagagtgaaatgagagaggaggatcccttaggtggcttcaccattgatgacgtaaaatcagccctggagcgagtgacggatgaggttttgattagcatgcagaaagagataagtgaaaaactccaagtacaggaagaggcctttaacgcacgaatagagaaactgaagaaagcctgaagacgcggtacaagcaaagtgatgctcaacttcagagaaacaaacnaaaccggccagtacaatagtgtctctagagcgctgggtcacttccatgcantccgagaaaggnaaacccanttccggttatccggantgantggcagcacgttntcccncccntcccatcccacacccacntntgagtttatagtgtaagagcattgctttgtgtgtataatcttggagagttatatacgaaaatacaattactattaggatgctgttttgac

SEQ ID NO: 7139 - DNA, 583 bp, Mus musculus
  misc_feature (359)..(359): n is a, c, g, or t
  misc_feature (369)..(369): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (384)..(384): n is a, c, g, or t
  misc_feature (386)..(386): n is a, c, g, or t
  misc_feature (389)..(390): n is a, c, g, or t
  misc_feature (398)..(398): n is a, c, g, or t
  misc_feature (400)..(400): n is a, c, g, or t
  misc_feature (427)..(427): n is a, c, g, or t
  misc_feature (435)..(435): n is a, c, g, or t
  misc_feature (438)..(438): n is a, c, g, or t
  misc_feature (443)..(443): n is a, c, g, or t
  misc_feature (479)..(479): n is a, c, g, or t
  misc_feature (511)..(511): n is a, c, g, or t
  misc_feature (515)..(515): n is a, c, g, or t
  misc_feature (527)..(527): n is a, c, g, or t
  misc_feature (530)..(530): n is a, c, g, or t
  misc_feature (532)..(532): n is a, c, g, or t
agtacagtgcgccttcccattggtacccaccggatctgcacatgcgtgcccgcgtggacgagtttatggcctggcagcatacagctattcaggtgcccatgagcaagatcctgtggattaagttgataatcccaatgatcacgggtgaggaggttcccactgagagattagagaagacactggatgaggtgaagagaaacctacagcaatttgaggagaagtttctgcaggacaagatgttcatcactggggaccatatctcactggctgacttggtggcgctggtagaaatgatgcagccaatggggagtaatcacaatgtctttgtcagctctaagcttgcagaatggcgaatgcgngtggagttanccatcggntntgncntnttnntgggaggntncatgaaagactggtgaagttaccaaantgggactnttngacantagaccctacgatcaagatgaggatttgtgactttntgcagaagtttaagtgatccaagagagcattngttntacaggggccanccntntttgccttttgagcctctttccctagggaagtcaccaagaaacacactgtt

SEQ ID NO: 7140 - DNA, 330 bp, Mus musculus
aaaagaatactgtagctcccgtgctgtttacatgtttctgtcgggaatgaaaccctggactgttgtgtttttgtctgtgttgccatcccaggcctgtgataggagcttgtggctgtattgtaatgtctgggcagtgtctggggagtccttttcacctgcccaaatagggacaagccatcgctagaagaggcctccacccccttcctatgctccatagcttggatttcagggactctgatggcaagtgcatcatgaacctacctcaggctacctcccagtcctcccacagtcctatgtaggaatcgaatgaatggatgtctctgagccctt

SEQ ID NO: 7141 - DNA, 317 bp, Mus musculus
  misc_feature (290)..(290): n is a, c, g, or t
ctctgatccagaccaccaaaaatactcactttgagtgagaatttttcaaccataaaaacatatagcccccaaagccatgtggagaaggagagcccacctccttgcactgtgctgaaacatagaggtttccccctgccttttcttatgtatgctttcttgacccaaggcagaagtgtggagtcttagagctttgtaattcctgttctctggctccctttaaaggccatttttgtcctttgcaaggtttggtagtctcacccttagttcgatgaaattccctacaactcctntcaaagcactctacctgggtccggaca

SEQ ID NO: 7142 - DNA, 458 bp, Mus musculus
  misc_feature (200)..(200): n is a, c, g, or t
  misc_feature (416)..(416): n is a, c, g, or t
  misc_feature (422)..(422): n is a, c, g, or t
  misc_feature (433)..(433): n is a, c, g, or t
gaatgtccttggcatcactgtgatgtatgtggcaaaccttctacctcattttgccacctctgccccaactcattctgtaaggaacaccaagatgggactgctttccgttccacccaggatgggcagtcctactgctgtgagcatgacttgagggcagactcttcaagtagcaccaagactgagaaaccctttccagaatnactgaagtcaaaaggaaagaggaagaaaaggcggtgctggcgaagggtcacagatggcaaatagcgcttggtcagatcctggggtggtgtggggcagccagccctgcagacagtgggaaggcaagcacggcacccaccccaaggacccagctcctagcgctgtgtataggcctgcttgggtgggaggcagctcctcccaccactgagccatcctcnagcagntgcgctgcgtntgcactgatgcctgtcagctgcagg

SEQ ID NO: 7143 - DNA, 538 bp, Mus musculus
  misc_feature (53)..(53): n is a, c, g, or t
  misc_feature (325)..(325): n is a, c, g, or t
  misc_feature (362)..(362): n is a, c, g, or t
  misc_feature (375)..(375): n is a, c, g, or t
  misc_feature (381)..(381): n is a, c, g, or t
  misc_feature (413)..(413): n is a, c, g, or t
  misc_feature (418)..(418): n is a, c, g, or t
  misc_feature (459)..(459): n is a, c, g, or t
aagagtgggcttctttgcagtctgtggagaattgtccggaggccttgcttcangttggaattgccactggacctagctgtgctgcaggacatcgagcaggagctgtgtaatgaagaaaagtccatcataagcgagtatgaagaggacttagagtttgatgaaagttgtctcaggagaatgttggctgagtgggaagcaaactccctcatctgtcctgtgtgtataaagtacaacctgagaataatgaacagtgtggtcacgtgtccatgtggcctgcacatccctgttcactcaacagacctgacagagcagaagcttcgagccngtttggaagaaaatgtgaatgagcacagtgtacactntccccacaccccngtgttntcagtcaccggtggaacagaagagaagcccantcttntgatgaactgcctgacttgtgacacctgggctgtgatcctntagccatcccgacctcacacttcactactgagctgagaacaactcatttcctgagagggccctgtatgcacaagccttt

SEQ ID NO: 7144 - DNA, 462 bp, Mus musculus
  misc_feature (353)..(353): n is a, c, g, or t
gaaagggactagtgcttgccaaaggggcctgagagggaagcctggtcagcaccgtgtggacagccctgcactgttttccaaagatgctcttgaagtagtcctcattaacacagcttgccttcacctgccaaagctcttcatcatgggctgcatgaagtcaaaggaaacgttcccatttcctaccacattggacattgacaagctgcatgagagtgaggaggcctttattccagatgacagcagtcaatataggacaccttctccaggtgaacaacagcaagtccaggaagtaaagaaactcccagagcccggtgctgtgatcggtgccctgatccttgaattcgcagaccgtntggccagtgaaattgtggaggatgccttgcagcagtgggcatgtgaaaacatccagtactacaacatcccatacatcgagagtgagggctcagacaccaccattaattg

SEQ ID NO: 7145 - DNA, 256 bp, Mus musculus
  misc_feature (31)..(32): n is a, c, g, or t
  misc_feature (35)..(35): n is a, c, g, or t
tgacgcagcacctgctgcagcggcggctgcnncantggacttccttctgcgtgccctacagtgcggtccacaacgaccagttcggcctgtcgcacttcaattggccggtgctgggcgccaactaccacgtcctgcgcaccggctgcttccccttcatcaagtaccactgctccaaggcgccctggcaggacctggccccgcaggaccgcttcttcaccgcgctcaaggtcatcaacctgggtattccaactttatt

SEQ ID NO: 7146 - DNA, 69 bp, Mus musculus
tggtcggctcctaaaccctgcgctagcccactctgtctctgtagcgtcgtgcggcaatatttttagctg

SEQ ID NO: 7147 - DNA, 365 bp, Mus musculus
  misc_feature (97)..(97): n is a, c, g, or t
  misc_feature (128)..(128): n is a, c, g, or t
  misc_feature (130)..(130): n is a, c, g, or t
  misc_feature (147)..(147): n is a, c, g, or t
  misc_feature (155)..(155): n is a, c, g, or t
  misc_feature (200)..(200): n is a, c, g, or t
  misc_feature (207)..(207): n is a, c, g, or t
  misc_feature (219)..(219): n is a, c, g, or t
  misc_feature (226)..(226): n is a, c, g, or t
  misc_feature (235)..(235): n is a, c, g, or t
  misc_feature (262)..(262): n is a, c, g, or t
  misc_feature (271)..(271): n is a, c, g, or t
tcaaatgtgagcgagaactgggatttaagggtcacactttgggggtatcccaggtctgctttctgcccgagtccagtctgttgcttactggaggganatgatgggaggatcaggttgtgggatgtgancngtaagatggagaagctncagaaganccctgcgaggcacatccacaggaagaaagcaaagagggcagcgtnccccacncagggtggaaantccaganccccagganccgaggatgaggggcatgcaaagattntgccaaagntcgatattgaacacggagaaaaagtgaactggcttttaagtacaaaaattaaagggaacaaaagcatattagtggctgatcaaacgagttgtgt

SEQ ID NO: 7148 - DNA, 213 bp, Mus musculus
gagggagcacgtgggcacggaccatctggggaacaaatactactacgtcgccgagtacaagaactggagagggcagactattcgagagaaaaggattgtagaagcagcgaacagaaaagaggtagactatgaagcaggagacatcccaaccgagtgggaagcatggattagaagaacaaggaagactccacccactatggaggaaatactaaa

SEQ ID NO: 7149 - DNA, 424 bp, Mus musculus
  misc_feature (38)..(38): n is a, c, g, or t
  misc_feature (58)..(58): n is a, c, g, or t
  misc_feature (232)..(232): n is a, c, g, or t
  misc_feature (249)..(249): n is a, c, g, or t
  misc_feature (251)..(253): n is a, c, g, or t
  misc_feature (283)..(283): n is a, c, g, or t
  misc_feature (288)..(288): n is a, c, g, or t
  misc_feature (290)..(290): n is a, c, g, or t
  misc_feature (316)..(316): n is a, c, g, or t
  misc_feature (363)..(363): n is a, c, g, or t
  misc_feature (365)..(365): n is a, c, g, or t
  misc_feature (376)..(376): n is a, c, g, or t
  misc_feature (399)..(399): n is a, c, g, or t
agcagccaccctactgagcagtcagcaccctccagttncagacacaggtgatgggccnttccacagattaccaagaaatctgtcacatgaaaaagaaaactgtggagtttaacttgaacattccagagagccccacagaacatcttcaacagcgccgtttggaccagatgtcaaccaatatacaggctctaatgaaggagcatgcagagtcctatccctacagggatgaagntggcaccaaacctgttntnnnatgagtgatgcctcacagcctggccctganttgcnanggatgcccagcagggcactgacccantcaaaggcacacaagcagcgacacccaggagtgtgttcccacgacantntagcatgtaantcagaaccaagagtacttaatantcctgcctgaaaacacctgtatttt

SEQ ID NO: 7150 - DNA, 344 bp, Mus musculus
  misc_feature (120)..(120): n is a, c, g, or t
  misc_feature (222)..(224): n is a, c, g, or t
gcgagactgttctagtgtgcccagatgcacagggtcctggagcacaagggccagcagaacccaaagtcagggctgcttgtggccaagcaggccagagtagtcatgggtgtggctggggcntgcagcttactcagggacagtgggccatctggagggtcacctcatagcagggaagcaagaccagaaccaacccaagggcccccgagaacacagaagggcaannntgggtgctggtcattggctaagattctggtgatacccaccactcttaagaggatataccctgttctaggctggtcgccatgacgtctggggctccatgactatgcctagcacctgtcctg

SEQ ID NO: 7151 - DNA, 433 bp, Mus musculus
  misc_feature (127)..(127): n is a, c, g, or t
  misc_feature (129)..(129): n is a, c, g, or t
  misc_feature (148)..(148): n is a, c, g, or t
  misc_feature (305)..(305): n is a, c, g, or t
  misc_feature (310)..(310): n is a, c, g, or t
aaaagctggcatctgacccggctctgcatcgtaaactggcccgcctgtccgcaggctctttcgcccgccttgtggaactcttctctagccgggaaagcagctcctccccaaattgctccagcccgtntntgccgtgcccggggccccnaccgccatccccggatcctctggcacgcctggcactagccatggaattgagccggcgtgtggctgggcttgggggtcccctggccaacctcagtgttgagcatgtacacagcttcctgccttgggtccaggcccatgggggatgggcaggcatcctngcctncctcacctgtggacttgaacttgcccttggactgaacgtttcctctgacccagcatagatgactgaaatatgacgacacacacatcagggctgtagggtggtggttgccctaccttttttatg

SEQ ID NO: 7152 - DNA, 333 bp, Mus musculus
  misc_feature (227)..(227): n is a, c, g, or t
  misc_feature (230)..(230): n is a, c, g, or t
  misc_feature (242)..(242): n is a, c, g, or t
  misc_feature (244)..(244): n is a, c, g, or t
  misc_feature (252)..(253): n is a, c, g, or t
  misc_feature (255)..(255): n is a, c, g, or t
  misc_feature (267)..(267): n is a, c, g, or t
  misc_feature (272)..(272): n is a, c, g, or t
  misc_feature (282)..(282): n is a, c, g, or t
tcgccagacttctcgctatcaggaaagagttgcttttgccgaagagattaagatggcgagagagacagactgcgacttggataagaaaacttccttgacttcagatgcagaaatgagacctgaaccaccggctctgtgcgtgaaccctggcaaccctgtgttttcctgtatgttggatcccaagacattgcacacagccacctcactgtccaaagcccagatgattnatntacaagaccagntnccagccannanggggccttctcncccangcccttcttntttccctgtaagttcctaccacaagagcaagcgtttacagagcacctcaaa

SEQ ID NO: 7153 - DNA, 425 bp, Mus musculus
  misc_feature (53)..(53): n is a, c, g, or t
  misc_feature (61)..(61): n is a, c, g, or t
  misc_feature (71)..(71): n is a, c, g, or t
  misc_feature (96)..(96): n is a, c, g, or t
  misc_feature (140)..(140): n is a, c, g, or t
  misc_feature (298)..(298): n is a, c, g, or t
  misc_feature (355)..(355): n is a, c, g, or t
gggttggaacctcacgcaacgtcttgacattggtaacaacatggcggccctanggctctanactctgagcntccgggctgtgtgctgcagaggggnaaggtgtcagtctctgtgctctgcttcctgctgtccctgggaantggcttaacttctctttgcccagaggatgtccctcctccttccttgaccttctgaaagtgacacctctgtcattgatgagcaggagaggggaactgactgtgggcacttgcacaattccacatgtatttaatctcagcgtggccatgctctgtcattntctgacttgctatccctgtcattcaaaagtcagcttgattgtcgggcttggcgacangcagggctgtgatcccagcagtcaggggctgaggcaaaataacagaagtgttagactagactggactaca

SEQ ID NO: 7154 - DNA, 344 bp, Mus musculus
  misc_feature (102)..(102): n is a, c, g, or t
  misc_feature (107)..(107): n is a, c, g, or t
  misc_feature (162)..(162): n is a, c, g, or t
  misc_feature (176)..(176): n is a, c, g, or t
  misc_feature (214)..(214): n is a, c, g, or t
  misc_feature (266)..(266): n is a, c, g, or t
gataccattggatcacgggaccttgctaatcatggaaggagccacacaagccgactggcagcaccgagtgcccaaggaataccactccagacaaccgagagntaaancttaacctttcggaccgtttatccagacccaagaggagcccctcggtgacacttntacagagttaccantgaggggagggctatgcacctaacagcccctccccatntcccgcaagcacttccgtgatgtggctgttcagaaagcgtggtgtttgcttntcaggttctactcctcctgaatgagagctgccagcacgtcaccttgtcaacatgtctactacaggaacacttactttg

SEQ ID NO: 7155 - DNA, 471 bp, Mus musculus
tacgtctgacaagcataggccgagaagtgcaagataacttttacccttaatgattttgaagttaagtgattgctcatttgcaaaaaagtaatattttttaaaagcccatttactatgagttgagaaattgttatatttggaacaggttatattggaaatttgactttttaaaactcaaattgcccagcaaatcatcccctcagtttgaatgcacaggtgtgttaatctctgcaagtagttcccagcaggggctgggtgaggaatatctatcttataccctgctcaacagcaccattgcttggaacttgaaccactttaaagttagatactaaggaaacttagtatctcaggtcttagtagcatagatactaagaaacttgaattgctggtcatctttttccttttctttttcctctttgtgtatcactaaacgactagtttctcttccgtttgttggttcccattgtgtat

SEQ ID NO: 7156 - DNA, 466 bp, Mus musculus
  misc_feature (46)..(46): n is a, c, g, or t
  misc_feature (342)..(342): n is a, c, g, or t
  misc_feature (353)..(353): n is a, c, g, or t
  misc_feature (355)..(355): n is a, c, g, or t
  misc_feature (407)..(407): n is a, c, g, or t
gctgccctcggaaatccacaggattcttcacggcaggcccgagtcnctcctacaggacatgtcgccagctgacgaggaagagcccgagccccctcttttggcgggtggcatggacagcgtgtctgagagcacaggcagcatcctgagcaaacttgattggaaagctgttgaagacatggtggccagcgtggaggataagaacctgtctgtgcactgggccttggaccagtaggacctgcatgacattctctttcccagcactggccagagtctcactgttgtggccctcagagttctgtgggtctaagactgcgaaataatgaaagaatttatatcctgcanccataggcttntntgggttaaccattcattccaagatggaaagtaaacatgaatcagtaatgttncctttatgagaaaggttgtttaactagagaaaaagtattacgttttgcatatctgattc

SEQ ID NO: 7157 - DNA, 461 bp, Mus musculus
acaccaggagctcttttttgcagtctgtgccaagtcaagcagagaccaacctcaggttgctgactaagtcctggtggcaaaaggcttcggtgccagagtccaggagaaagtgctgtgtgcacttgactgaggccagtttccatacaaagcaaacagctaaagaagtgcttttttccaggacaattctggaagaaataaaaaattcaagctggtaagcttaattttgtgccatttctttaaaagagtaaattctattatgaaataacttagtggaaaaagaaaacaaacaaacctagctgtaaattataacttcagactgctaaggctccttaggcagtttgtctgtttacagtctgtccctctccttcggacctgggcagttactgtttcacctgtattacactggaccaaagctctcaatgagaaatacccaccctcatctcccatcttgttctttatgt

SEQ ID NO: 7158 - DNA, 400 bp, Mus musculus
ttgactcttcggatcagcactggatgaagatgctgtcgtcgtcttgttagataatgctgtgccctgtcatctcttcagtactgtggaagagcctggggctgctgagcatctggagtctggatcagatgtgtgccttaatatttggtaggcactccagttagtgaactggcctgcaagcatggcaggatgtggctttgtatatttgaggaagactttccaacagtcaaatgtgaaatttgagactttctattacccagtgactgaccttttggtaagtcttgagagggtggaaagaaaaagcaggcttcaactttgtggtcagcactacatgcaggtattgaatacttctaaaaatgtgaaattcaacagggaagaagtggtttctacagtattccttgct

SEQ ID NO: 7159 - DNA, 508 bp, Mus musculus
  misc_feature (145)..(145): n is a, c, g, or t
  misc_feature (210)..(210): n is a, c, g, or t
  misc_feature (301)..(301): n is a, c, g, or t
  misc_feature (339)..(340): n is a, c, g, or t
  misc_feature (342)..(342): n is a, c, g, or t
  misc_feature (344)..(344): n is a, c, g, or t
  misc_feature (346)..(347): n is a, c, g, or t
  misc_feature (349)..(350): n is a, c, g, or t
  misc_feature (352)..(352): n is a, c, g, or t
  misc_feature (355)..(357): n is a, c, g, or t
  misc_feature (360)..(361): n is a, c, g, or t
  misc_feature (364)..(364): n is a, c, g, or t
  misc_feature (417)..(417): n is a, c, g, or t
gggatgcggacagcctgaaactcttaggggctgccctccggaaagggaagcaggagtcgcaggaaggggttgctctcccggtgtatgtgatttgcaaactgggaaacgactcccagaaagctgtgaaggtcctgcagtccttaanggcagtgccggagttagactctttaactgttcaggacatcgtggggggactcatggcctgggccnccaaaattgatgggacatttccacagtactgagaggacagcatgtgattcgtgtggatgacggttgtgatacctgaagaatctattcgagntttacaaaataatgtagggaagagcctggattcacggnntncngnntnnanaannngannccncccccccccccccccccaaggagctttttgagaaaagaggatagcattgcctntgagagctacttttgggcacttgtgcagcaccttcaacatgtgacttggtacgacaggattttttgtttcccacccggtcagattaaactg

SEQ ID NO: 7160 - DNA, 400 bp, Mus musculus
  misc_feature (300)..(300): n is a, c, g, or t
  misc_feature (337)..(337): n is a, c, g, or t
aaaacatgcgagtcccacatttccttcatgatcacagccggtacatggagcacttagagaggatcatggaggtgaacgagctgacagacgctgagctgaaaaacctcatctaagcagcagagccggctcttcatggctgttagcagctagggcacccagcacctgcagaactagaggagagcagctgaccttcgcttgttgaagaccagctctcaggatccagctgaaattctaggttccatgtagacctgaaactattttcctagaacatttctatagacttcgggtggaagtcacttntcttttcattcagatctctccagagacaaatgaaganttcgctgctggtgacaccacgatgagctgtgaacttgggcaccaaggccagctctggattgga

SEQ ID NO: 7161 - DNA, 167 bp, Mus musculus
gagcctgctggtcagagcttagcatcatcgcatgtctttccttctgcccattgcctgaaacgaagttgaaatacgaagaaggtggacacctccgatcatgtgctgcacgggtgtcctttacagacttacctcacttttttgttaacttgcctgttgccgcaatgttt

SEQ ID NO: 7162 - DNA, 276 bp, Mus musculus
aagcgcctggccaaagtcccatggacggtcgacgaggccgaagacctggaaaagagctggcttctgttggcagatatctattgccaaggcggcaagttcgacctggccttggagctactgcgccgatgcctgcagtataacaagtcttgctgccgggcctatgagtacatgggcttcatcatggagaaagagcagtcatacaaggatgcagcaaccaactacgagctggcctggaagtacagtcatcaggccaaccccgccattggtttcaaactg

SEQ ID NO: 7163 - DNA, 412 bp, Mus musculus
  misc_feature (344)..(344): n is a, c, g, or t
  misc_feature (348)..(348): n is a, c, g, or t
  misc_feature (357)..(357): n is a, c, g, or t
aagttattacagtgcccctatgataaaaatcaccagatcagggcctgcaggtttccttatcatcttatcaagtgcagaaagaatcatcctgatgtcgcaaacaaattggctacttgtcccttcaatgctcggcatcaggttccccgggctgagatcagtcatcacatctcgagctgtgatgacaagagctgtattgagcaggatgtggtcaaccaaaccaggaaccttggacaagagactctggctgagagcacatggcagtgccctccttgtgatgaagactgggataaagatttgtgggaacagactagcaccccatttgtctggggcacagccagtttctntggncaacaacantcctgcaaataacatagttatggaacataagagtaaccttgcttcaggcatgcga

SEQ ID NO: 7164 - DNA, 544 bp, Mus musculus
  misc_feature (295)..(295): n is a, c, g, or t
  misc_feature (303)..(303): n is a, c, g, or t
  misc_feature (311)..(311): n is a, c, g, or t
  misc_feature (318)..(318): n is a, c, g, or t
  misc_feature (339)..(340): n is a, c, g, or t
  misc_feature (347)..(347): n is a, c, g, or t
  misc_feature (350)..(350): n is a, c, g, or t
  misc_feature (360)..(360): n is a, c, g, or t
  misc_feature (371)..(372): n is a, c, g, or t
  misc_feature (374)..(374): n is a, c, g, or t
  misc_feature (378)..(378): n is a, c, g, or t
  misc_feature (493)..(493): n is a, c, g, or t
  misc_feature (511)..(511): n is a, c, g, or t
  misc_feature (514)..(514): n is a, c, g, or t
  misc_feature (516)..(516): n is a, c, g, or t
  misc_feature (518)..(518): n is a, c, g, or t
gagtggccactcatccaattgtaatcctgctgcttactatggaactgtcaatctgtgctttcttcttcttcctctactccttagccatcaacagatacattcccttcgtcttctggcctatgatggatctgatgaacgacctggcctgttccacattcctcataggtggtatattctttgctcttgaagcaagacgagaattgccagtgccctacttaactggtatgatcctcatgggtgttacggcatttataagtatcattgacctgtgtcttcagaggagacaatttaaaancaggaagnttcgaaantttattntacttaccccagacaggaaanncaagaancangacccgaaantccttttaatnntngctnccaaagaggatgaggaggagaggcaaagggaactggcagagaaagcgaagagggagtcgatggaccctggatggtgactgcgcagccacacctgtggtcagggacagctgcgaantctgcagccaggcctttntantntntttcttttgccagatttccagcagag

SEQ ID NO: 7165 - DNA, 561 bp, Mus musculus
tgttctagttctacagatagccctgtctggtacacatctacttccctggaccggaacaccttggaaaatatgcttgtacgggttcttctagtaaaagatatttatgataaagacaattatgaactggatgaagacacagactaaaaaggaccatttcagaagcaatgggataacacagcattagatagtcatgctgctagatctttacaggaaaacattttaagtttactccttctgttctgagttttgtagcaatgtacccacactgggtattaccatgtaaataatctgtgtgtgaaagttgccattattctatgtagtggttttaggatacttaacaaatacatcaaattcttttttattattatttatttgattaggtatgtttgtaactttttacattacaaataagaagagaatgtgccatgtataagtttttcttgttgcactgctctgctgttgcaaagctccctgcagagggcgggctttatgcgttcctgaccagatggttgtgtatgggtagcactactcaagtttagaacttgcggtgtctttcagaat

SEQ ID NO: 7166 - DNA, 544 bp, Mus musculus
  misc_feature (204)..(204): n is a, c, g, or t
  misc_feature (233)..(233): n is a, c, g, or t
  misc_feature (328)..(328): n is a, c, g, or t
  misc_feature (426)..(426): n is a, c, g, or t
tggtagcgagccagccagagacagctggggagaggctacaggataccagtgataaagagccaagggacaagagatctcgagagaaagaccctgaaacttctagatgtcatccggacacctgcaggaagcacagcagtcactcagagtttgccaggttctccagaaggaatgaagacgaggcaaagtgggggaaaggcttcgccnaggacagagggaagaagggccaggatggnagtgtccccatggacgtggcagagagaagcggcaaggagcacaaggagtatgacagcctggggccaagaaaggatcgcctgggacacaaggcccnagtagaccatgggccatcgtccctgttgatgtgctctgcagccacacagccatgttccccgggtagaaatccttgcaaagctagataagaacaatctngccttgtgttcgtaggtctagagttgtactctgtctatgtcttcccatgtgggctgaatttcaaagtccataccttctagagtgttcttgctcatctgggatgcactaaacttggaac

SEQ ID NO: 7167 - DNA, 552 bp, Mus musculus
ttcagcaaatcctcagtcacgtcggctgctgcagtaagtgccttggcaggggttcaggaccagctcatcgaaaagagggaaccaggaagtgggacggaaagcgatacttctccagacttccacaatcaggaaaacgagcctgcgcaggaggaccccgaggacctagacggctccgtccagggagtgaaacctcagaaagccgcctcttccacctcctcaggaagccaccacagcagccacaaaaaacggaagaataaaaaccggcacagaatgaatgtctccccccaaactggctggcaccagctccatctgtgacacccccgcccccatcgagaagtgcacacacctctgattctgtgttaagctgaaagtagaacccaaggtccattgcagatggaggctgtaaatatctgccattctcttgttttgttttgtgttgtattgtttttttattgttgcttttaccatctgattttcttttgggacattttgtgatgcctgtaccttcctgatgacacatctgatcgtctgtttcatgtggtgtcgatattc

SEQ ID NO: 7168 - DNA, 181 bp, Mus musculus
gaaagcaaattaaccattgtcagctttggttttggaattgaatgtgcagactgctcaccagcccttgaaagaaattaacccagaaaagcattcactgacaaagaagatatttcatagtagaaaaatattcaaacctggatgataatgtatcattctgatgactatttctgtggaattcgta

SEQ ID NO: 7169 - DNA, 282 bp, Mus musculus
gaattcgtatacattccctccttgatgactgtgttaaaattaactgagtcagttgtgacacacagtatagcctcagcactttagaaggggaagtgggaggatcatttgagcccagaatttgagatcacactgagcaacaccccacctcagaacagcatccattcttgttcttcactcctgacaggaggcttacatgaaaccttgtttaataaatggtttgatgtatttgtttaagtatttctgactatgctaaatattctatacctctaatttatcttttta

SEQ ID NO: 7170 - DNA, 519 bp, Mus musculus
aaactggtgcatagtgccctggcaaatttggatggtcatccagaggacaaaaaaacacacattgtctttgcttctgataatgaaagtgaaacggaagagacatccactcaggagcaaagctgtccagaaaaggagctgatgaaagaatctgtgagtaaatcgcctgggaagctgtttgacagcagtgatgatgaagactcagattccaaggaggacagcaccaggttcagcattaaacctcagtttgagggcagagctggccagaagcttatggatctgcagtctcagtttggaagtgatgagagattccgcatggactctagatttttagagagtgacagtgaggacgaaaagaaagagctaaatgaagataaagtgaatgaagacgagcttgctgcagaaaaaaagaaaaccctgaatgttgtgcaaagtgttttgaacatcaatgtgaacaacccgacgaacaaaggatcagtggctgctaagaaatttaaggatatcgtacattatgacccaaca

SEQ ID NO: 7171 - DNA, 231 bp, Mus musculus
gtcaggaaacttagccctacgcagtcttttgggcagacaaggagaaaagctgtatacaccaagtggaaacattgtccccagacactggtttcgcatcaaccatttgccctacaccacccgccgggactctctacaacagatgtggagggcaacagtcagcccaggccgcttctgagaatccaggcaacagggcagtcctggcttgcataggcactgcctcgtgatgaactt

SEQ ID NO: 7172 - DNA, 401 bp, Mus musculus
  misc_feature (157)..(157): n is a, c, g, or t
  misc_feature (176)..(176): n is a, c, g, or t
ctggagataagcatgaccttgaaacttcagggctattccccaagtacatcaacaaaaaggattatggcatcacgcctgagtacatatgcaagcgaaatgaggatgtgaagaaagcacaagaagagtatgacaattacatccaggagaacctcaaganagcggccatgaagagactntctgacgaagaaagggaggcagttctgcagggactgaagaagaactgggaagaggtgcacaaagagttccaatccctctcggtcttcattgattctgtaccaaagaagattcgcaagcagaagctggaaaaagagatgaagcagctggaacacgacatcagtgtcattgagaagcacaagatcatctacatcgctaacaagtgagccaactgttgcaggacagaa

SEQ ID NO: 7173 - DNA, 527 bp, Mus musculus
  misc_feature (343)..(343): n is a, c, g, or t
  misc_feature (361)..(361): n is a, c, g, or t
  misc_feature (383)..(383): n is a, c, g, or t
  misc_feature (436)..(436): n is a, c, g, or t
  misc_feature (467)..(467): n is a, c, g, or t
  misc_feature (491)..(491): n is a, c, g, or t
  misc_feature (494)..(494): n is a, c, g, or t
ttcagcctcaggaaactttctcgaaccctgccttacgcgacgaagacaaacatttgggaaatctgtgggcttctaagaaatcgctgtataagaacccagctcaccttgcgcaacagcaggatccctggagtcggctcagctcaacccccacagccacgtccagaagtcgagacaccttttttgattctaagataccaaaggatgacctggacttccgcttagcaaccttgtataaccaccacactggggcattcaagaacaaaactgagatattgttacaccaggagaccattgaggatatccagggaaccaagatccagtttcctggagaatgtttccacgntccttcagcccccattanttcccggaccaccatcaggcantggatcaaccctaagaaagagtccatccatagcattcagggatccatagtgtntcctcacactgcggccaccaatggaggttantcccggaaaaatgatggtggcttnttntccacctagtggtgacaaccaggctaatttcaa

SEQ ID NO: 7174 - DNA, 494 bp, Mus musculus
  misc_feature (296)..(296): n is a, c, g, or t
  misc_feature (317)..(317): n is a, c, g, or t
  misc_feature (391)..(391): n is a, c, g, or t
  misc_feature (440)..(440): n is a, c, g, or t
gtataatctgtgtggagggcttcaagaatcactgtgaggaattctggcacacaatcagataccccaattggaaacacatttcctgcaagcatgcagaaagtgtggagacagagggggacggtgaagacctgcgcctcttccattcgtttgaggaattactccttgaggcccatggtgactatggattgcggaatgattatcacatgaacctgggccaattcctggagtttctgagaaaacacaagagtgagcatgtttttcagatattatttggtattgaaagcaaaagctcagantcctagaaccctattaagatntctacgcttgtaaccgcattaagtatttatgttactaagaccaaaataaaaaggctaatgacaatatagaattntgggtgaaaaacctagctctagaatttcctgactgctgatgctaatagnccctttaactttgtaccagtgtaactgtgatgctgtttccaggttgctgtgtaa

SEQ ID NO: 7175 - DNA, 359 bp, Mus musculus
  misc_feature (84)..(84): n is a, c, g, or t
  misc_feature (149)..(149): n is a, c, g, or t
  misc_feature (298)..(298): n is a, c, g, or t
  misc_feature (300)..(300): n is a, c, g, or t
  misc_feature (334)..(334): n is a, c, g, or t
cattgtctagaggtcttggaaggacaaaggggtaaagaatttgtacagctcctccataaactcctacaaactgaaaccccaaanggcacagccacctctccagacactgtcatctcatcagcagagccagagagagtgtccagttaccnagagcccactggtgagcttaagaaaaaaacaacgtcacctcagaatataactctgaagaaaaataatagcctccaaaatgcatcagtgggttgcaaaaaggtaaggtcaaatatttatatttaccctgacttcagtacatggatcaagntnacttttgttcatggaggaaattggagatttttcntcagtgccaccaagttagaggaatt

SEQ ID NO: 7176 - DNA, 529 bp, Mus musculus
  misc_feature (332)..(332): n is a, c, g, or t
  misc_feature (353)..(353): n is a, c, g, or t
  misc_feature (371)..(371): n is a, c, g, or t
aacagcagcggtcgttcatctggagtcccaaggaccgcaagtaagaaggatctggccaaacagagacctggagaaaaaagcaggaaaaatcttcagttactgaaggacatgcagaccatacagaattcactgcagagcagtaatctgtgttgggattactgacaccaggtcataaatgatgtacctcactggtcataaacgatgtacgtactggacatgagcagactttccaggtctcatgcttgctaagctgccattactggcaggtgttaggggccaagcttcattacagtctattgtgctatgtagcacaactgatggagatggagttntgcggcagagaagcctcactntctttgaatttgctgtantcattcactgcactttgtaaacaaatgaccagttttttactcatgggtgtgttttttaaactaggtatatatgtaaattgggtttgaaaattcagaatatgagatagtccccatagtcagtgcttgaagtcttgttttttaaatcttcccacagcatg

SEQ ID NO: 7177 - DNA, 568 bp, Mus musculus
  misc_feature (329)..(329): n is a, c, g, or t
  misc_feature (355)..(355): n is a, c, g, or t
  misc_feature (359)..(359): n is a, c, g, or t
  misc_feature (377)..(377): n is a, c, g, or t
  misc_feature (379)..(379): n is a, c, g, or t
  misc_feature (406)..(406): n is a, c, g, or t
  misc_feature (409)..(409): n is a, c, g, or t
  misc_feature (416)..(416): n is a, c, g, or t
  misc_feature (448)..(448): n is a, c, g, or t
  misc_feature (518)..(518): n is a, c, g, or t
gcagagccatattttctgctcttaagaatcttcaagataagattcgacgcctggaactggaaaggattcaggcagaagaaagtgtgaaaaccttgtctagggaaaccattgagtacaagaaagtattggatgaacagatccaagagagggagaactcaaagaatgaagaatcaaagcacaatcaagaactggcatcccagttggtagctgcagaaaataaatgtaatcttctagaaaaacaattggaatacatgcgaaatatgataaagcatgcagaaatggagaggacatctgtgttagaaaagcaggtttctctagaaagagaacgncagcatgatcaaacccatgttcaganccanctggaaaaactggatctntnttgaacaggaatacaacaaactcaccnccnatgcagncccttgcagaaaaaaagatgcaggagttggantccaaactccgtgaagaagagcaggaaaggaagcggatgcaggcccgggcagcagagttacagagtggtntagaagcaaatagacttatttttgaagataagactacttcatgtgtttca

SEQ ID NO: 7178 - DNA, 132 bp, Mus musculus
  misc_feature (72)..(74): n is a, c, g, or t
  misc_feature (77)..(77): n is a, c, g, or t
  misc_feature (79)..(79): n is a, c, g, or t
caactcacaaaacgtctatcagaaatgattaaagataagctaaaagaattgggatatgaccggtataaaatnnntgntncaagtggtgattggagagcagaggggtgaaggagtattcatggctgctcgctg

SEQ ID NO: 7179 - DNA, 446 bp, Mus musculus
  misc_feature (237)..(237): n is a, c, g, or t
  misc_feature (310)..(312): n is a, c, g, or t
  misc_feature (315)..(315): n is a, c, g, or t
  misc_feature (317)..(317): n is a, c, g, or t
  misc_feature (374)..(374): n is a, c, g, or t
tctagagatctgttggaccagacgcagggatatggctgtgtccttccgcggcctgtccttatcggctcactccgagggcttgagtgaggtcgacaagaactcaggggagcctgagaacacctacattctgaggcccattttccagcaaaggtttagaccctctgtggttaaagactgcatccatactgtgctcaaggaagaattggcaagtgctgaatattctccagatgaaatgcntcaactcacaaaacgtctatcagaaatgattaaagataagctaaaagaattgggatatgaccggtataaaatnnntgntncaagtggtgattggagagcagaggggtgaaggagtattcatggctgctcgctgtttntgggatgcagacacggacaactacactcacgatgttttcatgaacgacagcttattctgtgtggtggcagca

SEQ ID NO: 7180 - DNA, 371 bp, Mus musculus
  misc_feature (78)..(78): n is a, c, g, or t
  misc_feature (90)..(90): n is a, c, g, or t
  misc_feature (96)..(96): n is a, c, g, or t
  misc_feature (106)..(106): n is a, c, g, or t
  misc_feature (108)..(109): n is a, c, g, or t
  misc_feature (112)..(114): n is a, c, g, or t
  misc_feature (123)..(123): n is a, c, g, or t
  misc_feature (128)..(128): n is a, c, g, or t
  misc_feature (155)..(155): n is a, c, g, or t
  misc_feature (159)..(159): n is a, c, g, or t
  misc_feature (169)..(169): n is a, c, g, or t
  misc_feature (181)..(181): n is a, c, g, or t
  misc_feature (183)..(183): n is a, c, g, or t
  misc_feature (198)..(198): n is a, c, g, or t
  misc_feature (200)..(201): n is a, c, g, or t
  misc_feature (221)..(221): n is a, c, g, or t
  misc_feature (229)..(229): n is a, c, g, or t
  misc_feature (244)..(244): n is a, c, g, or t
  misc_feature (246)..(247): n is a, c, g, or t
  misc_feature (254)..(254): n is a, c, g, or t
  misc_feature (300)..(300): n is a, c, g, or t
  misc_feature (302)..(302): n is a, c, g, or t
  misc_feature (304)..(305): n is a, c, g, or t
  misc_feature (345)..(345): n is a, c, g, or t
gattttaatatctccattgatgtacttttcctcgggtgaccatatataaagtatcggaaaccagacatgacgcctacnatgtgtggtgcngtgatntggtatgagnannaannnaagaccacnaggcnaggtaaaactcagaaagaaagcatttnaccntcacgtgttnacatggaggaantnttctatttctcaaancnnacatgtcacatcctgtgtgnacactctnagagagacttttccntnntccaccnatagggaatttattcccagagaagagtacattgaccagagagtacntntnnttattattttcactcacacacttcatattagctttgactntactgtgagacttttgtaactttgtt

SEQ ID NO: 7181 - DNA, 416 bp, Mus musculus
  misc_feature (31)..(31): n is a, c, g, or t
  misc_feature (160)..(160): n is a, c, g, or t
  misc_feature (344)..(344): n is a, c, g, or t
  misc_feature (353)..(353): n is a, c, g, or t
  misc_feature (374)..(374): n is a, c, g, or t
ccacagaccctggtgacatcagagagcaggntggtgtgacccacagtgtggacaaagacccttggactttcaggatgggaactccgggccctggtggctgctccagctcgccaggcacctacgtgatggtccacgcgttgaactctgcagggctggcccntggaaatcctgggaggcccaaagtgtaccttccagggtgaccccactagccagaggtctgcaagtcaacgtttgcccagctggacatgggccagggcagtcacctccaggcatagggggccatcgggagcctagctgacattaaaggctggggccccagtggggagcagtcttttctagaggtntcctctgtnggctgttacaggacctgctcnatgaactgctactggggtgatgtcccgaagaagtcaccacaa

SEQ ID NO: 7182 - DNA, 541 bp, Mus musculus
  misc_feature (372)..(372): n is a, c, g, or t
  misc_feature (491)..(491): n is a, c, g, or t
  misc_feature (493)..(493): n is a, c, g, or t
  misc_feature (496)..(496): n is a, c, g, or t
tgaaggacgcggtttagctgcctcgccccagttgggtttgggagttccccgacgtcatgggagcggaggtactgaaggcttgggggctggggagaagtgggtatgatgccagcagggagccgagcggaatctcggtgctgaaggaaacaaagcaggtgtcttccggtccccgaccacgatgagaactgagaagcctgagggtcgaagaaggaactgcgggagatccagtacacggagcatctagggaccaggctacatccatccttgggctccaccccaaaccatggccctctgccgacccagatttgcctggtccttaccagatatattcacgcctttaaagggaactttagacacacctactgctttctnttcagaatctttcgcaagaagatgctgtgtttactaaggatcgcttgggtgcggatagagtacagggctgtgtgattggcacctgtcaaatgctaaggatttggaaaggaattgagatntntcntcctagattgcttcacagaagatgttgttgtcgtgccaaatccct

SEQ ID NO: 7183 - DNA, 322 bp, Mus musculus
tggcatggagacaccttccttttactcggccttgctacggatccagcctaagatcgttcactgctggaggcccatgcggcgttccttcaagacctacgacaagaacggaacgggactcctgagtgtggctgacttcaggaaggtgctgcggcagtacagcattaatctgtcagaggaggagttcttccacgtgctcgagtactatgacaaatcactgtcttcgaagatttcctacaatgacttcctgcgtgccttcctgcagtaggcatccaggcggagcagcacttgggacagatggggcatcagggtctgtccccaagac

SEQ ID NO: 7184 - DNA, 275 bp, Mus musculus
aagagtctcgccaacaatggaaaacatttctatactgtgaaccgcataagagaatcaaggaggttttggaagaagaactttcaatcaagagagatgaatgccatgtgaaaagcccacctacagtggccctggatggaatctggagcattagaaggaatctccctgtgggaggcaccatatcaggacagcagagcagaaacagctcacttccacaagccaagtactactcgaggcacggaggactgagaagataagatggacacatctttccacag

SEQ ID NO: 7185 - DNA, 381 bp, Mus musculus
  misc_feature (187)..(187): n is a, c, g, or t
  misc_feature (190)..(190): n is a, c, g, or t
  misc_feature (239)..(239): n is a, c, g, or t
  misc_feature (317)..(317): n is a, c, g, or t
gcagaaggcattccaatccgaacaaccctggacaactccacaacggttcagtatgcgggtcttctccaccagctgaccatgaaagccaagagcacagtcagggatattgacccccagaacgacctgacttttcttaggatcagatcgaagaaacatgaaatcatggtagccccagataaggaatatnttntgattgtcattcagaacccatgtgagtagacctgctgtgaccaaccctntcctcctgacgatacctggaagcccttccctccacgaatccatgatattgtaccctgactgagtccagagatgtgttntcctgttttgacaatggaactgcactacttgcttccctaagtcccctttgaattgtgatcttgt

SEQ ID NO: 7186 - DNA, 559 bp, Mus musculus
  misc_feature (438)..(438): n is a, c, g, or t
gaccctgacagaaagcccggacataagtcctcgacactccaggactaccaagtgtaacgtataaagcccattagactccatctttcacataagaagcaggcactgtgaactttgaagccgtagaaattgggttgtaggtctttcctggccgaaactggagagtcgtcactcttgaaagttacttacctgggtgtgtgggtttgaagatggaagacttaattccaagcaaagacgacttaaatgggcagtgaaaatgaacagacacagcaagggttagggctgggccagtgaaggatcagagccacaacctagactctggcggtggggatggaaacgcggaggccagctctgagcgggggaatgaataggtaggccaggtttctagcgtggttgctgagacaggtgggagtaacatttagcaagacggaaagaaagctncctttgtgtgtcagttactaaatggtagtgacattccttacggatgacatggtagaacgatggaatgtggatacgttggttggggaaacattctccgctctcatcttccatgtggaacgat

SEQ ID NO: 7187 - DNA, 193 bp, Mus musculus
  misc_feature (96)..(96): n is a, c, g, or t
ggtcggccagtgaggatcgggtcttgttactggatgggtctggggaggagcctacacagacaggtgctccaagggcccaggcgccacccccccagntcctggacggtgggtggggacataatgaacgccagggtcattcgaaacctgcaggaacgccgcagcaccaggccttggtaaccatggccaaagctta

SEQ ID NO: 7188 - DNA, 544 bp, Mus musculus
  misc_feature (317)..(317): n is a, c, g, or t
  misc_feature (346)..(346): n is a, c, g, or t
  misc_feature (417)..(417): n is a, c, g, or t
aggataaggattcctcagagccagatgaaaaccctgctacagagccacggagcaccacagaacccggtccccctggctactccgtgtcgccgcccgtgcccggccgctctccggggcttcccatccgctcagcccgccgctacccgcgctccccagcacgttcccctgccactggccggacgcacacgtcgccaccgcgggccccgagctcgccaggccgctcgcgcagctcttcgcgctcactgcggactgcaggcgtgcagagaatccgggagcaggacgagtcagggcaggtggagatcagtgcctgagcctcntcgagagccctctgcggttgcccacggtntgctgtccgcggctggggggggaggctgagaagtcctgatgcctctggccaggagtgaaaggagatcgtgncctgatccccgtttagggtgcacacgcgtgtgagtttgcacaaatggctgatcttggtgttaaacccggttgcatgtgcgctgggtttactggctgtgttctctggctgtgttctcagtgggtatga

SEQ ID NO: 7189 - DNA, 449 bp, Mus musculus
  misc_feature (219)..(219): n is a, c, g, or t
  misc_feature (224)..(224): n is a, c, g, or t
  misc_feature (280)..(280): n is a, c, g, or t
  misc_feature (313)..(313): n is a, c, g, or t
  misc_feature (335)..(335): n is a, c, g, or t
  misc_feature (346)..(346): n is a, c, g, or t
  misc_feature (382)..(382): n is a, c, g, or t
  misc_feature (384)..(384): n is a, c, g, or t
  misc_feature (424)..(424): n is a, c, g, or t
ttctctgaggcctatgagcggtaccacactgagagccttcagggccgcagcaagcaggagctggtgcgagactacctggatctagagaggcgtctgtcacaggctgagcaggaaactcggaggctccggcagctgcagggttgctccagcaggcaaccctgtcaacaggtggaagagctggctgctgaggtggagaggctcagaactgaaaaccagcgnctgcntcaggagaacgagatgtggaaccgagagggcggctactgtgaccaggagaaaccancctcagaagggaccccttggcccaaggttgaanccccatttcagacccacacagnccagctgggtnatagggaggcaggtgacagatgaaagctactccctntntccactgagaactgctaagacaaggtcagagtttcccctnccattttcatggttggatctttaat

SEQ ID NO: 7190 - DNA, 512 bp, Mus musculus
  misc_feature (199)..(199): n is a, c, g, or t
  misc_feature (214)..(214): n is a, c, g, or t
  misc_feature (271)..(271): n is a, c, g, or t
  misc_feature (320)..(325): n is a, c, g, or t
  misc_feature (328)..(330): n is a, c, g, or t
  misc_feature (332)..(332): n is a, c, g, or t
  misc_feature (334)..(334): n is a, c, g, or t
  misc_feature (355)..(357): n is a, c, g, or t
  misc_feature (366)..(366): n is a, c, g, or t
  misc_feature (399)..(399): n is a, c, g, or t
  misc_feature (401)..(401): n is a, c, g, or t
  misc_feature (438)..(438): n is a, c, g, or t
  misc_feature (469)..(469): n is a, c, g, or t
  misc_feature (472)..(472): n is a, c, g, or t
tgaaggtctcttcccagacgaacttcttgtctcgggcttggtggttccccatcttctacttttttgagaagaatgtgcaaggctcaattccttgctgcttttcctggccgctgtcctggccccctggctgcttcaagtcatcgtgcagaaagtattcccgggtccagaagatcggggaggataatgagaagtctacctngagctgccaacccgncagccgctctcacaccaaaagagtccgtgctgcaaccgaaggcacgtgcggctttanatttattttcagagaactgactggtaaaatgaagtggaccaaattttannnnnnaannntngnagcgatgaagtattacctttnnnttttttttnattcatcccaagaaacatatattttcctgcagntnttcgttcattgatgacaaagcccccacactggagttntgaagaggtggcaaagaacacgccgagcctntcntcgccttccttcacttccacgttctttccagattgctttt

SEQ ID NO: 7191 - DNA, 542 bp, Mus musculus
  misc_feature (68)..(68): n is a, c, g, or t
  misc_feature (97)..(99): n is a, c, g, or t
  misc_feature (400)..(400): n is a, c, g, or t
  misc_feature (420)..(420): n is a, c, g, or t
  misc_feature (424)..(424): n is a, c, g, or t
  misc_feature (427)..(427): n is a, c, g, or t
  misc_feature (429)..(429): n is a, c, g, or t
  misc_feature (440)..(440): n is a, c, g, or t
  misc_feature (442)..(442): n is a, c, g, or t
  misc_feature (445)..(445): n is a, c, g, or t
  misc_feature (447)..(447): n is a, c, g, or t
aggccatccagagacaactagaggaggtggaggagcggcagaggacattggcgatccagggcgtgaanctggagaaggtgctgagaggagaagcagnnnattcagggacacaggatgaagcccagcttttgcaggaatggtttaagctggttctggagaagaataaattaatgcgatatgagtcggagctactgatcatggcccaagaactagaactagaagatcatcagagcagactggagcagaaactacgacagaaaatgctcaaggatgagggccagaaagacgagaatgacctaaaggaggagcaagaaatattcgaggagatgatgcaggtgattgagcaaagaaacaagctcgtggattccctagaggaacagcgggtcaaagaaagaacccnaagaccaacactttgaaaantttnttntntccagaggctntnagntncagcaggacttgaagtgcccttccccgctgaagccagagagccaagaacaccacactttcccacccaggcactgaatttaaagcctactgcctta

SEQ ID NO: 7192 - DNA, 561 bp, Mus musculus
  misc_feature (383)..(383): n is a, c, g, or t
  misc_feature (410)..(410): n is a, c, g, or t
  misc_feature (418)..(418): n is a, c, g, or t
  misc_feature (420)..(420): n is a, c, g, or t
  misc_feature (431)..(431): n is a, c, g, or t
  misc_feature (434)..(434): n is a, c, g, or t
  misc_feature (440)..(440): n is a, c, g, or t
  misc_feature (443)..(443): n is a, c, g, or t
  misc_feature (445)..(445): n is a, c, g, or t
  misc_feature (486)..(486): n is a, c, g, or t
  misc_feature (491)..(491): n is a, c, g, or t
  misc_feature (497)..(497): n is a, c, g, or t
agcaacggagagaccttggctacccggatggagatcatagagatgaatgacaagttaagaaacaggcaagaaattgtgaatggactgaacatatttttggaagaaaatgaagaagaagcctatttagaagaactggaagaagaatccgacatgtttgaggaggaagaaactgaagctctgaatgaagatggttccaaagaagcacacaataatgtaagaacatctcataaagtatccctcaggagtattgcatcaatgacagatgaagagagatttaatatgagaattaagaagtttggtattacaagtaaagaattcagaaaatcaccagtggcttcttgctttggactgcctctgtcaactggcaaagaaaatgctgatanggaaaagaagagaaggcgcctggaacnttttggantntcatgattcanttntgcatnttntntccaggtttgctatgtaaagagaagatcccagttccacatntcatntcattntcatcagttctttaatttttccactgacattggtttatactgataatgtcactgctgtaattta

SEQ ID NO: 7193 - DNA, 498 bp, Mus musculus
  misc_feature (158)..(158): n is a, c, g, or t
  misc_feature (331)..(331): n is a, c, g, or t
  misc_feature (356)..(356): n is a, c, g, or t
  misc_feature (430)..(430): n is a, c, g, or t
  misc_feature (441)..(441): n is a, c, g, or t
  misc_feature (443)..(443): n is a, c, g, or t
tgttgctgcatttagatgcacctgtgcaagaggaaggcaatatctctccagaccagacatctcgggaccaggaaccagaaaaagatgggcaggtagcccaggaggaaacaggtcctgaaaaaccttctgtgaccagagagaagaatgtggaacctgangcagccaagcacatcgaagaatgtcaccgaggaagagctggaggactggctggacagcatgatttcctgaagcggggtcaagggggaagagtgcctgaagcaaatgctggttgccttctgtgtaatgagcccgtcttgtgaggacgggctcgtttaccagctaccccatgctnacacgtcctgttatgcttacagcanccaacacctacctctgtgtttgatggcatctgaatatatgtatgaggcttgtttgaggcttcatttctgttgtnatctggcttantnatctaatagatttcattaaggacaggggatgtcacagctacattttgaacctcct

SEQ ID NO: 7194 - DNA, 491 bp, Mus musculus
  misc_feature (162)..(162): n is a, c, g, or t
  misc_feature (245)..(245): n is a, c, g, or t
  misc_feature (256)..(256): n is a, c, g, or t
gaactacagccatatctggaccagatcaacatgattgaggagcaggtggcagctctggagcaggcagcctacaagctcgatgcttattcaaaaaaactggaagccaagtacaagaagttggagaagcgatgagaatcgtgttcatgtggctcaagtgtttgnttaatatggaagatgttttataaccactaagtcctgaggctgacacatcatcagagctcctcagaagaaaatggctggttaancccaaggccangcaatactggatgaactggagggccgtggctgctccggagtctcctctgaggtggtacctctcagaaactcacacctgggactcctcaccgtttacttgaatgcttcatcatccatctaagatggagactgtagagttcagggcatacctgggtttgccagtagagtccagtgaggggacctgttttccctggtattgggcatttagcacgtcatcttctaaaatggctgctttg

SEQ ID NO: 7195 - DNA, 548 bp, Mus musculus
  misc_feature (460)..(460): n is a, c, g, or t
gctagtgtctacttacctacagaagtagagcattgttcttaaagttaaaggtaaaacgtgcccgatctaacataattgtagaatggatgtgtttctgaatagtttggaaagaaaaagttctagaattaaaaatcatctgatatttgataccccactggtatatagttatgtagagcaggtagttactaagaaatagaggggacatttaatactattttcagtcttcccattcactttcatctagttacatacttaattttattgaaaattggatatttaagttcagatcaggttagcttattgcttttaaatatacacatacatgtatttttttctgcttggttgtacatatctccacactatagatttctgaatgacctatgtgtagactttgggttttataagcctaaaattatacacattttaatgtgtgtcaagaacttgttccataccattgtgntctagagcaataatatgaataacgtttgaaattatataaactatgcttaataatttgtaaaaagaattgatacttccccttgtattaa

SEQ ID NO: 7196 - DNA, 149 bp, Mus musculus
tctccattgcagcccactgtagcgcgtctgtggccctgtctttcttcgtattcgagcgatgggaatgtaccacgtactggtacatttttaccttctgcagcgccttcccagctgtcactgaaactgcattattcatcgctgtctttggg

SEQ ID NO: 7197 - DNA, 396 bp, Mus musculus
catctggtggttgtcatcacgttgttctggtcccgggaaagcaacatccaggcttgcctgcctctcaaattcaccccggaggaatacgaaaagcaggacaaccagctggtagccgcgctctgtctcaccctgggcctctttgcagtggagctggctggcttcctctcaggagtctccatgttcaatagcacccagagcctcctctccattgcagcccactgtagcgcgtctgtggccctgtctttcttcgtattcgagcgatgggaatgtaccacgtactggtacatttttaccttctgcagcgccttcccagctgtcactgaaactgcattattcatcgctgtctttgggctgaaaaagaaacccttctgatcacaatccgggtgtagggaccaa

SEQ ID NO: 7198 - DNA, 549 bp, Mus musculus
  misc_feature (145)..(145): n is a, c, g, or t
  misc_feature (166)..(166): n is a, c, g, or t
  misc_feature (190)..(190): n is a, c, g, or t
ctacggcttaatctcaggtcatcaagcctagcagcaagtgtcagccctgagacttgtgttctgattcacacatatacttggagcatgcagagagaactgtcactgggcagactcaacaaggcaggcaagatcgatacttctgagnctcaagagtaggccgctaggnagtatctccctgtggcccgcaagngtgccaactctagaggctagctgtgttcctgtccctcaaggacacgtgtccctagcagtaactgaaagttgcttgtcttccctggtcagcgtccagagtgtgaagataaaacagccagaagttaaagcagggacccaccctgtagcacagccttgacctgctgacttgggatatcctgcacaaccccagtgacccacagctcctgacccgatggcagtgctggccctcagatgcagacccagagaggcccaggcgtgcaacagttacctgccccagctgcagggggggtttctagcccctctcagccaaggcacaccctcagggagcccactcactgtggctgcactatgttatgttta

SEQ ID NO: 7199 - DNA, 544 bp, Mus musculus
gtgctctagcaggtcatagctcagagggctgaagtacatgttgcccggcttcccaccttctctccgaggctctgccaggcaaggtttatctggatcactttcaaactttcgatgctgaggcctcaggctcccacgtttctaccccattcgccatgttgctgccacatctgggacactcatgaccaatgacaacaactcaaagttccagatcttagccaagcaaagaggccaagttgcctttccacgcatgcacactttgagatgcttagctccactgctgtcccaggaagaggtcccctggagacagtgaggtggctgtccactgtcccttctccgaggaggcgtgtgtaatgctagctgcagagagtggaatgaggtggggccccagcagggttgctacaggagcctcctaaggttttgtgacctagtttggttcttctctagggttggaaaactgagccattgttgtatctgttccatttgtgcataaagaggaagcctagattacttaagctaacttgttcttcccaggtcacaactttaa

SEQ ID NO: 7200 - DNA, 440 bp, Mus musculus
  misc_feature (301)..(301): n is a, c, g, or t
  misc_feature (350)..(350): n is a, c, g, or t
gctgcctttgcgaatgactcagaagcactcaagtcacagggcatctttctaggggagaggaaaagcagggtggcgtccgtagctctgcaagaagcgttgggaagtcatgggaaggacagggcggacactgaagacattgatcaggaaacgccagcaaaaggaagacatttgggccccacccacggtccttgtcccatgggtcctgaggaaggcgagtgcctgaattatgtcttgaagtagtactacagccaggaagaagaagcttgctaccgcctctggtttggggactgtgggggcaagnccaaccagtctgaaaccagagaagagtgtgagacatggtgtaggccaanccttgtaactgacgcccttcctttaacggcgagacagtgagactggcgttacccttgctgagacaggcttcccagctcatgactgacaaa

SEQ ID NO: 7201 - DNA, 370 bp, Mus musculus
  misc_feature (122)..(122): n is a, c, g, or t
  misc_feature (332)..(332): n is a, c, g, or t
tctatcatcgtcacacaaaccgagccctggcggtccaccggaatctcttcttaaggacctactttgggaaggaaatggaggttgtagctcacacatatctggactcacacaaagtagaaaancccaagaaccagtggatgctggttactggaaatcccaggaacaagtcgaacaccatgctagacatctccaaacccatcacagaggatacgcgcgccttggagcaggccatgggcatcaatacatagtgacataccaggcgtacaggtggcctctcaggctctgatctcatcaactcttccacttaaaagaaatgaacagtctttcttggntgtgccccaagcagtttgtcagtaggtgcagaactcca

SEQ ID NO: 7202 - DNA, 443 bp, Mus musculus
  misc_feature (249)..(249): n is a, c, g, or t
  misc_feature (252)..(252): n is a, c, g, or t
  misc_feature (261)..(261): n is a, c, g, or t
  misc_feature (263)..(263): n is a, c, g, or t
  misc_feature (265)..(265): n is a, c, g, or t
  misc_feature (272)..(272): n is a, c, g, or t
  misc_feature (275)..(275): n is a, c, g, or t
  misc_feature (282)..(282): n is a, c, g, or t
  misc_feature (307)..(307): n is a, c, g, or t
  misc_feature (313)..(314): n is a, c, g, or t
  misc_feature (317)..(317): n is a, c, g, or t
  misc_feature (325)..(325): n is a, c, g, or t
  misc_feature (328)..(328): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (350)..(350): n is a, c, g, or t
  misc_feature (354)..(354): n is a, c, g, or t
  misc_feature (362)..(362): n is a, c, g, or t
  misc_feature (366)..(366): n is a, c, g, or t
  misc_feature (374)..(374): n is a, c, g, or t
  misc_feature (378)..(378): n is a, c, g, or t
  misc_feature (394)..(394): n is a, c, g, or t
  misc_feature (410)..(410): n is a, c, g, or t
  misc_feature (418)..(418): n is a, c, g, or t
acagggctgtcatgccctactgggtgccccaggggctgaggtcacagaagaaggtgttgaagaggctggagaatgtggaagacactccaggtcgcccccaggactcaagcagatggtatggctgctggcgggtctgtgggaaccaacatctcctcctcaagtggcagcagctccaggccctttatcaagatgagctgccaggtcttcaggaggacgagccgcatgctggccgcttaggcctcctccccntcngcttcaatntncngagcctnctncaggcantcctgagggccatcatagccatttntcattnnttntgggactnaantctttagntantntcaagatcntccncaagaatntcancccccatnatgntcctcaagggacgccntcagcttaggaggatntgcgacanttgctgcttccacaggagataagat

SEQ ID NO: 7203 - DNA, 118 bp, Mus musculus
aattaagtgaatttgcatctagagcagaagaaaaaagagatttgctcatgtttttccgaagtctgcatttttttgtggagtggtgtgaatatcgtgagaacacatttaagcatttcaa

SEQ ID NO: 7204 - DNA, 444 bp, Mus musculus
  misc_feature (186)..(186): n is a, c, g, or t
  misc_feature (202)..(202): n is a, c, g, or t
  misc_feature (204)..(204): n is a, c, g, or t
  misc_feature (217)..(217): n is a, c, g, or t
  misc_feature (247)..(247): n is a, c, g, or t
  misc_feature (249)..(249): n is a, c, g, or t
  misc_feature (290)..(290): n is a, c, g, or t
  misc_feature (292)..(292): n is a, c, g, or t
  misc_feature (363)..(363): n is a, c, g, or t
  misc_feature (365)..(365): n is a, c, g, or t
cagatactgtatacctcttggagggtacctgttcccactgcatggagatccgcagtaccagacagccagggtttgaactggtgattgtctggaagatacaaatcgatgaggaagggatggtttttccaaagctggatcttctcaccaaagtcccagagcgagccctaggactggacaagaacagantcatagaaactgctcntntcagtttccgaancctgctaggtgtacttggtattgaagctgntntagacagcctgataagattgttcagtggagataacaactantntcccgctggcaaacacacaggaacattgctgggctgaggaacattcaaaatatgttgactatgagcatttntnttttccaattagaaaccatatccttcagacatgagtttgtgtgcattagtggtatattacatatgaactcccatggcat

SEQ ID NO: 7205 - DNA, 395 bp, Mus musculus
  misc_feature (232)..(232): n is a, c, g, or t
  misc_feature (326)..(326): n is a, c, g, or t
gcagatccaagcaaggcaggcacataaagactctggagagactcaggcatcaagcagcacctcccctcgaggaactgataaccagccagaagagccggtctccctctcttccaccctctcagagcctgaatatgagcctgtggctgcttcaggccctatgcatagagctcggctggtgaagtccaagaggaagaagcccaggggactcttcagttaactctccatgtctcanccaccacgaagagagcaaaaccgcttcctagcatcacctggaaggagcttgcatggcagagcatccctcagaggcctgagtttgtgttgacagnccacctggatggggactttaccaggggaagcctgactccaactcactggcattccggatatgagtgaca

SEQ ID NO: 7206 - DNA, 564 bp, Mus musculus
  misc_feature (255)..(255): n is a, c, g, or t
  misc_feature (258)..(258): n is a, c, g, or t
  misc_feature (260)..(260): n is a, c, g, or t
  misc_feature (284)..(284): n is a, c, g, or t
  misc_feature (286)..(286): n is a, c, g, or t
  misc_feature (290)..(290): n is a, c, g, or t
  misc_feature (293)..(293): n is a, c, g, or t
  misc_feature (295)..(296): n is a, c, g, or t
  misc_feature (315)..(315): n is a, c, g, or t
  misc_feature (333)..(333): n is a, c, g, or t
  misc_feature (341)..(341): n is a, c, g, or t
  misc_feature (365)..(365): n is a, c, g, or t
  misc_feature (380)..(380): n is a, c, g, or t
  misc_feature (443)..(443): n is a, c, g, or t
  misc_feature (445)..(445): n is a, c, g, or t
  misc_feature (449)..(449): n is a, c, g, or t
  misc_feature (456)..(456): n is a, c, g, or t
  misc_feature (468)..(468): n is a, c, g, or t
gatttctgagttccgccagaggaatctaagtgagaactccgtgtctgtagaagctgagaagaaggtgtcatacaactgctgcagtcagggctgggtgagcctgcatgtgcagatgagcaagaacacctatgtgccgggcgagaaggtgacattcacatcagagatccgcaatcacacgggcaagtacatcaagaccgtggtgttcgccctctatgcccatgtgcagtacgagggcttcacgccaagtgccgagangcncnggcgggcagacagcagcgagctgntncgancananngccaacgcacggattccanccttcaacagtaccacantggttagngccttcaacctgccgctggttttntctgtgagcagtggntcccaggaaaatgagatcatgaggaccagctatgagcttgtagtcacgattcacctcccctgntntttntcgacantcaaagcccgantccccatcatcatcaccagcaccagggaaggccaggccgactgcccccggctggatgagctgccatatgaggaccatatggtttgagtgcctgcat

SEQ ID NO: 7207 - DNA, 513 bp, Mus musculus
  misc_feature (349)..(349): n is a, c, g, or t
  misc_feature (360)..(360): n is a, c, g, or t
  misc_feature (387)..(388): n is a, c, g, or t
  misc_feature (394)..(394): n is a, c, g, or t
  misc_feature (397)..(397): n is a, c, g, or t
atccgccagcagcagtacaaattcctccccacagagctgagggaagatgagggctaagacaccccccatgctggtgagccccaggaggtggttcctactcccccaacaagaactggacatactggtgtcccccagagccaggaacttcctggaaactgctggccctccaccggagtctgtctctctcagtcctcagtcccgtcactatcagctgcatgatcatggtctcacacggtacagtgtcccacccacagctcttccagctcccctcacgcctcgctatatctcaggacagagggcgcatttcatggactgttaccaaaaaagaaaagtcagtattacgttgttntcagacacctntactccgtgtcctctaagactgctccnnggcctnttntgtgaaatcacactcgggaaagaacaatgctaataacggctcacaggaatcatcagtatcatggacatagagattctctctctggagagaagacagctggagttggacactgttaa

SEQ ID NO: 7208 - DNA, 512 bp, Mus musculus
  misc_feature (159)..(159): n is a, c, g, or t
  misc_feature (264)..(264): n is a, c, g, or t
  misc_feature (278)..(278): n is a, c, g, or t
  misc_feature (340)..(340): n is a, c, g, or t
  misc_feature (364)..(364): n is a, c, g, or t
  misc_feature (396)..(396): n is a, c, g, or t
  misc_feature (451)..(451): n is a, c, g, or t
  misc_feature (484)..(484): n is a, c, g, or t
ggcattgcttgctttcacatggataattcatggtttatacttcagctttaaatctgactgattgattcacttcaaggccttaaattgtcttcagtgacttctcttgttcatagaatagtttaattttttttattgtgccttgtcagtttgccaaggctntgcaggattgcactagctccacaatgcagtaatattgataactgataatactgagtttcaaaggatcttccattattttagaaacaaaagtattttataggtttngttctgtatgatcnccaagtataaaactaggttctattggattttgagattgccacaggcatgtccaatctcagtngtgtagacactaaagagcccgttnccatccaggtaagtgatggccatacactgctntggtttaagttatttttcatttcaaggagcagataagcaatgagttgacctaaantcttagtaatatttgtttagtaatatgtgtttntctgtatattaactgctcaagaactggt

SEQ ID NO: 7209 - DNA, 410 bp, Mus musculus
gttttgaaccacttgagtctacacgattcttaggtattgttaataaaggaatatattcatatccaggtagaaaaaaatgtcagtcttaatcctaattggtattatttttagcaaggaaaacatttagggacaacccaagtcatttagtatttattctgagaatcattttagaaattattttaagagtactgaaaattgtgtccccagatttccttgtaataaaaacttcccagtctagggctggcaggatggcgaggtaagcagaagcactttgctgccaagcctgacaacctgagttcagccctggatcccccacatggtacatagcagggcaagctgatccctgcaggttatcctcagactccacacatgcagtggctcacagcgcccatccttcacaatatgctaaa

SEQ ID NO: 7210 - DNA, 369 bp, Mus musculus
gagcactttagcaaactgagcatttcatattctattctgaaagtccatagtagagtgtattccctcagcagccttcaccttgtccgcctttcactaccactgataacttgcttatgatcacaatgacagatatgacccacgaactcaggagatggcaggtgacctacaaagctctcagggtggcatttgctctctgagcagatcgccctgcttagaggaactcagggttgaaaccacacgtggtgaagtctgcagaggagctacaatgggaccgtactgctttcttcacccacacttggtagaggtagaggggtagatagtagaatggaggtgaagggaaatttaaggttgttaataaactctgccctg

SEQ ID NO: 7211 - DNA, 321 bp, Mus musculus
  misc_feature (179)..(179): n is a, c, g, or t
  misc_feature (213)..(213): n is a, c, g, or t
  misc_feature (229)..(229): n is a, c, g, or t
  misc_feature (232)..(232): n is a, c, g, or t
gtcttgagctacaaaaggatgcaatggaaaagcttcagaacatggatgatgcctttagaagacaagtggatgagattgtggaagcgcaccaagctgaaataatgcagctagcaaatgagaagcagaagtatattgactgtgcaaatttaaagggtgactatgcgcgtggcgactgagantgaaaaacaccaccctccaggtcatgttctcatntcagttgcggatgtgnttntgagagcttggactaaagcaccgacatttattgttctgtgtttggttatgctgatgacagttgcacagctctatatattacaacctaca

SEQ ID NO: 7212 - DNA, 588 bp, Mus musculus
  misc_feature (119)..(119): n is a, c, g, or t
  misc_feature (122)..(122): n is a, c, g, or t
  misc_feature (151)..(151): n is a, c, g, or t
  misc_feature (159)..(159): n is a, c, g, or t
  misc_feature (162)..(162): n is a, c, g, or t
  misc_feature (193)..(194): n is a, c, g, or t
  misc_feature (313)..(313): n is a, c, g, or t
  misc_feature (429)..(429): n is a, c, g, or t
  misc_feature (481)..(481): n is a, c, g, or t
ccaacaagggcatcatcgaagaacttaagaaaacgaactacagggagatactcagggaaaaggcagagagacaggacatcatgtcacagatggatttgcagggagcatctgagaagganccngctgcgagggcgagaggagcaggagaggntggtgaancantgggagagggaccaggaaagtgagagagaannccacggatgacgagcaagacaggaaaagctcgggaggactcagcaaaaaactgttgggagacggtcactcgtcaaacctagggattaggagagagtccagagaaatctacagaaggctntcggactactccagccacctaccctcagaggacggcagccaaaaacaagagaagaaacaagcagaagcagccaaaggggaggtccaaaagttggagaagacaaaagaggaataatntaaagcccaggctacttaacaacagagaagggatgaagaccgctcagtaggntccgaggttcaggcggacagtgttcccaggtgttttggagaggaaacactgggagactcactcctacagaccccccgcccccgtttctccattaaatatgcgccttt

SEQ ID NO: 7213 - DNA, 405 bp, Mus musculus
  misc_feature (57)..(57): n is a, c, g, or t
  misc_feature (60)..(60): n is a, c, g, or t
  misc_feature (233)..(233): n is a, c, g, or t
  misc_feature (238)..(238): n is a, c, g, or t
  misc_feature (272)..(272): n is a, c, g, or t
  misc_feature (276)..(276): n is a, c, g, or t
  misc_feature (283)..(283): n is a, c, g, or t
  misc_feature (287)..(287): n is a, c, g, or t
  misc_feature (300)..(300): n is a, c, g, or t
  misc_feature (358)..(358): n is a, c, g, or t
atccccaagctggtggtcatcaagcagaacggagctgtcatcaccaacaaagggcgnaancagatccgagagcgcgggctagcttgctttcagaactgggtggaagcagccgatgttttccaaaacttctcggggtgaccagggcagttgctggaagttcagggcaactatcttcaaaaagggcttagctggttcccttctctgctgaggaatgtcattgtagagtcaccatnctgtnacagagagcataaactgctcaggaaagaactacntctnccccctntggntcctagagctccnttgaatgtttatttcttacacctttctccaccggtgcctaggatccaggacacatcanccacgagttaacagaactctatgcaagatgctctttcctacaggaaa

SEQ ID NO: 7214 - DNA, 538 bp, Mus musculus
  misc_feature (333)..(333): n is a, c, g, or t
  misc_feature (348)..(348): n is a, c, g, or t
  misc_feature (350)..(350): n is a, c, g, or t
  misc_feature (374)..(374): n is a, c, g, or t
  misc_feature (406)..(406): n is a, c, g, or t
acaactggaggagcttgggtctcctggggagtgaagcctgaagacaggcaaagccagagactcaataaaagtctgacgggtaacgtgtggcactgagacgccttcttcctgtttgccaaaatccatgagctgcctcaagaaaaggtactagcagcgcactgcatgggctccaagattttaggattatactaagaaaatgaaagtattcatatatttagaacatgcattgacaatcttttgacaatgcaaaaataaaaggaactagttagttaaaaaaatcaagttttcaaattaatttctgttttgttgatattttctggcattttgcttganatatatccaccctgnantcccttttcctcatctttgagatncctccttggtaatgacaaaaccaataaacatntcctttattatatataaaagttttggaaaagataatcatttataagtataaaaaccacttaaaagtttctaaacatgtttattatagaaatctttaccttttctaaaagctgtgcacttaatttattgaata

SEQ ID NO: 7215 - DNA, 501 bp, Mus musculus
tattgactggacagagacctgccaaatgggcaaaggatgataattcctttttgtacattctccatccttcagaactcaagtagaaaaactcaaattgggagtcatcttccagatcccaggctgcttggaaagatgaacgttttgaagggaagaggggaagagcaagtcaggagcaaagggtagggaaagggggcaaggaggagcccccagaatgcagtcagtctcaagcatgaaaatgatgaacaaaaggagtgcactgtggctcctcaagtctgcacagtgggaaaacaaagacagttctttgattatagtgagatcaagaaaataacacccacattcccataacttgggagactgagatgaaacaagattgccagcctgggtatcttaagaccaaaagaaaggggcctggagagatgactccgtggttaagattggcactgttcttgggtttgctccaaaacatctacacccgtaaggcttccatggacagtgcgttca

SEQ ID NO: 7216 - DNA, 579 bp, Mus musculus
  misc_feature (118)..(118): n is a, c, g, or t
  misc_feature (294)..(294): n is a, c, g, or t
  misc_feature (313)..(313): n is a, c, g, or t
  misc_feature (319)..(319): n is a, c, g, or t
  misc_feature (323)..(323): n is a, c, g, or t
  misc_feature (327)..(327): n is a, c, g, or t
  misc_feature (333)..(333): n is a, c, g, or t
  misc_feature (335)..(337): n is a, c, g, or t
  misc_feature (342)..(342): n is a, c, g, or t
  misc_feature (348)..(348): n is a, c, g, or t
  misc_feature (373)..(373): n is a, c, g, or t
  misc_feature (376)..(377): n is a, c, g, or t
  misc_feature (379)..(379): n is a, c, g, or t
  misc_feature (384)..(384): n is a, c, g, or t
  misc_feature (395)..(395): n is a, c, g, or t
  misc_feature (400)..(400): n is a, c, g, or t
  misc_feature (410)..(410): n is a, c, g, or t
  misc_feature (471)..(471): n is a, c, g, or t
  misc_feature (475)..(475): n is a, c, g, or t
  misc_feature (496)..(496): n is a, c, g, or t
  misc_feature (500)..(500): n is a, c, g, or t
aagactctgctttcactgataactgggctatttcaaaagtttaatttctcgggatttaaaacttctaaacttttgtaaaaggtacaaattgagaatctcaaaatattggaccaccttnctttaaaaactttttttaatgaaaaatggtgtgtgtgtgtggctaagacacaagtcaaaacacaaaattcatttatatttcacacctcatgaatatagcctgaaattaatgatttacaggatttttaatgagcttatgcttttactatgacccttcaattgaggtcaagtgtggangtttctcctggtggcactntcttgntgcnttancaagtntnnnatttntaaatnttttaggctttcaaatttagatgcnttnntntatgntgcttccccantggcnaatgtaaaangcatagggataagtatatacgtggtgctggaccaatagttactgagttcttaaatattttntcanccttcctcaaatagaagtttntcantcatttcaatgcagaccagaatttaattgaaaagcttttgcttcatttccagcaagtacaataaattaaagctggccat

SEQ ID NO: 7217 - DNA, 547 bp, Mus musculus
  misc_feature (110)..(111): n is a, c, g, or t
  misc_feature (114)..(117): n is a, c, g, or t
  misc_feature (119)..(122): n is a, c, g, or t
  misc_feature (124)..(125): n is a, c, g, or t
  misc_feature (127)..(128): n is a, c, g, or t
  misc_feature (131)..(131): n is a, c, g, or t
  misc_feature (133)..(139): n is a, c, g, or t
  misc_feature (142)..(142): n is a, c, g, or t
  misc_feature (144)..(151): n is a, c, g, or t
  misc_feature (153)..(153): n is a, c, g, or t
  misc_feature (301)..(301): n is a, c, g, or t
  misc_feature (305)..(305): n is a, c, g, or t
  misc_feature (312)..(312): n is a, c, g, or t
  misc_feature (325)..(325): n is a, c, g, or t
  misc_feature (332)..(332): n is a, c, g, or t
  misc_feature (343)..(343): n is a, c, g, or t
  misc_feature (346)..(346): n is a, c, g, or t
  misc_feature (358)..(358): n is a, c, g, or t
  misc_feature (380)..(380): n is a, c, g, or t
  misc_feature (390)..(390): n is a, c, g, or t
  misc_feature (400)..(400): n is a, c, g, or t
  misc_feature (421)..(421): n is a, c, g, or t
  misc_feature (429)..(429): n is a, c, g, or t
  misc_feature (437)..(437): n is a, c, g, or t
  misc_feature (458)..(458): n is a, c, g, or t
  misc_feature (461)..(461): n is a, c, g, or t
  misc_feature (463)..(463): n is a, c, g, or t
tggctcctttgtcacctgacacttcgcttcctcattgctgaactctctggaaggaccatggatactgacatgagacgagcatacactgttattcattcacgtgtccatgnntcnnnncnnnngnncnntgncnnnnnnnagntnnnnnnnnanttcaagatctggagtcactctagaggagcggtgagtaagagaaagcaaagagtctgcagaaacaagcctgctgcagaagagggcgcagagagaagcctgctgcagaagtggctgcagagagatgcctgctgcagagagaagcctcctngccnagagaancctgctggagaantggctgnagagagatgcntgntgcagaaatgantgcagagaggagaaggttgctntaaaagccantgtagagacnaagtgtagcaccttatcaggnccaagaanccaccttntcacctgacccttgaacattntantntcccagtgagagagaggtgccggagggatgggcaagaaggtggcagaaggcttccttccagggcttcagcaaagtttggactag

SEQ ID NO: 7218 - DNA, 461 bp, Mus musculus
  misc_feature (237)..(238): n is a, c, g, or t
  misc_feature (248)..(249): n is a, c, g, or t
  misc_feature (251)..(251): n is a, c, g, or t
  misc_feature (253)..(253): n is a, c, g, or t
  misc_feature (320)..(320): n is a, c, g, or t
  misc_feature (342)..(342): n is a, c, g, or t
  misc_feature (360)..(360): n is a, c, g, or t
  misc_feature (367)..(367): n is a, c, g, or t
  misc_feature (378)..(378): n is a, c, g, or t
  misc_feature (381)..(381): n is a, c, g, or t
  misc_feature (412)..(412): n is a, c, g, or t
  misc_feature (431)..(431): n is a, c, g, or t
acaaagtgaacttggctttcaccaatcgcattgccgagactgtcgatgctaagaataagattcacactcacttaacgaagaccctgcaggagatcttccagattgaaatgaccatagaatccatcaaaaaggccatcaaggaaaagtctgccttcctgaaggtggcgcagacccggctggatgagagaacgaggaggccaaacgtagagctgtgcagggatatggctcagttacgcnntgttaacganntntntgaggtagacgagaccatccagactctgcagcagcgcctgagggattcggaggacaccttgcagtcnttggcccataccaaagccaccntggagcatgacttggctngtgaaanccaacactctntanatcgaccaggaaaaatgcatgagcatgcgcnaatagctaccccagcaccntccggctggtgggctactgctagggaccct

SEQ ID NO: 7219 - DNA, 534 bp, Mus musculus
  misc_feature (212)..(212): n is a, c, g, or t
  misc_feature (403)..(403): n is a, c, g, or t
  misc_feature (405)..(405): n is a, c, g, or t
aagggctctgtgactggttgcatgttttggaaacatctgtaaatggttttttttatctagtttgtgttatgattatatctggaatgtgatttattagttttctaatatattttgagcccaatgttatgtattctacattgtctttgggtatatgaacatacatcttcctatacaaaagtttcctttggccatgtctttaagtaaaatgtttntactccatcttaaacaaattgtgacttgtcttcacacacagagacgcatccatgtctctggggttgataacggaaagggaaacaatggctgcctggagaaggcatgtttatcatcctggaaagaagaaatgttattatgttgttattattcttgcttttagattaaaaggtaaagcactgtggaaaggctntntgcataatcccagaaccataaacatttacataaaatttgaatttgtttatccaaaaagttggcttattttcattgttaagaattatactgtgtccttggaagatgaaaagcataccttgtcatttttga

SEQ ID NO: 7220 - DNA, 375 bp, Mus musculus
  misc_feature (222)..(222): n is a, c, g, or t
  misc_feature (264)..(264): n is a, c, g, or t
  misc_feature (298)..(298): n is a, c, g, or t
  misc_feature (300)..(300): n is a, c, g, or t
ctgtgcttcccttgtcccgcggagtccgcaccaccatccccgagcccggaagagaaaagagaaaagctggcagaggcagcagaaagaaggcagaaggaggcggcgactcgggggattttggacatccagtcagtggaggcaaaaaagaagaagaaggaacagttagaaaagcagatggcgacatcggggccaccaacggcagggggacttagatggacggtntcatgaagtatatcagacctggaagagaatcctgccaccaantccggcaactgcagtcaatggctttcagctgatntntcctcttaacacacattaagagtcagactgtgtcattagtgccctttcgtgcaatcctgacactaaatatactaa

SEQ ID NO: 7221 - DNA, 568 bp, Mus musculus
gcaggtctgctgactcgtagacagatctgaggacagttttcatctcgattgaatgttacctccttctctagtaagtttttgtgaaagatttcagactattaaaatgacttcttaaggagtagctactaccttaccccctcctctcagtctccatccaaacccactctcacggctactccactaacgctgtgctttgcttgtaaagtaacaccatgcagttgtgcgcaacccaagtatcaaaagcagctacgcggctctgaaaggtgattgtgataggttctgcttctcatctgcagatacaatgcagcaactccaaagtattaagattacagtaaagctgaagacgcacctttgccctggttagcaacgcaaaacctgtgtcgtcgtaaatgccaaagtcttagtgtgtaaatgtctgtacaccgtcacagcgaatgagctcactgctaatggccgagttgcttattttcatgaataaagattagcaagaaacttttaaaccatctttttaaaaaatgtcctagtttgttatattttaggcatgaagaactagcttggcctactgaag

SEQ ID NO: 7222 - DNA, 233 bp, Mus musculus
  misc_feature (142)..(142): n is a, c, g, or t
  misc_feature (156)..(156): n is a, c, g, or t
ccaccacagtcactaggcgggtaaagcgcaaggcgccccgcgccttcctcaagcgcaccttaaagcagaagaagcctcacctaggtctggggaggtgctgcgacctcctgatccatttgaattgcctactttttattcagcngattggcagaagantccaggacaaatgcttgtgaaagtaaatctagagttatcaaaaaggatcatgtactggctgcaggaaaggtaattct

SEQ ID NO: 7223 - DNA, 558 bp, Mus musculus
  misc_feature (57)..(57): n is a, c, g, or t
  misc_feature (225)..(225): n is a, c, g, or t
  misc_feature (268)..(268): n is a, c, g, or t
  misc_feature (273)..(273): n is a, c, g, or t
  misc_feature (347)..(347): n is a, c, g, or t
  misc_feature (375)..(375): n is a, c, g, or t
  misc_feature (510)..(510): n is a, c, g, or t
gtccatgtgctccaggctgcaggatttcataactggggaaactgtggttggatctcntccctcactggtctcaacaagaacattccagtcgggatcatgatgataatcatcgcagcgctcttcacagcgtccgcggtcatctcgctcgtcatgtttaaaaaagtgcatggactgtaccgcacaacaggtgctagttttgagaaggcccagcaagagtttgcaacngggagtgatgtccaataaaactgttcagacagcggctgcaaancgccncctcaaccgcagcaaccagcgcggcgcagaacgccttcaagggtaaccagatgtagcgagcctggaagcagttntctgtttccttaggactgtatctttttntccagttactgtattctacagatattttttgttggaaacacacaatacacaaaagcatgggtatttccaatccacatgtgcatggtctaaaaaccagagaaacttccttgtcttattactttgcctaatagtttnttaatatttccatgctctgcacagaagaaaactatcacctgctaaata

SEQ ID NO: 7224 - DNA, 467 bp, Mus musculus
ttcacttctagctcagacagggttgcatctcagaagggctccctcaagaagccagcttcttcccgaagcagcaagaaaacatttcgaaggcctggtaccaagaagaaaagcagagtgtggtccccacgtccccagggcaagaggaagcccaatcttgacagccatggtgtagggatgagacaggccgcaggcagaagtcacccatgacctcttggtcatcttggccgatgagacctgagacaggagaatgcttcactgagtgcataatgctgtccattctgagtctgggactcagacagtcaagaagcctgggtggcggtgggctgttttctgtgtggtcttttccctccctgggaaatcttgctgtctactgaagaaacatgagcctggtctgcgggcagcatttctgtggagataccacagcccacaggaccttgcacgtggcttatggcatgtccagtgtgcat

SEQ ID NO: 7225 - DNA, 514 bp, Mus musculus
  misc_feature (220)..(220): n is a, c, g, or t
  misc_feature (291)..(291): n is a, c, g, or t
  misc_feature (312)..(312): n is a, c, g, or t
  misc_feature (330)..(330): n is a, c, g, or t
  misc_feature (487)..(487): n is a, c, g, or t
tggactctgcgctggcgttaggcaaggagtagtcgggctcttgtttcctcttaggagggaagtacccactgaggcgagaggccaagctgcgtctctcccgaggggctcttaccttcaggagtgaggaagacagacaactgagttgcccattacacaacggggatccactccaacagatgagcccctgatgggagtcacaccctcagcaggcacagacacncaggatggggtatgcggatggacagacgccaagcaggcctcacagccgagtgctggccccagcagctgccnacttactttgagcttcatccntcttcttgtcgggatcgntgcacgacactgtgcctcatgagactctgctgcagtgcaagggaaagaaggacgcttgacctgggcctgcagacgtggctcagtgcttacagcattcgctgctcgaggaggacacgggtttggttcccagcacccgtactccagttccagtaaaaantcttggtgtctgctaaccttaagatgc

SEQ ID NO: 7226 - DNA, 519 bp, Mus musculus
  misc_feature (157)..(157): n is a, c, g, or t
  misc_feature (342)..(342): n is a, c, g, or t
gaaagcactgttgctgtccagctacgggaagctcctgctaatcccggccgtcatctgggaacatgactacacacctctgtgtctcaggctcattaaagtgtttgtcctgacctcaaatttccaggcagtcagagtgaccctgaacacaaaccggagnctctccctgttggtcgtgctaagtggcttactgctggagagcattgtggtcttcttcttccagaggatggagtgggatgtgagcagtgactgtgcgctctacaagtctcaggacttctgaaggaccagctacctcaaaagagaaggcacaaaagaacccaaggtctctgctttctgtgagtgaanccaagactggggatttctgaacgtacccagacaccccagaagatctgaaccacctataccaaggctgaacgctctcaggcagcactgtggttcccttataggaatgatagctctgagctccatccttcctgctctttagtgtaatattttattacactggtggctttaaccctgtat

SEQ ID NO: 7227 - DNA, 350 bp, Mus musculus
  misc_feature (198)..(198): n is a, c, g, or t
  misc_feature (202)..(202): n is a, c, g, or t
  misc_feature (300)..(300): n is a, c, g, or t
  misc_feature (308)..(308): n is a, c, g, or t
  misc_feature (313)..(313): n is a, c, g, or t
tgaggcctgaactccagctacaagcctgccaggtaccctgtgacaccgccacggagaccaaccagccgtactttgtctttgacacatatctgctggacaaacccaacagcaatgctcgactcaagtgtcccttggcttccatctacaggcctgtccactgggaagctgacaacagccctctgacatggcaggaccagntctntggccagacggtcagcaccatcatggacctgcacagtggtggccagcacctgaaggtcttccagcctgccacttacagatgttttgtggagcaggagnctcatagncccanttcaaccccactgagagacaatccaaagcccagaacc

SEQ ID NO: 7228 - DNA, 410 bp, Mus musculus
acaggaatctcttcctgagcgctgggaccgatggccacgtccacctgtactccatgctgcaggctcagccccttacctcactgcagctctctcacaagtacctgtttgctgtgcgctggtcccctgtgcgccccttggtttttgctgctgcttcaggggaaggtgatgtacaactttttgacctccagaaaagctcacagaaacccacagtttctataacacaaacccaagatggaagtcctgtctactgtctcgagtttaacagccagcagacacagctcttagccgctggtgatgctaagggcatggtcaaagtgtggcagctgagcacagccttcacagaacaagggccccgggaggtggaggacttggatcagctagaagcagaaatcactacctgagggctggtg

SEQ ID NO: 7229 - DNA, 501 bp, Mus musculus
  misc_feature (28)..(28): n is a, c, g, or t
  misc_feature (411)..(412): n is a, c, g, or t
  misc_feature (440)..(440): n is a, c, g, or t
attagcacctagctcaggcctggaggcnaccctcatggtggacacatgggactgatgagccatcagaaggctagtcacctgaaagctctatggcctctccccttctttctgagcctcagtttctccctctaaaataggggattgtaagaatgagttagagaaagaggcctcagtacattagttgtcatttggaagtctggctccccagatctcacagagccaggccagtacatgtaatcaaagtactgaggaagctgaagccggcagaccctgggactcaccagtcagccaagctaaccgagttagtgagttccaggctaatgagacctcatctcaaaacacgaggcggaatgatccgagatcctttggcttccacatgcacatgtgaatttgtacctgtacacacgtgcnnggaacacactcagatcaggggcctggtnagctcatatgatgagcccaagagatctgggatgaatggatccctagatacggtaggcccag

SEQ ID NO: 7230 - DNA, 484 bp, Mus musculus
  misc_feature (32)..(32): n is a, c, g, or t
  misc_feature (176)..(176): n is a, c, g, or t
  misc_feature (318)..(318): n is a, c, g, or t
  misc_feature (320)..(320): n is a, c, g, or t
  misc_feature (324)..(324): n is a, c, g, or t
  misc_feature (338)..(338): n is a, c, g, or t
  misc_feature (345)..(345): n is a, c, g, or t
  misc_feature (360)..(360): n is a, c, g, or t
  misc_feature (389)..(389): n is a, c, g, or t
  misc_feature (395)..(395): n is a, c, g, or t
  misc_feature (397)..(397): n is a, c, g, or t
  misc_feature (414)..(414): n is a, c, g, or t
gggttccttcatgggcacctggcaaatgcccntgaagatcccacctgctaaggtgaccttgaccgcccgtacaactacagctgccgacaacctcaccaaatggatacacaagaatcctgatctactcaacgcctgtaatgggctgcgtcctgaaatctcaggcaagcccttcgatnctgacagtcagacgaaacagaagaaatctgtcaccaagactgtacaacaagcaccaaatccaaccataattcccagctccccggttatccaaggagacaacccagatgaaccgcaaagctcgcacccctctgcaggtcacantncagntccccaaactccantcaactntcccaacaacccacntccgagcccttgtaagagcaccaagtagntcctantntagctgaggtccagatntatgccatgctggggtgacattttagagactgaccgaaataggtgagaccctgcctgtattcagaaatgt

SEQ ID NO: 7231 - DNA, 420 bp, Mus musculus
  misc_feature (128)..(128): n is a, c, g, or t
  misc_feature (276)..(276): n is a, c, g, or t
agctgcaacggtaaaggtggtccttactgcctaaagtgaatgcttgatgccagccctcctggcgacatctctgacagctgtgcacaaacgtgaagctgtgacacttcctgtcaaggtggttgcgaagntgcaggttctgatgctaaccgcgcaccaggttcacagactgtacagtacaaactcttgtgtttgttactaacactgtggatggttttactgtaaattgttcccaatttgtatcgatggaaagaatgtgattctattagaagatattantcatcttgaaaaatgcggatttctaattcctcacggctcaacgctggaatcagtttccctgaaaaggatcctcggactaaaagtggcatgttagaaaaaaccaggcctttaccgagctgcacaatcagttcctcacggtggaag

SEQ ID NO: 7232 - DNA, 54 bp, Mus musculus
ttggaagtgccaagtgtggactagcatgatgttataggcagtctttgtgagtga

SEQ ID NO: 7233 - DNA, 337 bp, Mus musculus
  misc_feature (232)..(232): n is a, c, g, or t
  misc_feature (235)..(236): n is a, c, g, or t
  misc_feature (238)..(239): n is a, c, g, or t
  misc_feature (246)..(246): n is a, c, g, or t
  misc_feature (260)..(260): n is a, c, g, or t
  misc_feature (276)..(276): n is a, c, g, or t
  misc_feature (288)..(288): n is a, c, g, or t
gggtactatcaactgaaagcagtatataactcatttaaaggcaactcatactggcagagaaagtgatcatttttaccttatattttcctatttctgtgtcacaattttccaacccaaccttgaatttatttgtcatgttatggccagtcgtcccactgtgatcatcctggtcatactctggatggtcttgctctgacctccatcccaacacccctctcttggctcagtggcntcnncnntgtaggnaatccttatatacntagtgggatccacgcngtaggaatcctnatatacttagtgggatccactctgtaggagtccttatatcctttggtcc

SEQ ID NO: 7234 - DNA, 510 bp, Mus musculus
  misc_feature (409)..(409): n is a, c, g, or t
  misc_feature (415)..(415): n is a, c, g, or t
  misc_feature (421)..(421): n is a, c, g, or t
  misc_feature (443)..(443): n is a, c, g, or t
gagacttcaagcaacctctcatggtttaatcaaccgctttcctgatgcgccctccttatcccattcccaacagattatcagataccctggacttgattactccttgggacaagtaagtcactaccacggcccatgcacagctaactgatgggcctcttaatttgcttcaaaagtagagtgttcatcctaatatcccatagtaaagtttgcttaaatatacttgcaacagaatgccaggaagttatcaaataaaaaagactggaagactaggggtgtagcttcacggcagagcacttgcctaacatatgagcacccaagttcaatatacagcaacacacacacacacacacatgactgaagaatagttaatgataaatgttccttatcgtacatatcatcacatatacgntctttntcgctntccccaattcaaagtagacggntccacatattaaatcaaaaactaaagtaatattttatagcaagaaaatttcagatgccgacaggtgt

SEQ ID NO: 7235 - DNA, 489 bp, Mus musculus
  misc_feature (133)..(133): n is a, c, g, or t
gaaatgtttgccagacacgcgaaaagaagcacggtcaccactgaagacgtgaagctcttagccaggcgaaataattcactgctaaaatacattacagagaagaatgaagagattgcccagcttaacctgaaangaaaggccaagaagaaaagaaagccggaagatgaaagcaggagctctcgggagtccatggctgaggagctggacggggctgaggagctgcagagcgagagctaaggccttcatctcatctggaagcagcgctcgccacgagggcagtctgcagggatgaggacagacatgggaaggacggccccgtgtgtgggcagcttttcgtgctgcctgtttgaagtcattctcggcagaagcttagaagctgggagttcctgcaaagccacctcacgcgtcacggggcataggaaaggcttgcacttgggtggcacagcgtgacttagtgactggcaaagtgggctagcaatcagctgtgct

SEQ ID NO: 7236 - DNA, 476 bp, Mus musculus
  misc_feature (383)..(383): n is a, c, g, or t
gtaatctacctcttacactttgtagttgaatacttgtgtgatgaatttgtgccactttaacctttcactaccattcccattttgttacctttctgttcaggagactttatgttggaatactgtataaagcatttgtagcagtttaaaaataaaatatttaaaattatttaaattgttttgggtgcttcaattgtattctgtgatttagagcttacatttgtgtttgcattgttaatccggaaggtgtctgctgtactgaagtttgctgttagttattttattgcttcttgtcgcaaagtgctataaagattattctaatgaaaacattaaaatttataatttgacatacaaaagggattgttcattgtttttaaccaatgtanccttgacagagtttttattacagacacacaagagtgatgtttgctactttgccctgttagcatggacacatcctctgtttgtcagatgtctaa

SEQ ID NO: 7237 - DNA, 374 bp, Mus musculus
  misc_feature (89)..(89): n is a, c, g, or t
caccgacatgtccaaagcgatcatcatagaggccatctgctcctttattttccacagcgctctactgcacttccaggaggtccgaaccnaagcttcgcatccacctgctggctgcactcatcacctttttggcctatgcaggagggagcctcacaggagcattgtttaacccagcgctggcactttctctgcactttccgtgctttgacgaactcttctataagttttttgtagtatactggcttgctccttctgtaggtgtgctgatgatgatcctcatgttcagttttttccttccatggctgcataacaatcaaatgactaataaaaaagagtaaccactcccaaagactcgaactaagtcccaggacagt

SEQ ID NO: 7238 - DNA, 449 bp, Mus musculus
  misc_feature (326)..(326): n is a, c, g, or t
  misc_feature (336)..(336): n is a, c, g, or t
  misc_feature (343)..(343): n is a, c, g, or t
atagaaatgaacgtcccctggctgtactttgtcaacagtttcctcatcgctgcagtttattggtttaactgccacaagcttgatttaagagacagctcgttacctgtggatcctttcatcaactggaaatgctgctttgttccagtccatagacttaagcaagtggagaggcccatgtccatagtcatctgttagcatgctgctgtgctgggaggaacttcagaagcaccaagatcagtctcacaaggacagaggtggctcgggacaggaactgaagctcgagtccccctttccagcacagcgtccgtggggcagatgccaagtantgctgagganacattancacagcagaatgtttatgcctgctcgacaacattgtggaatatttggtattaatccaaatgcaaagtaaacacattaacatgtgtccagcttgatgttttactcca

SEQ ID NO: 7239 - DNA, 452 bp, Mus musculus
  misc_feature (70)..(70): n is a, c, g, or t
  misc_feature (80)..(80): n is a, c, g, or t
  misc_feature (128)..(128): n is a, c, g, or t
  misc_feature (138)..(138): n is a, c, g, or t
  misc_feature (300)..(300): n is a, c, g, or t
  misc_feature (302)..(302): n is a, c, g, or t
  misc_feature (319)..(319): n is a, c, g, or t
  misc_feature (333)..(333): n is a, c, g, or t
  misc_feature (361)..(361): n is a, c, g, or t
tatcttaggctttcctcagtcgaaagacccctgagcaggaacatgctcatctgtgtgatggaccggaagncaggttcacnagggttctccggggttggatgaagtaatcttgcttctgcataaatgtncacacacaancacacacacacctctacacacacatacacctacactcaaataagaggcattccaatccatgttcttatgaagtataagaagtaataataatttcccagaaatgcaaaatgagaaaattactgaatttggacttcacactgaccacatctggaggcgacatantntgaaatcatatttgatntcagccctacctanaagccactgcgacctgcaagaaactgantgggttactacaagacaggctgtgtacacaacgtggatgtggacacagtatgagctggagggagctggagggcctgagatttttatcactg

SEQ ID NO: 7240 - DNA, 347 bp, Mus musculus
aaaccagatcctatctttcgagatcagtcaacctccgcatgcctgccaccagctctcttaccaccaccgctgctgccgccaccaccacaacctgtcaccaccgtggcctctgtagtggctgcatcaccctctgtctacactatgccccgggtctttggccctttccctccactgtctggcaagccgatggagaaactggatatttcaagttctgaagtgaaactaaactggagtggtctttcatcaacgtcaaagagccacatggttgatctgacccccttggttctcaatcccggaggcttccatttctcatatttggcaggaagcagtgcacacaagctccattg

SEQ ID NO: 7241 - DNA, 423 bp, Mus musculus
  misc_feature (378)..(378): n is a, c, g, or t
gacgtgcagctgtcagtttcacaaaatattcccatttcaggtgctgtgattgtctccacacctcaggacattgcactgatggatgcacacaagggtgcggagatgtttcggaaagtcaatgtgcctgttcttggtcttgtccaaaacatgagtgtcttccagtgtccaaaatgtaaacacaaaactcatatttttggtgctgatggtgcaagaaaactagcacagacccttgatcttgatgttctaggagatgttcccttgcacctcagtataagggaagcttcggatatgggtcaaccagttgtcttttctcagcctggaagtgatgaggccaaagcttacctgcatattgcttccgaagtggtgagaagattgaantcatctccagaatgattcccgagtgccctggaaattgtcctggta

SEQ ID NO: 7242 - DNA, 290 bp, Mus musculus
  misc_feature (147)..(147): n is a, c, g, or t
atgtggcctgtgagctcgcacgccccgagtgcctctttctgctgcttggccacggagcttctccaggccttcgagatggcagtggctttacaccattggagctgctgttgcgccagctgaaccaggacgccagctcagcccccactnaggctgaggcagcttctgccacggtcaatgctgccaccgccaacaccacttcgtctgaggaggtgtgtcagcgccgcctgctgctgcttgacctgctagtactgtacaccccggggggcgtcgtaggtccagctcgatgtgaa

SEQ ID NO: 7243 - DNA, 130 bp, Mus musculus
gctctggcagggttcgatgttgaaaaagccaagaaatgacggcgtggtgggtttggctctgccggccccacccctcctgcacacggtgcttccatcctgaggactcaggccacacaaagctgtagagact

SEQ ID NO: 7244 - DNA, 336 bp, Mus musculus
  misc_feature (172)..(172): n is a, c, g, or t
  misc_feature (178)..(178): n is a, c, g, or t
  misc_feature (187)..(187): n is a, c, g, or t
  misc_feature (209)..(209): n is a, c, g, or t
  misc_feature (215)..(215): n is a, c, g, or t
  misc_feature (226)..(227): n is a, c, g, or t
  misc_feature (235)..(235): n is a, c, g, or t
  misc_feature (258)..(258): n is a, c, g, or t
  misc_feature (265)..(265): n is a, c, g, or t
gtagagactctcacaatgcagcaacagcccaggaacaggtgacttggaacacagtgtggcttctgcctagggtcctcgtccctctctctgtggatctcccttcttacgtgaccccaggcttgttggacagagggacattgttcactatgattcgttttgttaagatatcttngttttnagtgctgantaggtgtgagagctatgagctnagactntcctgacctcnntctgcatnccttgggatggacagcagtgatntccctgnccctcctgtggctggagaatcttttcagtttttatacaaggaaaccaagacttagcacttgtgatgtctaa

SEQ ID NO: 7245 - DNA, 497 bp, Mus musculus
  misc_feature (48)..(48): n is a, c, g, or t
  misc_feature (81)..(81): n is a, c, g, or t
  misc_feature (299)..(299): n is a, c, g, or t
  misc_feature (317)..(317): n is a, c, g, or t
  misc_feature (321)..(321): n is a, c, g, or t
  misc_feature (330)..(330): n is a, c, g, or t
  misc_feature (383)..(383): n is a, c, g, or t
  misc_feature (390)..(390): n is a, c, g, or t
  misc_feature (430)..(430): n is a, c, g, or t
  misc_feature (470)..(470): n is a, c, g, or t
ttggcaccagctggcagcctgaatcctgtctgattttcttccttgagnctcagaaagaaggatccgaagaaacttcccaantgtgtttctcaaggattcctccccagtgtctccccggcattaggttttcggagacactttcttcttatgccagtgtggataccaggctcatcccttgtttgtctagtgctcttggtttccggcacaggatggggagtgttccatcgttggtggcttcccattactgcatcaggacggagcatccagagtgggttctgatctggacggaagtggagttncagtacagaccagtttgntcanccttcaagntcctcacagctcagcctactactgctggcgtaggtgacttagtcacacactgnccctcantctgaggtccagctggcttcccattccacctcagggacantcttgctggagaattactggctcctggcctgtggactatnccatctgcactaatcggtctgcacagc

SEQ ID NO: 7246 - DNA, 571 bp, Mus musculus
  misc_feature (95)..(95): n is a, c, g, or t
  misc_feature (125)..(125): n is a, c, g, or t
  misc_feature (145)..(145): n is a, c, g, or t
  misc_feature (193)..(196): n is a, c, g, or t
  misc_feature (315)..(315): n is a, c, g, or t
  misc_feature (319)..(319): n is a, c, g, or t
  misc_feature (322)..(322): n is a, c, g, or t
  misc_feature (327)..(327): n is a, c, g, or t
  misc_feature (341)..(341): n is a, c, g, or t
  misc_feature (345)..(345): n is a, c, g, or t
  misc_feature (371)..(371): n is a, c, g, or t
  misc_feature (386)..(386): n is a, c, g, or t
  misc_feature (390)..(390): n is a, c, g, or t
  misc_feature (413)..(413): n is a, c, g, or t
  misc_feature (435)..(435): n is a, c, g, or t
  misc_feature (437)..(437): n is a, c, g, or t
  misc_feature (451)..(451): n is a, c, g, or t
  misc_feature (453)..(453): n is a, c, g, or t
cagtgcatattaaagggtgtacattgacagcataccagcgtgctgttttatttgctgaagaaaatactatcttctatttttaatgatatattagntacgatgtgtagttctgtagaatcttaaantttttgtactactactaccnatttggtagaaatgtattaagttgtctaccatgccttttttttttttnnnncctaacttgattgaatcacataaaagaagggggaccacagtatttgaatgtgtgaaactatacaacctaaggtttaaaaatgttgctcatgatgctgaacagctcttaaagaacaagangagnttntctcnaactattttcatgnaaanctgtaaacttttttttagatataaancagtataaagtactnattnttattttattctaaagttgtttnaaattcaccatgattttgacgncntgcagattcttaancnaggttaatttatgttttgaggtaaatttcaatttacactttattaagacataatgttggtttctataggaagcatattttgtgactactatgaacagactgatttgtttagatattaa

SEQ ID NO: 7247 - DNA, 234 bp, Mus musculus
attatttccatgaagttctccgaggaactgttaaaagataactattcctacagcatcaagcagaaacaccgcctccgtgagtgcactcaactaaaggaaaaagtgaggatattactgaatgagaacagaaagctgctggtggagcaggctggaacgcaagtgtcccatggggaaaaaaaaaggttttgtgaggaggccagcaagaacatttgtgcctcaagtgccaaggagcag

SEQ ID NO: 7248 - DNA, 516 bp, Mus musculus
  misc_feature (128)..(128): n is a, c, g, or t
  misc_feature (224)..(225): n is a, c, g, or t
  misc_feature (230)..(230): n is a, c, g, or t
  misc_feature (233)..(236): n is a, c, g, or t
  misc_feature (240)..(245): n is a, c, g, or t
  misc_feature (247)..(248): n is a, c, g, or t
  misc_feature (250)..(250): n is a, c, g, or t
  misc_feature (308)..(308): n is a, c, g, or t
  misc_feature (315)..(315): n is a, c, g, or t
  misc_feature (325)..(325): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (386)..(386): n is a, c, g, or t
  misc_feature (388)..(388): n is a, c, g, or t
  misc_feature (395)..(395): n is a, c, g, or t
  misc_feature (400)..(400): n is a, c, g, or t
  misc_feature (407)..(407): n is a, c, g, or t
  misc_feature (413)..(413): n is a, c, g, or t
  misc_feature (440)..(440): n is a, c, g, or t
  misc_feature (467)..(467): n is a, c, g, or t
  misc_feature (482)..(482): n is a, c, g, or t
ctgactcttgaaaactgcttgctaaagtgtgaagggacaggagtgtgcgttctcacaggggcttcactgacgatcacaaacagtgagataactggtgcccagggtgctggtgttgaactgtatcctgngagcatagccattttggaagggaatgagattcatcactgtaataacctcagaaccagtgacagctcaaagagcaccttaggtggtgttaacatganngttcntcnnnnaccnnnnnngnngntgacgaacaatcatatctacaacaacaatggctatggagtgagcattcttcagccatnggaacanttctttattntngcanaancnagntntcaacaaaggggctgcttcaggagataagaaagatgacaaaatgntntccaaantcatncaaactntgaatntggaaatgaacaacaacaggatagaanccaacttaaagggggatattaggatantcaccgggtaaagtntctggataggtgttcgttcgtgttttatagttca

SEQ ID NO: 7249 - DNA, 481 bp, Mus musculus
  misc_feature (331)..(331): n is a, c, g, or t
  misc_feature (364)..(364): n is a, c, g, or t
  misc_feature (406)..(406): n is a, c, g, or t
gaaccctttgttaatgccagaatgttcatccacaactgtgaaaaagagaccagaagatgtaagtgatgtgccctccgaaagcctgaggagcgtcccgctggcggtggctgacgcactggagcacattatggaacaactcaacatcctaacccagactgtttcaattctggagcagcgactgtctttgacagaagataagctgagagactgccttgagaatcagcaaaagcttttcagcgctgtccaacagaagagctgagcagggagggccgtgagcgaggtcaggtcagtcgccagaagacgggctcacacactctggaggtagccgagnccttccacacccctgccacgcactaaccgattnttcagagggtgagcaacgaaaccgaaaaggttccaggcattntcagggactgacttaaacacacaaatcaatgtcaaggatcaagttatgctcctcccaggtctaattgcagtaata

SEQ ID NO: 7250 - DNA, 233 bp, Mus musculus
ttggtctgtgccctgtagcccacagagcttagatatttcttatgcaatacatccagaagatgcaaaagctttatgggaaagtgtccacaaaacccctggggaggttacccaggaggaagttgacttatttatgaactgcctttattcacatttccataggcatttcaaaattcacttagcagccacaagattggttcgtgtctcaacatctgtagcttcagcacacactgatg

SEQ ID NO: 7251 - DNA, 477 bp, Mus musculus
  misc_feature (50)..(50): n is a, c, g, or t
  misc_feature (279)..(279): n is a, c, g, or t
  misc_feature (298)..(298): n is a, c, g, or t
  misc_feature (301)..(301): n is a, c, g, or t
  misc_feature (322)..(322): n is a, c, g, or t
  misc_feature (329)..(329): n is a, c, g, or t
  misc_feature (334)..(334): n is a, c, g, or t
  misc_feature (345)..(345): n is a, c, g, or t
  misc_feature (355)..(355): n is a, c, g, or t
  misc_feature (357)..(357): n is a, c, g, or t
  misc_feature (360)..(361): n is a, c, g, or t
  misc_feature (363)..(363): n is a, c, g, or t
  misc_feature (365)..(365): n is a, c, g, or t
  misc_feature (384)..(384): n is a, c, g, or t
  misc_feature (386)..(386): n is a, c, g, or t
  misc_feature (447)..(448): n is a, c, g, or t
gcgacaatctcacccggaatgacttcctgtgaaaatactttcaatacttnaagatacgccaacagagtcaaagaattagctttagaggcaaggccctaccatcactgtgtctctccacctggccatgaggtaccactgatgatagaaaacgacaatacgaattcgggaaagtcccttcagagggatgaagttattcagatacctactgtagagaaagaggaagagaaagaaagtgatgaactcacatcaaaaaaggagccagcagcttcatggagcagntccaaccagtggtgggagnccntccaagaaacggctgagggantcaacgntgatntggatttttgncattgcgcantnttnntntnttttggagcagaaaatcgntntgctgactgatatccaaaaaaagctccaatcactacgagaagacctccaaaagaaaagccnnagttgagtgacagcaatgatcagagatca

SEQ ID NO: 7252 - DNA, 285 bp, Mus musculus
  misc_feature (189)..(189): n is a, c, g, or t
  misc_feature (194)..(194): n is a, c, g, or t
  misc_feature (201)..(201): n is a, c, g, or t
accaagcagttgagggcaatccaagacccagacctggagacctgattgagatttttcgaattggctatgaacattgggccatctatgtggaagatgactgcgtggtccacctggctcccccaagtgagtttgaggcagggagcatcacctctatcttcagcaaccgagctgtggtgaagtacagccggntggangatgtgntgcacggttgctcctggaagatcaacaacaagctggatggcacatacctgccgctgccggtggacaagatcatgcagcgcacaa

SEQ ID NO: 7253 - DNA, 311 bp, Mus musculus
  misc_feature (108)..(108): n is a, c, g, or t
  misc_feature (111)..(111): n is a, c, g, or t
  misc_feature (114)..(114): n is a, c, g, or t
  misc_feature (120)..(120): n is a, c, g, or t
  misc_feature (142)..(142): n is a, c, g, or t
  misc_feature (151)..(151): n is a, c, g, or t
  misc_feature (155)..(155): n is a, c, g, or t
  misc_feature (169)..(169): n is a, c, g, or t
  misc_feature (171)..(171): n is a, c, g, or t
  misc_feature (174)..(174): n is a, c, g, or t
  misc_feature (246)..(246): n is a, c, g, or t
  misc_feature (278)..(278): n is a, c, g, or t
  misc_feature (282)..(282): n is a, c, g, or t
agcttgacagcaacactggagtatgtggaggagaaaaccaatgtggactctgtgtttgtgaacttccaaatcgatcggaaggacagaggtgccctgctgcgagccttnagntanatgggnttcgaggtggttagaccagatnatcctgccntccntccctgggacaatntnatnttcatggtgtatccccttgaaagggaccttggccaccctggccagtgagcctccctaaacatgttccatttntgtgaggggttggaaacctcaacacacgggantttngaggcccaggatgtgatttaagatacttc

SEQ ID NO: 7254 - DNA, 396 bp, Mus musculus
  misc_feature (197)..(197): n is a, c, g, or t
  misc_feature (200)..(200): n is a, c, g, or t
  misc_feature (203)..(203): n is a, c, g, or t
  misc_feature (209)..(209): n is a, c, g, or t
  misc_feature (231)..(231): n is a, c, g, or t
  misc_feature (240)..(240): n is a, c, g, or t
  misc_feature (244)..(244): n is a, c, g, or t
  misc_feature (258)..(258): n is a, c, g, or t
  misc_feature (260)..(260): n is a, c, g, or t
  misc_feature (263)..(263): n is a, c, g, or t
  misc_feature (335)..(335): n is a, c, g, or t
  misc_feature (367)..(367): n is a, c, g, or t
  misc_feature (371)..(371): n is a, c, g, or t
attcctctgctcattggcacggccttctgtgtgatcaccgactcttcctggatatcccatatcaggccttggatcaaggcaaccgagaaagcttgacagcaacactggagtatgtggaggagaaaaccaatgtggactctgtgtttgtgaacttccaaatcgatcggaaggacagaggtgccctgctgcgagccttnagntanatgggnttcgaggtggttagaccagatnatcctgccntccntccctgggacaatntnatnttcatggtgtatccccttgaaagggaccttggccaccctggccagtgagcctccctaaacatgttccatttntgtgaggggttggaaacctcaacacacgggantttngaggcccaggatgtgatttaagata

SEQ ID NO: 7255 - DNA, 252 bp, Mus musculus
caagcccagatgctgcttaactgtactacatccttgaataatcacatcttaaatctgtgaggaaggttctcattctcactttgcaaatgagtaaactggagatctgaaaggttaactagaatttaaaatgaataataaatgcagggtagagcccgtgtctatcactccaaagcacaccctacgccagcactaccctgcttgctagtcactctcttgagaaaacatgtatgaggagtatatgggctgagcttc

SEQ ID NO: 7256 - DNA, 154 bp, Mus musculus
  misc_feature (124)..(124): n is a, c, g, or t
gcgtggcgccggtcctgcccgagggccaccgccatcttacggcgggggccgctatgacgagtaccgaggctgctcgcccgacggctatggcggccgcgacagctaccgcagcgagcgctactcnagtggccgtgagcgcgtgggtaggccggag

SEQ ID NO: 7257 - DNA, 231 bp, Mus musculus
  misc_feature (85)..(85): n is a, c, g, or t
  misc_feature (196)..(196): n is a, c, g, or t
tttaagaagactacggccctgatccctcaccgtagctcccgacgtgggggccggcagtcctgctagctgctagtgagctgtactntcctccatcagggaaagccccagggttgtacctgggcatgcatctatctaagtaccccagtgagactgtaattaccttaggatcctcaaaatgtgttcataaactcagctngcttatgtgttctgaattgatgcagtcgaccctgg

SEQ ID NO: 7258 - DNA, 334 bp, Mus musculus
  misc_feature (32)..(32): n is a, c, g, or t
  misc_feature (234)..(234): n is a, c, g, or t
  misc_feature (243)..(243): n is a, c, g, or t
  misc_feature (251)..(251): n is a, c, g, or t
  misc_feature (259)..(259): n is a, c, g, or t
  misc_feature (267)..(268): n is a, c, g, or t
  misc_feature (270)..(270): n is a, c, g, or t
  misc_feature (273)..(274): n is a, c, g, or t
  misc_feature (279)..(279): n is a, c, g, or t
ttcatttttgggtcatttaaggcagaacgttntgcacgaaagccccggcttggatgtcacaaaagagcttgcaaaatggaaggaagtggagatatgcctacaaagttgaggaggctggatgtgcatgctaatcaggagacgacagaaaaagaagttgagagaatcttgggattgctgcaaacctactttcaaaagtaccccgatactccagtgtcatactttgagtttgtgatngatccaaantcattctntcgcactntggagaanntnttnnatgtntcttttattattagggatggctttgcaagaataaggcttgaccaagacaggctgc

SEQ ID NO: 7259 - DNA, 483 bp, Mus musculus
  misc_feature (177)..(177): n is a, c, g, or t
  misc_feature (341)..(341): n is a, c, g, or t
  misc_feature (345)..(345): n is a, c, g, or t
  misc_feature (351)..(351): n is a, c, g, or t
  misc_feature (353)..(354): n is a, c, g, or t
  misc_feature (367)..(367): n is a, c, g, or t
  misc_feature (381)..(381): n is a, c, g, or t
  misc_feature (385)..(385): n is a, c, g, or t
  misc_feature (388)..(392): n is a, c, g, or t
  misc_feature (398)..(398): n is a, c, g, or t
  misc_feature (408)..(408): n is a, c, g, or t
  misc_feature (410)..(410): n is a, c, g, or t
  misc_feature (417)..(417): n is a, c, g, or t
  misc_feature (419)..(419): n is a, c, g, or t
  misc_feature (433)..(433): n is a, c, g, or t
  misc_feature (437)..(437): n is a, c, g, or t
  misc_feature (452)..(452): n is a, c, g, or t
  misc_feature (454)..(454): n is a, c, g, or t
tagcctcggttaacctgcggaagttaattgactgcatcttgcgggatacggccgaggacctgcggctacagtgcgatgcagtgaactcggctttctcaagccgctgccaagagctggacgactcactccagaagctgcagtaccaccttcgaaagaccctgacggagatcacagacnaggaacaccagattgcagccttgaagcaggccatcaaggacaaggaggcccctctgcgtgtggcccagactcgcctttaccagcggtcacaccggcccaatgtggagttgtgccgggacaatgcccagttcaggttgctgagcgaggtggaggagttgaacatntccntcagancnnttaaaggagaagnttcaggatgcggancagncannnnnggaacntggaggattnangcatgantntggagaaggacatngcantcaagaccaacagcntntttatcgaccgccagaagtgtatgaccca

SEQ ID NO: 7260 - DNA, 537 bp, Mus musculus
  misc_feature (203)..(203): n is a, c, g, or t
  misc_feature (212)..(212): n is a, c, g, or t
  misc_feature (218)..(218): n is a, c, g, or t
  misc_feature (250)..(250): n is a, c, g, or t
  misc_feature (264)..(264): n is a, c, g, or t
  misc_feature (270)..(270): n is a, c, g, or t
  misc_feature (279)..(280): n is a, c, g, or t
  misc_feature (283)..(283): n is a, c, g, or t
  misc_feature (285)..(286): n is a, c, g, or t
  misc_feature (292)..(294): n is a, c, g, or t
  misc_feature (296)..(296): n is a, c, g, or t
  misc_feature (327)..(328): n is a, c, g, or t
  misc_feature (335)..(336): n is a, c, g, or t
  misc_feature (340)..(340): n is a, c, g, or t
  misc_feature (344)..(344): n is a, c, g, or t
  misc_feature (385)..(385): n is a, c, g, or t
  misc_feature (396)..(396): n is a, c, g, or t
  misc_feature (472)..(472): n is a, c, g, or t
  misc_feature (504)..(504): n is a, c, g, or t
gattcgatcatactggttgcatctggtgtactcagcgcttggaacattgctcttctccatatacctggtgatggacgtgcaaatgatggtgggggggcgctaccattatgagataaaccccgaagagtacatttttgctgctctgaacatctacgtggacatcatcagccttttcatttttattttggacctgattggacganagctgatgnccaaanccagctaaggcccagaagaggaaaggtggganacctatggtgtgtngacagnttcaggcgnntancnntgaccnnntnatagacccttttgagagtcacttattcatcnntcaattnnactntatntcaaaagaagctaagaattcagtagatggtagctgtagctnttataattttntttcccttgacatatggcaaaactttcgtatccatattgaaatatatcagattactataaattcagaaaaagagtntcctaatcataagctgacgtggatttagaagntcctcaatgctttggtgacgttttccaggtaca

SEQ ID NO: 7261 - DNA, 208 bp, Mus musculus
gaagatggcccagaccatgctagcatgcaggacccgacggcccaatgtggaactctgcagggatgtgccacagttcaggctcgtgaatgaggtcttcaccatagacgacactctacagacgctcaagctgaggcttcgggagacgcaagacacgttgcagctgctggtgatgaccaagtcccgtctggagcacgagctggccatcaaa

SEQ ID NO: 7262 - DNA, 565 bp, Mus musculus
agacttaccaattacctcattcagcagtgatttaaataatgtattatagttgtgtagatgctaagtttatgacatatttatacctttttatatggaagataatttatatcatccatgtgtagagccttttaaacatcaactttactttctaggtaatgtggctgtgcaatagttttttaattttatctttttacttttctatttttcatatattttgctacctaagtatttcagtgaaccttgtgcccatgtgtatgtctgatcttttattattggcttccacgatccttattcagactatatcacattaagagctgttattgctagcatagtattttaaattctctaatttggggcttttggtggacaataaattttacctttaacactttattctgtttaaactggaagtaaaataatggctgctaaaatgtatttttgaaatcaacttctttaatcctaagatattaaatttacatttgatcaaaccaggtggttcatacatgccaatgttttaaaggttttctataaaatcatattgttgctgttaaatgtgtcatgctta

SEQ ID NO: 7263 - DNA, 583 bp, Mus musculus
  misc_feature (147)..(147): n is a, c, g, or t
  misc_feature (262)..(262): n is a, c, g, or t
  misc_feature (271)..(271): n is a, c, g, or t
  misc_feature (297)..(297): n is a, c, g, or t
  misc_feature (319)..(319): n is a, c, g, or t
  misc_feature (326)..(326): n is a, c, g, or t
  misc_feature (339)..(339): n is a, c, g, or t
  misc_feature (359)..(359): n is a, c, g, or t
  misc_feature (363)..(363): n is a, c, g, or t
  misc_feature (379)..(379): n is a, c, g, or t
  misc_feature (396)..(396): n is a, c, g, or t
  misc_feature (435)..(435): n is a, c, g, or t
  misc_feature (451)..(451): n is a, c, g, or t
  misc_feature (465)..(465): n is a, c, g, or t
  misc_feature (474)..(474): n is a, c, g, or t
  misc_feature (480)..(480): n is a, c, g, or t
  misc_feature (521)..(521): n is a, c, g, or t
acatgaaccttgcacagctctgctcacttctcatggctttatggggacagtttttggaagctataacactgcatgaagatttaagagtgctgttagcacaggaacaccatactttgagggttcgcagattttcggaggcgttctttngttttgaacatccaagagaagctgccattgcataccaagaactccatgctcagagtcatctacagatgtgcaccgctatcaaaaatacttccttctgcagttctcttccaccccnacctattgnatgtagtgaattagatggagatctcnattcattacctataatctttgnagatagntatttagattcanttattgaagacttagatgcncccnggatgggaattcaaantcttcagatatcagagnccagtaaaacggataaacatgagactgaagaaagctctntagtaggactttctancccagagttgaagntcagacctnctgttncctccagtaattgctatacagaaggtgaaaagcagctaacnaaatctctaaaaggaaagaatgaagaatcaaataaatccaaggttaaggtcactaagctcat

SEQ ID NO: 7264 - DNA, 472 bp, Mus musculus
  misc_feature (268)..(268): n is a, c, g, or t
  misc_feature (286)..(286): n is a, c, g, or t
  misc_feature (289)..(289): n is a, c, g, or t
  misc_feature (294)..(296): n is a, c, g, or t
  misc_feature (327)..(328): n is a, c, g, or t
  misc_feature (332)..(332): n is a, c, g, or t
  misc_feature (334)..(334): n is a, c, g, or t
  misc_feature (337)..(338): n is a, c, g, or t
  misc_feature (340)..(340): n is a, c, g, or t
  misc_feature (342)..(342): n is a, c, g, or t
  misc_feature (344)..(349): n is a, c, g, or t
  misc_feature (352)..(353): n is a, c, g, or t
  misc_feature (356)..(358): n is a, c, g, or t
  misc_feature (363)..(363): n is a, c, g, or t
  misc_feature (376)..(376): n is a, c, g, or t
  misc_feature (402)..(402): n is a, c, g, or t
  misc_feature (441)..(441): n is a, c, g, or t
  misc_feature (444)..(444): n is a, c, g, or t
aggcaaaccgttttagataagtatgaattacttctacaaatgaaatctacctttgaaaagaagatgcaaaggcaacatgaactcagtgagagttgtagtgcaagtgctctacaggcaagattgaaagtagctgcacacgaagctgaggaagaatcggataatattgctgaagacttcttggagggaaaaactgaaatagatgattttctcaatagcttcaaggaaaagagaacaatttgccactgtagaagagctaaagaagagaagncttcaccaggtgatagcnatncacannncaatttcatgctcctctctagattttcctgnnaccntnaannancnannnnnnaannggnnnacagncctaagcacattnttttctatttatgacttagggatggncacttgaaaccatggctgaggtccagatgcgatgtaganttntctatcacctgagactgattccgtacag

SEQ ID NO: 7265 - DNA, 356 bp, Mus musculus
  misc_feature (118)..(118): n is a, c, g, or t
  misc_feature (225)..(225): n is a, c, g, or t
  misc_feature (230)..(230): n is a, c, g, or t
  misc_feature (245)..(245): n is a, c, g, or t
  misc_feature (253)..(253): n is a, c, g, or t
  misc_feature (272)..(272): n is a, c, g, or t
  misc_feature (276)..(276): n is a, c, g, or t
  misc_feature (282)..(282): n is a, c, g, or t
aatatttctcttgttgttggtgttctatatatgttcagttgctgtgtttgaaataccttatctaatttatggctgtatgctagctactacttagtggagttttgcaagttatttacanaattctaatgttggtttcctgtcagacgaggatagtttaaggccccaccttatctgtactgtgttttctgtccatctgtccatctgtcttcaagccatggactaccntgatncacaagaccttgaantattgatntgatgtctgtgtagatatnttgnatgtgnatagaactctattctgaagtctcactggggagctatgatggggacaaatggatggacaaagactagtttcgaca

SEQ ID NO: 7266 - DNA, 501 bp, Mus musculus
  misc_feature (276)..(276): n is a, c, g, or t
  misc_feature (294)..(294): n is a, c, g, or t
  misc_feature (297)..(297): n is a, c, g, or t
  misc_feature (300)..(300): n is a, c, g, or t
  misc_feature (306)..(307): n is a, c, g, or t
  misc_feature (315)..(315): n is a, c, g, or t
  misc_feature (322)..(322): n is a, c, g, or t
  misc_feature (324)..(324): n is a, c, g, or t
  misc_feature (329)..(329): n is a, c, g, or t
  misc_feature (361)..(361): n is a, c, g, or t
  misc_feature (375)..(375): n is a, c, g, or t
  misc_feature (383)..(383): n is a, c, g, or t
  misc_feature (386)..(386): n is a, c, g, or t
  misc_feature (390)..(390): n is a, c, g, or t
  misc_feature (403)..(403): n is a, c, g, or t
  misc_feature (421)..(421): n is a, c, g, or t
  misc_feature (443)..(443): n is a, c, g, or t
  misc_feature (454)..(454): n is a, c, g, or t
aaggatgtggcttctcaggctacagtacccctcctcttcaatatggctgatccctgccaagaagtagctatgaaggccaggttcaccttcctgcgctgtgccatcttgttaaagtgggagttccggaaggagctgtttggcaagctggcatggggccaagggctgggcgctgcaaatgacatttttatctacatgctagaaagcaatgtcggcaactaccagcagttcctcagtcaggccttgacgtatctggacagttcccacatgacagtgaanctggcagccatgaagttnatnggngcattnnttcaggantatttcnantgacntatgcatatacttgagaaagaaagatgtgatnttccttaagaactntttggagnccntccnccatgacacggantccaggacccgaaggttntacctgaactactggaatgatnccgtggagctntcttactatgttcaagactagctgcacctgcgattgttcttattttt

SEQ ID NO: 7267 - DNA, 455 bp, Mus musculus
  misc_feature (290)..(290): n is a, c, g, or t
  misc_feature (297)..(297): n is a, c, g, or t
  misc_feature (340)..(340): n is a, c, g, or t
  misc_feature (343)..(343): n is a, c, g, or t
  misc_feature (349)..(349): n is a, c, g, or t
  misc_feature (356)..(356): n is a, c, g, or t
  misc_feature (367)..(367): n is a, c, g, or t
  misc_feature (399)..(399): n is a, c, g, or t
  misc_feature (401)..(401): n is a, c, g, or t
ggtggacgaacatatttacctttcagaagtctccaacggccttaaaaggcattattactgggcaccgacttatggagaaacttacatgccgtcatcttccgcaggctttgctcttgttcctgtgggcgaacatctataagaagcttgaaaacagttttcatacattcatctcaacacttttggagactaatattttgtagactatttttttcttttgtaaatcagaacaaattatttttatcaaagtataaaattttgtgtacttgttctcgagaaaaagctgattcttnacatagngactaaaatatcaaccctgaaacaagccacagaactatagtanttntttttntaatganaaacgaacacnaaaaccaaagaaaagtaaagtcactacagatntnttaaccaaatgatatggcagatttgctttgcagctggcaagtttacagtggatt

SEQ ID NO: 7268 - DNA, 178 bp, Mus musculus
  misc_feature (67)..(67): n is a, c, g, or t
ggaagagccccagtatggcacgtgtggccaagagagcgcctgagccgactactgctgctgcagcagnaagatccaagcagcggaatcgtagagcttcctatggtcgaaggtgcaagaactccaacaagaaccaacgtgcttcgcgtcgtcgcaaaagctgtgctgagataatgagaaa

SEQ ID NO: 7269 - DNA, 63 bp, Mus musculus
gaaacttactggcaatctgatggctctcagcctcacttagtgaacatccaattcagaagaaaa

SEQ ID NO: 7270 - DNA, 299 bp, Mus musculus
gctacactccaagcaaaatctcagtcagagtaggaaataattttcacaaccttcaagaaatccggcaacttgaattggtggaaccaagtggctggattcacgttcctttaactgacaatcataagaagccaactcgcacattcatgatacagattgctgttctagccaatcatcagaatggaagagatacccacatgagacaaattaagatatacacaccagtggaagagagctccattgggaaattccctagatgcacaaccattgatttcatgatgtatcgttcaatacggtgactt

SEQ ID NO: 7271 - DNA, 276 bp, Mus musculus
  misc_feature (135)..(135): n is a, c, g, or t
aaggcccgggtaatggctaccattggggtgacacggggcttgggagaccacaaccttaaggtctgcagctctactctgtccatcaagcctttcctctcctgctttcctgaagtacgagtgtatgatctgacgcantatgagcactgtccagatgatgtgctggtcctgggaacagatggcttgtgggatgtgaccaatgactctgaggtagctgccactgtggacagggtgctgtcatcctatgagcccaatgatcccagcaggtatacagctctg

SEQ ID NO: 7272 - DNA, 494 bp, Mus musculus
  misc_feature (42)..(42): n is a, c, g, or t
  misc_feature (54)..(54): n is a, c, g, or t
  misc_feature (70)..(70): n is a, c, g, or t
  misc_feature (84)..(84): n is a, c, g, or t
  misc_feature (103)..(103): n is a, c, g, or t
  misc_feature (126)..(126): n is a, c, g, or t
  misc_feature (162)..(163): n is a, c, g, or t
  misc_feature (165)..(169): n is a, c, g, or t
  misc_feature (186)..(186): n is a, c, g, or t
  misc_feature (285)..(285): n is a, c, g, or t
  misc_feature (435)..(435): n is a, c, g, or t
  misc_feature (456)..(456): n is a, c, g, or t
  misc_feature (458)..(458): n is a, c, g, or t
ttccctgatgcactggtctgcagtaccttccatgagtgctangtagcactggcngtgctaaacaccattntcagcactggcctntcctgctactccaggtttnttgaactccagaagccccggctntgcaagctactccgggtcctggccttcgcctacccnnannnnngggactcactccccatnttctacaggctcttcctgttcccaggggagagttcaagaaatgaagccatgttgtaccaccagaagcacatgggcatgactctcctggcctctttcttntactctgctcacctgccagagcgactagcccctggacgctttgactacattggccacagtcaccagctgtttcatgtgtgcgtcatcctggccacacacttgcagatggaagccatccttctggacaagaccctgaggagggagtggctnctggccacctccagacccttntntttccctcagatagcagcggccatgcttctgtgcat

SEQ ID NO: 7273 - DNA, 533 bp, Mus musculus
  misc_feature (315)..(315): n is a, c, g, or t
  misc_feature (338)..(338): n is a, c, g, or t
  misc_feature (348)..(348): n is a, c, g, or t
  misc_feature (364)..(364): n is a, c, g, or t
  misc_feature (367)..(367): n is a, c, g, or t
  misc_feature (388)..(388): n is a, c, g, or t
  misc_feature (418)..(418): n is a, c, g, or t
  misc_feature (420)..(420): n is a, c, g, or t
  misc_feature (443)..(443): n is a, c, g, or t
  misc_feature (445)..(445): n is a, c, g, or t
  misc_feature (464)..(464): n is a, c, g, or t
  misc_feature (466)..(466): n is a, c, g, or t
  misc_feature (486)..(486): n is a, c, g, or t
  misc_feature (508)..(508): n is a, c, g, or t
acacagctcactggacagaagcagagtcagcagcagtacgacccttccacagggcctcctgtgcagaacgccgccagcttgcataccccaccaccacagcttcctgcgaggctgcctccggccagtgtcccagccacagccctcccttccaccttacagttttcacagcagtcacagatggtggaggcttcaactcagctccaaatccctgtgaagactcaacagctaaatgcccccatccctgcccccctgcccagccagctccctgctccttcttcacagcccgcccagccggccctacatgttccgatgccngggaaggcgcagatgcagacatntcagctttcntcccagacccaggtantcntgtggacattggctgttttantagtgaggtacagaagaaaagaggaaacantntgcagaggtggcttggcttgctntntaggtatttggtagggtgntntgcgctgaacctgcacgttnctggaagcagctttacctgccntcttagcacagttggttattgtaga

SEQ ID NO: 7274 - DNA, 308 bp, Mus musculus
  misc_feature (122)..(122): n is a, c, g, or t
attctggatgttcgagttccctgcacaccggttgctaggctaaacaaccaccgagcatgtgtcaatggcattgcctgggccccacactcgtcctgccacatctgtactgcagcggatgaccnatcaggccctcatctgggacatccagcagatgcctcgggccatcgaggaccctatcttggcctacacagctgagggagagatcaacaatgtgcagtgggcctccactcagcctgactggatcgctatctgctacaacaactgcctggagatactccgcgtgtagtgttggtggcacctcacgtatc

SEQ ID NO: 7275 - DNA, 484 bp, Mus musculus
  misc_feature (250)..(250): n is a, c, g, or t
  misc_feature (286)..(287): n is a, c, g, or t
  misc_feature (293)..(293): n is a, c, g, or t
  misc_feature (302)..(302): n is a, c, g, or t
  misc_feature (338)..(338): n is a, c, g, or t
  misc_feature (340)..(340): n is a, c, g, or t
  misc_feature (372)..(372): n is a, c, g, or t
  misc_feature (377)..(377): n is a, c, g, or t
  misc_feature (379)..(379): n is a, c, g, or t
  misc_feature (412)..(412): n is a, c, g, or t
caaagagttcctcaacattgatgttggaggtagttcatcaggagattaaattgagaaatgcatatttctaatgtaaaaacatgaaaattacatagctgccatttttatatattttgatagtgtgttactactgtcagtgtctcttacagtatttgttctgcaataaagaaaagatttttttttcaagattttagtattaaaagtcaggacaaaaatttttttcacttagacccagaatcatatattaagncattttattataggtagtgtatgttacttctgttannaaattnttacacttntgatgaacaccatataatgtgaaatatgaggaagtntntttaaacttcaatttgcttagtacaacagtantcccntnttttaggaattgtattgtatgaccaatagttgnaaagttgataatgacttagtgacactatcaaactatttgaaaagtataggttgggctatttgctaatgttta

SEQ ID NO: 7276 - DNA, 237 bp, Mus musculus
gaatataccctgaaacataggagtctacaagatacaaaaactaagagtgactaccaagattccccaaatcctgtcaccatgtcaaacatagccctggctttgcaagatgaagggtgttttcagactactcagactcctgtaaaaagcaaggaagacatatacaaagaaatatgtgatgaaacttctgaagaaaatatgattcgtcttcaaaacatacatttaaaggccacggaatcc

SEQ ID NO: 7277 - DNA, 479 bp, Mus musculus
  misc_feature (52)..(52): n is a, c, g, or t
  misc_feature (83)..(83): n is a, c, g, or t
  misc_feature (247)..(247): n is a, c, g, or t
  misc_feature (331)..(331): n is a, c, g, or t
  misc_feature (389)..(389): n is a, c, g, or t
  misc_feature (395)..(395): n is a, c, g, or t
  misc_feature (408)..(408): n is a, c, g, or t
  misc_feature (438)..(438): n is a, c, g, or t
  misc_feature (447)..(448): n is a, c, g, or t
cagtattacctgcttgtctttgttatgttgcattcaaaaaccgtgttcattntggcttagatctgcccttacattcttgagtntattagacatttaaccacgagacacagcctctcagccattaacagatggaagagacacgacacaggctggctatgtgatggagcagcttcctgtgtccattagtgatgtgtgtataacgctacatattcccaactgtcatcatggttaggcgagaaagccaatntctgttccatgctaaaagacggagaaaggaacaaaatatggacattaaaggaaatctgaaatgtattcaaattctcatgctctnatctccaataaggaacgtgaataatcttatgaaaaggaggaaagggaagaatttgaantcaccnaaatccaatttanccaaattatagtacataatataatactgcnaacaacttnntgcgtttgaagtgtattcttagccaggcatg

SEQ ID NO: 7278 - DNA, 285 bp, Mus musculus
  misc_feature (207)..(207): n is a, c, g, or t
  misc_feature (212)..(212): n is a, c, g, or t
  misc_feature (239)..(239): n is a, c, g, or t
ttcggctactgttttttctaatatgtgcagtatacctgtcatctcaattatcctccaaagtgtacctgccaacttcacttcacttagcctgggtgtgacctacgccattgtgaaatttgttgcatctgtccctgcaccactcttgtttcgactgtcgtcagctatagcttgtatatactgggacaataatagatgtggagggaaagnacgtngttggatctataataagaacatattgntctacgaatttatgggaatatggatgagttcccaattaatcatagt

SEQ ID NO: 7279 - DNA, 541 bp, Mus musculus
  misc_feature (320)..(320): n is a, c, g, or t
  misc_feature (326)..(326): n is a, c, g, or t
  misc_feature (328)..(328): n is a, c, g, or t
  misc_feature (338)..(338): n is a, c, g, or t
  misc_feature (341)..(341): n is a, c, g, or t
  misc_feature (352)..(353): n is a, c, g, or t
  misc_feature (373)..(374): n is a, c, g, or t
  misc_feature (378)..(378): n is a, c, g, or t
  misc_feature (404)..(404): n is a, c, g, or t
  misc_feature (412)..(412): n is a, c, g, or t
  misc_feature (414)..(414): n is a, c, g, or t
  misc_feature (441)..(441): n is a, c, g, or t
  misc_feature (465)..(465): n is a, c, g, or t
cagaggttttaactctactcagcaacctggctgacctggcaaatgctgtgcactggttgccccgaggtgtcctgtgggctggccgcttccctccttggctggtgggtctcatgggcaccatctcctccatcctcagcacatgccaagctgtcagggctggcagacaggccgaggcagacagcccttgatgaggccctgaagtggcaggtggaggacactgtggtgctcaacaggactcagattcccagagtgggaatcactggccactggtgcatccataagtgtgtactccggtgctggcccctgggcagggtgggaanaggggntnaaatgagatnttntcaggccccanncagggtttcaggggaagctnntttnttgggaagaggggggcacatgagaanttcaggantntcagagccaagggcaaggtttgcaaantcccaggaggacactgctagagcntcctacctgctggcttgcctaaaggtgagtgggagagacacatgcctcaggtcgggcttcggcaaagctggaatat

SEQ ID NO: 7280 - DNA, 462 bp, Mus musculus
  misc_feature (161)..(161): n is a, c, g, or t
  misc_feature (230)..(230): n is a, c, g, or t
  misc_feature (232)..(232): n is a, c, g, or t
  misc_feature (236)..(236): n is a, c, g, or t
  misc_feature (283)..(284): n is a, c, g, or t
  misc_feature (286)..(286): n is a, c, g, or t
  misc_feature (291)..(291): n is a, c, g, or t
  misc_feature (305)..(305): n is a, c, g, or t
  misc_feature (311)..(311): n is a, c, g, or t
  misc_feature (321)..(321): n is a, c, g, or t
  misc_feature (332)..(332): n is a, c, g, or t
  misc_feature (334)..(334): n is a, c, g, or t
  misc_feature (338)..(338): n is a, c, g, or t
  misc_feature (344)..(344): n is a, c, g, or t
  misc_feature (352)..(352): n is a, c, g, or t
  misc_feature (355)..(355): n is a, c, g, or t
  misc_feature (358)..(358): n is a, c, g, or t
  misc_feature (360)..(360): n is a, c, g, or t
  misc_feature (362)..(362): n is a, c, g, or t
  misc_feature (364)..(365): n is a, c, g, or t
  misc_feature (371)..(371): n is a, c, g, or t
  misc_feature (374)..(374): n is a, c, g, or t
  misc_feature (381)..(381): n is a, c, g, or t
  misc_feature (386)..(386): n is a, c, g, or t
  misc_feature (401)..(401): n is a, c, g, or t
  misc_feature (405)..(405): n is a, c, g, or t
  misc_feature (425)..(425): n is a, c, g, or t
  misc_feature (428)..(428): n is a, c, g, or t
  misc_feature (430)..(430): n is a, c, g, or t
gagcacagctgtgtcatcaacatcggtgtaggcaagaatctggacatgctcaacagcctgatcactctactggaccctgaatttgctgaacacctcaaagggaagggctcaggggctgtgcagtccctcttcccgtggttctgcctttgcttccagcgtgncttcaaaaccttcgatgatgtctggaggctctgggaggtcctgctgacggggaagccctgcagaaactncnaggntgctggtggcctacagcatgctacagatggtgcgcgagcaggcgctnntngagtntatgagcggtgacnccattntcatggcctncaacaaccttntngacnttgatncggatganctnatntntncnncctgcntgntttattntgagntcatgcaaaaggagntccntcagccattaaaggagttcnttntntaaggacactgacactcacaatggacacctgc

SEQ ID NO: 7281 - DNA, 567 bp, Mus musculus
  misc_feature (49)..(49): n is a, c, g, or t
  misc_feature (108)..(108): n is a, c, g, or t
  misc_feature (124)..(124): n is a, c, g, or t
  misc_feature (136)..(136): n is a, c, g, or t
  misc_feature (140)..(140): n is a, c, g, or t
  misc_feature (147)..(147): n is a, c, g, or t
  misc_feature (169)..(169): n is a, c, g, or t
  misc_feature (181)..(181): n is a, c, g, or t
  misc_feature (194)..(194): n is a, c, g, or t
  misc_feature (203)..(203): n is a, c, g, or t
  misc_feature (211)..(211): n is a, c, g, or t
  misc_feature (222)..(222): n is a, c, g, or t
  misc_feature (233)..(233): n is a, c, g, or t
  misc_feature (286)..(286): n is a, c, g, or t
  misc_feature (301)..(301): n is a, c, g, or t
  misc_feature (367)..(367): n is a, c, g, or t
  misc_feature (420)..(420): n is a, c, g, or t
  misc_feature (460)..(460): n is a, c, g, or t
  misc_feature (489)..(489): n is a, c, g, or t
  misc_feature (535)..(535): n is a, c, g, or t
tggagcctagaccttgggcacaatatcttggatgatgctggtctgaatnttctgtgtgatgctttaagaaatcccaactgccacgttcagaggctaggattggaaaanctgtggtttgaccccntggttgctgtcnggantctcttnggtatcttatctaacaacaaangtgtgatacaantgaacttaatgangaatgcccnttgatcangaatcaattangaatctatgtnaaagtcttgagatctccaacatgcaaaatggaatttctagcgttagacaaaanggaaatattgaagangaaaatcaagaagtttctggtcgatgtaagaattaataatccacatttggtcattgggccagagtntcctaatacagaaagtgggtgctggtggaattatttctgaagaaccggatgtncctgtaaaaaatttaaaaacctaacttccaagtggcaaantctttaacttgtaagaaatactgtttatntccagaagcactgaactgcactcagtaggggtaggttgctcacgtntctgtaaaatgtttgttgggtttcacgtggag

SEQ ID NO: 7282 - DNA, 474 bp, Mus musculus
  misc_feature (61)..(61): n is a, c, g, or t
  misc_feature (375)..(375): n is a, c, g, or t
  misc_feature (385)..(385): n is a, c, g, or t
  misc_feature (387)..(387): n is a, c, g, or t
  misc_feature (403)..(403): n is a, c, g, or t
  misc_feature (435)..(435): n is a, c, g, or t
  misc_feature (441)..(441): n is a, c, g, or t
  misc_feature (447)..(447): n is a, c, g, or t
tgagaggcaacacccatacttcatgatacccagagtccctctgcctgggttttattgcccnttacaaactgggtgtgcctctctgcaggaagatggtgctgttcagatagaaacacacttccccaaagattacacgtgctgtgacttggttgtaaaactaaaggaatgtgagaagaacgaagaccccactgtcacccctgagccctcaccagcaaccccctctccatcaaccccagagggagcacagagctctgacccatcagaagatagttacgagcctctgctggcaagttctatgactttgcaggaagcactggaagtccatagacctcagttcatttctcgctcacaagaacggctgcaaaagcttaagcncatggtacancnaaaggaaaacccaacnaaaggagagcctggggcagaagcagagcctanttcctntccgcnccaacaagaagcagttcaccattcccc

SEQ ID NO: 7283 - DNA, 486 bp, Mus musculus
  misc_feature (153)..(153): n is a, c, g, or t
  misc_feature (157)..(157): n is a, c, g, or t
  misc_feature (159)..(160): n is a, c, g, or t
  misc_feature (222)..(222): n is a, c, g, or t
  misc_feature (227)..(227): n is a, c, g, or t
  misc_feature (229)..(230): n is a, c, g, or t
  misc_feature (232)..(232): n is a, c, g, or t
  misc_feature (235)..(236): n is a, c, g, or t
  misc_feature (238)..(238): n is a, c, g, or t
  misc_feature (241)..(241): n is a, c, g, or t
  misc_feature (257)..(257): n is a, c, g, or t
  misc_feature (272)..(272): n is a, c, g, or t
  misc_feature (274)..(274): n is a, c, g, or t
  misc_feature (288)..(288): n is a, c, g, or t
  misc_feature (314)..(314): n is a, c, g, or t
  misc_feature (329)..(329): n is a, c, g, or t
  misc_feature (382)..(382): n is a, c, g, or t
  misc_feature (422)..(422): n is a, c, g, or t
  misc_feature (424)..(424): n is a, c, g, or t
  misc_feature (427)..(427): n is a, c, g, or t
agatggaatgctcggcttctgcgccagagggaagagaagaagcctggatttctttcggcaagcacaacaaccgagtgtgcttgatggagaccagaggccatgggatagtggggccggatcccggaacgctgaacccggagcaactggagcagntgcnanngatttcaagatccagactcggatcgcaaatgaaaagtacttgagaacccacaaagaggtgtntctgntnntnagnngnttnttcagagaaatgtttntgaaaagaccggacnanattcttgaatttgntgcacactatttcacggatccaaganttcccagcagaattnacatgcagctaattaaagagaagaaaggaacctaattagcaaagccacaatgntcagctgctgggagaagccagaaggaatcaagctttgggntnatntggagccctgagagcagcattgccaccagtgtggatttccaagctgtgtgggccttttc

SEQ ID NO: 7284 - DNA, 403 bp, Mus musculus
  misc_feature (303)..(303): n is a, c, g, or t
  misc_feature (311)..(311): n is a, c, g, or t
  misc_feature (313)..(313): n is a, c, g, or t
  misc_feature (361)..(361): n is a, c, g, or t
tcactggctacattgacaccagctctggaaagaaaataggaacttggtatgttccttgaatgaagaagcaccatggccagattcttacagaccctgctgttcctggtgatcatggtggagtttgtatctagaagagtcgaagcctggggctccccacagattgtgaggccattcgaagacatccccaaatcctatgtctatgtgcagcatgcactctggtatgccatgaaagaatataacaaggccagcaatgacctctacaacttcagggtggtggatatcctaaaatctcaggagcagatnacagacantntggagtattatcttgaagtaaacattgcccgaacaatgtgcaagaagnttgcaggagataatgaaaactgcttgtttcaacaggatccta

SEQ ID NO: 7285 - DNA, 532 bp, Mus musculus
  misc_feature (170)..(171): n is a, c, g, or t
  misc_feature (187)..(187): n is a, c, g, or t
  misc_feature (336)..(336): n is a, c, g, or t
  misc_feature (339)..(339): n is a, c, g, or t
  misc_feature (345)..(345): n is a, c, g, or t
  misc_feature (350)..(352): n is a, c, g, or t
  misc_feature (387)..(387): n is a, c, g, or t
  misc_feature (396)..(396): n is a, c, g, or t
  misc_feature (415)..(415): n is a, c, g, or t
  misc_feature (432)..(432): n is a, c, g, or t
  misc_feature (474)..(474): n is a, c, g, or t
gatgtctgtgcaatctgctatcatgagttcacaacatctgctcgtataacaccgtgtaaccattatttccatgcactctgccttcggaaatggctgtacattcaagatacttgtccaatgtgccatcagaaagtgtacatcgaagatgagatcaaggataactcaaatgnnatctaacaacaacggnatttattgcacccaatgaaaatccaaacccagaggaggctttaagagaggatgctgctggatctgaccgagaactgaacgaggatgacagtacagactgtgatgatgatgctcaaagagaaagaaacggggggattcagcacacaggcncancagcancagcnnncgcagaatttaatgatgacactgattaaagtagcnatttactantcattgaggtatttgtttnaaaattcagttcatccnaaatggagtaatatgcttcacgtcagtgtgtaaccaagcacnaaaacagtatggatgttgaaactgtgaatgctttccgtttactgtgatgtgctactgt

SEQ ID NO: 7286 - DNA, 458 bp, Mus musculus
  misc_feature (384)..(384): n is a, c, g, or t
  misc_feature (408)..(408): n is a, c, g, or t
  misc_feature (410)..(410): n is a, c, g, or t
  misc_feature (429)..(429): n is a, c, g, or t
agcatcactggtggttacctggcatccatgattgctaccttttcagctaggtgctcagaaaacatggccagacctagctcacccaagacacaagtgggaatgtaaatgctttagattgccagcatgttttagaatgaatcagtattcaaagtaatgagaagtactgtccttgtatttaaaaaaaaatcacaaattcactgtagacattttagaacaattttaggtctagcgagactgaacaaagcagagaccacacacaccctcataccgcaccccccagtaaagcacagcctcccacacactaaatcacagcacagcggttacacgtgttagaatctgtaaacccactctgacacatcgctgcctccgaagcccatgttgtanaggtggtcaccgcgacggcgcatntnttagacagtaacttcactncctcccggtcctacgtgctgtgtgtattc

SEQ ID NO: 7287 - DNA, 431 bp, Mus musculus
  misc_feature (262)..(262): n is a, c, g, or t
  misc_feature (309)..(309): n is a, c, g, or t
  misc_feature (326)..(326): n is a, c, g, or t
  misc_feature (360)..(360): n is a, c, g, or t
gaggtactccaacatattgcaggcttccttgacggcttcagtttatgccagcttgcatgtgtatcccggctaatgagggacgtttgtggcagtttacttcagtctcgtggaatggtaatcttgcagtgggggaagaagaagtatccggaaggaaattcatcatggcagataaaagagaaggtatggcgattcagtactgcattttgttctgttaatgactggaaatttgctgacatcctgagcatggctgaccacttgaagnactgcagttacaacgtgatagagaaacgggaggaagccatcccattnccgtgtatgtgtgtgantcgagagcttacaaaagaaggacgttccctgcgntcagttttaaagcctgtgctttaaggctgtaacttcttcacttgcacacacatgcaagcacctggtatcag

SEQ ID NO: 7288 - DNA, 497 bp, Mus musculus
  misc_feature (289)..(289): n is a, c, g, or t
  misc_feature (292)..(292): n is a, c, g, or t
  misc_feature (294)..(294): n is a, c, g, or t
  misc_feature (299)..(300): n is a, c, g, or t
  misc_feature (312)..(312): n is a, c, g, or t
  misc_feature (316)..(316): n is a, c, g, or t
  misc_feature (331)..(331): n is a, c, g, or t
  misc_feature (333)..(333): n is a, c, g, or t
  misc_feature (338)..(338): n is a, c, g, or t
  misc_feature (345)..(345): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (371)..(371): n is a, c, g, or t
  misc_feature (375)..(375): n is a, c, g, or t
  misc_feature (380)..(380): n is a, c, g, or t
  misc_feature (384)..(384): n is a, c, g, or t
  misc_feature (386)..(386): n is a, c, g, or t
  misc_feature (459)..(459): n is a, c, g, or t
  misc_feature (467)..(467): n is a, c, g, or t
aatgtgaaacctctcaagtctgcctcaggctattcagatgacatcttagccattgaccacctgttcaagaaaaagcaacattggactgtgactgatgcggctgctatcaaacagcatgtaaagaaagccacggagagttataacttaggaattgcccttgaccaccggaaagaaatgctgaacctctggaagaagattcgaggggatttggttgggatcgaaagcaacaatgagtccttttacaacaccttttcgacctacacctggtcctggaacgtctgccaagagntgntntccgnnaaggacctccgnttgnacgacgccagcatgnanaaganttccccntccaantntngnttntnttccccatngganttcantgantntgacccggagacggggaggaagaggaaacggaaaagttccagagggtttcggcaatgaaaagcctacgttttntaaacagnttttcgaaaaccgctttccatagtaatcaa

SEQ ID NO: 7289 - DNA, 375 bp, Mus musculus
  misc_feature (129)..(130): n is a, c, g, or t
  misc_feature (135)..(135): n is a, c, g, or t
  misc_feature (144)..(144): n is a, c, g, or t
  misc_feature (162)..(162): n is a, c, g, or t
  misc_feature (173)..(173): n is a, c, g, or t
  misc_feature (177)..(177): n is a, c, g, or t
  misc_feature (187)..(187): n is a, c, g, or t
  misc_feature (190)..(190): n is a, c, g, or t
  misc_feature (197)..(197): n is a, c, g, or t
  misc_feature (201)..(201): n is a, c, g, or t
  misc_feature (205)..(205): n is a, c, g, or t
  misc_feature (236)..(237): n is a, c, g, or t
  misc_feature (239)..(239): n is a, c, g, or t
  misc_feature (255)..(255): n is a, c, g, or t
  misc_feature (264)..(264): n is a, c, g, or t
  misc_feature (299)..(299): n is a, c, g, or t
gcgccccgatctgggcagttgaagagttggggagatttactgcaggctggctccatccgacaccctcccaggtggtcactgcaacctgtcacttccttctccctgcggccactttggattccccggagnntccgntcacctctntgcttggtacctggatcntccagcaaggntccncccaccaagncanttcatantcantttntccttgttaggcaacgggaacgagaaacatnntntccactgttcctgccntcaggggtntcaacctaaccttagaacagaagagagtgaaaagnccgggagcatcaggccaggtttggaatgtatgccaaggttaccctcagtaagggagctgacgttacagtgtaatga

SEQ ID NO: 7290 - DNA, 552 bp, Mus musculus
  misc_feature (49)..(49): n is a, c, g, or t
  misc_feature (63)..(63): n is a, c, g, or t
  misc_feature (73)..(73): n is a, c, g, or t
  misc_feature (96)..(96): n is a, c, g, or t
  misc_feature (383)..(383): n is a, c, g, or t
  misc_feature (421)..(421): n is a, c, g, or t
  misc_feature (443)..(443): n is a, c, g, or t
  misc_feature (450)..(450): n is a, c, g, or t
  misc_feature (452)..(452): n is a, c, g, or t
  misc_feature (455)..(455): n is a, c, g, or t
  misc_feature (469)..(469): n is a, c, g, or t
  misc_feature (471)..(472): n is a, c, g, or t
  misc_feature (504)..(504): n is a, c, g, or t
  misc_feature (508)..(508): n is a, c, g, or t
tgggcagacggaacccacgacagtaccagatcgcatctcggaatgtccnttccgcccgccttngtctcctggncaccagtggatttgtcagctccnaccagcgccacaccgctgccaaccccaccatcatgaaacaaggaagacagaacctctggtttgccaaccctgggggcagcaacagcatgcccagccgcacccacagctccgtccagaagacccgctcgctgcccgtgcatacttccccacaaaacatgctgatgttccagcaaccagaatttcagcttcctgtgactgaacctgacatcaacaataggctggagtccttgtgcctcagtatgacggagcatgccctgggagacggggttgaccggacctccacaatntagaaactgaagatgacagtgaccgcgctggccgtganatggactgctgcgggcccagtntcagccntnttnagggttgcagagantnnttccaagacactttgcagcctttttcccctgntccntcgcccattttgattttgtgagagcgtaggtcatccttgtaaac

SEQ ID NO: 7291 - DNA, 478 bp, Mus musculus
  misc_feature (50)..(50): n is a, c, g, or t
  misc_feature (233)..(233): n is a, c, g, or t
  misc_feature (326)..(327): n is a, c, g, or t
  misc_feature (345)..(345): n is a, c, g, or t
  misc_feature (351)..(351): n is a, c, g, or t
  misc_feature (353)..(353): n is a, c, g, or t
  misc_feature (371)..(371): n is a, c, g, or t
  misc_feature (373)..(373): n is a, c, g, or t
  misc_feature (387)..(387): n is a, c, g, or t
  misc_feature (393)..(393): n is a, c, g, or t
  misc_feature (412)..(412): n is a, c, g, or t
  misc_feature (420)..(420): n is a, c, g, or t
  misc_feature (445)..(445): n is a, c, g, or t
gacttgactagtctctatgacgtacaatcatttccaaagatcacagacantaaaaagacagatgatttgtactggagacagctggagatgaagcccctccccatatcctgctctaagtcaaaccattacattgactatgaaccacttaagtctgcctaccgtgacccatatgctatgtgtccaaaccctgttcgcctcagtaagtctaatattcttcaaaacaaaacagatanggctgatttcacttttgacaactttttaagtaaaccagaatttttgggcatgaacatggaaagcaatgaagaaacaagacctcttttagattnnatccctagagctggagtncccaancntcattccaacctgcgaantnttaggaacacattntcaaantccatggcacagaagcgtntgcataantccattcaagaagaacaaaaagacntccgagataaactgcagtgtgggatgagacatc

SEQ ID NO: 7292 - DNA, 257 bp, Mus musculus
  misc_feature (58)..(58): n is a, c, g, or t
  misc_feature (227)..(227): n is a, c, g, or t
  misc_feature (229)..(232): n is a, c, g, or t
tactacccaagcaactcaaccaatggctagagtggtctcaagatgcctcccaccgagntccccaatgccagtttcccctatacccctgtccttccctgaaaatccaagggaagaaggtaaagtgccaaggaccaaaaagaaatgtcaccgaaaaagcatactactgaatagagctttctatattcagaagcgaaactgcttatcaccttcacttatagccaggggcnannnntcacccactgaccaaaaatagcttt

SEQ ID NO: 7293 - DNA, 534 bp, Mus musculus
  misc_feature (154)..(155): n is a, c, g, or t
  misc_feature (160)..(160): n is a, c, g, or t
  misc_feature (202)..(202): n is a, c, g, or t
  misc_feature (206)..(206): n is a, c, g, or t
  misc_feature (208)..(208): n is a, c, g, or t
  misc_feature (223)..(223): n is a, c, g, or t
  misc_feature (227)..(227): n is a, c, g, or t
  misc_feature (238)..(238): n is a, c, g, or t
  misc_feature (300)..(300): n is a, c, g, or t
  misc_feature (305)..(305): n is a, c, g, or t
  misc_feature (308)..(308): n is a, c, g, or t
  misc_feature (315)..(315): n is a, c, g, or t
  misc_feature (334)..(334): n is a, c, g, or t
  misc_feature (389)..(389): n is a, c, g, or t
  misc_feature (392)..(392): n is a, c, g, or t
  misc_feature (465)..(465): n is a, c, g, or t
  misc_feature (473)..(473): n is a, c, g, or t
gtcagactttcagaacttttcggtatttgaggacattagccaacacatcaaagaagtgggagcccaactggtaaagaaagtgaatgccatctttcagcttgacatcaccaaagatgggaagaccattctgcagtggaccattgacctcaagaanntggtngccggggacatgtacctgggatcggcccggcttcctgcaganaccntnttcatcatccctgantctntcttcacaganttagttgtgggtaagataaacccacagaaggctttcctggctggcaagtttaaagtgagagncaaanttntccttantcagaagctggagaggatnttcagagagtgggctaaaatttaagcatgtgggaatacccaggaaagatcaaganttntggcttataataatgttgagtagcaatcatgctttaactgaagattaaaggaaacgatagccaatatttttantcaaattnttcctattcaagttcgattgatttcctgctgatgtgtacctttgctgggatccggaatagt

SEQ ID NO: 7294 - DNA, 430 bp, Mus musculus
  misc_feature (53)..(54): n is a, c, g, or t
  misc_feature (183)..(184): n is a, c, g, or t
  misc_feature (191)..(191): n is a, c, g, or t
  misc_feature (200)..(200): n is a, c, g, or t
  misc_feature (204)..(204): n is a, c, g, or t
  misc_feature (221)..(221): n is a, c, g, or t
  misc_feature (225)..(225): n is a, c, g, or t
  misc_feature (228)..(228): n is a, c, g, or t
  misc_feature (239)..(239): n is a, c, g, or t
  misc_feature (242)..(242): n is a, c, g, or t
  misc_feature (244)..(245): n is a, c, g, or t
  misc_feature (249)..(249): n is a, c, g, or t
  misc_feature (266)..(266): n is a, c, g, or t
  misc_feature (270)..(271): n is a, c, g, or t
  misc_feature (276)..(277): n is a, c, g, or t
  misc_feature (284)..(284): n is a, c, g, or t
  misc_feature (287)..(287): n is a, c, g, or t
  misc_feature (292)..(292): n is a, c, g, or t
  misc_feature (311)..(311): n is a, c, g, or t
  misc_feature (327)..(327): n is a, c, g, or t
  misc_feature (332)..(332): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (363)..(363): n is a, c, g, or t
ttgggacaacatccacaagcacttggaccaatatgcttcgtttgcggtctccnnaaaaggaggcaagattggaattgaagcattctcacgttatttaaaactcccaatttcagagcccttgagacagcttttctctctctttgacaggaatcaggatggcaccatagacttccgagagtatgnnataggtntaactgtcntgtncaacccatccaatacgnagangantctgcaaatgncantnnaacnttttgatcttgatgagnatgnntatgnnacagaancgngagtngacaactatgcttcaggcnagctttcggagtgccnagacntagatgtttccanantnttccagcagatggntggcaaggattcagatcaggtttcatacagaacttttcggaggtttgccctgaagcatccagcatat

SEQ ID NO: 7295 - DNA, 527 bp, Mus musculus
  misc_feature (59)..(59): n is a, c, g, or t
  misc_feature (234)..(234): n is a, c, g, or t
  misc_feature (341)..(341): n is a, c, g, or t
  misc_feature (344)..(344): n is a, c, g, or t
  misc_feature (353)..(353): n is a, c, g, or t
  misc_feature (366)..(366): n is a, c, g, or t
  misc_feature (385)..(385): n is a, c, g, or t
  misc_feature (387)..(387): n is a, c, g, or t
  misc_feature (496)..(497): n is a, c, g, or t
gaacttcctccaccagcttaaaaggttaaactagaagacaaaagagctagtttaaaagngagaacagttaaggtcataacactgaattaatgaaaaaaaaaacaattaatatattctgaaaacagtactgacatgtgcgaccactttaccagtgaataagtcaagcaatgcagggacatggtctgtgtggaaaatcagaatgtgactcttctgtaacagaaaatgcacactgtncaaatgttttacagtttgttcacaaaaagtgttgaaatgttaaacactgtcccttttctgtaagctttttctcagaacttgttttttaagcatttttgagactgttnggntagttactntcagaaacatttntcagtgattacacagtaantntacagatgggcttataaccaaacggagaagcctgtttcataaatcaatgtatcgaaaacccatttcatggcctaaataatgtgtacatatgagtacctaaacttgtttnnttggaagaacttcagcaatgttgtaggagc

SEQ ID NO: 7296 - DNA, 548 bp, Mus musculus
  misc_feature (282)..(282): n is a, c, g, or t
  misc_feature (299)..(299): n is a, c, g, or t
  misc_feature (305)..(305): n is a, c, g, or t
  misc_feature (309)..(309): n is a, c, g, or t
  misc_feature (311)..(311): n is a, c, g, or t
  misc_feature (319)..(319): n is a, c, g, or t
  misc_feature (321)..(322): n is a, c, g, or t
  misc_feature (328)..(328): n is a, c, g, or t
  misc_feature (352)..(352): n is a, c, g, or t
  misc_feature (354)..(354): n is a, c, g, or t
  misc_feature (368)..(368): n is a, c, g, or t
  misc_feature (373)..(373): n is a, c, g, or t
  misc_feature (385)..(385): n is a, c, g, or t
  misc_feature (392)..(392): n is a, c, g, or t
  misc_feature (494)..(494): n is a, c, g, or t
  misc_feature (496)..(496): n is a, c, g, or t
  misc_feature (505)..(505): n is a, c, g, or t
  misc_feature (510)..(510): n is a, c, g, or t
  misc_feature (512)..(512): n is a, c, g, or t
gagcttaaggtaccacgtgtgccacttccaggacaccgggatggagtcagttcgaggaatgccgttggaatatcctcctaagcaggagcgcctcaacgcctacgagcgcgaggtagtggtgaacatgctgaactcgctgtctcggaaccggactctgccgcagattgtaccccgctgtgggtgcgtggaccctctcccgggccgattgccataccaaggatatgaaagcccttgctccggccgccactactgtctgcgcgggatggactactgcaccacccnggagcctagcacagaangccgcntgcngnctttgtgntnncagcanccgactgagtgtgtcgcccttcgntnaccggccaggaatncaatntgctgttacaantcccccnccatcattttacccgtatcccaaccttagatgggacacaagtcacttcaagaagactggtggttcccagagaaacaactatgtagtccatcctgagtttgtntntgagacctntcctntntacccttcctagtaaagctttgaccaggccaaggga

SEQ ID NO: 7297 - DNA, 497 bp, Mus musculus
  misc_feature (343)..(343): n is a, c, g, or t
  misc_feature (355)..(357): n is a, c, g, or t
  misc_feature (359)..(359): n is a, c, g, or t
  misc_feature (361)..(361): n is a, c, g, or t
  misc_feature (376)..(376): n is a, c, g, or t
  misc_feature (378)..(378): n is a, c, g, or t
  misc_feature (392)..(392): n is a, c, g, or t
  misc_feature (406)..(406): n is a, c, g, or t
  misc_feature (412)..(412): n is a, c, g, or t
  misc_feature (418)..(418): n is a, c, g, or t
  misc_feature (420)..(420): n is a, c, g, or t
  misc_feature (425)..(425): n is a, c, g, or t
  misc_feature (427)..(427): n is a, c, g, or t
  misc_feature (441)..(441): n is a, c, g, or t
  misc_feature (445)..(445): n is a, c, g, or t
  misc_feature (460)..(460): n is a, c, g, or t
gtcatagttacaccccagtcttggatcttggagttttctaatttatgaagcaagccccaaatacctcctcaagccagaagcctgatgggagaattcattaatgcccttacctgacccttgagaatgaaaaagggtcagggaaagttggacttgctgagtgtctagcacaatccttgacgtcttgcacgtcctttagtgagccttcacattagcccgaggaacccacagaagacgcctatgactcaagaattatcggccaacatgtggacttcctgctgatgtctgcacttgcattagaggaggctctggaataccatttgtggtaatggaccacttctgtatnttgattgtggtnnngntnatatgggatcaaatntnacaggagcaaatgncacaggctgcgtgntgagcngaagcntntggantnttaaagaaggcttntganttagtgaaattggantacagccaacttgctggctcagagttttgtggtcaca

SEQ ID NO: 7298 - DNA, 272 bp, Mus musculus
atgcacacagctcatagtgacccttctcacagtgtcctcccatgttgtcttcccccatagcctaatgaggaatggctacagcttcacccacagagcacataaatctttcttgtacctttggaagtgcaaatgagaggttcattaattaggtagacctgtgccgataggtgtgctgtgcaggtcacctcgggattagacaggttagagattgcatcacagacagaaacctccaaacattgggggcaaaattactcttctgtagtcacaaactg

SEQ ID NO: 7299 - DNA, 466 bp, Mus musculus
  misc_feature (27)..(27): n is a, c, g, or t
  misc_feature (420)..(420): n is a, c, g, or t
taaactgcaggccactgcacaggtggnttttctttccacatttgccggatttgccagctgctggagtacctgataagtccagatggactgatggacatctgttgatctatgtgtaacttctaaaattggtatcgtatccacagagtgtataatttaaactaaccacagagctttacatcttcatttcgactgttctgtagcagagtaaagcacttgaaataagactccctttcacatgtgggttataagtttcagtcctggtatctgcttgatttttatcagttttgtgtagactttatgtttcatattttaaactcaaatccagcattgtaaagtttgtacaatttgtcctgaagctttgtgtttggctgcacctgcataagctgctacaaatagaataaagaattcatagcctgtatntatcatttagatgcatggaaaaatgggctttgcacacaatgggttt

SEQ ID NO: 7300 - DNA, 509 bp, Mus musculus
  misc_feature (228)..(229): n is a, c, g, or t
  misc_feature (232)..(232): n is a, c, g, or t
  misc_feature (259)..(259): n is a, c, g, or t
  misc_feature (261)..(261): n is a, c, g, or t
  misc_feature (276)..(276): n is a, c, g, or t
  misc_feature (278)..(280): n is a, c, g, or t
  misc_feature (282)..(282): n is a, c, g, or t
  misc_feature (324)..(324): n is a, c, g, or t
  misc_feature (343)..(343): n is a, c, g, or t
  misc_feature (354)..(354): n is a, c, g, or t
  misc_feature (356)..(356): n is a, c, g, or t
  misc_feature (392)..(392): n is a, c, g, or t
  misc_feature (458)..(458): n is a, c, g, or t
gccggcttttgtgacagcttctgtagtggagacagcaccaaggctgctgtcatccgcctgggcctcatggagatgattgcttttgccaggattttctccaagggtcaggtgtccatagccactttcctggagagctgtggggtggccgacctcgttactacctgctatggggggcggaaccgaaaggtagcggaagccttcgccaggacaggaaaaagtattgagganntgnagaaggagatgctgaagggacagaagntncaagggccacacacntnnncncaggtgtaccgcatcctcaagcagaaggggctgctagacgantttcccttgttcacagttntgtatcaaatntntcacgagggcagaccagttgcagagctgataccgtntttacagaaccacccagagtacaggtgaaggcagctggggccggccagagctttacctcatccatntcagagacacatggaaaccaggacgtgacagtgagacggttgcctggctaa

SEQ ID NO: 7301 - DNA, 452 bp, Mus musculus
  misc_feature (54)..(55): n is a, c, g, or t
  misc_feature (384)..(384): n is a, c, g, or t
  misc_feature (386)..(386): n is a, c, g, or t
  misc_feature (401)..(401): n is a, c, g, or t
  misc_feature (414)..(414): n is a, c, g, or t
  misc_feature (424)..(424): n is a, c, g, or t
ggttcgtcatcctcgatacagatgagtatgttttaaaatacatggagagcaacnncttcccagtattcaccagaagccctggcctcaattcagaaccggatccagaagccggagcttcccgcaccagaactggaaagcaagcaagctacaggagaacccatggtgcagggtacagaggaatccaaggtgcaggacttggatgcactgatagaccaaatccatatgcacctgaaatacaattcatgcaaagaaaacctccgtgaaacatttcaaatgtatgacaaggatgaatcgggatatgtggacagagagacgttctttaaaatctgtgaaactcttaatgtcccggtcgatgactcgttgattaaggagttgatcaggctntncacccacggagaagncaggattaactantataactttnttcgagctttctcgaactgacctgaacg

SEQ ID NO: 7302 - DNA, 373 bp, Mus musculus
  misc_feature (259)..(259): n is a, c, g, or t
  misc_feature (277)..(277): n is a, c, g, or t
  misc_feature (279)..(279): n is a, c, g, or t
  misc_feature (295)..(295): n is a, c, g, or t
  misc_feature (297)..(297): n is a, c, g, or t
  misc_feature (301)..(301): n is a, c, g, or t
  misc_feature (309)..(309): n is a, c, g, or t
  misc_feature (311)..(311): n is a, c, g, or t
  misc_feature (318)..(318): n is a, c, g, or t
  misc_feature (326)..(326): n is a, c, g, or t
  misc_feature (330)..(330): n is a, c, g, or t
gtgaatgggcatcctttaaaggcttttgttgactctggtgcccagatgactatcatgagccaagcttgtgctgagagatgtaatattatgagactggtagaccgacggtggggtggggttgctaagggagtaggcacacagaggattatgggccgcgttcatctggctcagattcaaattgaaggtgatttcttacagtgctctttctctatacttgaagagcagcccatggatatccttctagggcttgatatgctcnggaggcaccagtgttccntngacctaaagaaaaatntnctgntgattggnantaccggntcacagantcanttccttcctgaaggagagttgcccttgtgtgctaaactgttga

SEQ ID NO: 7303 - DNA, 171 bp, Mus musculus
  misc_feature (48)..(48): n is a, c, g, or t
  misc_feature (65)..(65): n is a, c, g, or t
  misc_feature (119)..(119): n is a, c, g, or t
cctccaaagatccattactaatgccaagaagaggggttagggaatgantcctgccctatgaatanttatggaggtcagccgaagctgcgccagcgcacgtgcatagatacctgctgctntctttgcccaatccagatgaagatttccgacttgttccctccaggataaata

SEQ ID NO: 7304 - DNA, 519 bp, Mus musculus
  misc_feature (93)..(93): n is a, c, g, or t
  misc_feature (247)..(247): n is a, c, g, or t
  misc_feature (283)..(283): n is a, c, g, or t
  misc_feature (286)..(286): n is a, c, g, or t
  misc_feature (300)..(300): n is a, c, g, or t
  misc_feature (306)..(306): n is a, c, g, or t
  misc_feature (322)..(322): n is a, c, g, or t
  misc_feature (336)..(336): n is a, c, g, or t
  misc_feature (342)..(342): n is a, c, g, or t
  misc_feature (350)..(350): n is a, c, g, or t
  misc_feature (420)..(420): n is a, c, g, or t
  misc_feature (466)..(466): n is a, c, g, or t
ggaactatatccttcgtggtctgtggaagttgttgcagagtggtactgggtaaaaatcacaaattcaggagagtttgtgttcccgttggattnctccacacaaaaagccttatgaatgtcttgtactggggagagttaaagaaaaaactcccttagcattaaggaatccagatgtaagaatacccccagttccagatcagaagttgattgtcagtgtgccctgtgttcttcactcacacaaaccgcntcttaccgaagttctgagagactacatcaagccagntgnccagtgcttggaanttgttntgctaggaatttacanccaggttggatganttgggncaacgaantcctcaagtttcagcacatggattatttcattgctctggagtccggatgctgactgtaaaagttgtgctntctttacctcagctccttccttcaaacttatttccccttgtaccantcagtgtgcttagacatatgaacttttacaccattcagtgtacccagaagtat

SEQ ID NO: 7305 - DNA, 569 bp, Mus musculus
  misc_feature (309)..(309): n is a, c, g, or t
  misc_feature (313)..(313): n is a, c, g, or t
  misc_feature (315)..(317): n is a, c, g, or t
  misc_feature (332)..(332): n is a, c, g, or t
  misc_feature (396)..(396): n is a, c, g, or t
  misc_feature (418)..(418): n is a, c, g, or t
  misc_feature (428)..(428): n is a, c, g, or t
  misc_feature (431)..(431): n is a, c, g, or t
  misc_feature (439)..(439): n is a, c, g, or t
  misc_feature (441)..(442): n is a, c, g, or t
  misc_feature (444)..(444): n is a, c, g, or t
  misc_feature (455)..(455): n is a, c, g, or t
  misc_feature (484)..(484): n is a, c, g, or t
  misc_feature (538)..(538): n is a, c, g, or t
tgatctgcacagaccaaccatcgtgcccctccagtcctaccttcctagaccagctcatcaaaggcattagctacctggacagatccaccaatgttttcaacaacagcagctaccccaaagccctgagcttacctcagctggcggctacctatctggaaagagctgctaactccctctacctggaccaaacggaacgccccccaccccgaagctattccactcccagcactagcacagccgctgccaatcagcccccagccaacaactgcttggtcccttccactcgggacaccaagagcctgcagtgcntggntnnntccactggtttgaantatcaacaacggcctaacagccagactttcaatgtcgagacacctcagaggcccggggtaaaantgccagagattcccctgttcgncaacgggttnttntccttagntnntntgcccaagttntgggaagcaatccgttccggatggaatgntcctgtgcccacccctaagcccgagggctggtggtgacatggatgccacctttntccagtgggcacatggccaccgtgtggaaaa

SEQ ID NO: 7306 - DNA, 388 bp, Mus musculus
  misc_feature (280)..(280): n is a, c, g, or t
  misc_feature (340)..(340): n is a, c, g, or t
tcttctgacttatatgacgcagcgagacagagttataagaaagaaagtgaagagcaccatcgactaatcaaagggtcacctttcaagctgcatcttcacccgaaggactattttgatactaacccttactttttagagcaccatttacctccccttaggagagaagaaaagaaggaagtgtctttcaagccctttaagccctcctctcctggtaaaaaggctggtggaatgaaagcaggggcatttgacccttacccagcacactcagcggacccttacntggtcaaagtggaaaaggcgattccttcgaaaggtgaaagggttttccacccacccaatngaccaaaaagcagacccgttgaaagtataatggcgctgaatgtcaaaa

SEQ ID NO: 7307 - DNA, 290 bp, Mus musculus
acagaccatcctcaaggagtactgaaaataaagatgtcttaacaaaccagcagtccggcctgtggtcatcttccttcctaaaagaaagcgcaggtgaaacaagcaaggatttggtccttgcaaagcaagagggaaatagtgactattgccttaaggacattgaagagaacttgtcagactcgacagatggtgatggtgaagaggacagcagcaacgacgatgacgaaggccccactaagaaggcgactcaagccccactggagctaatggcagaattcctgagagcagaa

SEQ ID NO: 7308 - DNA, 537 bp, Mus musculus
  misc_feature (130)..(130): n is a, c, g, or t
  misc_feature (226)..(226): n is a, c, g, or t
  misc_feature (242)..(242): n is a, c, g, or t
  misc_feature (384)..(384): n is a, c, g, or t
  misc_feature (480)..(480): n is a, c, g, or t
  misc_feature (491)..(491): n is a, c, g, or t
  misc_feature (493)..(493): n is a, c, g, or t
aagagcctatgctgaaactaccaagatgaaagttttggaattcttggcaaagatgaatgggtgtgacccatctgatttctcaatctggtatgaagaggctttaagagatgaggaagagagggcctgggcnttaaatgattctgcaaatacaagcccaaatgcgtggtttgtcgagcgctgatcactggtttctcttatccagtgtgagggatcccttttggcatgnattcactctaactttnaatagagcagtcaaaattttaagtaatgaaaatcaaacttaggctcagtagaacagtatcattatgctaattagggttttcttaactgtttcatttggggttactgttaaatgttactcattttaagggaaagtgtattatntctaaaatttgtcattgaaactgataacacaattattactgtttgtttaaaaatatagtggaaaaattatgtaaggttaccttttgatttctttantccttttattntnttctggaaaatttaaatgtggtatgcatttattttccagactaa

SEQ ID NO: 7309 - DNA, 264 bp, Mus musculus
acttcaacagaacggtcccagctatgcactttgtggaccacagttttcaagtaacacggatagacaattgtcgaccaggctttgggaaaaacgaaggtctgcacagcaattgtgctacctgttgcgtggtctgtagtcctggaacgttcagtcccgatgtggatgtcacctgtcagatctgtgtttctgtccatatctatggagctaaagcttgcccataaactccaagagcagaggtggaagcatggctgtttgcccttgaag

SEQ ID NO: 7310 - DNA, 452 bp, Mus musculus
  misc_feature (180)..(180): n is a, c, g, or t
  misc_feature (183)..(183): n is a, c, g, or t
  misc_feature (188)..(188): n is a, c, g, or t
  misc_feature (192)..(192): n is a, c, g, or t
  misc_feature (210)..(210): n is a, c, g, or t
  misc_feature (233)..(233): n is a, c, g, or t
  misc_feature (239)..(240): n is a, c, g, or t
  misc_feature (252)..(252): n is a, c, g, or t
  misc_feature (268)..(268): n is a, c, g, or t
  misc_feature (270)..(270): n is a, c, g, or t
  misc_feature (306)..(306): n is a, c, g, or t
  misc_feature (313)..(313): n is a, c, g, or t
  misc_feature (315)..(315): n is a, c, g, or t
  misc_feature (351)..(351): n is a, c, g, or t
  misc_feature (380)..(380): n is a, c, g, or t
  misc_feature (421)..(421): n is a, c, g, or t
  misc_feature (423)..(423): n is a, c, g, or t
gaagacgcacaatctgacacaggatgttgagccatcaacctcgacatccaaacccaagacagtgaaggcttgccatcgtaaatcctgttccaaatgtagcaagaagataagaaggcccacggtgcaaaagcctaagaagaagagcaagaaaacactgccaaacatgcctaaaagaaaganttntaagnaaantacaccaccaaaaaggantaataaaggcaaggggaaagaantatttnntcactaccaccntttgttgaaagagctntnaacaggtagtgggaaggagcccgaacatagcagcantgagagntncaggagttcaacaatggattaagaatgccagtagantcagcatgctaaccaaagacctggggatntgtgaaaaggattggcagctgagcaatgctaaactgtgtantntgaaaatgtaagtgctacacagtgctttg

SEQ ID NO: 7311 - DNA, 273 bp, Mus musculus
accagtcgctatgcagtgatgtccacccagctgaagcatgacaatctctcactaatcttctattacgtttttctccagatgtgtaaggcccatggcattggctatgaccttgaggacagacaaggaactgtttttatattatatgaatctctgaagagatacaagttgggcatgttaacaatcggtgtggatctccagggggtcctcatgacctttgctcgcaatctcttcatcatccatcaagaaatatcagcacctgatatgcaaggcgag

SEQ ID NO: 7312 - DNA, 271 bp, Mus musculus
  misc_feature (215)..(215): n is a, c, g, or t
gagacaacttcttgaaatcgctgagagcaactttaaacacttgggtgggataaccgaagaggatttaaagcagaagaaagaacagctggagtctaagaagaccatcaacgagctgcagggccagctggcctatgagcgactccgcagggaaaagttagagtgccagctggatgagtatcgagtggaagtggatcaactcaaggaaacgctgcagnaaatccaggtcaccagtgtcgcggctatggaagatgactcgtgtgagtctagcaaa

SEQ ID NO: 7313 - DNA, 404 bp, Mus musculus
  misc_feature (56)..(56): n is a, c, g, or t
  misc_feature (118)..(118): n is a, c, g, or t
  misc_feature (120)..(120): n is a, c, g, or t
  misc_feature (175)..(175): n is a, c, g, or t
  misc_feature (184)..(184): n is a, c, g, or t
  misc_feature (201)..(201): n is a, c, g, or t
  misc_feature (223)..(223): n is a, c, g, or t
  misc_feature (306)..(306): n is a, c, g, or t
  misc_feature (328)..(328): n is a, c, g, or t
  misc_feature (340)..(340): n is a, c, g, or t
  misc_feature (354)..(354): n is a, c, g, or t
ttggaaaccattctgccgggtttgcctcagccagttgctaccatatgccataaatngacatattcacaggttacaagctcagtttccgacagacctggtcagatgactcttcatctcnancctttcctggtgtgcggaggggatggatttactcactccaacttcaatggctgcntctcctctnccctgagtgtcatgaangttttaaagcgttatatttagngtctgtgttcttgttctctacatttactttaggatttttgttttcacaatcctctgttattaattgttctattttcctttctntgaagagaaattactttggaanaatgtcttcacntactgttatttttnatatgaaatataaaaacaatgttataattttgatagctaccacccatagt

SEQ ID NO: 7314 - DNA, 598 bp, Mus musculus
  misc_feature (372)..(372): n is a, c, g, or t
  misc_feature (377)..(377): n is a, c, g, or t
  misc_feature (403)..(403): n is a, c, g, or t
  misc_feature (407)..(407): n is a, c, g, or t
  misc_feature (442)..(442): n is a, c, g, or t
  misc_feature (499)..(500): n is a, c, g, or t
gggttattcctgcactttgcagtttgctccagagaataagttgagtaccagagaacccgagactagcgtttctttaaataatgcagtcatagtactggcaaaatctccagagagccacggactttggcgagagtggtattgtggcttgaacaaggagtctttggaggaaagattgtttatcaatgaagaaaatgttaatgggtttcttgaagaggtcctttgctccccattgaagcaggcaaggtctctggccccaccgctgattgaggttcttcaggccactgatgagcaggttcagatccatgcagagttgcaggaatgtagtgatcctgctgggcttcaaggaaagggaaaaggagtcagagaaggctntcctntgagtgaagcagaagccgctgaccantccnccacctctccagctgcttctgattcagctgcagcnagtcgaagcactaaaaataaacacgcatggttcagctgtggacctgcaacacggctnntcctgaggttcctcacgtactgtctggaaaaccgctgcaaccagaggcaaaaatggatcctgagtttataagagaaagtagtactacctactcgactg

SEQ ID NO: 7315 - DNA, 501 bp, Mus musculus
  misc_feature (56)..(56): n is a, c, g, or t
agtggtgctagttcctggagagcctttgctgctgcttttctactatgtactctctnggctccagagagccctgcacctcccatgctctggaggtgaggaggacagaccatgtgcttcagacaaccactcagagccagaaaggcacgagcttcatctgatggctgtcggaagaattctggttccagtcccaactcttcacactcctgttcaagactgattttgtactcttgatccaaaccaccttgggatttgtatccatcaaggcaaggctgccaccttgtgtcctggggtctctgcagaagatggggaagtgttggtgagggaactgtgcacatatggctggaagtgcctgcttgagttctgccatcaggttgtttaggggggatagcattcagaagttcttctctggaacattctccaatagatgggttttaagttggtgcacttacccccacggctgcccccatccaactttctgttgaccctatccaggcagagtat

SEQ ID NO: 7316 - DNA, 478 bp, Mus musculus
  misc_feature (128)..(128): n is a, c, g, or t
  misc_feature (139)..(139): n is a, c, g, or t
  misc_feature (157)..(157): n is a, c, g, or t
  misc_feature (162)..(162): n is a, c, g, or t
  misc_feature (167)..(167): n is a, c, g, or t
  misc_feature (191)..(191): n is a, c, g, or t
  misc_feature (193)..(193): n is a, c, g, or t
  misc_feature (199)..(199): n is a, c, g, or t
  misc_feature (201)..(201): n is a, c, g, or t
  misc_feature (209)..(209): n is a, c, g, or t
  misc_feature (214)..(214): n is a, c, g, or t
  misc_feature (217)..(217): n is a, c, g, or t
  misc_feature (222)..(222): n is a, c, g, or t
  misc_feature (224)..(224): n is a, c, g, or t
  misc_feature (284)..(284): n is a, c, g, or t
  misc_feature (294)..(294): n is a, c, g, or t
  misc_feature (324)..(324): n is a, c, g, or t
  misc_feature (374)..(374): n is a, c, g, or t
  misc_feature (391)..(391): n is a, c, g, or t
  misc_feature (399)..(399): n is a, c, g, or t
  misc_feature (417)..(417): n is a, c, g, or t
  misc_feature (420)..(420): n is a, c, g, or t
  misc_feature (422)..(422): n is a, c, g, or t
ctggcaaggcctagaaagaagtgatctgctgaaatacttcaacgactgtggtcatttccccacccagacccagatcgatgagtactgggacctgctccacagatatggtcaaggaagatattctgaantaatcaaaaantccaatgctattgaactnttatntacantctaccctcctcaaggtgccagantnaacatnancacaagantaaantcnacatngntgagacccttggtggatggggaagaaggctataagtacttagtgaatggacatccaatantcaagagagntaacatccggactgttggcaagttggtggntcgatccataagagaaagaaaaatgagacaattttataaaacatgagaantggaataaatttttcancacagtgntccattaaatagttgaanttntntcctcagaaatgcatattagtaatgaacacagaatgatttgctattgacaggataa

SEQ ID NO: 7317 - DNA, 564 bp, Mus musculus
  misc_feature (272)..(272): n is a, c, g, or t
  misc_feature (301)..(301): n is a, c, g, or t
  misc_feature (319)..(319): n is a, c, g, or t
  misc_feature (326)..(326): n is a, c, g, or t
  misc_feature (329)..(329): n is a, c, g, or t
  misc_feature (331)..(331): n is a, c, g, or t
  misc_feature (340)..(340): n is a, c, g, or t
  misc_feature (359)..(359): n is a, c, g, or t
  misc_feature (375)..(375): n is a, c, g, or t
  misc_feature (377)..(377): n is a, c, g, or t
  misc_feature (399)..(399): n is a, c, g, or t
  misc_feature (401)..(401): n is a, c, g, or t
  misc_feature (422)..(422): n is a, c, g, or t
  misc_feature (468)..(468): n is a, c, g, or t
  misc_feature (485)..(485): n is a, c, g, or t
  misc_feature (500)..(500): n is a, c, g, or t
  misc_feature (502)..(502): n is a, c, g, or t
ggacgcagctgaaatggcgcctgttcttgtctctgggcaaactttgtgcctgtgccttcatgttttcttcgatgagggagaaaaccaaggaaagcccagggaaggtgccttgcggcggacacttccggattagacagaatcttccagagaatgcccaaggctggcttgggaacaaatggctctggctttttgttgccattatgatatatgtgatgctgaagtttcgaggagatggcgagaataaggagcagcatcctcctggcctccgaggntgccagttccgctttccaccaaagaaagntcaaaatatttcccccancaaaganttnantttcaatantttaacccagctcgagatngaattggtgaaatttntntccaaggtgcggaaccttaagntntccatggcaactaacagtaantccaggcagcaggttccagagagccccacgaacctgtacaataatntcacaatatatgagatntggggggaggaggantntgagtgaagaggtttatagtaaagtataagaaaagacaagtattgacagacagtatccgaac

SEQ ID NO: 7318 - DNA, 482 bp, Mus musculus
  misc_feature (297)..(298): n is a, c, g, or t
  misc_feature (302)..(302): n is a, c, g, or t
  misc_feature (339)..(339): n is a, c, g, or t
  misc_feature (364)..(364): n is a, c, g, or t
  misc_feature (381)..(381): n is a, c, g, or t
  misc_feature (444)..(444): n is a, c, g, or t
  misc_feature (457)..(457): n is a, c, g, or t
gctcagacaccttcattaacttctagggacggacccacccactggccctgaccactgacccaacagaagttcaaaacatggccagcgagagtcagtatggttctgatggctaacctaccaaggatcccgattagttatgacagacacattaatgcgtaccagctaatcagtggcttctccctgttcccaagtaacgatcccgatcaaagttctctcgatgactccaggcctatttacaaccaatgaccttttgaatagtcaatgttctctctcattagtgacccagataaataaccnntccnattgatcatcctgtgattcgggccagtgactccctcnacccagatcattgatcagttagtgncccacctgtacctgctntgggctctgggtgacaccgaacccaggaatcgattccagcttatccagtgtgccccctgtgtntcccagactgcgnccgctgatcattggcacctggtgga

SEQ ID NO: 7319 - DNA, 531 bp, Mus musculus
  misc_feature (324)..(324): n is a, c, g, or t
  misc_feature (337)..(337): n is a, c, g, or t
  misc_feature (365)..(365): n is a, c, g, or t
  misc_feature (369)..(369): n is a, c, g, or t
  misc_feature (371)..(371): n is a, c, g, or t
  misc_feature (378)..(378): n is a, c, g, or t
  misc_feature (392)..(392): n is a, c, g, or t
  misc_feature (399)..(399): n is a, c, g, or t
  misc_feature (419)..(419): n is a, c, g, or t
  misc_feature (430)..(430): n is a, c, g, or t
  misc_feature (432)..(432): n is a, c, g, or t
  misc_feature (496)..(496): n is a, c, g, or t
  misc_feature (502)..(502): n is a, c, g, or t
gtcgctcatgagcaaatatgtgcaccaccccagccccttccactgacggatggcacagacagggatgtgtggaggcatgagcagcaggtagctgagctgagcacggctgaggtggagaagcgcgcaaatgtgctgatgctgaaggagacgctgcgcatggagcaggcacagatgctgcagaaggcctttggggttgaggaggctccagggcagctgcagccccatccaaccctgaggaaagaggctctggagcgtctggtcagtgaagccatccatatccagattgcatgcctgcaggagcttctacagtacgagatccaggcnagcctttgacatnctggacctgaggctgcagaagaaaacantcantntcagtgntcctccacccccgnttccctntatcaccactggaccagcanccttagaggantntcccaaggctagtaaggccaataaaggaaagaaagccaaagctaagaagtaggaggctggtgantaccantcaaggacacgcgagaaaagcaacttggg

SEQ ID NO: 7320 - DNA, 228 bp, Mus musculus
gaggaagacgctacagtggcagcttgctcaagagcaaagacaacagtcacccccacaggggcttgccgtggcctccagccagccagacaccaagagcaagcctcaggacgacttgcagacccaagactgggtgtgtgagcctcaggaactcaggcgcccaggaagtcgctggaacatcagcatcgatgagcgcaggcggctggccttgcagcgtatgcaggagaggac

SEQ ID NO: 7321 - DNA, 461 bp, Mus musculus
  misc_feature (102)..(102): n is a, c, g, or t
  misc_feature (107)..(107): n is a, c, g, or t
  misc_feature (114)..(114): n is a, c, g, or t
  misc_feature (188)..(188): n is a, c, g, or t
  misc_feature (191)..(191): n is a, c, g, or t
  misc_feature (193)..(193): n is a, c, g, or t
  misc_feature (198)..(198): n is a, c, g, or t
  misc_feature (204)..(204): n is a, c, g, or t
  misc_feature (207)..(207): n is a, c, g, or t
  misc_feature (212)..(212): n is a, c, g, or t
  misc_feature (216)..(219): n is a, c, g, or t
  misc_feature (221)..(223): n is a, c, g, or t
  misc_feature (225)..(228): n is a, c, g, or t
  misc_feature (231)..(231): n is a, c, g, or t
  misc_feature (233)..(235): n is a, c, g, or t
  misc_feature (237)..(238): n is a, c, g, or t
  misc_feature (240)..(240): n is a, c, g, or t
  misc_feature (242)..(244): n is a, c, g, or t
  misc_feature (246)..(246): n is a, c, g, or t
  misc_feature (248)..(251): n is a, c, g, or t
  misc_feature (253)..(253): n is a, c, g, or t
  misc_feature (260)..(260): n is a, c, g, or t
  misc_feature (294)..(294): n is a, c, g, or t
  misc_feature (337)..(337): n is a, c, g, or t
  misc_feature (339)..(339): n is a, c, g, or t
  misc_feature (362)..(362): n is a, c, g, or t
  misc_feature (409)..(409): n is a, c, g, or t
  misc_feature (411)..(411): n is a, c, g, or t
ccaccgtcggcttcgaagaggaggtgtacgactgcctggattactactacctgcgtgacttcccggcctctggggctggacgcagcaagggccggacgcggngcgancagcagntacgcaccaactacccggtgcccggcggccacgagcgcaaggtggcgcagatactgctcaacgggcagcgcaancgncngccancgccangcntgcanaccnnnncnnngnnnncgncnnncnngnannncncnnnncncttgagncgggaacctgagacaggaggatcttgagttggantcctgcctgggcattattgaaacctgaaagacctgttaaaaantnttttccagctgtaaccaagatcntccgtgctggtcacctggactttttgacagggttttaagtttactgntntagtgtttttcctcactaattaattgttaagtaagtagtttcctggtgtg

SEQ ID NO: 7322 - DNA, 357 bp, Mus musculus
  misc_feature (277)..(282): n is a, c, g, or t
  misc_feature (284)..(284): n is a, c, g, or t
  misc_feature (314)..(314): n is a, c, g, or t
aaggctccttgtctgggtccatcaatggtatggatatcactcaggaaggagggcactttgttacaggtggccatgaccatctggtcaaagtctgggactacaacgagggtgaagtgactcacgtcggggtggggcacagcggcaacatcatggccatgcggataagtccaggaaaccagtatatcgtcagtgtgagcgcagatggagccatcttgaggtggaaatacccatttgcttcgtgatgggctctggatctccgcagcttccaccctgtgtnnnnnnancaggcctgtccagggccaagtttgcataantccagaaccgggtttgatttctcacacctatttttgccctata

SEQ ID NO: 7323 - DNA, 550 bp, Mus musculus
  misc_feature (334)..(334): n is a, c, g, or t
  misc_feature (358)..(358): n is a, c, g, or t
  misc_feature (451)..(451): n is a, c, g, or t
tagctcacagtccatcggaggatccccaaaggcagtcaccaaacctcaatccagatcccatgtggaaacctgggcccaggagacctacaggatgcaggatgcaacagacacagtgcgaggcctcgtggtggagctctccggtctgaaccggctgattatgagtacccaccgggacctggaggccttcaagcgcaggaagaccaagtctctgccttacctgacaaaggggttggggagccttcctagaggggatcagagctggagggacttgtaatctgctgcagcctgtaggggtcggcttaccatggctccagatgcaggaggctgagggtgnccacttggccaggatcactattgntcccatgcaacagggttgcctgagctttaaggaagtcacctgacagagcatggccctactcccgatgctcatcccggtttgagcatgcaggantctgagctgagctgcagttgtcgttgagtttgtttctggaggagagaggtgccctctgtctgcctatccttcccccatgctctctgttacatttgggaa

SEQ ID NO: 7324 - DNA, 569 bp, Mus musculus
  misc_feature (279)..(280): n is a, c, g, or t
  misc_feature (283)..(283): n is a, c, g, or t
  misc_feature (298)..(298): n is a, c, g, or t
  misc_feature (300)..(301): n is a, c, g, or t
  misc_feature (307)..(307): n is a, c, g, or t
  misc_feature (317)..(317): n is a, c, g, or t
  misc_feature (322)..(322): n is a, c, g, or t
  misc_feature (369)..(369): n is a, c, g, or t
  misc_feature (380)..(380): n is a, c, g, or t
  misc_feature (487)..(487): n is a, c, g, or t
  misc_feature (496)..(496): n is a, c, g, or t
  misc_feature (531)..(531): n is a, c, g, or t
  misc_feature (533)..(533): n is a, c, g, or t
aattggcgaatgtggacctgccctacccagctgcctctcgcctgcaggagctcctggccgtgctccttcagatggccggccagctggcctggctacaggttctaaaacttaacaagcggtcggtggtgaaacacattggtgaccttctccagcaccgccacatgctggtccgaacggcttttcgagatggaacagcagaagtggagacccagcagcagcagcagcagcagcagggacaaggacaaggacagcaggacgaggtgggggatggtcccttcnnatnttgcccaagaggaananntcccgnccagtcccantcccntcctgcccccctgcatgttgaagccccccaagcggacccacaccttnccccccgaatntgcagtgactggcgatgaggatatttcagatagtgaaatagagcagtatttgcgcacccctcaggaagttagagactttgagagagcccaagctgctagccaggcanccatgcgtntccctaaccctccctgatgcacgttctttaaggtntnttcagttctgactgcaatttattaacaggcctgttg

SEQ ID NO: 7325 - DNA, 512 bp, Mus musculus
  misc_feature (252)..(252): n is a, c, g, or t
attgattttgggtaggcccagcccaggctgagctgaatgaatcctgcactatttgtttactcgtcgacagattgcacagtgaatggtgtgtggacttgagagacacaatctgatttcagcatgcacataaggccattgtctgtctgagttgtcagcgtccttcatgttctgcctattaggagcgatccaagtgcccttctgctactgaccatctgcataagatactcgtgccgtctcctcggtgtgcaaggngcggctgaagtgagttaggtgtccagccgtgtctgctttctcagtgttccgcttgcctgttgcaagattgttctaatgttaattacactagtaaaatggctcagtccttgtggtgttgcagttttcacataattaatacttttattcttattaaaatagagtactgtacaagaacctagtataattatatcttgaaattattttgtataagaatatatttagaaaagtggtttctgagccactgacctattcttggtaaa

SEQ ID NO: 7326 - DNA, 490 bp, Mus musculus
  misc_feature (67)..(67): n is a, c, g, or t
  misc_feature (69)..(69): n is a, c, g, or t
  misc_feature (242)..(242): n is a, c, g, or t
  misc_feature (272)..(272): n is a, c, g, or t
  misc_feature (280)..(280): n is a, c, g, or t
  misc_feature (282)..(282): n is a, c, g, or t
  misc_feature (287)..(287): n is a, c, g, or t
  misc_feature (302)..(302): n is a, c, g, or t
  misc_feature (304)..(304): n is a, c, g, or t
  misc_feature (315)..(315): n is a, c, g, or t
  misc_feature (331)..(331): n is a, c, g, or t
  misc_feature (337)..(337): n is a, c, g, or t
  misc_feature (353)..(353): n is a, c, g, or t
  misc_feature (377)..(377): n is a, c, g, or t
  misc_feature (396)..(396): n is a, c, g, or t
  misc_feature (400)..(400): n is a, c, g, or t
  misc_feature (402)..(403): n is a, c, g, or t
  misc_feature (406)..(406): n is a, c, g, or t
atttctgactggaggaactgcacgattgtctctcctgatgctggcggagccaagagggtcacttccntngcggaccatttgaatgtggattttgccttgattcacaaagaacggaagaaagccaatgaagtggaccgcatggtgcttgtgggtgatgtgaaggatcgggtggctattcttgtagatgacatggctgatacttgtggtacaatctgttacgcggcggacaaacttctctcagngggagctaccagagtttatgccattttgantcatggcntnttttntggcccagctattgntngcatcaatggngcatgctttgaagcantagtantcacaaacaccatacntcaagaagacaagatgaaacagtntagcaaaatccaggtgatngacntnnccnatgatccttgctgaagccatccggagaacccataacggagaatctgtttcctacctgttcagtcacgtacccttgtaatgcagt

SEQ ID NO: 7327 - DNA, 353 bp, Mus musculus
agtgctagactatcatgtgttcatatatctcctgaaaatcgtttcaaatatgtatggaagcttctaaagccagaccaacaacctgttatactgacaaatgactcagcagtcttggaaataacgagagaaattcgtcctctggcttttgaatgtgacaccttggataataatgaaatggtggcatctgttaaattcaccgtctatacaacaaatgaactgcagatgagaagatccagcagaccagacactgatgcagtcttagttttcgtgctgaccataggagtcattatctgcatatttgtgatcttcgtattgattttcatcatcataaattgggcggcagtgaaatcctt

SEQ ID NO: 7328 - DNA, 365 bp, Mus musculus
  misc_feature (338)..(338): n is a, c, g, or t
acttcgcgaccatttggcagtggatggtaacgacaccagcaacgtccaaatgaaaatctccgagctcttgcaccgagaaagcaagataagtacttcaacaaaaatgtccgccccagcaaagactgtgtctcaagccggcacttcctcccaagtcagaaagcccagcaagcctttatcgaccccactggtgaggaatttttccaggccggtagaaaggccaacgaactttgtgagagcgcggccagaaggcaaagtgattcctttgaaaccaattgaaatcgttctgccgccagtgatattcccattgagttcccaggggcccagggttcagatgccanccacccatttttattaccgcttcattg

SEQ ID NO: 7329 - DNA, 496 bp, Mus musculus
  misc_feature (290)..(290): n is a, c, g, or t
  misc_feature (342)..(342): n is a, c, g, or t
  misc_feature (352)..(352): n is a, c, g, or t
  misc_feature (368)..(368): n is a, c, g, or t
  misc_feature (385)..(385): n is a, c, g, or t
  misc_feature (387)..(387): n is a, c, g, or t
  misc_feature (402)..(402): n is a, c, g, or t
  misc_feature (404)..(404): n is a, c, g, or t
  misc_feature (409)..(409): n is a, c, g, or t
  misc_feature (432)..(432): n is a, c, g, or t
tatgtgatttggctctggactttgttggctctggactttgtctttctgtctccaggtactgctggagagaggggactgcagctggccaacccctctatgccaccaaggcctaccagctctggttctctgccttctggacatctggattgcatgtccctcttgacttaagaacccagactatgaggcctcactagagcactgcctgtttgattactgtttctgaacttgcaaaatggctcctgtccaaagtgcttaatgtgttttttaagccttcaggtattttataagcnttaagatcctttttatgatgtagagcaattacttggctttcctatgttcttnacccccatcngtaatttctttggaanctggggctttttatgtntnttataaaatgctttntncaatntaatatgatcaaacaatctatcnatggggttctgagtggtatcaaatgccagtgttttcctttgtgtgcactcactcgcacacatat

SEQ ID NO: 7330 - DNA, 339 bp, Mus musculus
agttgtgcatatttggccggaaaccaagaggaaactttagaaagtgttactgaagtagtggaaggcaactcctgaaagctgaagacatgagcaactttcatggctgctaacacctgatgtaggtgcccatgagattcccatataacaaggcacacctcatgcattttgtgcaaaaggaaattcacaacaaggtgaaagttatcccttggtatttagggagtgtctacatacagatattctaggttccagagggaaaagcttttcctatgtaagtatgagaccatcgcaagaaagcatttgctagctagccactccaaagagatgtcaactctccccagc

SEQ ID NO: 7331 - DNA, 493 bp, Mus musculus
  misc_feature (268)..(270): n is a, c, g, or t
  misc_feature (276)..(276): n is a, c, g, or t
  misc_feature (281)..(281): n is a, c, g, or t
  misc_feature (284)..(284): n is a, c, g, or t
  misc_feature (289)..(289): n is a, c, g, or t
  misc_feature (308)..(308): n is a, c, g, or t
  misc_feature (329)..(330): n is a, c, g, or t
  misc_feature (343)..(343): n is a, c, g, or t
  misc_feature (345)..(345): n is a, c, g, or t
  misc_feature (354)..(354): n is a, c, g, or t
  misc_feature (356)..(356): n is a, c, g, or t
  misc_feature (374)..(374): n is a, c, g, or t
  misc_feature (442)..(442): n is a, c, g, or t
  misc_feature (448)..(448): n is a, c, g, or t
  misc_feature (464)..(464): n is a, c, g, or t
aaaaaagctcagaccttcttccactccaaaggtggaacacacgtggccctcgaagttagagctatccctacagcatctatcacaaaaaacacagaatgccagaaagatacaggcctggtggcgaggcaccctgcgtgagacgctcactgctgagggccgccctcagtgcatggatcattcaatcctggtggaggaagatactggccaaaagacaggaaaagaatcgactgataatcctgcacttgatggcacaagaaacaagggcctnnntccttnttcanttngtggntccggatgctgaaaatccntcagaattattgcaggttgtnntatgccacccgtntnatccaggcntngtggcgctggtataactnccgcacccgtggctttttccagggcagctatgaacttgtaggaaacaaactacgtttacggcttgatntctttntgggatcacaggtttntcgaatatcagactgcatatccttgccaa

SEQ ID NO: 7332 - DNA, 590 bp, Mus musculus
  misc_feature (311)..(311): n is a, c, g, or t
  misc_feature (313)..(313): n is a, c, g, or t
  misc_feature (321)..(321): n is a, c, g, or t
  misc_feature (324)..(324): n is a, c, g, or t
  misc_feature (327)..(327): n is a, c, g, or t
  misc_feature (347)..(347): n is a, c, g, or t
  misc_feature (351)..(351): n is a, c, g, or t
  misc_feature (359)..(359): n is a, c, g, or t
  misc_feature (366)..(366): n is a, c, g, or t
  misc_feature (375)..(375): n is a, c, g, or t
  misc_feature (377)..(377): n is a, c, g, or t
  misc_feature (379)..(380): n is a, c, g, or t
  misc_feature (382)..(382): n is a, c, g, or t
  misc_feature (385)..(385): n is a, c, g, or t
  misc_feature (395)..(395): n is a, c, g, or t
  misc_feature (398)..(398): n is a, c, g, or t
  misc_feature (407)..(407): n is a, c, g, or t
  misc_feature (409)..(409): n is a, c, g, or t
  misc_feature (411)..(411): n is a, c, g, or t
  misc_feature (432)..(432): n is a, c, g, or t
  misc_feature (438)..(438): n is a, c, g, or t
  misc_feature (501)..(501): n is a, c, g, or t
  misc_feature (503)..(503): n is a, c, g, or t
  misc_feature (520)..(520): n is a, c, g, or t
  misc_feature (522)..(522): n is a, c, g, or t
  misc_feature (535)..(535): n is a, c, g, or t
  misc_feature (537)..(537): n is a, c, g, or t
  misc_feature (562)..(562): n is a, c, g, or t
caaagtttgatgactggctcctggacaacgacatagctttgctcttgctcaaatccccattaaacttgagtgtcaacaggatacctatctgcacttcagaaatctctgacatacaggcatggaggaactgctgggtgacaggatggggcattactaatactagtgaaaaaggagtccaacccacaattctgcaggcagtcaaagtggatctgtacagatgggattggtgtggctatattttgtctctattaaccaagaatatgctgtgtgctgggactcaagatcctgggaaggatgcctgccagggcganantggagganctntcntttgcaacaaaaagagaaanacanccatttgntaccagntgggcattntnanntnggngcatgggctntgncaagaagantntnccaggagtatacaccaaggtntcacantatgtgaggtggatcagcaagcagacagcgaaggcggggaggccttatatgtatgagcagaantntgcgtgccctttggtgntntcttgccgggctntnttgttcctatattttgtaatgtttnttctaacctgatgattaaacgtgagact

SEQ ID NO: 7333 - DNA, 580 bp, Mus musculus
  misc_feature (297)..(297): n is a, c, g, or t
  misc_feature (335)..(335): n is a, c, g, or t
  misc_feature (414)..(414): n is a, c, g, or t
  misc_feature (423)..(423): n is a, c, g, or t
  misc_feature (470)..(470): n is a, c, g, or t
  misc_feature (503)..(503): n is a, c, g, or t
  misc_feature (525)..(525): n is a, c, g, or t
  misc_feature (541)..(541): n is a, c, g, or t
atttcagcagcagttggcattccagttggagttggaaatgcaacaaaaagagaaacagaagtcagaagatttcgagacagggcaagaaaaatcatttaagagcatgatgagcatggagagcacggctaggggtgaggagcaggagcccatgcaggcggaggaattggtgatggactcgggtaaaaccctagcggagatcagcgatcggtacggggagcctaacttgagccgggtggaagaacttgatgagccaatgttatctgataatggtgtctcggcgcctccctgaatcgtggnggcagcacaaatataaccagaatagacttaagtttgantcaagagatgggggagagggagccgaaaaggaaacccagcctttgtccccgagcagccgagctgttaccttaaacattnatcaagatntgtaggaccaaccaactgaaaagaaatattttctacctgtttcaaanttcaaatcacaagggccctaacatgtatttttntcttttcaaacttggaccctantccccttcccaccaantcactaactttataaacaggcttcaactgtatccttaaa

SEQ ID NO: 7334 - DNA, 257 bp, Mus musculus
gtgatatctcgtgcaaaatctgacaaagggaagaagggacttacttgaggcactacgacatggtaggttcaccatcagcctttgttcttaaccacacaatgttgtggaggccttgtgcccctattttacagatcgatagggacccaatatattgtttctctgatccaagaactcaaagttaatttctagtattataaatcccatcgaattttgttgtgtcctccctctaaataaagaactctggtagcatcggatgc

SEQ ID NO: 7335 - DNA, 490 bp, Mus musculus
  misc_feature (124)..(124): n is a, c, g, or t
catcgttgcccttcttactaagcaacaacgggagttattagtttcacagcaagaggaggacttggataacagcgtgggtgagcttagtgaaggacagaggctcgtgctgaaagcagcagaggancatctcagcaggaccgtccggccaaatgctgccgcccacttctcctgcagagccctcctatcagcacgcagaccctcggctggtattgcagcagtctgacatggcctcaggtggcccggcagatctgctcctcattgcacatgtgtcacccgccaggatgtctgtgactctaccctctgcgaaccttgaggactgctctcagtccctgagcaccagctccatgcatggcggcaccgaatcctcagggacagacaccttctgagcaggaggagagcagcacaaggttcatgaagactcatgaaggcttacaaggttcatgaagacatgtcactctggctgcagaccatgtctgtatactgttggcct

SEQ ID NO: 7336 - DNA, 179 bp, Mus musculus
ttcattagccaataaattgcttcaatataaagccaatcttgaagccaaaaataaggacggtcacactccgcttttacttgctgttgctgaaaataatgaaaatatggtaaaattccttctgaagaaaggagcagatgtaaatgcatcagataaaaaccacagaacagccatcatgattg

SEQ ID NO: 7337 - DNA, 543 bp, Mus musculus
  misc_feature (36)..(36): n is a, c, g, or t
gggaccagtgcgtcactcagtaaagcaagcaaaganacttcctgtaagcgacaaaatagagaagggtcctgggactcttcactggtgatgaagaaaccaaagcagaaccaagtttccacagtaaccgattccgaggtggctttggtcagcgcctaccttgagcaaagacgagtcaggcgccattcccagttcctccgggtgaatcagatccagcaagatagtgacaccactgaatgtgacagcgaggaatcgaactccggagcgtcctcctggaaggagagtgaaagcgaccatcatctgtcacctgccaatattaagaggaggaagtcagtgtccaggcaaagggatatggaaaactatgaagtcagacaaaggccctgtctccactgcaaagccatgagaaccagggagtggctgacacgtcacttcccaccaagcgcctcagtaacaacccccatgaagggagagattcaagaggagaatttgacacctgggaccaacacaaaattcagcaaattttgaatttggcatccttaccttgaa

SEQ ID NO: 7338 - DNA, 496 bp, Mus musculus
  misc_feature (77)..(77): n is a, c, g, or t
  misc_feature (90)..(90): n is a, c, g, or t
  misc_feature (267)..(267): n is a, c, g, or t
  misc_feature (276)..(276): n is a, c, g, or t
  misc_feature (279)..(279): n is a, c, g, or t
  misc_feature (288)..(288): n is a, c, g, or t
  misc_feature (295)..(295): n is a, c, g, or t
  misc_feature (309)..(309): n is a, c, g, or t
  misc_feature (312)..(312): n is a, c, g, or t
  misc_feature (314)..(314): n is a, c, g, or t
  misc_feature (325)..(325): n is a, c, g, or t
  misc_feature (327)..(328): n is a, c, g, or t
  misc_feature (345)..(345): n is a, c, g, or t
  misc_feature (347)..(348): n is a, c, g, or t
  misc_feature (350)..(350): n is a, c, g, or t
  misc_feature (368)..(368): n is a, c, g, or t
  misc_feature (385)..(385): n is a, c, g, or t
  misc_feature (406)..(406): n is a, c, g, or t
  misc_feature (451)..(451): n is a, c, g, or t
  misc_feature (456)..(456): n is a, c, g, or t
  misc_feature (458)..(458): n is a, c, g, or t
gtggctacttcagggactcgtgcaacattattgccttcacccctaatagcaccaaccgtgtggccctgaaggatacnggaaaccaactcnttatcactatatcctgcctggtcaaggaggacacaggctggtactggtgtggtatccagcgggacttggccagagatgacatggattttacacagctgattgtgactgacaatagagaagaccgggccaatggcttttcatctgacccttcaggcaataggacccggagctgtaggncttccaaanctntccaaaagncagaggnctcccgaatgtccnttntnatcatttgtananngattaccagtttggggntnntntttataatcagtcacttntccagaggaaggcgaanccaaagaaatagagaagttantggcaaaagcatcagtagaaacccacaagcaagccaaggcccgtntatgntntccataactttggcaaggatttgaagttctttccacgt

SEQ ID NO: 7339 - DNA, 348 bp, Mus musculus
  misc_feature (107)..(107): n is a, c, g, or t
  misc_feature (111)..(113): n is a, c, g, or t
  misc_feature (127)..(127): n is a, c, g, or t
  misc_feature (132)..(132): n is a, c, g, or t
  misc_feature (135)..(135): n is a, c, g, or t
  misc_feature (139)..(139): n is a, c, g, or t
  misc_feature (156)..(156): n is a, c, g, or t
  misc_feature (158)..(158): n is a, c, g, or t
  misc_feature (162)..(162): n is a, c, g, or t
  misc_feature (168)..(168): n is a, c, g, or t
  misc_feature (171)..(171): n is a, c, g, or t
  misc_feature (183)..(183): n is a, c, g, or t
  misc_feature (185)..(185): n is a, c, g, or t
  misc_feature (230)..(230): n is a, c, g, or t
  misc_feature (256)..(256): n is a, c, g, or t
  misc_feature (260)..(260): n is a, c, g, or t
  misc_feature (263)..(263): n is a, c, g, or t
gaatatcagggcagcatcctaggatcctgtggctctcaggtgtaaaaagaacaacaataagccaacaatgataaggcgtccaccaacaattgtttgttacatctgtngccnnngaatatgggaccanatctnttnagcnattcatgagccacagtntntganaaagtngcntaatgagaacantntgttgcctaaagaactaaggagaccagaaccgaaaaaaccagaantcagaaccattactgccaaagggttntacnatnttgacgccttaaacgaagctgcttggacaagtgcccagagccaattggttccctgtaacgtttgtgggcggaccttcctgccaga

SEQ ID NO: 7340 - DNA, 343 bp, Mus musculus
  misc_feature (149)..(149): n is a, c, g, or t
  misc_feature (296)..(296): n is a, c, g, or t
  misc_feature (306)..(306): n is a, c, g, or t
  misc_feature (308)..(309): n is a, c, g, or t
  misc_feature (312)..(312): n is a, c, g, or t
  misc_feature (315)..(315): n is a, c, g, or t
agcaagcctgtgaccatgccaaggagaccgaggacgtgcgcagccagctgcagagcatcaaacagcaacaccagcaggccacggaacagatgggaaaggagcaagaggctaatctcaacctgaaccaggagctgcaggccaggctgcanactgtcctgcgagagaaagaggagctgctgcagctgtccatggagagaggcaaggtgcttcagaacaaacaggctgagatccgccagcttgaggagaagttggagacagcagccatggctaagaagcatgcgctggaacgctttgancaagaggcantnnccnttnatagcaacctgagagttcgcgagcttca

SEQ ID NO: 7341 - DNA, 435 bp, Mus musculus
ggtaggacaaaaacttctcagcaaaaaggctctaattggatctgattttgtattagcttggcaaagcaaaagtttgatcattcacttgtgtgccaaagtgtaaaagctagctctgatacattcattctattgagcattaagattcaagttcgttacatcaaccaattctaatattttctgcaagtctatcttacttccactttcttggtttttctccttaataactgagaggatttagacattctctattgagactattttacaatatgctaataggcaaaaaaattacctcaatttaaggtaactagtcatagcagattttggtagcagctcataaattgttttctgtttctgtcaatacattttgtgtaattttgtgttttaaaagtccaagctgaatgcgtatatgtgtacttatggcattctttgtaggaa

SEQ ID NO: 7342 - DNA, 385 bp, Mus musculus
  misc_feature (59)..(59): n is a, c, g, or t
  misc_feature (80)..(80): n is a, c, g, or t
  misc_feature (82)..(85): n is a, c, g, or t
  misc_feature (87)..(87): n is a, c, g, or t
  misc_feature (91)..(96): n is a, c, g, or t
  misc_feature (98)..(100): n is a, c, g, or t
  misc_feature (102)..(104): n is a, c, g, or t
  misc_feature (115)..(115): n is a, c, g, or t
  misc_feature (130)..(130): n is a, c, g, or t
  misc_feature (145)..(145): n is a, c, g, or t
  misc_feature (147)..(147): n is a, c, g, or t
  misc_feature (202)..(202): n is a, c, g, or t
  misc_feature (208)..(208): n is a, c, g, or t
  misc_feature (219)..(219): n is a, c, g, or t
  misc_feature (243)..(243): n is a, c, g, or t
  misc_feature (254)..(254): n is a, c, g, or t
  misc_feature (259)..(259): n is a, c, g, or t
  misc_feature (281)..(281): n is a, c, g, or t
  misc_feature (302)..(302): n is a, c, g, or t
  misc_feature (333)..(333): n is a, c, g, or t
aacccaagagagtgatgaactgcctcataccagatgctgtgccatcaacctggacttcngaacccaagacagtggacacntnnnncncacnnnnnntnnngnnntcaacctcgantgctgagccaaaganagtgaagatttgccntnatcagttccagtccaaatgtagcaagaagattagaaggcccaaggtgcctaccangaagancaagaaaacgntgggaaggatgctgaaaaaaaagncatctaagaanaatanagcacctaaacggcgtttcganttgtgattgagaatgccagtntcagcatgccacctaaaggaggtgtggcatntgagcaatggccaactgtgtagatactgtagatactacacagttctttgact

SEQ ID NO: 7343 - DNA, 526 bp, Mus musculus
  misc_feature (123)..(123): n is a, c, g, or t
  misc_feature (169)..(169): n is a, c, g, or t
  misc_feature (182)..(182): n is a, c, g, or t
  misc_feature (214)..(214): n is a, c, g, or t
  misc_feature (253)..(253): n is a, c, g, or t
  misc_feature (274)..(274): n is a, c, g, or t
  misc_feature (276)..(276): n is a, c, g, or t
  misc_feature (301)..(301): n is a, c, g, or t
  misc_feature (308)..(308): n is a, c, g, or t
  misc_feature (315)..(315): n is a, c, g, or t
  misc_feature (322)..(322): n is a, c, g, or t
  misc_feature (384)..(384): n is a, c, g, or t
  misc_feature (393)..(394): n is a, c, g, or t
  misc_feature (494)..(494): n is a, c, g, or t
  misc_feature (497)..(497): n is a, c, g, or t
ttctttcccagcaaaaactgctttaactagcataatgtatgcttcttatgcagcactaatttatttggcagtctgtgttaatgcggtgctggcaaagataaagaagattttccaagaagaagnatccattaggcaaaatagagagagcgagaattttaggaaagccttntctgagcccgcgntccgaaagcccatgttttctgaaagtgaaatnaaagcaaaaccttacaggtcgttgccagagaagccaganaaccttttagatcaacccaancntcctgccaacaagcagagtaacaanatccagnttttacnttctgtntttgaccaattggctgaattgaatgaatgagaaatacaaacacaaataccactttagagtgntcaatagtnntctatccacaggtaaatttcatcagacataccagaggaccaatttatataagctgaatgtaaatttaagaagggacagggtagggaaaactatgacatcntcntcttgtatcattgtattttctatatggca

SEQ ID NO: 7344 - DNA, 437 bp, Mus musculus
  misc_feature (277)..(277): n is a, c, g, or t
  misc_feature (280)..(280): n is a, c, g, or t
  misc_feature (285)..(285): n is a, c, g, or t
  misc_feature (293)..(293): n is a, c, g, or t
  misc_feature (295)..(295): n is a, c, g, or t
  misc_feature (312)..(312): n is a, c, g, or t
  misc_feature (324)..(324): n is a, c, g, or t
  misc_feature (331)..(331): n is a, c, g, or t
  misc_feature (336)..(336): n is a, c, g, or t
  misc_feature (354)..(354): n is a, c, g, or t
  misc_feature (358)..(358): n is a, c, g, or t
  misc_feature (365)..(365): n is a, c, g, or t
  misc_feature (367)..(368): n is a, c, g, or t
  misc_feature (370)..(370): n is a, c, g, or t
  misc_feature (372)..(372): n is a, c, g, or t
  misc_feature (375)..(375): n is a, c, g, or t
  misc_feature (377)..(378): n is a, c, g, or t
  misc_feature (381)..(385): n is a, c, g, or t
  misc_feature (397)..(397): n is a, c, g, or t
  misc_feature (401)..(401): n is a, c, g, or t
cctccaggtgattcttgtcacttagaagagcctttgaagtttattacatttttttgtaagtcatcgcataacgggagaggaacttatcctcacatccctccattatatcttgatgaatatgccacagaatcgtttgtggataaaaaaggaactgagagtcttggggtttagcctatcaggaagtttatcaataatactacagaagaggccttcaaatcatacgctgatctggaccatgacaatgaatatcctaagcatcttcgcaacactagttggnttnttttnaacaacantngaaatgatagtgacttnaagtgtatattntaccctntggcnaatataagagtggcaggntgcnttacagnanntntnttncnnttnnnnnatgttggagttnttcntggcatccatagtaactgagtggacctatagagcaa

SEQ ID NO: 7345 - DNA, 302 bp, Mus musculus
  misc_feature (218)..(218): n is a, c, g, or t
ttaggaagttgctattggccacataactaggcttccatgttgtacagcagtgagtggttccatatggctctgttcaaactgagcacattttgccttttttctttcttttcttggggggatgggataaatgggatattttttaaagaataaatcccgcatgtgaaagtttatgaaggttactagcaggttctttttaaaagaacatttggttttttttnaaacatgtgatttttaacacatatatttcttccatattcagattggcattcatatatgtatccattctgtagaacacatcatgt

SEQ ID NO: 7346 - DNA, 575 bp, Mus musculus
  misc_feature (30)..(30): n is a, c, g, or t
  misc_feature (72)..(72): n is a, c, g, or t
  misc_feature (270)..(270): n is a, c, g, or t
  misc_feature (274)..(276): n is a, c, g, or t
  misc_feature (278)..(291): n is a, c, g, or t
  misc_feature (293)..(293): n is a, c, g, or t
  misc_feature (299)..(299): n is a, c, g, or t
  misc_feature (313)..(314): n is a, c, g, or t
  misc_feature (320)..(320): n is a, c, g, or t
  misc_feature (328)..(328): n is a, c, g, or t
  misc_feature (341)..(341): n is a, c, g, or t
  misc_feature (345)..(345): n is a, c, g, or t
  misc_feature (350)..(350): n is a, c, g, or t
  misc_feature (355)..(355): n is a, c, g, or t
  misc_feature (360)..(360): n is a, c, g, or t
  misc_feature (366)..(366): n is a, c, g, or t
  misc_feature (375)..(375): n is a, c, g, or t
  misc_feature (379)..(380): n is a, c, g, or t
  misc_feature (426)..(426): n is a, c, g, or t
  misc_feature (447)..(447): n is a, c, g, or t
  misc_feature (474)..(474): n is a, c, g, or t
  misc_feature (477)..(477): n is a, c, g, or t
  misc_feature (481)..(481): n is a, c, g, or t
  misc_feature (491)..(491): n is a, c, g, or t
  misc_feature (522)..(522): n is a, c, g, or t
  misc_feature (532)..(532): n is a, c, g, or t
  misc_feature (534)..(534): n is a, c, g, or t
acgttggtggagagttgtatgaaaacatgnttcttgagaaagacaagtgcattgagaagttgcaagctgaantcaaagcctcccaggagaaacttaacatccataaactaaagcacaaaaaggcagtgaaaaagctacaaactgatttggcaatagctaagcaagaggctgccatcactgtcctggaactcaatgagaagataatgacactctgtgaaggaaggcccttccctagagcaaccaactcagtggatgtactctccggaggtntccnnncnnnnnnnnnnnnnnanaggaanttttccctgatcanngagctntccacccnactttcccttcanacgnagaanatcantcagntcgaanacaccttancggnnaaggaaaagaagatcgaggagctggaagcagagtgcacttcccagntcccccaaggtgaagacaganttacagaagatttataggaaccccctnccntccntccccacccntccccactgtaaatgatgaggctaggagcgntcccaccacntntgatggggagtggaatggtttcccatgtgacaataaagttt

SEQ ID NO: 7347 - DNA, 273 bp, Mus musculus
  misc_feature (27)..(27): n is a, c, g, or t
  misc_feature (143)..(143): n is a, c, g, or t
gacgatgacataaattttttggaggangctcattctgaagaaaacgtaagtttctcagaggaatggcagcgttttgcaagttctgtagagacaccaatagaaaacaggaatttgttaagtggtgaacagcaagatgggaatgnttcaaaattggatcttatggaagaacagaatccagtaactcatgatgatgagaatgaaattcctgaagaaatcgttggagatacacgggagatgatcaacaacaagtcgtgtgagcagtataaaactaca

SEQ ID NO: 7348 - DNA, 285 bp, Mus musculus
  misc_feature (198)..(198): n is a, c, g, or t
  misc_feature (232)..(232): n is a, c, g, or t
ggaagactactgtatcacaagctttacgtccaatctgaaactcagctgtgaatgacctgggtgccaaagatccctttcctaagcgacaagacaactgctcatagaaaaacgggctcatttcttttttacagtgtgtctctattctctatcaactgaggaagcactgttaagcacattgtatgtagcacacacggctanacacacatgtgtgtgtgtatatactcagacagtntgcagtgggtgtgcagtagggtgagaacattgaacagaagaatcgccccggaa

SEQ ID NO: 7349 - DNA, 528 bp, Mus musculus
  misc_feature (201)..(201): n is a, c, g, or t
  misc_feature (203)..(204): n is a, c, g, or t
  misc_feature (207)..(207): n is a, c, g, or t
  misc_feature (210)..(210): n is a, c, g, or t
  misc_feature (215)..(216): n is a, c, g, or t
  misc_feature (222)..(222): n is a, c, g, or t
  misc_feature (224)..(224): n is a, c, g, or t
  misc_feature (228)..(229): n is a, c, g, or t
  misc_feature (231)..(231): n is a, c, g, or t
  misc_feature (233)..(234): n is a, c, g, or t
  misc_feature (236)..(236): n is a, c, g, or t
  misc_feature (239)..(239): n is a, c, g, or t
  misc_feature (241)..(241): n is a, c, g, or t
  misc_feature (248)..(248): n is a, c, g, or t
  misc_feature (252)..(252): n is a, c, g, or t
  misc_feature (254)..(254): n is a, c, g, or t
  misc_feature (257)..(257): n is a, c, g, or t
  misc_feature (261)..(261): n is a, c, g, or t
  misc_feature (263)..(263): n is a, c, g, or t
  misc_feature (271)..(271): n is a, c, g, or t
  misc_feature (275)..(275): n is a, c, g, or t
  misc_feature (286)..(286): n is a, c, g, or t
  misc_feature (290)..(290): n is a, c, g, or t
  misc_feature (299)..(299): n is a, c, g, or t
  misc_feature (329)..(330): n is a, c, g, or t
  misc_feature (337)..(337): n is a, c, g, or t
  misc_feature (342)..(342): n is a, c, g, or t
  misc_feature (346)..(346): n is a, c, g, or t
  misc_feature (356)..(356): n is a, c, g, or t
  misc_feature (365)..(365): n is a, c, g, or t
  misc_feature (376)..(376): n is a, c, g, or t
  misc_feature (382)..(382): n is a, c, g, or t
  misc_feature (388)..(388): n is a, c, g, or t
  misc_feature (401)..(401): n is a, c, g, or t
  misc_feature (438)..(438): n is a, c, g, or t
  misc_feature (442)..(442): n is a, c, g, or t
  misc_feature (444)..(444): n is a, c, g, or t
  misc_feature (454)..(454): n is a, c, g, or t
  misc_feature (490)..(490): n is a, c, g, or t
agcagcagagcctccctttaaagcacacggagaagtgtactgaatcttctgtgtactggccaaccaaaagaggcataaccatatatgctgatccagatgttccatcagtaagtgggtctagccagaggccgaatgagaagccactgcggttgactgaaaagaaagactgtgacgagaagaacggctgtgtaaaattactgnannttntanatccnnatcctntnaganntnanngnacntnagacctncacnanttncagnanggtgaagntggncacactgcagncctngggtggtgntccggaacaggatcgagccctgcctaaccnnggagaantcacntctntcggcagacntgaagaagntgaacatgttnttaaanccagantcctgacgacatnccagccctttccaacacagagtgttgctttgttttgntttntntgttctgttntaagagtgacggggatgaaatacagggctttgcgcntcctgggcatgcattcatcactgaaccataccccaatt

SEQ ID NO: 7350 - DNA, 287 bp, Mus musculus
gaacgacatgttgtgtacaagctcagaatggggcctggacacttgtcaggacacctccggaagctctctggtttgccagatgaacaagacctgggtccagatgggcgtggtgagctggaactttgactgtggccgtcgccaattcccaagcgtctacaccagcacctcccacttcacccagtggatcaagagacagattggcgacctgaagtttaccagcatggctgtcccctccttcctgagcccattcatcctcactggctacattctgctggtatccttgggct

SEQ ID NO: 7351 - DNA, 542 bp, Mus musculus
  misc_feature (110)..(110): n is a, c, g, or t
  misc_feature (124)..(124): n is a, c, g, or t
  misc_feature (189)..(189): n is a, c, g, or t
  misc_feature (197)..(197): n is a, c, g, or t
  misc_feature (199)..(199): n is a, c, g, or t
  misc_feature (206)..(206): n is a, c, g, or t
  misc_feature (221)..(221): n is a, c, g, or t
  misc_feature (312)..(312): n is a, c, g, or t
  misc_feature (361)..(361): n is a, c, g, or t
  misc_feature (363)..(363): n is a, c, g, or t
  misc_feature (368)..(368): n is a, c, g, or t
  misc_feature (404)..(404): n is a, c, g, or t
  misc_feature (416)..(416): n is a, c, g, or t
  misc_feature (445)..(445): n is a, c, g, or t
  misc_feature (461)..(461): n is a, c, g, or t
  misc_feature (498)..(498): n is a, c, g, or t
  misc_feature (503)..(503): n is a, c, g, or t
  misc_feature (506)..(506): n is a, c, g, or t
tgggctggagcctctgcaacagaagttagcggctattcagcgagcgcatgcttggatcctacagatcccagctgagcacttggccatgaactttcatgaggtgctggcanatctgggctccaanacactgacaggactcttcagagcttgggtgagggccggtttgggggaccagcgtgtggtcttcantggcctantnggcttgnaaccttccacactgnctcatagtctcccccggctactagtgcaggccctgaaggccttccgctcagcttccctgacagaaggagagccccaggcaccctggatagntgctgatcaaggacagaggctgggaaaggagcgccagggccaactccancntcctnttccctgaaccaggcaaccctgtgatggtcacactntcctgggggctnaagcggttgtgtgagacatacaaagtctntctattccagttgatnttggatgtgtggatagagtggggatcctggatctcantcatnttnttcaatgtgtcaccagacacgcatggctgctttaat

SEQ ID NO: 7352 - DNA, 545 bp, Mus musculus
  misc_feature (28)..(28): n is a, c, g, or t
  misc_feature (32)..(32): n is a, c, g, or t
  misc_feature (37)..(37): n is a, c, g, or t
  misc_feature (137)..(137): n is a, c, g, or t
  misc_feature (146)..(146): n is a, c, g, or t
  misc_feature (271)..(271): n is a, c, g, or t
  misc_feature (274)..(274): n is a, c, g, or t
  misc_feature (333)..(333): n is a, c, g, or t
  misc_feature (348)..(348): n is a, c, g, or t
  misc_feature (350)..(350): n is a, c, g, or t
  misc_feature (357)..(357): n is a, c, g, or t
  misc_feature (374)..(374): n is a, c, g, or t
  misc_feature (396)..(396): n is a, c, g, or t
  misc_feature (477)..(477): n is a, c, g, or t
  misc_feature (479)..(482): n is a, c, g, or t
  misc_feature (485)..(485): n is a, c, g, or t
  misc_feature (501)..(501): n is a, c, g, or t
gtttcacaatgccaatcagctagctgcntggngtttngcatcacatctgcaccaactacaacagcgtctgttccaagttccgcaaggaaatcaaatccaagtcagcagacaaccaggagtactttgagcggcaccgntggcccccntgtgtggtacctgaaggaggaagaccactaccagcgtgtgaagagggaacgagagaaagaggacctggcgctgaacaagcaccattcaaggagaaagtggtgtttctggcattcgtccccagctntcncctgaggaggagagaggggaccgtcacccgctaagggccacctccactgttgacagctntactataaaaaccantntccttanccatccgcacagttggntctggggccctggcttttccantcgtgtgcatttacctccaccaggatcaaagcacaagccctgccaccaatgagcagggacataaaaggaaagctgactgantnnnnaantccttcaaccagaatntccttttggtttttttctttcttggttaggaagctactacactt

SEQ ID NO: 7353 - DNA, 459 bp, Mus musculus
  misc_feature (169)..(175): n is a, c, g, or t
  misc_feature (286)..(302): n is a, c, g, or t
  misc_feature (347)..(347): n is a, c, g, or t
  misc_feature (350)..(350): n is a, c, g, or t
  misc_feature (353)..(353): n is a, c, g, or t
  misc_feature (385)..(385): n is a, c, g, or t
aatttggcaaatatctcagattctaagaattatcttataatccagattactgaagtacagcacgcaattgaccaacttaagagaaaattggatactgataaaatgaaactcatattagaagttaagatgagaaaacaagcagtttcagatttacagacattaaaagctnnnnnnncacagaagaaaatgggtgcacctttccgacctccgatgttttctggaagtgtgccaacctagaagttcaacagatgaatattgtgtgtgataaatcagccagatgaacagnnnnnnnnnnnnnnnnnggagcattggcggctgcaatacattctgaccagatctgactttgntcntcntaagacatcacaaaaagaaagtcacaggcatntgcgatcccagtgtaattatagcaccttttgtctatgcgctttggtgaccaagctacatcaaaggttacctgtg

SEQ ID NO: 7354 - DNA, 355 bp, Mus musculus
  misc_feature (28)..(29): n is a, c, g, or t
  misc_feature (91)..(91): n is a, c, g, or t
gaggccagacaagccatgatctaccacnngctgccgcctgtgagcaagaaccatgccctggagctacacacacagctggagtacagcgtgntgagccaggaaacagagggctactcaggctccgacattaagctggtctgcagggaggcagccatgcggcctgtgcgaaagatcttcagtgtgcttgaaaacaaccagtcagagagcaacaatttacctgggatccagctggacactgtgaccacacaggactttctggatgttttggctcacaccaagccttcagcaaagaatctgaccgagagatacttggcctggcaagagaagtttgagtctgtataaagctgtgcccagc

SEQ ID NO: 7355 - DNA, 274 bp, Mus musculus
  misc_feature (86)..(86): n is a, c, g, or t
  misc_feature (88)..(88): n is a, c, g, or t
  misc_feature (121)..(121): n is a, c, g, or t
  misc_feature (128)..(128): n is a, c, g, or t
  misc_feature (134)..(134): n is a, c, g, or t
  misc_feature (143)..(143): n is a, c, g, or t
  misc_feature (183)..(183): n is a, c, g, or t
  misc_feature (185)..(185): n is a, c, g, or t
  misc_feature (189)..(189): n is a, c, g, or t
  misc_feature (213)..(213): n is a, c, g, or t
  misc_feature (224)..(224): n is a, c, g, or t
  misc_feature (227)..(227): n is a, c, g, or t
tgatctgtgggcctgtaacgcgccagagcaacatccagactctggatcggcccatcaagaaaggtccggtgcagctgatccaacantnagagatgaggcggaaaagtgacctgctccggantctgacntcaggntccagggantcgaacataagcagcaaaaagaaagctgcgaaggaaaagntntccntcgaggaagagctggagaaatgtntccaggatttnttngaagataaaaattccagatcgcttccctgagcgaaaacatccttggc

SEQ ID NO: 7356 - DNA, 112 bp, Mus musculus
  misc_feature (40)..(40): n is a, c, g, or t
  misc_feature (43)..(43): n is a, c, g, or t
  misc_feature (45)..(49): n is a, c, g, or t
gaagatgagacctgctggctacctgacgcagtatgacctntcngnnnnngagaacattggcgccattggtctagagctgtggcaggtgagatctggaaccatctttgataac

SEQ ID NO: 7357 - DNA, 588 bp, Mus musculus
  misc_feature (254)..(254): n is a, c, g, or t
  misc_feature (257)..(257): n is a, c, g, or t
  misc_feature (259)..(263): n is a, c, g, or t
  misc_feature (374)..(374): n is a, c, g, or t
  misc_feature (410)..(410): n is a, c, g, or t
  misc_feature (414)..(414): n is a, c, g, or t
  misc_feature (423)..(423): n is a, c, g, or t
  misc_feature (435)..(435): n is a, c, g, or t
  misc_feature (468)..(468): n is a, c, g, or t
  misc_feature (533)..(533): n is a, c, g, or t
  misc_feature (536)..(536): n is a, c, g, or t
  misc_feature (545)..(545): n is a, c, g, or t
cgctgaggaaaacggaaaagacatcactggactctagggactgggatcaggtggaaggcagtaaagtccaggattgggaaaagcactttctggatgcgggtgccagcaagccgagtgactggaacagtgagctggatggggactggctgcagaagccaccatatgaggatggcctgaaagctgagggcatcgacaaggacgtgtggctccaccagaagatgagacctgctggctacctgacgcagtatgacctntcngnnnnngagaacattggcgccattggtctagagctgtggcaggtgagatctggaaccatctttgataacttcctgatcacagatgatgaagaatatgcagagaagtttggcaaggcnacctggggagaaactaagggtccagaaaaggagatngatnccatacagnccaaggaagaantgaaaaaggcccgtgaagaagatgaggaggatntgctgatggggaagtttcacaggcacaaccatttcagcagattccacaggcagggcgaactatantcntcctcactntgcatgctgagtggcccagctgcaactctaataatacacattt

SEQ ID NO: 7358 - DNA, 444 bp, Mus musculus
  misc_feature (160)..(160): n is a, c, g, or t
  misc_feature (207)..(210): n is a, c, g, or t
  misc_feature (219)..(220): n is a, c, g, or t
  misc_feature (223)..(223): n is a, c, g, or t
  misc_feature (229)..(230): n is a, c, g, or t
  misc_feature (241)..(241): n is a, c, g, or t
  misc_feature (256)..(256): n is a, c, g, or t
  misc_feature (275)..(275): n is a, c, g, or t
  misc_feature (278)..(280): n is a, c, g, or t
  misc_feature (286)..(286): n is a, c, g, or t
  misc_feature (290)..(290): n is a, c, g, or t
  misc_feature (293)..(293): n is a, c, g, or t
  misc_feature (304)..(304): n is a, c, g, or t
  misc_feature (312)..(312): n is a, c, g, or t
  misc_feature (318)..(318): n is a, c, g, or t
  misc_feature (363)..(363): n is a, c, g, or t
  misc_feature (370)..(370): n is a, c, g, or t
  misc_feature (391)..(391): n is a, c, g, or t
  misc_feature (398)..(398): n is a, c, g, or t
accaggaattcagcaccaaactcgtgaacagcaaacacttgatcctccaccccaatctgctagggctgggtcccctccatgttttagtcaagttcaaaatcactgcctcaagagaagcagggggaagtgggattcgaggggtggggtggaggaggagggnaaagaagatgaggcagagacagaaatggaggcagtgaaacacgaaannnnccacgagcnnagngttatnntcataagcacnccaatagtgtgatgntctgatcaatatggcgganacnnntcattnatanaantagaggcgctntcattccntccccncaaacaccgaccccaggagttggggtgggggacccagaaccaacntagggantgggggaggggaggcaacctngggtttnttctgtgtgtgcgcgaattaaaaaccaggcctggagagcaaatatg

SEQ ID NO: 7359 - DNA, 426 bp, Mus musculus
  misc_feature (27)..(27): n is a, c, g, or t
  misc_feature (337)..(337): n is a, c, g, or t
  misc_feature (349)..(349): n is a, c, g, or t
  misc_feature (367)..(367): n is a, c, g, or t
aaagaacacttggacatgcttgcaagngaaatttcctggtactttccaaatctacccgagattccgtttgcactcgccaggagcccgttctcagtcaaagctgaagatgttcccgagactgcgcaagaagatttcaccagacttaccaacagcgacgcggcgagagctgatttctccacaatgccagtcacacagttctgggtcaagtgtttgcagtcatacccagttctgtcagagatggtgttgcgcctcctccttccttttccaacaacatatctgtgtgaaacagggttctcaagtttgttagttatcaagtctaaatacagaagtagacttntggtggaagatnatcttcgctgtgctcttncaaagaccaccccgagaatttctgatctggtgagaaagaagcagtctcaaccttcgcac

SEQ ID NO: 7360 - DNA, 522 bp, Mus musculus
  misc_feature (116)..(116): n is a, c, g, or t
  misc_feature (118)..(118): n is a, c, g, or t
  misc_feature (263)..(263): n is a, c, g, or t
  misc_feature (267)..(267): n is a, c, g, or t
  misc_feature (269)..(269): n is a, c, g, or t
  misc_feature (271)..(271): n is a, c, g, or t
  misc_feature (276)..(277): n is a, c, g, or t
  misc_feature (285)..(285): n is a, c, g, or t
  misc_feature (288)..(288): n is a, c, g, or t
  misc_feature (310)..(310): n is a, c, g, or t
  misc_feature (323)..(323): n is a, c, g, or t
  misc_feature (355)..(355): n is a, c, g, or t
  misc_feature (362)..(362): n is a, c, g, or t
  misc_feature (364)..(364): n is a, c, g, or t
  misc_feature (382)..(382): n is a, c, g, or t
  misc_feature (384)..(384): n is a, c, g, or t
  misc_feature (427)..(427): n is a, c, g, or t
  misc_feature (433)..(433): n is a, c, g, or t
tggtgtgtcagtcgcagtgttccacaccaacttccccactgtgtcccccactgtgtagcccaagatgctccggtaccctggcatgttgtccaccatcatgcccccaaaaaggatgngncaagccttgccctcccaagtgtccttctccatgcctaccccgaaagtgaggcaccatgggcaacactccaccacccccaccactggcctccattaccacctacaatgtgtgggcctggaagtgaaaccatgaactgacaaagacnttcntntnctgtnnatcacttntgntcccttggaggatttgcttttntggtggttgttanacagcattcggccaagaagcaatccgtgagantgagatntntttgaggaccccacagcntntacctgtcacctaggggaaggttcctttccaaagaatgccaantcctgntagggcaatgcatgacaccaaccttgccaccactggcctccattaccacctacaacattgtggggctggaagtgaaaccatgaactgac

SEQ ID NO: 7361 - DNA, 493 bp, Mus musculus
  misc_feature (39)..(39): n is a, c, g, or t
  misc_feature (221)..(221): n is a, c, g, or t
  misc_feature (270)..(270): n is a, c, g, or t
  misc_feature (275)..(275): n is a, c, g, or t
  misc_feature (280)..(280): n is a, c, g, or t
  misc_feature (296)..(296): n is a, c, g, or t
  misc_feature (298)..(298): n is a, c, g, or t
  misc_feature (304)..(304): n is a, c, g, or t
  misc_feature (309)..(309): n is a, c, g, or t
  misc_feature (313)..(313): n is a, c, g, or t
  misc_feature (316)..(316): n is a, c, g, or t
  misc_feature (326)..(326): n is a, c, g, or t
  misc_feature (328)..(328): n is a, c, g, or t
  misc_feature (334)..(334): n is a, c, g, or t
  misc_feature (337)..(337): n is a, c, g, or t
  misc_feature (343)..(343): n is a, c, g, or t
  misc_feature (348)..(348): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (370)..(370): n is a, c, g, or t
  misc_feature (373)..(373): n is a, c, g, or t
  misc_feature (408)..(408): n is a, c, g, or t
  misc_feature (410)..(410): n is a, c, g, or t
  misc_feature (432)..(432): n is a, c, g, or t
  misc_feature (439)..(439): n is a, c, g, or t
  misc_feature (454)..(454): n is a, c, g, or t
  misc_feature (456)..(456): n is a, c, g, or t
  misc_feature (458)..(458): n is a, c, g, or t
tgcctctcattgacaaacaagagagtgaaattacctatntggtaccatggtgcaaaataggaaagcctcccaaggaaggagtctatgaactggctacttttctgatgaaacctggtggcccagctctatggggtgaagcatttcaaagagcagtaaatgcccatgctgatcaaggctacattaaactaattggtgtgttccatgcagagtatggattgctnaacagagttcatgttctgtggtggtgtgagaacgcagacgctcgggcanctggnagacngcaagcccatgaagantnccagantcgtntctnctntccgggaaantntcaacnacntagatnttcancagaacatnttncntcattccntgntcattttcaccactgaaatagtttcctaacgactntnttaggagctgatgtgacatgtntcagggnccagtgcttcaattntntntagagaattatttcagcttttattggaaggaagtg

SEQ ID NO: 7362 - DNA, 273 bp, Mus musculus
gcctacaaatggtcctgcgctgagaccttttaccgccattggcctctgcagaagtgtcagtcagaactactcttcccagccgatcagctgtaagacttctgaaaccgtgcaggaggataaagctacagcctcgggatctccaacacaaacagattccctaaccgtgtgcggaagtgcattaggaagaggcgcggttgccataacaccagagacgaccctcaagcatcctcatctccccactgaacggaggccaaaggcagttatctctttccc

SEQ ID NO: 7363 - DNA, 435 bp, Mus musculus
  misc_feature (301)..(301): n is a, c, g, or t
  misc_feature (329)..(329): n is a, c, g, or t
  misc_feature (337)..(337): n is a, c, g, or t
  misc_feature (347)..(347): n is a, c, g, or t
  misc_feature (349)..(349): n is a, c, g, or t
  misc_feature (356)..(356): n is a, c, g, or t
  misc_feature (373)..(373): n is a, c, g, or t
  misc_feature (392)..(392): n is a, c, g, or t
  misc_feature (398)..(398): n is a, c, g, or t
  misc_feature (407)..(407): n is a, c, g, or t
  misc_feature (409)..(409): n is a, c, g, or t
ggactctgatcaggaggcagacattgaggagaagatcacagaaattagaaggcaattaaaggaagtgaacatcaagttgactcaggtcgatgcttgcgaagaagcccgtgaattgaaggagaagcttgttgaacagatagagagcttccataaggaaatgaatgtcttgaacagtaagctggagatgtactacacgcaaggatcggatgcggactcccataactctgaagacgtggacacggagcaagaagagcccctggttcccgaggcttctccgagcctgtcagcatcacccactccnccctgcagtgccgtgtggaagaacgcantgaagctnttcgtcatantntacgtgntcaccatcactggactntcgtgctacatactgtttntggacnccacgtttntnttcgaaagggtgctgcccagcgtgct

SEQ ID NO: 7364 - DNA, 357 bp, Mus musculus
  misc_feature (101)..(103): n is a, c, g, or t
  misc_feature (107)..(107): n is a, c, g, or t
  misc_feature (114)..(114): n is a, c, g, or t
  misc_feature (123)..(123): n is a, c, g, or t
  misc_feature (126)..(126): n is a, c, g, or t
  misc_feature (128)..(128): n is a, c, g, or t
  misc_feature (133)..(133): n is a, c, g, or t
  misc_feature (144)..(144): n is a, c, g, or t
  misc_feature (161)..(161): n is a, c, g, or t
  misc_feature (163)..(163): n is a, c, g, or t
  misc_feature (166)..(166): n is a, c, g, or t
  misc_feature (168)..(168): n is a, c, g, or t
  misc_feature (173)..(173): n is a, c, g, or t
  misc_feature (177)..(177): n is a, c, g, or t
  misc_feature (179)..(179): n is a, c, g, or t
  misc_feature (185)..(185): n is a, c, g, or t
  misc_feature (196)..(197): n is a, c, g, or t
  misc_feature (199)..(208): n is a, c, g, or t
  misc_feature (231)..(231): n is a, c, g, or t
  misc_feature (235)..(235): n is a, c, g, or t
  misc_feature (240)..(240): n is a, c, g, or t
  misc_feature (253)..(253): n is a, c, g, or t
  misc_feature (260)..(261): n is a, c, g, or t
  misc_feature (272)..(272): n is a, c, g, or t
  misc_feature (284)..(284): n is a, c, g, or t
  misc_feature (287)..(287): n is a, c, g, or t
  misc_feature (314)..(314): n is a, c, g, or t
tggcgcagggccctcggcgagccaaggagcgccagcctggaacagcaagcgccggcgggaaggagccagagctcgggttgaacagccagaatgagcggcgnnntgangagcatngaagggccnacncnagctntcccgattccncgaactttgtccatcananggntnactantggntnggggtnatgtcaccggnngnnnnnnnnnngtgggaagctgagcaagcctgcnagcnccttnccagaaaaatatnagggaanntacagaagaangaccctggaatntcnaaggagtggaaaagcccagatgaactntgatgaagttgcgttaaagaatcctaaagcaatagagcttttt

SEQ ID NO: 7365 - DNA, 433 bp, Mus musculus
  misc_feature (306)..(306): n is a, c, g, or t
ttccacctgcacctcagttgaaaaatcccattttgggaatatatttgtctctgttatctctgcgtagtccaaaacaaagtaaatggtaccgctgtcgtgctgcgaaggtgagaacgctagtgtcttcaaactgaaaataatatatttattattgttgctaacgtttttgggttaaatgtaagtttttatgtgttgtactcaggccttcctgggattgtaaagttagagatgattctggtgctaatttctttttgtgagtcccacggccggccgggtgcctggcagtgtctgccatactgtccctanccgcttgcatgtgtttttctagagacattttcagtgcatttctttcccaaaagttcataattttatagttcttttcaaacaattactctgagatgtaaaacagtgcattttctgtcatggcatggag

SEQ ID NO: 7366 - DNA, 480 bp, Mus musculus
  misc_feature (126)..(126): n is a, c, g, or t
  misc_feature (134)..(134): n is a, c, g, or t
  misc_feature (165)..(165): n is a, c, g, or t
  misc_feature (169)..(169): n is a, c, g, or t
  misc_feature (428)..(428): n is a, c, g, or t
ataaccttgagtcgtgtgaccttgaggatgatgaccttatgttggatgtggatttgccggaggacgcacctcttgaaaatgtggagtgtgacaatatgaaccgctttgaccgaacagacagaaatntacgacantcgcaggacggattttggaaaaggccacccnaganggtggagtggacaggaccattaccacctcagccaccctggtcactatcatcaccatggacaaagtgacttgagcagaggctctccttatagagaatctcctttgggtcattttgaaagctatggagggaccccctttttccaggctcagaagatgtttgtagatgtgcccgacaacacagtgatcctggatgagatgaccctccggcacatggtccaggattgcacagctgtgaaaacgcagttactgaaactcaagcntctgttacaccagcatgacggaagtggatcattgcatgatgttcagctctca

SEQ ID NO: 7367 - DNA, 286 bp, Mus musculus
  misc_feature (195)..(195): n is a, c, g, or t
  misc_feature (205)..(205): n is a, c, g, or t
  misc_feature (215)..(215): n is a, c, g, or t
  misc_feature (226)..(226): n is a, c, g, or t
ctggcagctgagtcagaacttctgaggagagcgtctgttcttgtctgttctcgactgactttgcagatctctgaaaacagacctgttgcttcaatcaatagtaatcctattgattaaacatcatgatgtttcccttggccagatatgcactaaactatctcaagactccaagcattctgaaaattgtgggaagantgaaacactnaaagccctcntcagaagaaantcatgacaaatacggcaatatgatgctaattagtgggactattttctgtttagctggata

SEQ ID NO: 7368 - DNA, 377 bp, Mus musculus
  misc_feature (310)..(310): n is a, c, g, or t
aagaaccatatctgaccaagtcgatggtgggtccagaggatgctggcaactaccgctgtgtgctagataccatcaaccaaggtcatgccaccgtcatccgctacgatgtcacagtattgcccccaaagcattcagaggaaaaccaaccaccgaacatcataacccaagaggagcacgagactcctgtccacgtgactccacagacaccaccggggcaggagccagagtcggagctgtacccggagctgcacccagagttgtacccggagctcatacctacagtcgctcaaaatccagagaaaaaaatganaactcgcctcttaatactgttgacccttggctttgtggttcttgtggccagcatcattatctcggta

SEQ ID NO: 7369 - DNA, 537 bp, Mus musculus
  misc_feature (199)..(202): n is a, c, g, or t
  misc_feature (204)..(204): n is a, c, g, or t
  misc_feature (207)..(212): n is a, c, g, or t
  misc_feature (216)..(220): n is a, c, g, or t
  misc_feature (222)..(223): n is a, c, g, or t
  misc_feature (225)..(232): n is a, c, g, or t
  misc_feature (234)..(236): n is a, c, g, or t
  misc_feature (238)..(240): n is a, c, g, or t
  misc_feature (243)..(243): n is a, c, g, or t
  misc_feature (245)..(247): n is a, c, g, or t
  misc_feature (265)..(265): n is a, c, g, or t
  misc_feature (274)..(276): n is a, c, g, or t
  misc_feature (313)..(313): n is a, c, g, or t
  misc_feature (336)..(336): n is a, c, g, or t
  misc_feature (339)..(347): n is a, c, g, or t
  misc_feature (349)..(350): n is a, c, g, or t
  misc_feature (352)..(354): n is a, c, g, or t
  misc_feature (357)..(357): n is a, c, g, or t
  misc_feature (359)..(359): n is a, c, g, or t
  misc_feature (370)..(370): n is a, c, g, or t
  misc_feature (381)..(381): n is a, c, g, or t
  misc_feature (383)..(383): n is a, c, g, or t
  misc_feature (391)..(391): n is a, c, g, or t
  misc_feature (433)..(433): n is a, c, g, or t
  misc_feature (466)..(466): n is a, c, g, or t
  misc_feature (472)..(472): n is a, c, g, or t
  misc_feature (512)..(512): n is a, c, g, or t
ggctgcctgcagtgcgaccagtcagtgctactggagctcaggcagttgcgtgatgccatcgtcaccaagcgcttccatctggaagggctgcaggcgcgcgcgcaggccctgctgttgagcatggaggggcctttcttcagggactatgcaatgaacgctttcgtggggaaagtggtcgtggatcaactggaaaaagtgnnnncntcnnnnnngaannnnncnnannnnnnnnannntnnntcnannncagacgttcctctgctgngaagagctnnngagcttcagggaacatgccatcaaggaactaaagggngcattaagagactatgaaatganagnnnnnnnnnannannnttntnaggatgggcanttccgcatgantntgaagttncaggacgacaacaaaccaaggaacatggtattggtgggaganttggtgactgtaggattggccatcctaaccttnttggtnatcctgattgcggcttgtacctacaggcaaaaccggaaantcctgctgaagtaggccagagactt

SEQ ID NO: 7370 - DNA, 414 bp, Mus musculus
  misc_feature (36)..(36): n is a, c, g, or t
  misc_feature (48)..(48): n is a, c, g, or t
  misc_feature (160)..(160): n is a, c, g, or t
  misc_feature (165)..(165): n is a, c, g, or t
  misc_feature (177)..(177): n is a, c, g, or t
  misc_feature (195)..(195): n is a, c, g, or t
  misc_feature (204)..(204): n is a, c, g, or t
  misc_feature (206)..(206): n is a, c, g, or t
  misc_feature (212)..(212): n is a, c, g, or t
  misc_feature (216)..(216): n is a, c, g, or t
  misc_feature (240)..(240): n is a, c, g, or t
  misc_feature (272)..(272): n is a, c, g, or t
  misc_feature (285)..(285): n is a, c, g, or t
  misc_feature (287)..(287): n is a, c, g, or t
  misc_feature (294)..(294): n is a, c, g, or t
  misc_feature (379)..(379): n is a, c, g, or t
atggctgctgctgtaaaagatgcaggcgtatcaccntgagcagatatncctatgtcaacgcacatgccacttccacaccactgggtgatgccgctgagaacagagccatcaagaggctctttagggaccatgcttgtgcccttgccatatcctccacaanggganccactgggcatnttctgggtgctgcagggncagttgagncnactttnactncactggcttgttaccaccagaaantcccaccaactttaaacctggattgtacagancctgaatttgatntnaattatnttccactggagtcacaggaatggaaagctgagggtcggtgtattggactcaccaattcctttgggtttggtggtactaatgcaantctttgtattgctggcatgtaaacactggctttta

SEQ ID NO: 7371 - DNA, 268 bp, Mus musculus
gaagtgtaacaaccgcagagaattttgccctcggagtgctctcattaagatcagccaaaacaagtatgccctgtcttgctcaatgatacactcatccctggttgagaagaacggagcaggggaggaagtagatggaagtaattcttccaacatctggactgtgactgaagaagccactgggaatttgaaacagccgagacaagagaacctcagaaaaaagagaaagaaacgcaccaagaggctccctctccaagagctgatgtgttca

SEQ ID NO: 7372 - DNA, 527 bp, Mus musculus
gagagaacccttaccatgctattagagcatgctgattcaagttctacttctggtgaaagttctagtgacacaagcagcaacttctctcaggtctagtacagtcagagatcagttccttctgtataatttacagagaatttttaaacttgcggggaaagatgtacgacctagattgtatagggagaagggagcgtcttagctgcatagttctaatttgtataagcaccatgccatgtttttcattgtttgccctttatatatgaaaatacttacacttaaaagcattgttgtttagtttcaaaatctcaacttaataccattcacaaatttaataagagcgttgtcataacataaaactaattgggaaataatcccatctatctgtacagttatctggaatagtaaaacatgcgttttctaagcttctaccttttaaacagctttcttctaattactccctttgtacctttccatttctcagtaaaattacatgctctatgtggagttgtttactttatagttgccaa

SEQ ID NO: 7373 - DNA, 99 bp, Mus musculus
  misc_feature (46)..(46): n is a, c, g, or t
  misc_feature (48)..(48): n is a, c, g, or t
tttagacaccaatcaaattgctgggaagagtattccgagagcaacntnttagcctgtagagtggcctgggctgaactgggtttgaaaacatgccaagag

SEQ ID NO: 7374 - DNA, 454 bp, Mus musculus
  misc_feature (208)..(208): n is a, c, g, or t
  misc_feature (210)..(210): n is a, c, g, or t
  misc_feature (222)..(222): n is a, c, g, or t
  misc_feature (227)..(227): n is a, c, g, or t
  misc_feature (235)..(235): n is a, c, g, or t
  misc_feature (237)..(237): n is a, c, g, or t
  misc_feature (240)..(240): n is a, c, g, or t
  misc_feature (242)..(242): n is a, c, g, or t
  misc_feature (247)..(247): n is a, c, g, or t
  misc_feature (252)..(252): n is a, c, g, or t
  misc_feature (259)..(259): n is a, c, g, or t
  misc_feature (266)..(266): n is a, c, g, or t
  misc_feature (268)..(268): n is a, c, g, or t
  misc_feature (286)..(286): n is a, c, g, or t
  misc_feature (303)..(303): n is a, c, g, or t
  misc_feature (305)..(305): n is a, c, g, or t
  misc_feature (315)..(315): n is a, c, g, or t
  misc_feature (321)..(321): n is a, c, g, or t
  misc_feature (323)..(323): n is a, c, g, or t
  misc_feature (325)..(325): n is a, c, g, or t
  misc_feature (332)..(332): n is a, c, g, or t
  misc_feature (337)..(337): n is a, c, g, or t
  misc_feature (366)..(366): n is a, c, g, or t
  misc_feature (373)..(373): n is a, c, g, or t
tttacggacagggaatccgccaagacactgatgccgccctgcactgcttacgggaagcagctgagcgagggaatgtctatgcccaggggactcttgtggaatactactacaagatgaagttttttaccaagtgtgtttcgttttccaaaaggatagcagactatgatgaagtccacgacatccccatgatagcccacgtcacggactntntcccagagtttntcatnaaaggcangnccntnggcgnctttntaccacnggcgctntntccagctgggcttaggcntcatgaaagacgaagantntgccaagcantactantntnaagcttnccttntgaaccctacattggcagatgaacttcantccttantcattcaccagagaatttagaccacagtgcattctgtcaaagaacttaaactacaaagcatttcaacaaagaccatcaatt

SEQ ID NO: 7375 - DNA, 319 bp, Mus musculus
  misc_feature (288)..(288): n is a, c, g, or t
tctgatagtgagtgcaagcttggatggtgacaagagtcagaaagacaaagtgtcctctgaagaccagggtgaggaggagtatgaagaacactttgaggcttcatcagagggtgagcagtggcaggagatagatatggtccagcaagaagacacgatctcccaggcaataactctccaggaccacctccttgacctagccttctgcttcaacctggccagcatcatgttttttttatgagagactttgaggtggaggcagtagtctggatccttcatgaggacttaganatccacttccccttcctgattgcttactgac

SEQ ID NO: 7376 - DNA, 478 bp, Mus musculus
  misc_feature (235)..(235): n is a, c, g, or t
  misc_feature (237)..(238): n is a, c, g, or t
  misc_feature (250)..(250): n is a, c, g, or t
  misc_feature (255)..(256): n is a, c, g, or t
  misc_feature (266)..(266): n is a, c, g, or t
  misc_feature (269)..(269): n is a, c, g, or t
  misc_feature (272)..(272): n is a, c, g, or t
  misc_feature (276)..(276): n is a, c, g, or t
  misc_feature (278)..(278): n is a, c, g, or t
  misc_feature (284)..(284): n is a, c, g, or t
  misc_feature (289)..(289): n is a, c, g, or t
  misc_feature (303)..(303): n is a, c, g, or t
  misc_feature (307)..(307): n is a, c, g, or t
  misc_feature (319)..(319): n is a, c, g, or t
  misc_feature (330)..(330): n is a, c, g, or t
  misc_feature (342)..(342): n is a, c, g, or t
  misc_feature (344)..(344): n is a, c, g, or t
  misc_feature (346)..(347): n is a, c, g, or t
  misc_feature (361)..(361): n is a, c, g, or t
  misc_feature (364)..(364): n is a, c, g, or t
  misc_feature (391)..(391): n is a, c, g, or t
  misc_feature (406)..(406): n is a, c, g, or t
  misc_feature (424)..(424): n is a, c, g, or t
  misc_feature (426)..(426): n is a, c, g, or t
  misc_feature (435)..(435): n is a, c, g, or t
  misc_feature (437)..(437): n is a, c, g, or t
aggtgttccaggaggtcacactcggccatccaggaggtcaaggaagcccccggcctggcttgggtgctatccacgccgccaggccaccatggtccttggctggccactgcttctggtgttggttctttgcccaggtgtgacaggcatcaaggactgcgtcttctgtgagctgactgactctgctcggtgccctggcacacacatgcgctgtggggatgacgaagattgcttcacngnncacggagtagcncaggnngtggggcccntcntcnacanangctgcntgcantccaccagctgtgnccgngaggaacccatnagctacatggncctcacatacantntnnaccaccacctgctnttntggccacctttgcaataagggcactgncctttccacaggggntaccagcctgtcactggntntgcagctgntnctgggcctgttgctgctgcttcaatactggctgtgacccac

SEQ ID NO: 7377 - DNA, 462 bp, Mus musculus
  misc_feature (182)..(182): n is a, c, g, or t
  misc_feature (203)..(203): n is a, c, g, or t
  misc_feature (210)..(210): n is a, c, g, or t
  misc_feature (228)..(228): n is a, c, g, or t
  misc_feature (238)..(238): n is a, c, g, or t
  misc_feature (244)..(244): n is a, c, g, or t
  misc_feature (249)..(249): n is a, c, g, or t
  misc_feature (251)..(251): n is a, c, g, or t
  misc_feature (270)..(270): n is a, c, g, or t
  misc_feature (275)..(275): n is a, c, g, or t
  misc_feature (277)..(277): n is a, c, g, or t
  misc_feature (287)..(287): n is a, c, g, or t
  misc_feature (290)..(290): n is a, c, g, or t
  misc_feature (304)..(304): n is a, c, g, or t
  misc_feature (310)..(310): n is a, c, g, or t
  misc_feature (341)..(341): n is a, c, g, or t
  misc_feature (347)..(347): n is a, c, g, or t
  misc_feature (349)..(349): n is a, c, g, or t
gatgggaacatctagcccctaaccatgggcccagaaaagtctacggccatgacagaaacatctgcggctgtgcgcatccaagcatggtggcgtggcacactactacgacgcacgttgctgcatgctgccctcagcgcgtggatcattcagtgctggtggagaaagataatgataatgttgcnagggaagaaacggcggatggntctgganttatacgctcgaaaaacntgggcaatantcaaantgcantnctggttcaggatgtggcanatacntnatcgatactntcntttgctgaatgctnttcgcntcatccaggtttattggcgttggcatagttntcacantngtggctttattcagggcaactatgaaatcaaagaaaaccgactgaatattcaacttgagatttccctgggctcacaggcttgtaaggtggaacagtgcataaccctaccaata

SEQ ID NO: 7378 - DNA, 274 bp, Mus musculus
gttccgagacgcgacacggcagataagtaatgaaagaggatttgagaatgtagaactgggcgtcatggggaagaagaagaaagtcccgaggagggtcatccactttgtcagtggagagacaatggaggagtacagcaccgacgaggacgaggtggacggcctggacaagaaggacgtgctgcccactgtcgacccgacaaaacttacctggggcccctacctatggttttacatgctgcgggccgccacatcaaccctctcagtgtgtgacttt

SEQ ID NO: 7379 - DNA, 587 bp, Mus musculus
ctcgcctctaactctgaaatgaaatctctaatagctgagtgggctgtgacgtggagaacagtaagcaagagattcggattcgggcataacctgaaccaaaggagccaaagccccagagaaaaggctgaaggggcttagtgaggacaaaataaaacagcagacacatttgtacaggtctccctgcccctcagaacagaacaattatgagataagagaggcacagatgggaggaaattctttcatttttcacattgcaagctagagagctccaataggctgtttatgaagaacaataaagaaggcagtgcactcagtaaagaggttgttacaaatgtatcgggtggttttgaaaaggcagggttttctcccggcttttggataaagctgtcagctgagtattaaaggattttctttttctttctctgtctttttttccttcctcttgttttttttttctttcttcttcccccaaagcaataaacgacaccagtggtttgttacaattggcagaaagagttatcattttttctttaggatttggaaatgcaatcaaagacgggcagattggagcccgaattaaatgaagc

SEQ ID NO: 7380 - DNA, 560 bp, Mus musculus
  misc_feature (172)..(172): n is a, c, g, or t
  misc_feature (228)..(228): n is a, c, g, or t
  misc_feature (244)..(244): n is a, c, g, or t
  misc_feature (271)..(271): n is a, c, g, or t
  misc_feature (446)..(446): n is a, c, g, or t
  misc_feature (529)..(529): n is a, c, g, or t
acagacagtgtttacgtgcctttacattcataatcccgacttcatagaagatcctgccatgaaagcttttgctctgggaatcttgaagatctgcgacattgcacgggaaaaagtaaataaagctgctgttttcgaagaggaagatttccagtcaatgacatacggatttaanaatggccaacagtgtgacagatctccgagttacagggatgctaaaggatgtggaangatgatctgcaaaggncgagtaaagagtactcgaagtcgacanggagaagagagagatccagaggtcgaactagaacaccagcagtgcttggcagcattcagcagagtgaagttcacgcgagtgctgctcacagtgctcatagcctttactaagaaagagaccagtgctgttgcagaggctcagaaactgatggtccaggcggcagaccttctttctnccattcacacctcattgcaccacggcatccaggctcagaatggcactaccaaaggagaccatccaattatgatgggttttganccccttgttaaccagagattacttccaccca

SEQ ID NO: 7381 - DNA, 440 bp, Mus musculus
  misc_feature (160)..(160): n is a, c, g, or t
  misc_feature (391)..(391): n is a, c, g, or t
aaaaaggtctttggcactcatctcatgcaagacatggtgaaagatgctctgcggtccttcgtcagtcctccggtgctctcccccaagtgttgcctatataataatcaccaggctaaggactgtatcgactcctttgttactcactgtgttcggccgtttngtagtcttgttcagatccatggccataacagggctcggcagagagacaagcttggtcacattcttgaggagtttgctaccttgcaagatgaggcagagaaggttgatgcagcgcttcatactatgttgttgaaacaggagcctcagagacaacatctggcctgcttaggaacctgggttctttaccataacctccggattatgatccagtatctgctcagtggctttgagnctggagctgtacagcatgcatgagtactactacatctactggtacctct

SEQ ID NO: 7382 - DNA, 519 bp, Mus musculus
  misc_feature (341)..(341): n is a, c, g, or t
  misc_feature (362)..(362): n is a, c, g, or t
gggccttgtgtcatcgactacattacagaaagtggatgtgctgtcctcagagataacacgggaaccagactcaaacgacctatcaaaatgtcccaccttaggccctatgtgagagagtccagtgagcaggacagtctttatctcttgcaaggttcgatagtggcagatcacgactacattggattacctgagatcccagttggaacataccaggcaaatattctggtagaagatgcaactattgggatagctgataatgaactattgatatcaagcaaggatcatgaactcttagaatatagaaattccaaaatctctgcattggtagaagaccacagttntcttgagaaacagacttttancctactggattcttcaaatcaagttctcgagtacttaagttagtaaataccaaaattaatgtaaaatgcttgcacagaatgtatatatttctagtttgtaagtattttatctattaaaataggttgtatagaagagagatcttggtactatgttaat

SEQ ID NO: 7383 - DNA, 375 bp, Mus musculus
  misc_feature (281)..(281): n is a, c, g, or t
  misc_feature (304)..(304): n is a, c, g, or t
  misc_feature (321)..(321): n is a, c, g, or t
  misc_feature (326)..(326): n is a, c, g, or t
aagacgggcatctgcggaggctcctaagtaataaccgcacttagcaagcttctgtgccctacatcagaccccagtttacctcaaggagacagtgataggcagacatctgttgtctggcttcaaaacaccacatcagatgttacatgatttccatccagcagttacttaaagaaacaaatgtccctttattttctaagccattcaatgttggcttctcagcatcatctagttattggaaaggaaatgttaaatttgtaagtaaacatagccattctcttctnccttttctttattattatttttnaactatttaaaacgaanccatntatattgtatcacttttgtttgtctgggtttttcattgtttctttctgt

SEQ ID NO: 7384 - DNA, 539 bp, Mus musculus
  misc_feature (50)..(50): n is a, c, g, or t
  misc_feature (366)..(366): n is a, c, g, or t
acagcgatgcttctgatcttcacaaattagaaaataagcatagatggccnaaaaaggaagatgacaatttcacaatatgcagaaaactcacatatcctttagagaccctttgcagtagcccagaaagtataaatacatcgaaagagatgccttgcaggcctagcaataataacttaacaccaagttcttctggtgatcatgaaggtagttacaatgcttctgctgatctttttgattatattgctaacgataaggacattggaacagaaattaccaaaataccacaggataacttgttaccactggaagtaccttgcacagaaaattatcctataaatgagaaccgtggccagccttcacaaaaanttatccttgcaaagcatatcaccctcaaggtattcaagaccaaggtctcagtcagactcagaatgtgattttgaagaaagccaagactttgttccatgttcacagtcaactccagttgcaggcttccaccaaagaattcatggcttaaatggtgcttccaaaatactgccttc

SEQ ID NO: 7385 - DNA, 516 bp, Mus musculus
  misc_feature (313)..(313): n is a, c, g, or t
  misc_feature (316)..(316): n is a, c, g, or t
  misc_feature (330)..(330): n is a, c, g, or t
  misc_feature (373)..(373): n is a, c, g, or t
  misc_feature (388)..(388): n is a, c, g, or t
  misc_feature (399)..(399): n is a, c, g, or t
  misc_feature (417)..(418): n is a, c, g, or t
  misc_feature (424)..(424): n is a, c, g, or t
  misc_feature (435)..(437): n is a, c, g, or t
  misc_feature (440)..(440): n is a, c, g, or t
  misc_feature (442)..(442): n is a, c, g, or t
  misc_feature (447)..(447): n is a, c, g, or t
  misc_feature (461)..(461): n is a, c, g, or t
  misc_feature (463)..(463): n is a, c, g, or t
  misc_feature (467)..(467): n is a, c, g, or t
gtcccactcacttacatgataatttcaagagatgtaatgttgatcgctgctgtgttttatgtcagataccgaactctgccaacaccgcgaacactagctaagtacttcaatccttgctatgccacggctaggttaaaaccaacattcatcagcaaggtaaatacagcagtccagttaattttggtggcagcttctttggcagctccagttttcaattatgctgacagcatttatcttcagatactatggtgttgcacagcattcactacagctgcatcagcatacagttattatcactatggtcggaaaactnttncaggtgataaaggncaaatgagaagcacccagatccagcagcaaggaagcaacttcntcatcggcagcagcnccagcgaaagntacaggactttcctgatnnttggtnttcagcttgcnnnaangntcttntcagacaaaccatntnttcnaaactgaagaaatgtacggcgaaaataagctcgatcatgggcctataca

SEQ ID NO: 7386 - DNA, 405 bp, Mus musculus
  misc_feature (258)..(258): n is a, c, g, or t
  misc_feature (261)..(261): n is a, c, g, or t
  misc_feature (263)..(263): n is a, c, g, or t
  misc_feature (266)..(266): n is a, c, g, or t
  misc_feature (314)..(314): n is a, c, g, or t
  misc_feature (316)..(316): n is a, c, g, or t
  misc_feature (333)..(333): n is a, c, g, or t
aactcacgtgcaaagctgaaagcgctgactggatctagagagcgtcagctacacagaacgtcaagtcaaggatccaaagggaacaagctggtgtcacacggggctgagacaccactgtttataagaagaaacaagaagcaaacacctgttacagaatatctcaatccagagtctcctctagggtccaacagtgtggcgagcagatcaccaaatccggggtcagccaggagtgcacaaggctacagccctcaaagagtnttntntcnttaacacagcaaaccagggtcagccaggagtgcgcaaggccacagccntncaaagagttttctatgnttaacacagcaaaggtagagatgagtgctgggtggttctttcacaaagatgggcttcacactgacagaacat

SEQ ID NO: 7387 - DNA, 371 bp, Mus musculus
  misc_feature (155)..(182): n is a, c, g, or t
  misc_feature (318)..(318): n is a, c, g, or t
  misc_feature (327)..(327): n is a, c, g, or t
tgggaccgcatgttcgagctggcccggcatctgcagatgctgggcatttccggcggcggcagtagcaaccggcgaaacagcccgagcggcaggttcaccactctggacaccggtgagtgagggaagggcagattcgcccggagcgagcgcgcgannnnnnnnnnnnnnnnnnnnnnnnnnnnctcaaccgacccgtcccggagccggcgctgggtgctaccctccggcttgccgaggcagttaggaaagtcgtctgtcccaagagaaaaatcgctttgcagattgggtgtttgaagagaagagagagaaagagaaaantttgtgctntctgccttttaaggtcacgtgggtaaccctaccctgaaatggag

SEQ ID NO: 7388 - DNA, 417 bp, Mus musculus
  misc_feature (318)..(318): n is a, c, g, or t
  misc_feature (359)..(359): n is a, c, g, or t
  misc_feature (378)..(378): n is a, c, g, or t
  misc_feature (392)..(392): n is a, c, g, or t
ttaaatgctctcaaggctgccaaggccagtgacctggtacacctgcaagacctggcaaagatgatccgggagtacgagcaggtcattattgaggaccggatagaaaaggagaagacccggaagaagctggagcaggatgacctggagctgaggagcatcgtgaagctccaggcctggtggcgagggtcagtggtccggaaggaaattggcaatttcaaaatgcccaagaaagataaagatgacagcaaagactcgaaaggcaaggagaaggagaagaggagaaagaagtaaccagtttctgctgagccttctcaggcntcgagacactgggggtgctgacccagcgcccacctcctggntcacagacctagggagttntcactgtctgatantctagttttcacaccccagtgaggg

SEQ ID NO: 7389 - DNA, 532 bp, Mus musculus
  misc_feature (348)..(348): n is a, c, g, or t
  misc_feature (375)..(375): n is a, c, g, or t
  misc_feature (442)..(442): n is a, c, g, or t
  misc_feature (445)..(445): n is a, c, g, or t
  misc_feature (447)..(447): n is a, c, g, or t
  misc_feature (473)..(473): n is a, c, g, or t
  misc_feature (503)..(503): n is a, c, g, or t
gagatttgtgccctggaattgtcacactactcgggaaaggacttctcaagatgtggtcactgaaataccccaggagaaatcacccttccagcccaccacctctgcagaattttaccgtgattggcggcgacacttaagaagtgggccagagcgctaccaggccctacttcagcttggggggcccaagctgggccacctcttccagatggatgtgggctttggacttcttggggagctgctggtggcattggctgagcacgcgaggctgagcgaccggacagcagtgctggggattctgcacagcctggctaacactgggcggttcaacttgaacctgagcctgctganccatgcagagcgagagagctgccagcncctgtttcagaagttgcaagccatgagcaccaccagacccatgcaggagggcctcactgtggagganccntntgctgggctacagggagaagaagggntcctacaggagctgctagaactgtatggantccattgataggactgtttgccctcagca

SEQ ID NO: 7390 - DNA, 318 bp, Mus musculus
cgactgatggagctaatgattggatggaaaaagaaactgcaagtgaggcagagtcccatgctgttctgctcactgctgtggaatcgaggtatgactttattgtcactgcctcagaaactgacaacgtcatggaggaatcacatgtgaacaccacagatttgcctgaaaacgagacaacagagtctgtcactaatgtcacagaggagcttccttcagtgacctctatagtagatacccttaaggacaaggaggacttatctaccaccaactccggtctcttcaaactgctgaaagaagaaccagacgatctcatgatgt

SEQ ID NO: 7391 - DNA, 338 bp, Mus musculus
gatgtgcaccacaggaacaccttgaatgatgtgctcttctttcatttcctccagcacgtgactaacctgaacaagtcacagatcgggatgatatttgacctcctggactggacagctgtaggagagattggttttgaccagttctatgtgttgatttgcatactgctggcacatcaggaccatctggaagaccactttatgtaccgccattcccggccagtctttgagctgcttgatctggacggggagatgaatataggtgcggccaatttccaaaactacagatttctcttcaatattaaaaagcaggaactccgagaccttttccatgactttga

SEQ ID NO: 7392 - DNA, 523 bp, Mus musculus
  misc_feature (331)..(331): n is a, c, g, or t
  misc_feature (347)..(347): n is a, c, g, or t
  misc_feature (372)..(372): n is a, c, g, or t
  misc_feature (438)..(438): n is a, c, g, or t
  misc_feature (462)..(462): n is a, c, g, or t
  misc_feature (482)..(482): n is a, c, g, or t
  misc_feature (497)..(497): n is a, c, g, or t
ttcagtattacgacatttcagccaaaagcaactacaactttgagaaacccttcctctggctctccagaagactcactggagactctaacttggagttcgttgccatgccggctctagccccacctgaggtggtcatggacccagccttagcaaagaaatacgagcatgacttggaagtggcacaggccactgctctccccgatgaggatgatgacttatgagaaagtgaggcttgggtggcatcacaagcctaagcgtacaggcaactgcgctgtaatgtcacctgtgtgtcctgtgtgtcatcttgctacctaactacgcagactcagantccgtgtcagtggtanccaaacagaaggcttcggggtgaanccttcggactgtggcagttacaaacacaccttccatctgggatttgcaggtttagctgtttgtttnttccctgaggttcaaaactaaggntcctgcagttacaacctgtntcctgtggcaaaatnttggcactgtaatttcatcccttttg

SEQ ID NO: 7393 - DNA, 407 bp, Mus musculus
  misc_feature (184)..(184): n is a, c, g, or t
  misc_feature (225)..(225): n is a, c, g, or t
ggaactgctctcaagtggaaactcaggcagaagggttcctagatggctcattctgtctatgtctagctcaagtcacaattattagcagaggctgagaagaagcagacagtctctagtcctttgtgagaatctctgaggttttaactgctcacattttcctcccaccttcctccttttttccccnctaaagacaatcaggggcttgccaggatgggactccaggcngcttccagcaccatccttagccctctctccagtaccctctctttggaagtaatgcactttgtttaatgtattttgcctttaaaaaaaaacaaaagaaacaaaaaacaagttgcttgtttggaacaaaatgagatgctttcggcactgtatcattcctgcttgctgtttttcctcttaattta

SEQ ID NO: 7394 - DNA, 258 bp, Mus musculus
gggcagctccgcttgctggcatcgtctggggctttgccatagccgaatctttgatgtcctcctacctcgggactggtcatccatgccagggagaggagtcccaaaccttctcaccttctacagaaaaccgtcaaggaagtactgcgctccccgtaactctcgtgcttcaagctctcggaactgttgctgtggctctgggggccttgggagttgcctacttcatggctgaatccttgtgaattggaccccaggcccacc

SEQ ID NO: 7395 - DNA, 218 bp, Mus musculus
attagcaaacagttccccacatatctgaaaaatccaaccactgggcaaacaccatctcaaacatttcttccttcccttcctcataagaacattatttgtctcactggaagggaaagcccacatatctatgaaaaagatcatattggtcagagtcaaaagacaagcagaggttacgaacatataaactataacacaaggaaatctcttggttctagatt

SEQ ID NO: 7396 - DNA, 544 bp, Mus musculus
  misc_feature (270)..(270): n is a, c, g, or t
  misc_feature (273)..(273): n is a, c, g, or t
  misc_feature (276)..(276): n is a, c, g, or t
  misc_feature (280)..(280): n is a, c, g, or t
  misc_feature (282)..(282): n is a, c, g, or t
  misc_feature (284)..(284): n is a, c, g, or t
  misc_feature (289)..(289): n is a, c, g, or t
  misc_feature (311)..(311): n is a, c, g, or t
  misc_feature (315)..(315): n is a, c, g, or t
  misc_feature (341)..(341): n is a, c, g, or t
  misc_feature (352)..(352): n is a, c, g, or t
  misc_feature (361)..(361): n is a, c, g, or t
  misc_feature (382)..(382): n is a, c, g, or t
  misc_feature (384)..(384): n is a, c, g, or t
  misc_feature (387)..(387): n is a, c, g, or t
  misc_feature (407)..(408): n is a, c, g, or t
  misc_feature (410)..(412): n is a, c, g, or t
  misc_feature (423)..(423): n is a, c, g, or t
  misc_feature (427)..(427): n is a, c, g, or t
  misc_feature (434)..(434): n is a, c, g, or t
  misc_feature (519)..(519): n is a, c, g, or t
atgagatcttcttttcaggcctccatccttcctggcccacctttagtactgaggaattacagcagaaaacatgaagaattggtgcttgctgacttgcctgggattgtaagttgtatcctggtactctgagcctcatggatttgggaagggaaattctccctcaatggaacgacttccatccaagactgttctgctcttcatctccagaaagaagcaaaggacctcaaatctcagcatgtacaccagtaggatcaggctgaacagtttcangcnttntgtntnantcctnagagccaccatacaaggtacantctnttttttgaacaaatggcacaattgantcatggtgaantcaaccttntggataagaagaaggattaantntgncccttggtagagcactgatnntnnntatgatcaagncccntggatcnaactatgggaaatgaaaaagaaatttcaaacataaagacacacacaaacaatttagaactaccaatgcagctactttcaacttcnctgtaccttcctgaaatgtttcaaa

SEQ ID NO: 7397 - DNA, 547 bp, Mus musculus
  misc_feature (340)..(341): n is a, c, g, or t
  misc_feature (360)..(360): n is a, c, g, or t
  misc_feature (384)..(384): n is a, c, g, or t
  misc_feature (389)..(389): n is a, c, g, or t
  misc_feature (400)..(400): n is a, c, g, or t
  misc_feature (403)..(403): n is a, c, g, or t
  misc_feature (442)..(442): n is a, c, g, or t
  misc_feature (446)..(446): n is a, c, g, or t
  misc_feature (457)..(457): n is a, c, g, or t
  misc_feature (509)..(509): n is a, c, g, or t
atgagacccatctttcttcagcatagagaagatgaatcactagactatgcacgtagcagtaaaggggcttgatacagccaaactttggctcagaccctctggccaggcccatttggataatgtgcctgcttttgcacagttgtcagtcttatcagcaagtgtcctgtgagcaaaaaaaccaagaagactcctccagtaagagtaaaagatgcttgtgactgtctgcagttaaggtagtagagttctcataacttgggccttcatttctccaggcccagctgtcccctggctttggcagtggcatattgatgggactgtctgttctagaaaacacatgctnngatgttagaaaggatgagntctcagcttccatagtgatatctnttttngagcccttacntgngggcctagtaccaaatcaggccatattcacagatggttntttnttccccaccantgataatcaggcctttctttattttattcatattactgttgttgatagagtntcatgtttcccaggcaggcacagagtcatgatccttct

SEQ ID NO: 7398 - DNA, 568 bp, Mus musculus
  misc_feature (277)..(277): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (291)..(291): n is a, c, g, or t
  misc_feature (298)..(299): n is a, c, g, or t
  misc_feature (339)..(339): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (378)..(378): n is a, c, g, or t
  misc_feature (388)..(388): n is a, c, g, or t
  misc_feature (391)..(391): n is a, c, g, or t
  misc_feature (408)..(408): n is a, c, g, or t
  misc_feature (414)..(414): n is a, c, g, or t
  misc_feature (417)..(417): n is a, c, g, or t
  misc_feature (494)..(494): n is a, c, g, or t
  misc_feature (540)..(540): n is a, c, g, or t
  misc_feature (542)..(542): n is a, c, g, or t
ggcagattgcagtacggccttcagccagccaaccctactgaggagggcctggctagcctgcatagtgtgctgtttcgaaagcaaccattcctgtggcgcgccgccctgctctactacaccatccaccaggcggcgcacatgtccttccgccagctcttccaggatctggcgcagtacgtgcaggacgagggtgtacgctgggagtactgcgtccgtgccaagcgaggacagacggatacctcccagccaggctgcttcagcaaggaccaggtgtacntggntgncnttttncgcatcnnacggcaccggcacaccattgatttccagctgctgacctcnctggncnagntctcctatgaagacgtggaacaactgcgnccctacgggntgntagacaataccagagtnccccanttnatgaaggacttggaacgttaccggcagcagctggaacacatcatgaccaccaaccggctggatgaagcggagctggnccgcctgctgcctgactgatgttgactaagggttatagacagacgntnttgacagaggtcacagatcggaatat

SEQ ID NO: 7399 - DNA, 501 bp, Mus musculus
  misc_feature (277)..(277): n is a, c, g, or t
  misc_feature (283)..(283): n is a, c, g, or t
  misc_feature (306)..(306): n is a, c, g, or t
  misc_feature (310)..(310): n is a, c, g, or t
  misc_feature (322)..(322): n is a, c, g, or t
  misc_feature (324)..(324): n is a, c, g, or t
  misc_feature (337)..(337): n is a, c, g, or t
  misc_feature (364)..(364): n is a, c, g, or t
  misc_feature (368)..(369): n is a, c, g, or t
  misc_feature (371)..(371): n is a, c, g, or t
  misc_feature (388)..(388): n is a, c, g, or t
  misc_feature (400)..(400): n is a, c, g, or t
  misc_feature (411)..(411): n is a, c, g, or t
ttcttatgactatcctggctatgatttttatgaacggtaactctgcttctgaggaagacatttggaaattcctgaattatatgcaagtgtacccagggaggaagcattttatttatagagagccacggaagctcatcactcaagatttcgtaaaactgaagtacctggaatacaagcagatatcccttagtgatcctccatgctatcggttccaatggggtccaaaagcttatactgaaactaccaagatgaaagtcctagaatttatggctaaagncagtgncgttgaacctagtactttttctntacnatatacagaagntntgagagaagaaantcaaaagaccaagataagaaaatggtntccnntnctggcacaaaaacattntccaggacatanccatcaacatntccagaaggttatgaaacctcaataaattatgagacattaccttcggaaaagaaattataacatcacgtttgagattttctttgaagcaa

SEQ ID NO: 7400 - DNA, 315 bp, Mus musculus
acagaaaacatacccgaagcattagatgaaattctagcccaagagattttggagcccaaaacatcagcagtgtctgaaacatcaccacgaccaagatcatcgatactgacaacagtacaaaccaaggaaataaatgctggtattgatgaaaactaccaagaggaagcctttgagaactaccatgaggtcctggagaacatagaacacttgcctacaaaggaggaaagtggcaaaaatgacagaagcacggttgcaaaccttcatgaccacagctctcagactaagcatgagccaccctcgtctcctgaaggaaag

SEQ ID NO: 7401 - DNA, 464 bp, Mus musculus
  misc_feature (293)..(293): n is a, c, g, or t
aaaatttggtttggcgcttgtcatagaaagctctcagcagagtggaggatacgtccttggctttaaaatagaccctgtggaaaaactacaggaatcagttaaagagatcaactcacttcacaaagtctattctgccagtccaatatttggagtgaattatgaaatggaagaaaagccacagccacttgaagctctgactgttgaacaaattcaagatgatgtggaaatagactctgatgaccacacggatgcttttgtggcgtattttgctgatgggaataagcaacaagatngtgaacctgtattttcagaagaactggggcttgcaatagagaaactgaaggatggattcacactgcagggactttgggaagtgatgagttgatcttgagttgttggattcacactgcagggactttgggatgagttaatcttgaatgagttgagctggacctctatttaaa

SEQ ID NO: 7402 - DNA, 462 bp, Mus musculus
  misc_feature (265)..(265): n is a, c, g, or t
  misc_feature (267)..(267): n is a, c, g, or t
  misc_feature (274)..(274): n is a, c, g, or t
  misc_feature (279)..(279): n is a, c, g, or t
  misc_feature (292)..(293): n is a, c, g, or t
  misc_feature (306)..(307): n is a, c, g, or t
  misc_feature (312)..(312): n is a, c, g, or t
  misc_feature (320)..(320): n is a, c, g, or t
  misc_feature (324)..(324): n is a, c, g, or t
  misc_feature (326)..(326): n is a, c, g, or t
  misc_feature (328)..(328): n is a, c, g, or t
  misc_feature (334)..(334): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (372)..(372): n is a, c, g, or t
  misc_feature (378)..(378): n is a, c, g, or t
  misc_feature (386)..(386): n is a, c, g, or t
  misc_feature (400)..(400): n is a, c, g, or t
gggttggacaacaggatggcatcctgagaaagtcaatgaaggctacagttggtcgatggtgaaagagatggactacatatgcagcgagctaacccagccggtcacgttccctgtcagggcagctttagtgaggcagtcgtgtcctcagttgctctggctattgacaaaatcaaacaggtacagcttaactgtttggactggaaaagatgacatttattcccactgaggatttactttacattcgagactactttaataaaacccnanttttctntgatntttcagaaccacnnaaccatgaatttnnacaanccattggnattngngnccattntctaagaatatanttnttaatnttatatatatatatanatatanatatatanatatatataatttnttctaaatcatgttctctttggtttcctttgctttttgctgctttggtctcaatcaatggct

SEQ ID NO: 7403 - DNA, 489 bp, Mus musculus
  misc_feature (456)..(456): n is a, c, g, or t
  misc_feature (461)..(461): n is a, c, g, or t
agagcaggctctggcatccaaacagctccagatggatgagatgaagcagacgctcgctaagcaggaggaagacctggagaccatggccgtcctcagggctcagatggaggtgtactgctcagattttcacgctgagagagcagcaagagagaagattcatgaagaaaaggagcagctggccttgcagctcgcgattttgctgaaagagaacaatgacattgaagagggaggcagtagacagtccctgatggaaatgcagtgccgacacggggcaagaaccagtgactctgaccagcagacttacctgtttcaaagaggagccgaggacaggagctggcagcacgggcagcagcctcgcagtattccgattcactcctgccccaagtgcggggaggtcctgccggacatcgacacgcttcagatccatgtgatggactgcatcatttgagtgttctntccantccccaaagctcttggtaaatgccagat

SEQ ID NO: 7404 - DNA, 170 bp, Mus musculus
  misc_feature (130)..(130): n is a, c, g, or t
catttattaatgatgcaggcttactaaaatactaccaaaagtacagagcagacaaaagttctgtacagtggctataagagctgtctgagaaaagaacaaagggagttttgtgtttgtttttttcctactnttttatttatagagaaggaaaactgcagaaccttagccaa

SEQ ID NO: 7405 - DNA, 265 bp, Mus musculus
  misc_feature (101)..(101): n is a, c, g, or t
gattctttcactaatacacttctaaagatttattctatctctcaataatgaagttttcatttactctagatcaccaaactaccttttaaaataaaaaatanagcgaacaactgtattcttcagatgtttttaagggggttaacatgagggaggagcttgggaaagaccatcttttgtttatttgtactgtttataatgtgtaaccaaaacacagcatcattcccactccctcaggaaaaagtttagtaagaaagacactgtttat

SEQ ID NO: 7406 - DNA, 515 bp, Mus musculus
  misc_feature (239)..(239): n is a, c, g, or t
  misc_feature (373)..(373): n is a, c, g, or t
  misc_feature (379)..(379): n is a, c, g, or t
  misc_feature (386)..(386): n is a, c, g, or t
  misc_feature (391)..(391): n is a, c, g, or t
  misc_feature (409)..(409): n is a, c, g, or t
  misc_feature (454)..(454): n is a, c, g, or t
  misc_feature (473)..(473): n is a, c, g, or t
  misc_feature (475)..(475): n is a, c, g, or t
  misc_feature (480)..(480): n is a, c, g, or t
  misc_feature (488)..(488): n is a, c, g, or t
cgatgacaacaaccctgctttgagagttctaccaaagaaaaggaagatatcagataatgccccaaggattcctagggcagatgagatcccaacactaccaaagcaggaccattctgtgcctgagggtaacagagttggctccattgagatagactggactacagcagctacaaagctggcacaggaggtgaacaacatgaagctcactctcactagtccaggaaaaagcagccaataancagagaagctaagacttaaatccatgtcctccaacttcaacttttttctgttgcttgatacttaagtgaatatatagtttagtaaaaatatcctatttaaatgaaatttatagggttatgtttttaatgggaanttctanagagttntagantttcttagaaatgccttntagggtgttattgagacccagaggagatcaagcaggtcaagatcntcttttactaatacttgcntntgtcntttatatntcaatgctgcgcataacttagaaataa

SEQ ID NO: 7407 - DNA, 440 bp, Mus musculus
  misc_feature (130)..(130): n is a, c, g, or t
  misc_feature (221)..(221): n is a, c, g, or t
  misc_feature (307)..(307): n is a, c, g, or t
  misc_feature (324)..(324): n is a, c, g, or t
  misc_feature (329)..(329): n is a, c, g, or t
  misc_feature (339)..(339): n is a, c, g, or t
  misc_feature (343)..(343): n is a, c, g, or t
  misc_feature (348)..(348): n is a, c, g, or t
  misc_feature (350)..(352): n is a, c, g, or t
  misc_feature (354)..(355): n is a, c, g, or t
  misc_feature (357)..(357): n is a, c, g, or t
  misc_feature (361)..(361): n is a, c, g, or t
  misc_feature (369)..(369): n is a, c, g, or t
  misc_feature (371)..(371): n is a, c, g, or t
  misc_feature (403)..(403): n is a, c, g, or t
  misc_feature (412)..(412): n is a, c, g, or t
gtgattttgacaagcaccgaaagatacactacagtgaagggaagttcctaaagtccccaaaaaacctgcccactgaggaagagagcattggggctagtgccagcatcagcagcagtaatcaagctgtggncgacagacctgaagcctaggcctgtggagaaaggctgggcaggaagactggccacaggagtcaaaaatgacactgtcctgatgactgatanccatgtcttaagcaccaacgattctgctacctatagaaaccagttcccatcagcctcagactcttccatggggcagctggctaatntacagcgcaaggaatantacancaaaggaagntatntgagntnnncnncncccncccagagntnggagaggatatagaagatgaagaacaggatantccttcagntttgacctgggttactgagaatccgaaa

SEQ ID NO: 7408 - DNA, 533 bp, Mus musculus
  misc_feature (26)..(26): n is a, c, g, or t
  misc_feature (34)..(34): n is a, c, g, or t
  misc_feature (48)..(48): n is a, c, g, or t
  misc_feature (60)..(60): n is a, c, g, or t
  misc_feature (289)..(289): n is a, c, g, or t
  misc_feature (294)..(294): n is a, c, g, or t
  misc_feature (298)..(298): n is a, c, g, or t
  misc_feature (308)..(308): n is a, c, g, or t
  misc_feature (316)..(316): n is a, c, g, or t
  misc_feature (321)..(321): n is a, c, g, or t
  misc_feature (325)..(325): n is a, c, g, or t
  misc_feature (344)..(344): n is a, c, g, or t
  misc_feature (380)..(380): n is a, c, g, or t
  misc_feature (389)..(389): n is a, c, g, or t
  misc_feature (392)..(392): n is a, c, g, or t
  misc_feature (452)..(452): n is a, c, g, or t
  misc_feature (460)..(460): n is a, c, g, or t
  misc_feature (462)..(462): n is a, c, g, or t
  misc_feature (464)..(464): n is a, c, g, or t
aagggtgatggtatcatgctgcttanaaccgggnacaggaaggttgtnacagacattaangagaatgcttgttatgtggcgatgaactatgaagatgaaatgaccaaggactctaacctagagaaaatatacacccagcctgatggaaagactgtcaaactccataagcagttatttcattgcccagaggccctcttttctccatatcttgtgaatgttgatgctccgggcatcgacaagatgtgcttcggcagcataatgaaatgtgatacagatctcaggaactccntcttntccnatatcatccnttcggganggatnaacntcttttcctggtttagatnagcgactcattaaggatgtggcaaagctggcacctnccaatactnccntacaggttatagctcccccggaaaggaaaatatcagtgtggatggggggttctattcttncctccttntntnccttccaagacatgtggatcacggctgcagaatttgaagaagttggacccaacattgtacaccagagat

SEQ ID NO: 7409 - DNA, 518 bp, Mus musculus
  misc_feature (264)..(264): n is a, c, g, or t
  misc_feature (279)..(279): n is a, c, g, or t
  misc_feature (289)..(289): n is a, c, g, or t
  misc_feature (315)..(315): n is a, c, g, or t
  misc_feature (318)..(318): n is a, c, g, or t
  misc_feature (324)..(324): n is a, c, g, or t
  misc_feature (337)..(337): n is a, c, g, or t
  misc_feature (346)..(346): n is a, c, g, or t
  misc_feature (349)..(349): n is a, c, g, or t
  misc_feature (383)..(383): n is a, c, g, or t
  misc_feature (410)..(410): n is a, c, g, or t
  misc_feature (413)..(413): n is a, c, g, or t
  misc_feature (432)..(432): n is a, c, g, or t
  misc_feature (443)..(443): n is a, c, g, or t
  misc_feature (454)..(454): n is a, c, g, or t
  misc_feature (458)..(458): n is a, c, g, or t
ttcggagctgttgtctctgccaaagtttttgtggaccgtgccaccaatcagagcaagtgttttgggtttgttagttttgacaatccaaccagtgcccagaccgccatccaggccatgaatggctttcaaatcggcatgaagaggctcaaggtccagctaaagagacctaaggatgccaacaggccttactgatctgagctcactgaccagtcacagacagaaactgaagaatgaagaaaggaaacagaaaagcacagaaatgcnggagaggcccttccngaaggagtgncagcagacggaggtggatcggacccnggnctggcncctggggctcagnccactcatnatntgggttgttccatggagtgatcaggctggcaggncaaccagtgctggctgaggaccgacanctntaaaggaaccagcagaggncctcgggggtnccaagggcttntcancaagggaagcccagacttactttgttcaaaatcatatcattccttagtgtttagggacca

SEQ ID NO: 7410 - DNA, 400 bp, Mus musculus
  misc_feature (119)..(119): n is a, c, g, or t
  misc_feature (339)..(339): n is a, c, g, or t
  misc_feature (354)..(354): n is a, c, g, or t
  misc_feature (356)..(356): n is a, c, g, or t
ggatgatagtgccaactgctactagaaagaggatgagacacttagaccactgtgacaaagcacaagctcttcaggcaaatgtttcaaatgtgggagcaagagttttcagagcctacgtncgccatgttcaggtccagtccctgtgcttctccatggcccatcattctccctgtgtctgctctgcctctcactggatagatgtaggtgagagatgtgcaccccagtactcactgttttgggtcccaagtatacatctacattgatggcaaagctatgagcgtagctgccccttcctcattcaccacatgcctgtgttcattttgtcattggtgagcactntgctgtgcaaccttntngcctagatctggccccagcatcctgaagcatatgaggcacctta

SEQ ID NO: 7411 - DNA, 236 bp, Mus musculus
  misc_feature (82)..(82): n is a, c, g, or t
  misc_feature (97)..(97): n is a, c, g, or t
  misc_feature (116)..(116): n is a, c, g, or t
  misc_feature (146)..(146): n is a, c, g, or t
tgttctcaccggtctctaaccagtgcatctgtctctctgcctcatccccacaccgccctgccacccccagtcttctgtctantggttccaggctggnagcaagagataaggctggnctcctgtgccccattgccatttcaccctanctcaaagtccaggagccaggcttccagaaaggctcttcaagagcaagcttaaggaaatacagtgagccaagtggctgtatgatatggtat

SEQ ID NO: 7412 - DNA, 451 bp, Mus musculus
  misc_feature (188)..(188): n is a, c, g, or t
  misc_feature (254)..(254): n is a, c, g, or t
  misc_feature (274)..(274): n is a, c, g, or t
  misc_feature (285)..(285): n is a, c, g, or t
  misc_feature (314)..(314): n is a, c, g, or t
  misc_feature (355)..(355): n is a, c, g, or t
  misc_feature (357)..(357): n is a, c, g, or t
  misc_feature (361)..(361): n is a, c, g, or t
gaaataccgtctgagggccgaaagtgaagcccggcaaaactggccggccaagtggggatatttaacaacgtccatgaaagagctgcttgagggtgaagaggagccacaaaccccgaagcccaagcctgagctgcctagccacttctatgtccgtccagtgagccccatggataaacacatcaagattntcccatcgcccccagtcccaaagaccacccagggcttcatcggatggcgatccgggaagccagccntgtactgtttggagaagtantcagaggtttncagctgcaaaggggcttatgcccgagagntatgctggcccgagcaaggcgtgcactgagcaacaccatcntntgcntcagacagggtgtgtgctgtgcctgggtgagcatccttgatactttgaagaaccacagtttgctgtaggcactgccatttgttggtgctt

SEQ ID NO: 7413 - DNA, 264 bp, Mus musculus
gtcattgaagcttccagaaacccaggacacaccaatgaaatctacttgggagacgactgaacagcaggtgccagaaaacaaggatagtttaggcgaaggccctcctgatagttttgagagatgggattcaagcagagccctttcttttgctgagaggtggggtttaagcagagcctctcctgatgctgagaagtggggttcaggcagagtccctcctgatgctgggaagtggggtgcaggcatagcccctcctgtgactgagag

SEQ ID NO: 7414 - DNA, 515 bp, Mus musculus
  misc_feature (272)..(272): n is a, c, g, or t
  misc_feature (289)..(289): n is a, c, g, or t
  misc_feature (302)..(302): n is a, c, g, or t
  misc_feature (305)..(305): n is a, c, g, or t
  misc_feature (308)..(308): n is a, c, g, or t
  misc_feature (312)..(312): n is a, c, g, or t
  misc_feature (317)..(317): n is a, c, g, or t
  misc_feature (326)..(326): n is a, c, g, or t
  misc_feature (343)..(344): n is a, c, g, or t
  misc_feature (349)..(349): n is a, c, g, or t
  misc_feature (356)..(356): n is a, c, g, or t
  misc_feature (365)..(365): n is a, c, g, or t
  misc_feature (391)..(391): n is a, c, g, or t
  misc_feature (395)..(395): n is a, c, g, or t
  misc_feature (411)..(411): n is a, c, g, or t
  misc_feature (442)..(442): n is a, c, g, or t
  misc_feature (452)..(452): n is a, c, g, or t
  misc_feature (464)..(464): n is a, c, g, or t
gcattgtaattgaaggtcctgtcctcgattgttggaactgtcttcggatgaccactcggtgtttcaaaggagactattgtcaagatgaggatccaaaaaccgctgaaaatcgagagatttccctctatctgatatttatagcagaagctgtcattttggcgagtgctgtgctactattccatgtttgcatctcacatcggaggaaaatgaaggcaatacgaagaactatgaagacatatttggagaagaaactagaagaactagtggagatnatatacaaagatgatgntgaaaaaaatttnganttngggngatcnaattcaaantttctgacaggagagcnnacatntgctgantcagaaatncaaactgggacttgaattccttattnatcnggaaaatcacagcatntcaaaaactggaatatagcttagggtttctnccagtgaacntccttactgacntcctgagacaatggacagaatgagagggaagaagatttaccctgagctata

SEQ ID NO: 7415 - DNA, 446 bp, Mus musculus
  misc_feature (120)..(120): n is a, c, g, or t
  misc_feature (122)..(122): n is a, c, g, or t
  misc_feature (126)..(126): n is a, c, g, or t
  misc_feature (282)..(282): n is a, c, g, or t
  misc_feature (292)..(292): n is a, c, g, or t
  misc_feature (295)..(295): n is a, c, g, or t
  misc_feature (304)..(304): n is a, c, g, or t
  misc_feature (324)..(324): n is a, c, g, or t
  misc_feature (343)..(343): n is a, c, g, or t
  misc_feature (351)..(351): n is a, c, g, or t
  misc_feature (361)..(361): n is a, c, g, or t
  misc_feature (374)..(374): n is a, c, g, or t
  misc_feature (377)..(377): n is a, c, g, or t
  misc_feature (386)..(386): n is a, c, g, or t
  misc_feature (389)..(389): n is a, c, g, or t
  misc_feature (391)..(391): n is a, c, g, or t
  misc_feature (394)..(394): n is a, c, g, or t
  misc_feature (401)..(401): n is a, c, g, or t
ggaaccttgccacgctcaagaagaaagtgatcaaggagggtgagctgcatcgcaccgactatgtccgcatcatgcaggaaaatgtctctctgatcaaagaaattaatgagctccgcaggnanctgnaagttaacccgctcccaaatctatgaccttgaatcggccctgaaagtatccaagaagacgcgctcacaagaagttccagagtcagtgataagcaaggacgtagtcggcagcacctctactatgaggctgaacgaacaggaggaaaccgggagaatnatcgagatgnaangtctggaantccgccgcctcagagaccanatccaagagcaggagcagntcccaggnttccacaccnattgccggagttnggnttccttccntcntngantcagatntggattttgaagtgcacaccaagtgacctccggtgagccatttcc

SEQ ID NO: 7416 - DNA, 493 bp, Mus musculus
  misc_feature (254)..(254): n is a, c, g, or t
  misc_feature (258)..(259): n is a, c, g, or t
  misc_feature (266)..(266): n is a, c, g, or t
  misc_feature (277)..(277): n is a, c, g, or t
  misc_feature (282)..(282): n is a, c, g, or t
  misc_feature (289)..(289): n is a, c, g, or t
  misc_feature (294)..(294): n is a, c, g, or t
  misc_feature (329)..(329): n is a, c, g, or t
  misc_feature (339)..(339): n is a, c, g, or t
  misc_feature (359)..(359): n is a, c, g, or t
  misc_feature (362)..(362): n is a, c, g, or t
  misc_feature (365)..(365): n is a, c, g, or t
  misc_feature (368)..(368): n is a, c, g, or t
  misc_feature (403)..(414): n is a, c, g, or t
  misc_feature (428)..(428): n is a, c, g, or t
gagccgatggcagttgagttatgcaggctcggggccctaaatatccttgaagaaattaatcgatcattaagtcggaaaaataaattcagtgaggcagcctataacaaattgctaaacaacaatctttccctgaaatacagccagactggctatttgtcatcaagcaatataattagcgatggattctatgattacggtcggataaatcctggcaccaaacttttgtcactgaaggaactgtgcttacaggagcngaannatcaacntgctattctantagtnaacaatnaatcngacacctctccacctccatctatggaggataaatnatcggacgtnggctatggacgaagcatttnttnttnatnttccttaagaaggggaagcaaggagaaggccaatnnnnnnnnnnnngctatatttggatntcctacagaagaaaaatccgagccagcatcagtacggaacactatccttagcagagctttcacca

SEQ ID NO: 7417 - DNA, 482 bp, Mus musculus
  misc_feature (352)..(352): n is a, c, g, or t
tgagaaagagtggaaccctcctcctgaccctgagttctgtgtgtatgtgctggaggtgaccaagtcgatactgcccattgtcaaccttaaggagcagattgaggtccttgccaagtatgtggcagataaaatgggcggtgagattccaaaagagaagctagctgatttcagctgggaacttcatataagtgagttgaaatttcaactgaaatccaatgtcgtaccaattggatacatcaagaagggaatcttttatcatcgagcgttgcttttcaaggcactggctgataaaatcggggtaggctgcagcctggtgcgtggtgagtacagccgagggtggaacgaagtgaanctggtgaatgaggctcggaaaggcatgatcgggaacctgcccccacccgaagagtacatcgtggatctcatgttccacccggggaacctgctgaagctgcgcagcaaagaggctgacctctaccgctttc

SEQ ID NO: 7418 - DNA, 554 bp, Mus musculus
  misc_feature (314)..(314): n is a, c, g, or t
  misc_feature (426)..(426): n is a, c, g, or t
  misc_feature (432)..(432): n is a, c, g, or t
tcaggcatcttcatccatgttgggatttccctggccagtgagctgcaagcagcgcagcctaagtgacccacacacacattaattctaccaaaaagtaattgtgacgttactgtgaaaaccatactacaaagaaggcccatgtgggtgtaagcttctacaaccaggcaggccagcacgcacggctcctgcagcctggtgattggctctgtcattgatttctgttggtatcttttctagattggcatttgaaagagcccccttcttccatcatcatccaaactaagataagcaggctataaggagcggcagccctnccctcttggcgatgtgggtagattgctgtgctttccgctgggtttgcaggcttgtgagtagaatggcagccaggaggggcattgctttccttgctgaacccacacatttctntccttnccttaacagggtgtttgagcaactgttggaaacaaggggagagaaggatggctgttttatatttcactgaaatgttcttacacaaacattttattgttaaagtgtctaggtttaccctgcaa

SEQ ID NO: 7419 - DNA, 473 bp, Mus musculus
agatctccttcaatccccaaggaaaccggctcctgacgggcagctctgataagacagccagaatctgggatgttcagactggccagtgcctccaggtccttgaggggcacactgatgaaatattttcatgtgctttcaactataaagggaatatagtcattacaggcagcaaggacaactcctgcaggatatggcgttgacccaagggctctgctatggagcagggctgttggcaacagtgatcaagaacttgaactccagagagcaagtgagcctatgtcctctgcctcttttcatgcaacttatccatggaacagcctgtccttcaccttacagacatgaccatgaaaaccaatgagccttcaccattttctgacattatctaaaggttattggcaggagcaggcataatatgtgttaaatatcactaattgtttctgttgtgttttgtgtttcaatagcgccaggatact

SEQ ID NO: 7420 - DNA, 426 bp, Mus musculus
  misc_feature (191)..(191): n is a, c, g, or t
  misc_feature (195)..(196): n is a, c, g, or t
  misc_feature (201)..(201): n is a, c, g, or t
  misc_feature (207)..(207): n is a, c, g, or t
  misc_feature (228)..(228): n is a, c, g, or t
  misc_feature (366)..(366): n is a, c, g, or t
  misc_feature (384)..(384): n is a, c, g, or t
gagactttaggtctaattcacaaagcaacaaaaggcctaatcaagagtattgaagatggtggagtggattctgtaatggagtgggaagtagatgaagtgctgaactggacaaacacactcaactttgatgagtatattgcaagttggagagaaactgctacaagcaactcttcagctaacttaaaagatgntcanncttcngcgaantacagaaaagcctacagagcnaacatctatggcgatgaggcaaagcaagcagaggagtcactgtacgatgattctacttactatgaaaatgcttatacaaaacagttcactagattaacacccgattccatgttcggcatgtaaccagaaaggattccnttttctgagcgatggacntaccttcaagcccactttccagcgaaagccaagaaactactt

SEQ ID NO: 7421 - DNA, 524 bp, Mus musculus
  misc_feature (355)..(355): n is a, c, g, or t
  misc_feature (366)..(366): n is a, c, g, or t
  misc_feature (370)..(370): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (386)..(386): n is a, c, g, or t
  misc_feature (392)..(392): n is a, c, g, or t
  misc_feature (394)..(394): n is a, c, g, or t
  misc_feature (406)..(406): n is a, c, g, or t
  misc_feature (408)..(408): n is a, c, g, or t
  misc_feature (427)..(427): n is a, c, g, or t
  misc_feature (458)..(458): n is a, c, g, or t
  misc_feature (471)..(471): n is a, c, g, or t
  misc_feature (473)..(473): n is a, c, g, or t
actctcaacatttccatctatctaaacttgatcataggtttgcagttctcctatatgatttctcaaaacaagtgtgtgcatctccttgttggcttcctgagtttcttcgcaggttgccttttgttctatgcgatcattgtgtatcaccacaagctaaataaaggtcaatatgtgtacttcgttaattacaagaccaagtggatagctttcactgtctacttaacaatcgccctctttcttacctgtggtatcttctgtttcatacagagcacaaatagatgcgaatgcatgaaattctgtataccccacacagaaagtaaaagccaagaaatgattccgagtacaatcgaagttntttcacttccnccancgatgtncnatncctngaagcntngtccatgtgcantntgtgacctcaaaggatggntccttaaatagaccacacacccaagcacgtngggtaacctgggntntgtgacttgacaatacgtacctttcagtactacctgacgttgctatggaat

SEQ ID NO: 7422 - DNA, 440 bp, Mus musculus
  misc_feature (334)..(334): n is a, c, g, or t
  misc_feature (338)..(338): n is a, c, g, or t
  misc_feature (340)..(340): n is a, c, g, or t
  misc_feature (347)..(347): n is a, c, g, or t
  misc_feature (349)..(349): n is a, c, g, or t
  misc_feature (351)..(351): n is a, c, g, or t
  misc_feature (363)..(363): n is a, c, g, or t
  misc_feature (373)..(373): n is a, c, g, or t
  misc_feature (375)..(375): n is a, c, g, or t
  misc_feature (400)..(400): n is a, c, g, or t
gtggttcctacctctgtaagatggaagcatgtgtggtggcgatgcttgtgagagttcccagagctgatagctgaggcaggcagtacaatcgctcctcagaaaagtccactctgaaccccgtacctgtgactgcagcaccttgtgtgggagacgtggccattcaggatcttgaggtataggaagatggcccagaatcatacagatgttgaactctcagctccttctccagaaccatgtctgcctgcatgccatcatgtttcccgccatgatgaaaatggactgaacctccaaactaaataccgcaggagaaagaggaaaccatggaaagagaacnctgntnttcccanantntcaatccgaaantcagctgctntntccacaggcttttccaggctgcttntgctggatgctgtaagccctggtttgatgaggttaccctt

SEQ ID NO: 7423 - DNA, 400 bp, Mus musculus
  misc_feature (128)..(128): n is a, c, g, or t
  misc_feature (133)..(133): n is a, c, g, or t
  misc_feature (142)..(143): n is a, c, g, or t
  misc_feature (160)..(160): n is a, c, g, or t
  misc_feature (162)..(162): n is a, c, g, or t
  misc_feature (166)..(166): n is a, c, g, or t
  misc_feature (173)..(173): n is a, c, g, or t
  misc_feature (187)..(187): n is a, c, g, or t
  misc_feature (191)..(191): n is a, c, g, or t
  misc_feature (200)..(200): n is a, c, g, or t
  misc_feature (202)..(202): n is a, c, g, or t
  misc_feature (205)..(205): n is a, c, g, or t
  misc_feature (208)..(208): n is a, c, g, or t
  misc_feature (219)..(219): n is a, c, g, or t
  misc_feature (296)..(296): n is a, c, g, or t
  misc_feature (347)..(347): n is a, c, g, or t
  misc_feature (375)..(375): n is a, c, g, or t
aatggccaagcccaccttcaaaagacaatgctacatcaaaagacatctaagaccattgtatagaaagcactcacgttgctctagcatcaatttgggccatggaaattactccctttacataaacagantcctnaaggaagtnntccctaacaggggtatntnatcntattctntggacatcatgaanatcntcatcaatnanatnttngaacgcattgntacggaagcctgccagcagatgttcctcagaaagcgctgtaccctcaccccaggagatatccagcaggcagtgcatntgctgttgccgaagaagctggctacgcttgctgtgacttttggaagtaaanccgtccacagattcattcattcctaagntccatccatgttcaagcctaattga

SEQ ID NO: 7424 - DNA, 314 bp, Mus musculus
  misc_feature (256)..(256): n is a, c, g, or t
caagaccttgtctgtgtgggatgcacgaacaggtaaatgtgagcagtctctgtatggtcacatgcattctgtcaatgatgccaccttcacgcctaggggtcacataatagcatcctgtgatgcccgtggagttacaaagctgtgggacttccggaaactcattccaatcgtgtccattgatgtgggtccaagttcgggaaatgaggtgaactttgaccagtcaggtcgagttttagctcaggcgagtgccaacggnattatccatttgctggatcttaaatcggggcaaattcacaaactggtgggccacgaga

SEQ ID NO: 7425 - DNA, 519 bp, Mus musculus
  misc_feature (80)..(80): n is a, c, g, or t
  misc_feature (90)..(90): n is a, c, g, or t
  misc_feature (103)..(103): n is a, c, g, or t
  misc_feature (156)..(156): n is a, c, g, or t
  misc_feature (166)..(166): n is a, c, g, or t
  misc_feature (241)..(241): n is a, c, g, or t
  misc_feature (243)..(243): n is a, c, g, or t
  misc_feature (316)..(316): n is a, c, g, or t
  misc_feature (335)..(336): n is a, c, g, or t
  misc_feature (345)..(345): n is a, c, g, or t
  misc_feature (441)..(441): n is a, c, g, or t
  misc_feature (480)..(480): n is a, c, g, or t
gtactgcaaaagattctcccaaggaagacgcatctctacccaggccagatgtggagacaccagacattcttggagagatntgcccagctnatccaagcagctncaagggctgattagcattgagaccagcgaaggacaaggaaggattcctgtgtntccctgtgtntcaagggaaagatcaacgggatttaagtatgatgattgtgggttatagcataaaggcttgcttaacaaagagatntngatggcataagtgagttatttttacacatctgtatacacacaccagaaaaggaaatgttttggtaggcacaantgaattttctctctataannaacgtgcanttcacggatggtggattttaagcacgtgttggtgatgttaatttacagtaatgattattctgttctgaaaatgaaaccataccatctctttttttnaccataccacaccttttaacattagcctggatacataanagcgtagctctagcgaccatctcagctgttgtatcaaag

SEQ ID NO: 7426 - DNA, 513 bp, Mus musculus
  misc_feature (218)..(219): n is a, c, g, or t
  misc_feature (373)..(373): n is a, c, g, or t
  misc_feature (408)..(408): n is a, c, g, or t
  misc_feature (411)..(411): n is a, c, g, or t
  misc_feature (440)..(440): n is a, c, g, or t
  misc_feature (442)..(442): n is a, c, g, or t
  misc_feature (484)..(484): n is a, c, g, or t
ttggaggcatcttggctgcacacagcatagccaccaccctgaagtactggtatcatggctcaccacctggagagattgtttccttgggggtaatgagtgaaggccagtttgacattcctgaagggatcgtcttttctatgccagtgaaatttgagaatggaacgtgggtggttcttactgatcttgaagacatttcgcttagtgagaagacactaagnnggctcacaggcgatctgattcaggagaaacttgttgcatgtggagacttattaacttttcagccaattgaagaagatcccaaagataacgaaccttctaatacaggcatgaatgaagaaaaggaacagcctgggtccgatgactctgatgaaanaaaatgaggaccaataatagcttcaaccagaacanatntgaaggaaagacagaaagacctgcaggtntntgcacttagggaagaacagtgaaataaaatagaccccaaatntagcagattcacatgctgccacatccaat

SEQ ID NO: 7427 - DNA, 493 bp, Mus musculus
  misc_feature (140)..(140): n is a, c, g, or t
  misc_feature (338)..(338): n is a, c, g, or t
  misc_feature (344)..(344): n is a, c, g, or t
  misc_feature (351)..(356): n is a, c, g, or t
  misc_feature (361)..(361): n is a, c, g, or t
  misc_feature (368)..(368): n is a, c, g, or t
  misc_feature (424)..(424): n is a, c, g, or t
  misc_feature (426)..(426): n is a, c, g, or t
  misc_feature (443)..(443): n is a, c, g, or t
  misc_feature (467)..(467): n is a, c, g, or t
gctactatctcacgctgagggccaaccgggtacactacaagggtggccagcctgacagccagctccgagtcctccgtgttgggaatgacaacaactgttccctggagtcccagggctgtaactcgcctttgccaggggcnggcccctatagagtgaaattcctggcgatgagtgccgagggacccgtggctgagacactgtggtccgaggagatctacctgcagcaagcccagacattccgagaagctccagggtcccagggcaagggcactgtggtcatcattgccttcttgtcaatcctactggccatcctgcttgtggtcttcctcgtactggtnatatcngcttgcnnnnnnagtanttccggntccagcccagaggagcaagtgcgcatgcggcactatcacacgcaccacatgggcancntccgagctgagcgcagntcctgagagtttcccagggctttnatctgggatcaagttgctgagcctga

SEQ ID NO: 7428 - DNA, 380 bp, Mus musculus
  misc_feature (57)..(57): n is a, c, g, or t
gtgacatcggccttgggcataggaattgtggctggagtggttggcggcgtgttggtnagcgttgctgtcttcaaggccctgggagggactgatggcagtgggggccgcacccgcttatgatgcaagtcttcctcccaggaggctggctacctaggaagctaagctagattgtatgtgtgcctctgatggtgaagtgtcaaaagagggctctcagccagagttggctaggaggctgggaagatgtaacctcagtagttcagggcagcatccaccattgtattcaggtttccctgatcctagatgctcaggagatccactgcaggcttaggttctgtccctagagagagttctgtcttgcaagcttgtttttgtgccacact

SEQ ID NO: 7429 - DNA, 483 bp, Mus musculus
  misc_feature (212)..(212): n is a, c, g, or t
  misc_feature (318)..(318): n is a, c, g, or t
  misc_feature (352)..(352): n is a, c, g, or t
  misc_feature (359)..(359): n is a, c, g, or t
tgacaacggcacacagacagatacacacatattgccacccacgaccatgagaacatatgagtggaacgaatgggaactaagaagaaaagccataaaactggctaatttgcgccagaaaattactcactccgtccagactgaccttagccacatgagaagagataacacctcacaggtgtaccctttgaaagaggctagcacccagtccaagnagagaaggcagcagccgagtgcccaggccccagattttcatagctggccttcgtgggggacaaagcaaaacaacctatggggtgaaggtgaacttaaccagagcgntggacgaaacctagagatggacgtttacaggaanctgctcnttagtggcacggatggagggtttaaagtgctgtgcgtgtataaagctcatttgcggggctggcacagtcactggttgtgtgactgtgcactagggcaccgtatcctgcctgactgttatgcaaa

SEQ ID NO: 7430 - DNA, 325 bp, Mus musculus
  misc_feature (247)..(247): n is a, c, g, or t
aaagctaccacaggctcatgaagtccctgaagaaagtgaccaccgtacccacagatcgtcttcattggccagcagttccctccaagacatctggaggctgctagagctgggatccagcccttcgggcgtcccctcacaggataactctgttgcagagtgtccagcaccttcaagacccagctgtttccaaaaggtcaaccggagccctgtccccatacaaaaggcctttgctgtcaaagggctaaangatggaagctcagccaaaagccacaccccccagacccagcaagtctcacccagctaaacctacaaactgccagcagca

SEQ ID NO: 7431 - DNA, 544 bp, Mus musculus
  misc_feature (181)..(181): n is a, c, g, or t
  misc_feature (215)..(215): n is a, c, g, or t
  misc_feature (218)..(218): n is a, c, g, or t
  misc_feature (269)..(269): n is a, c, g, or t
  misc_feature (288)..(288): n is a, c, g, or t
  misc_feature (298)..(298): n is a, c, g, or t
  misc_feature (304)..(304): n is a, c, g, or t
  misc_feature (306)..(306): n is a, c, g, or t
  misc_feature (317)..(317): n is a, c, g, or t
  misc_feature (333)..(333): n is a, c, g, or t
  misc_feature (339)..(340): n is a, c, g, or t
  misc_feature (345)..(346): n is a, c, g, or t
  misc_feature (348)..(348): n is a, c, g, or t
  misc_feature (353)..(353): n is a, c, g, or t
  misc_feature (362)..(362): n is a, c, g, or t
  misc_feature (368)..(368): n is a, c, g, or t
  misc_feature (371)..(372): n is a, c, g, or t
  misc_feature (375)..(375): n is a, c, g, or t
  misc_feature (378)..(378): n is a, c, g, or t
  misc_feature (381)..(381): n is a, c, g, or t
  misc_feature (393)..(393): n is a, c, g, or t
  misc_feature (395)..(395): n is a, c, g, or t
  misc_feature (403)..(403): n is a, c, g, or t
  misc_feature (405)..(405): n is a, c, g, or t
  misc_feature (408)..(408): n is a, c, g, or t
  misc_feature (420)..(420): n is a, c, g, or t
  misc_feature (451)..(451): n is a, c, g, or t
  misc_feature (473)..(473): n is a, c, g, or t
  misc_feature (495)..(495): n is a, c, g, or t
  misc_feature (497)..(497): n is a, c, g, or t
gctggcagagtaaaaccttcatttcttctctatggcggcccaccaaacccttgcctcaaagatcttcagtttatgctgctgggactgtgaggaacctgttattgagagcgccaaggttccaagccaagagagccagacaccaacctacaattcgctgaagactgagaagagtgagttatgngaacaaaacctcaagagagctaccgcacagtccngtngttggccaagaaaagcactccactgccagcagtgattatgaagagctgacngcatacaatatacaaacangataccctanaaggantntaaaccgctantaccaggaacactggnccctcnnaccgnntntcatngggagaccntgaggnttnntantgncanttccacacaggntntgagctgntnagntactggagggtntccatgagatgaagaaggcagtggacaggantcatgaagaccaattcagaaantccaccacaaggagggaagagntntgagccatccctgtgccactggtgtgagtcaccccagatcctgacag

SEQ ID NO: 7432 - DNA, 255 bp, Mus musculus
aagccatcagaattcgatacaaataaagtaattccacgtaggcctggacttgttcatgtaatttcagtttcaagtatagcctttgtcattgccctgctatgtgggctcatgctctcctacgtgatatatcgactggtaaaagttgaggaaaaacagcagcttgcaatgttgtatgaaaatatcgagattccacttgtagatgagaaagaggcctctgaagatgatggttatgatgaatctcagttgcatccagag

SEQ ID NO: 7433 - DNA, 464 bp, Mus musculus
  misc_feature (177)..(177): n is a, c, g, or t
  misc_feature (193)..(193): n is a, c, g, or t
  misc_feature (200)..(200): n is a, c, g, or t
  misc_feature (202)..(202): n is a, c, g, or t
  misc_feature (215)..(215): n is a, c, g, or t
  misc_feature (233)..(233): n is a, c, g, or t
  misc_feature (236)..(236): n is a, c, g, or t
  misc_feature (239)..(239): n is a, c, g, or t
  misc_feature (265)..(265): n is a, c, g, or t
  misc_feature (291)..(291): n is a, c, g, or t
cacctgaggaagactacggactgatgaaaacaagtgcgccaaacacactataccacaattcgatggcttatgataaagatgctgctaatgcttcagaatgccatgaaatgttgaatacagattgcttagagaagaaactcactgttgatgaagattctgggccaagcgatatggaanttgaagaagaaggtgntagagangnagaaaattacctntcccctcaagaaaagaancgncantttgaaatgaaaaggaagcttcacancaacgaaggactaaatattaaattanccagactgctaatttcaaaagacctacatgatgatgatgacgaagatgaagaaatgtcagaggctacagactttgacagcatcaatattgactagtcgaatcaaggatctaccgaaagtgaccatctgcaactgaaatcacaaagttcataaaagtaatgtgttcagcctaac

SEQ ID NO: 7434 - DNA, 537 bp, Mus musculus
  misc_feature (65)..(65): n is a, c, g, or t
  misc_feature (81)..(81): n is a, c, g, or t
  misc_feature (86)..(86): n is a, c, g, or t
  misc_feature (104)..(104): n is a, c, g, or t
  misc_feature (124)..(124): n is a, c, g, or t
  misc_feature (129)..(129): n is a, c, g, or t
  misc_feature (167)..(167): n is a, c, g, or t
  misc_feature (175)..(175): n is a, c, g, or t
  misc_feature (212)..(212): n is a, c, g, or t
  misc_feature (233)..(233): n is a, c, g, or t
  misc_feature (263)..(263): n is a, c, g, or t
  misc_feature (290)..(290): n is a, c, g, or t
  misc_feature (293)..(293): n is a, c, g, or t
  misc_feature (296)..(298): n is a, c, g, or t
  misc_feature (301)..(302): n is a, c, g, or t
  misc_feature (308)..(308): n is a, c, g, or t
  misc_feature (310)..(310): n is a, c, g, or t
  misc_feature (312)..(312): n is a, c, g, or t
  misc_feature (320)..(320): n is a, c, g, or t
  misc_feature (345)..(345): n is a, c, g, or t
  misc_feature (354)..(355): n is a, c, g, or t
  misc_feature (357)..(358): n is a, c, g, or t
  misc_feature (374)..(374): n is a, c, g, or t
  misc_feature (401)..(401): n is a, c, g, or t
  misc_feature (403)..(403): n is a, c, g, or t
  misc_feature (424)..(424): n is a, c, g, or t
  misc_feature (440)..(440): n is a, c, g, or t
  misc_feature (447)..(447): n is a, c, g, or t
  misc_feature (482)..(482): n is a, c, g, or t
  misc_feature (484)..(484): n is a, c, g, or t
  misc_feature (506)..(506): n is a, c, g, or t
  misc_feature (508)..(508): n is a, c, g, or t
caggacttttactgaagaagccctattaaacccagtgaaaataacctacaactttaaaaacgaanggaggaaaaagctccntcttntgctgagaaacgatccgntcccaactgacctcccacantacantcctcctgacttcttggagctgctgaagaagcagacgncctcatantctttcaaggacaaaccccgggcagaccccagcacantagttgacaaagatgagtcantccatctttgcccgggacagtacgaggtanttccagcaccggttcccaagagcccanccnggnnnttnntatttngntnttcagttnaaagattcccaccaaattatttcantcctcacgnngnnccctggaccaggtgantatgagctgaaggcatccccaaaaggntntattacttcttgttttcgatntaaggttccccgattnttacctntcagttcaaaaacaccaggcccaggagcatacacntnttcgagacagttccccaagcantnttcaaccattgccaaaatgggtagagaac

SEQ ID NO: 7435 - DNA, 272 bp, Mus musculus
  misc_feature (29)..(29): n is a, c, g, or t
  misc_feature (31)..(31): n is a, c, g, or t
  misc_feature (41)..(41): n is a, c, g, or t
  misc_feature (77)..(77): n is a, c, g, or t
  misc_feature (82)..(82): n is a, c, g, or t
  misc_feature (89)..(89): n is a, c, g, or t
  misc_feature (91)..(91): n is a, c, g, or t
  misc_feature (108)..(108): n is a, c, g, or t
  misc_feature (110)..(110): n is a, c, g, or t
  misc_feature (118)..(118): n is a, c, g, or t
  misc_feature (125)..(125): n is a, c, g, or t
  misc_feature (149)..(149): n is a, c, g, or t
tgacaatccccgagacacaaaacagctantntgtgagaggntagtgggggaaatcgccttccagctagaccgaagantcctntccagcntnttcccagagcgcgtacntntctacggnttcactntctccaacatcccagagaagatcntccaggcctccctaaaccccagtaatcacaagttggatgaggacctgtgccagacgctcacacagcgttacgtgagcatcatgaacaagctgcagagcttaggctacaacgggcgggtgcacc

SEQ ID NO: 7436 - DNA, 305 bp, Mus musculus
  misc_feature (68)..(68): n is a, c, g, or t
  misc_feature (235)..(235): n is a, c, g, or t
gctctctgaaacaggaccaacgatactgagcgaggaggagcagttctactctaaagctggatggccgnttcaaagttaacctaactttgatgtgcatgtgcgaaaatgattaccttatcatagaaataagccagcctagttgagcacaccttaaatgccaaagacaatgatgaactggtgaagaaagagatgccaagaaaagacaggtatggatctctggataccagaggatganaggggtcaaaaaaatctataaatgggttaaggactaatttaaaaacagcattccctcctcaaatcaatgt

SEQ ID NO: 7437 - DNA, 537 bp, Mus musculus
  misc_feature (97)..(97): n is a, c, g, or t
  misc_feature (112)..(112): n is a, c, g, or t
  misc_feature (183)..(183): n is a, c, g, or t
  misc_feature (275)..(275): n is a, c, g, or t
  misc_feature (277)..(279): n is a, c, g, or t
  misc_feature (282)..(283): n is a, c, g, or t
  misc_feature (287)..(288): n is a, c, g, or t
  misc_feature (290)..(290): n is a, c, g, or t
  misc_feature (292)..(294): n is a, c, g, or t
  misc_feature (297)..(299): n is a, c, g, or t
  misc_feature (301)..(301): n is a, c, g, or t
  misc_feature (303)..(306): n is a, c, g, or t
  misc_feature (308)..(310): n is a, c, g, or t
  misc_feature (312)..(313): n is a, c, g, or t
  misc_feature (315)..(316): n is a, c, g, or t
  misc_feature (318)..(320): n is a, c, g, or t
  misc_feature (322)..(322): n is a, c, g, or t
  misc_feature (331)..(333): n is a, c, g, or t
  misc_feature (338)..(340): n is a, c, g, or t
  misc_feature (352)..(353): n is a, c, g, or t
  misc_feature (373)..(373): n is a, c, g, or t
  misc_feature (375)..(375): n is a, c, g, or t
  misc_feature (384)..(384): n is a, c, g, or t
  misc_feature (394)..(394): n is a, c, g, or t
  misc_feature (397)..(397): n is a, c, g, or t
  misc_feature (400)..(400): n is a, c, g, or t
  misc_feature (404)..(404): n is a, c, g, or t
  misc_feature (406)..(406): n is a, c, g, or t
  misc_feature (410)..(410): n is a, c, g, or t
  misc_feature (415)..(415): n is a, c, g, or t
  misc_feature (421)..(421): n is a, c, g, or t
  misc_feature (481)..(481): n is a, c, g, or t
  misc_feature (495)..(495): n is a, c, g, or t
  misc_feature (503)..(503): n is a, c, g, or t
cctcaagatatcgagtggctggtgaggagctagaacacagtctggaattgcattcctccaggattctgaacacacaaaactgtcgtcaaggcaaaangaacataaaatgtcnagagtcttgatagttcaagaacatggctgctctcctgagaagtttcatggtgatgacctgcaactgctgtngtgccatcatttgcctccactgaaggaatttgagggtctgacttaaagaataggagcttgaactgtcaaggcaggaaatccaagggtaggcncnnnctnncctnnancnnnacnnngncnnnnannntnngnncnnnantcccctctnnnattcnnnatgaagacatanncacaacagacagacatatantnaaaaatacnaggaaattanttnagnttgntngganttggnttggtnggagttggattggttggagttgggttggttggagctaggttgctatgtaacccagagtgncctgaaactgctgntcttcctnccttgaccaagtgcttggactgctggtatactag

SEQ ID NO: 7438 - DNA, 439 bp, Mus musculus
  misc_feature (270)..(275): n is a, c, g, or t
  misc_feature (277)..(277): n is a, c, g, or t
  misc_feature (280)..(280): n is a, c, g, or t
  misc_feature (282)..(290): n is a, c, g, or t
  misc_feature (294)..(294): n is a, c, g, or t
  misc_feature (296)..(296): n is a, c, g, or t
  misc_feature (300)..(301): n is a, c, g, or t
  misc_feature (305)..(306): n is a, c, g, or t
  misc_feature (308)..(309): n is a, c, g, or t
  misc_feature (315)..(315): n is a, c, g, or t
  misc_feature (320)..(320): n is a, c, g, or t
  misc_feature (325)..(325): n is a, c, g, or t
  misc_feature (335)..(335): n is a, c, g, or t
  misc_feature (339)..(339): n is a, c, g, or t
  misc_feature (341)..(341): n is a, c, g, or t
  misc_feature (347)..(347): n is a, c, g, or t
  misc_feature (349)..(349): n is a, c, g, or t
  misc_feature (354)..(355): n is a, c, g, or t
  misc_feature (385)..(385): n is a, c, g, or t
  misc_feature (392)..(392): n is a, c, g, or t
  misc_feature (394)..(394): n is a, c, g, or t
  misc_feature (404)..(404): n is a, c, g, or t
ataaggcgccagtattcttcacaagctctccagtaaagctctgatttcccatttaaatgagaaaccatacaactctgtttagaaatctcttcccctgaacagtctcctaactctttagtgagggagaaaggtagcaataaggtccatttatagagctctctgatggtctggcattacggtaaacaatgaggtgcattattttcttcatgttttcccagcagcctccacagttattagctctgttttataagtcaagaaaatgagactcgnnnnnntnctntnnnnnnnnntccnanaacnnaaanncnngggagntacantttgnacacaatctnattntncaaacntnaactnntgaaatgtttccctaataaggtgcaatctntatgccntntgctccattntctgcacgtacaggtctgagttgtggttagtgctt

SEQ ID NO: 7439 - DNA, 505 bp, Mus musculus
  misc_feature (303)..(303): n is a, c, g, or t
  misc_feature (324)..(324): n is a, c, g, or t
  misc_feature (380)..(380): n is a, c, g, or t
  misc_feature (430)..(430): n is a, c, g, or t
gacatttgtattgatctttctccaattggaagactgatttttgagctgtattgtgatgcatgtcccagaacatgtacaaattttcaggtcttgtgcacaggaacgtcaggattttctgagagaggcacaaagcttcattacaaagattcgatttttcatcgagtagttcagaatggttggatacaaggaggagatatagtacaggggcgcggagacgacggagagtctatttatggaccaacgtttgaagatgaaaacttctcgattcctcacaataagaggggagttcttggaatggtcaanaagggccatcacaccaatggntcacaattctacatcacactacaggcagctccctacttggataaaaaatatgtggnttttgggcaactaatcgaaggaacccacgttcttaagcaactagaattantcccaacagagaacgaaagaccattgcttctttgcagtattgcagacagtggagttctttacacatgattttcat

SEQ ID NO: 7440 - DNA, 499 bp, Mus musculus
  misc_feature (303)..(303): n is a, c, g, or t
  misc_feature (312)..(312): n is a, c, g, or t
  misc_feature (314)..(315): n is a, c, g, or t
  misc_feature (318)..(318): n is a, c, g, or t
  misc_feature (320)..(320): n is a, c, g, or t
  misc_feature (337)..(337): n is a, c, g, or t
  misc_feature (371)..(371): n is a, c, g, or t
  misc_feature (398)..(398): n is a, c, g, or t
  misc_feature (454)..(454): n is a, c, g, or t
  misc_feature (458)..(458): n is a, c, g, or t
  misc_feature (469)..(469): n is a, c, g, or t
ttgccacgccaatccaattcaataaagacaaaatgcccatctgcctgccacagagggagaactcctgggaccggtgctggatgtcagagtgggcatatactcatggccatggttcagccaaaggctcaaacatgcacctgaagaagctcagggtggttcagattagctggaggacatgtgccaagagggtgactcagctctccaggaacatgctttgtgcttggaaggaagtgggcaccaacggcaagtgccagggagacagcggggcacccatggtctgtgctaactgggagactcggagantctttcaantnngtntnttcagctggggcataanttcaggatccagggggaggccaggcatttttgtntctgtggctcagtttatcccatggatnctggaggagacacaaagggagggacgagcccttgccctttcaaaggcctcaaaaantttnttggctggcantccacgctaccatcccatattgctaagcat

SEQ ID NO: 7441 - DNA, 312 bp, Mus musculus
ggcctgagccaggataccttcaaaattaatgctgtggcggtttgtctccctcttctcagagctggaagcaaagcagcttcgtcggctctataagtacaccaagacgaaccagacggccaagttcctggccgcactctgccccttggatgcaccggagagatcactgcttgccaaccaagaggactgtcttcccaggctctgcagtgcctggggcttgcatggaaatatcagcggcatgaaggagaggttgtccaagatgcaagcccctggccaagaagttgtcatgatggaggagccaaggtcctcacactg

SEQ ID NO: 7442 - DNA, 370 bp, Mus musculus
  misc_feature (39)..(39): n is a, c, g, or t
  misc_feature (42)..(43): n is a, c, g, or t
  misc_feature (46)..(46): n is a, c, g, or t
  misc_feature (48)..(48): n is a, c, g, or t
  misc_feature (50)..(50): n is a, c, g, or t
  misc_feature (52)..(53): n is a, c, g, or t
  misc_feature (72)..(72): n is a, c, g, or t
  misc_feature (84)..(84): n is a, c, g, or t
  misc_feature (88)..(88): n is a, c, g, or t
  misc_feature (119)..(119): n is a, c, g, or t
  misc_feature (122)..(122): n is a, c, g, or t
  misc_feature (128)..(128): n is a, c, g, or t
  misc_feature (130)..(130): n is a, c, g, or t
  misc_feature (133)..(134): n is a, c, g, or t
  misc_feature (137)..(137): n is a, c, g, or t
  misc_feature (207)..(207): n is a, c, g, or t
  misc_feature (324)..(324): n is a, c, g, or t
gaggaaagagagctttgtctgcattttattttctccttnctnnccngngngnnaaagttttgctcatgccangtgcctcctagnaagncaggtgccgtgttctcattgtgacatttcanccncacagnanacnnttnccagaaggaggagtgtcatcaaggggttagacagcgcgaaagagttgtggttaataaaggaggctttggnggagttcgcagaaatgaaagagagagaagagagaaaggttctcctggaacgagaggagaagcaaaaagattaccaagcccgcaagatgcattacctgctcagcacaaagcagtgtgntcatcccaccgcagcctgacattatgctcaagaaaagctcaccaac

SEQ ID NO: 7443 - DNA, 498 bp, Mus musculus
  misc_feature (39)..(39): n is a, c, g, or t
  misc_feature (66)..(66): n is a, c, g, or t
  misc_feature (101)..(101): n is a, c, g, or t
  misc_feature (103)..(103): n is a, c, g, or t
  misc_feature (139)..(139): n is a, c, g, or t
  misc_feature (193)..(193): n is a, c, g, or t
  misc_feature (272)..(272): n is a, c, g, or t
  misc_feature (277)..(278): n is a, c, g, or t
  misc_feature (282)..(282): n is a, c, g, or t
  misc_feature (284)..(284): n is a, c, g, or t
  misc_feature (305)..(306): n is a, c, g, or t
  misc_feature (318)..(318): n is a, c, g, or t
  misc_feature (325)..(326): n is a, c, g, or t
  misc_feature (330)..(330): n is a, c, g, or t
  misc_feature (341)..(341): n is a, c, g, or t
  misc_feature (345)..(345): n is a, c, g, or t
  misc_feature (348)..(348): n is a, c, g, or t
  misc_feature (350)..(350): n is a, c, g, or t
  misc_feature (354)..(354): n is a, c, g, or t
  misc_feature (363)..(363): n is a, c, g, or t
  misc_feature (367)..(367): n is a, c, g, or t
  misc_feature (392)..(392): n is a, c, g, or t
  misc_feature (459)..(459): n is a, c, g, or t
  misc_feature (461)..(461): n is a, c, g, or t
agggagaggggatgctattcttttaggaagcagcatacnacctaagtttaccaagagttaattcanccttctgaattcaacaagcatattttcagcctgantnaaagtaatttgcttggagaagacacacataagaganatctgtgtttactggggaaaaagacgtggggattgttgagcaggggttcccatntcccccaagactatactgaagaaaaagcccaattctttagtaagatttctggtttctgcctactccttttaacctctgnaatgnngcantnggaagtattcaagcatagctnnttcattctagtntccaatnnattntccaaccaaancagntcntntaancctcacatntggngaaggggtgaggctagtgagtaccnaaagggatgcgtgggagctggagggccactggggtgttgggggtaagaattttactgaacctttaantntcctgtagaattactataattgtcaggcacatattaa

SEQ ID NO: 7444 - DNA, 504 bp, Mus musculus
  misc_feature (173)..(173): n is a, c, g, or t
  misc_feature (176)..(176): n is a, c, g, or t
  misc_feature (178)..(178): n is a, c, g, or t
  misc_feature (185)..(185): n is a, c, g, or t
  misc_feature (194)..(194): n is a, c, g, or t
  misc_feature (203)..(203): n is a, c, g, or t
  misc_feature (225)..(225): n is a, c, g, or t
  misc_feature (246)..(246): n is a, c, g, or t
  misc_feature (263)..(263): n is a, c, g, or t
  misc_feature (267)..(267): n is a, c, g, or t
  misc_feature (333)..(333): n is a, c, g, or t
  misc_feature (434)..(434): n is a, c, g, or t
atgaagcaatgccagatcacatctgatgatagttgtgaattgtgatcactctttttacttaaaggatctcaaggtcatactgggaagacatgctctccacaagacagatctagggatagctaggttcaggatcagagagaagatatccccagatgtttctggtactgactacnatncnaatcctnttgattttncacccatgnagggtcactatgtatctatgcncccaggagagtatcaaagctntctgagttcttctttanaaantcttccaaagactgcaggctttcatcgctctaacaacgaccagttgtaaagctgctttcaatattntctggtaattttttatgttattgccaaattttatcaaaatattatatgcagtaaaaactttaattaccaaagttcatatattgaagtgtatttcctgtttntcttattaaaataatttttaaatgttttaagttttcaaaataaaagtttcaccaatgtatcaactactta

SEQ ID NO: 7445 - DNA, 372 bp, Mus musculus
  misc_feature (41)..(41): n is a, c, g, or t
  misc_feature (231)..(231): n is a, c, g, or t
  misc_feature (243)..(243): n is a, c, g, or t
  misc_feature (281)..(281): n is a, c, g, or t
  misc_feature (331)..(331): n is a, c, g, or t
acaggcctcttggtaccacggtacacagcctccttccattnttaagcatctgctaatgacacagcccctgagccaccaagacttaagttacaggtgcagggtttagggtctgtgcccaccagtcccttcattccttgctgcagagcccagtgtgggagccacacatctttcaggtagctgttttcaagtgcagagctcttaagactgaagtgggtggagctaaaaagtctncctcccctcctncaaaatctatatgcaaggggcagtagacactattaaanccttaacctttgtcactctggagactgaagaacaaattttctttaaattntctctccctttgatacattgccataggccattatgactttc

SEQ ID NO: 7446 - DNA, 390 bp, Mus musculus
  misc_feature (359)..(359): n is a, c, g, or t
  misc_feature (365)..(365): n is a, c, g, or t
gttcaatgagctgacggtgcccatctgccttcctctctggcccgcccctcccagctggcacgaatgctgggtggcaggatggggcgtaaccaactcaactgacaaggaatctatgtcaacggatctgatgaaggtgcccatgcgtatcatagagtgggaggaatgcttacagatgtttcccagcctcaccacaaacatgctgtgtgcctcatatggtaatgagagctacgatgcttgccagggtgacagtgggggaccgcttgtctgcaccacagatcctggcagtaggtggtaccaggtgggcatcatcagctggggcaagagctgtggaaaaaaaggcttcccagggatatatactntattgncaaagtataccctgtggattgagaa

SEQ ID NO: 7447 - DNA, 490 bp, Mus musculus
  misc_feature (288)..(288): n is a, c, g, or t
  misc_feature (324)..(324): n is a, c, g, or t
  misc_feature (350)..(350): n is a, c, g, or t
  misc_feature (373)..(373): n is a, c, g, or t
  misc_feature (429)..(429): n is a, c, g, or t
  misc_feature (432)..(432): n is a, c, g, or t
  misc_feature (434)..(434): n is a, c, g, or t
cagtctcctctcagtaatacatcttcagacttagtatctcctttaaggaaaaaacctctggaagacttagtctgtaagctggcagaggtgagcattagctttgtcaacgagcggaagtcagagcagcacctgcagtttctctccacgctgctcgactccttctcctccgtccaagtatttaacattctcctcagtgacaaacagaagaatgtcgtcaaagccaaacctctggaaataaccaaacttgcagaaaaaaatcctgcagttaagttcttatatcataaattnataggctggctaaatgacagccagaaagaggacggnggcttcctggtggacatcttgtatantgccctccgatgctgtgacagtnggtgtggaaaggaaagaagtcttggatgatctaaccaaggaggacctgaagtgganttntnttcttcaggtcattgaaaaggctttgaaatgaaccaagttgcaaatcctttctcct

SEQ ID NO: 7448 - DNA, 518 bp, Mus musculus
atctatcgaaagtcccaaccagtacgaaaggctatgctattggagccaggacagctgtgaggtttaagccaatcagcaaggatgtgacaccatacccagggatgtatcagaaagttgatactttgagtgaaaaacacaaaaaaagctttgctccatttaatatcttgatgcctcgatttaggagtgcagcaaagggtgattcttaccccggccctggcacatacaatccagagatgaagtcagtcccaaaagttacttggccaatgaaatttggatctccagactggtctcaggttccatgtctagagaaaaggactctaaaggctgagctgtccgcagacaaggactttagaaagcatcgtagccgtgtggcctactttagcctatattaccagtgaaatgtaggcactgtcttcacgtgctgtcctgaccacagagtctccagaactgaggacataattgctcctgtatttctgtgttcctcggccctcttgtctgcccatttcgtgtccagagag

SEQ ID NO: 7449 - DNA, 435 bp, Mus musculus
  misc_feature (384)..(384): n is a, c, g, or t
  misc_feature (394)..(394): n is a, c, g, or t
gaagaacttttccagagattcgatagagacggcagtggaacaatagacttcaatgagtttcttctcacgttaaggcctccaatgtccagagccagaaaagaggtaatcatgaaagcttttagaaagttagacaaaactggagatggggttataaccattgaagaccttcgtgaagtttataacgctaaacatcatccaaagtatcaaaatggggaatggacggaggaacaagtcttcaggaaatttctggataactttgactcaccctatgataaagatggattggtgacccccgaggaattcatgaactactatgcaggtgtaagtgcatccattgacacagatgtgtacttcatcatcatgatgacgacggcttggaagctntaaagacctntccctggaaaccaggccatgcatgcagtcacgtgactccaa

SEQ ID NO: 7450 - DNA, 238 bp, Mus musculus
tgccagctcgtgtcgtggtgaaacagccgatccgtggagccattggtaggaccacagttgcagccattgttcagactggtggggactggagcaccggactcttcagtgtctgcagagacagaaaaatctgtttctggggtctgctttgtcccatgtgtcttgagtgtgacattgccaggcattacggagagtgtctttgttggccactgttaccagggtctacctttgcactgagaat

SEQ ID NO: 7451 - DNA, 526 bp, Mus musculus
  misc_feature (197)..(197): n is a, c, g, or t
  misc_feature (201)..(201): n is a, c, g, or t
  misc_feature (212)..(212): n is a, c, g, or t
  misc_feature (238)..(238): n is a, c, g, or t
  misc_feature (241)..(241): n is a, c, g, or t
  misc_feature (248)..(248): n is a, c, g, or t
  misc_feature (288)..(288): n is a, c, g, or t
  misc_feature (309)..(309): n is a, c, g, or t
  misc_feature (311)..(311): n is a, c, g, or t
  misc_feature (318)..(318): n is a, c, g, or t
  misc_feature (320)..(320): n is a, c, g, or t
  misc_feature (325)..(325): n is a, c, g, or t
  misc_feature (385)..(385): n is a, c, g, or t
  misc_feature (402)..(402): n is a, c, g, or t
  misc_feature (451)..(451): n is a, c, g, or t
  misc_feature (453)..(453): n is a, c, g, or t
  misc_feature (463)..(463): n is a, c, g, or t
gatgcaatggcacagcttaatgaagagtctgctcaggcatttgcaaatctgtttgagcaatggaatgaggattttaagaaattccgagaacaacatgagaaacttgtgaatgattttaagcaacaggagaagatttttcaacgaactagatttgttcagaaccagagaattagaacaattaaagaaatacatgaacnattnttacagaaatnggaagacctggagagcaagaatgatnatntgcttantagaacacaaaatgaacttaaggatgaaattaatgatctncagaaaaaaattttgagagantntgaggantntacgntcttttgatgggaagaatatttgaagaaggaactttaactgaagtgatacagttcaaatnccagcgaggatccatgnttgaagacaagtattaggataaatgatgagatcattagtcattagtttntntcccttgttntttatttagaataacatccagttatgttagtatcaactattcctgtatgtcaaggatttgcct

SEQ ID NO: 7452 - DNA, 435 bp, Mus musculus
  misc_feature (389)..(389): n is a, c, g, or t
gaaaagccagactttgccctgaagtccataggggccagcatcgacttcgagcacacgtcagccacgtataaccacgacaaggctcgctcctactggaactggatccgactgtggaactacgcgcagcccccggatgtgatccttgagccaaacgtgacacctgggaactgctgggcctttgccagtgaccgcggccaggtgaccatccgtttggcccagaaagtctacctgtccaacattacactgcagcacattcctaagacaatctcgttgtcgggaagcctggacaccgcaccaaaggactttgtcatctatggcttggagagcctacccagggaggaagtgttcctaggggcattccagtttcagccagaaaacatcatccaaangtttcagctccagaacctgccacccaggagctttgctgcagtcaag

SEQ ID NO: 7453 - DNA, 245 bp, Mus musculus
ggcagtctgctgtttttgttactagctcagtaccaagtcctgtaaagttcacccgtgatatctctattacaggaagcggcctagcactgccacctaaaccaaaaagcaaggtcaaacgacgcaatctgacccggcttccaaagccaaagcaacagcctcagctgtgtagaagctttgagagaggagatgacatttctgggaaaaagctttgtatattgactgctataaagcccatcaacctggag

SEQ ID NO: 7454 - DNA, 238 bp, Mus musculus
aggaaccttcgcatcgctatctgatcagcacctatgatgaccactacaacaggcacaattataacccaggcttgccagctctgcgtacctggaatggacagaaactgctgtggctgcccgagaagtctgactttccccttgttgcacctcccacaaactatggactattagagcaactgcagcaaaagtggctggcttccaagactagcctgaaagagagcatttatactacatccta

SEQ ID NO: 7455 - DNA, 475 bp, Mus musculus
  misc_feature (300)..(300): n is a, c, g, or t
  misc_feature (302)..(302): n is a, c, g, or t
  misc_feature (304)..(304): n is a, c, g, or t
  misc_feature (319)..(319): n is a, c, g, or t
  misc_feature (425)..(425): n is a, c, g, or t
  misc_feature (440)..(440): n is a, c, g, or t
  misc_feature (450)..(450): n is a, c, g, or t
gtattcccggagtgatgcagacaagtttgtccacatgccaaaagaaataacagctcactttgattgcatgtatgagattttctttcacatttaggccattctgacaaaaggaccaagttgactttctacacataccaggatatctgttctttgatgtatgacagtttcccaagactactgtatctcctgacttcttgaggtttatcaagcagtctctgtataaatctaactactatttcaaagggatttataacctagaaaaactagatttgctccagccaggtggaaaggacaaatccncntntgacaaatgttactnattgtatttctacaatgtataaacacacacacacacacacacacacacactaaattctatccaaattttagagaaacaaatttacttttaatgaggactcgatctnatgttaataactatnttctttatantctacttagcaggtcataacactga

SEQ ID NO: 7456 - DNA, 322 bp, Mus musculus
  misc_feature (179)..(179): n is a, c, g, or t
  misc_feature (197)..(197): n is a, c, g, or t
cacacagccgccgatgggctggaaagcatttgtcccgtggaggatccacttccgggtggctgtagaagtcacttcaaggttgaagaagtaagcaggaagcagcagagtatggacctggaagtctcagagctgtctcctgctgacgagaaagatgaacctgctaggagtgttcctgactngtgtataaaagacgcaangggcagtgagaaggaagcatggagcccccgcgagcctgtggtcacaccggaatttgagaagtcccctccagcaggtgctgatctgctactactgaaggatggtcaccttctcactaaaatggatc

SEQ ID NO: 7457 - DNA, 347 bp, Mus musculus
catcttgtgcaagcccaatggtgaggccattgcctggtacactcctatccactggaagcaagcctgggagaagttagagactgacattgaattcgaaagatgctcagtggtggtcccatcaatgagaaaccacatgtttggatggataacagcatctgtctcttccacaaacgaggagaaagaagaaccaatacagaaaacgccctcccaagtctaccctgtcctctacagagaaaaggaaatcccgccaactgtcttacccaataagagcccctggtgccgcaatcccaacacttctccacatccgtacagctctctgattgactcacatgactcggacatttccg

SEQ ID NO: 7458 - DNA, 273 bp, Mus musculus
atttcaccgcagactagctccgattcctcacagcagcccagctcagaaaccccgccgtcatgtccagagcccgcctcgccaccatctaagccacagccttgccaggagtccaccacaccacaccaagttaaccctgagcctaaaccgcaacagcatacaccacagcctctcccgcctccagagaaacctgcctcatctccgttcctggtacccatggaacctaaaccaattcttccaagcaggaaagcagtgcctctgacctatgtggcccca

SEQ ID NO: 7459 - DNA, 552 bp, Mus musculus
  misc_feature (294)..(294): n is a, c, g, or t
  misc_feature (306)..(306): n is a, c, g, or t
  misc_feature (315)..(315): n is a, c, g, or t
  misc_feature (318)..(318): n is a, c, g, or t
  misc_feature (320)..(321): n is a, c, g, or t
  misc_feature (326)..(327): n is a, c, g, or t
  misc_feature (329)..(329): n is a, c, g, or t
  misc_feature (332)..(332): n is a, c, g, or t
  misc_feature (335)..(335): n is a, c, g, or t
  misc_feature (345)..(347): n is a, c, g, or t
  misc_feature (360)..(360): n is a, c, g, or t
  misc_feature (367)..(367): n is a, c, g, or t
  misc_feature (370)..(370): n is a, c, g, or t
  misc_feature (377)..(377): n is a, c, g, or t
  misc_feature (379)..(380): n is a, c, g, or t
  misc_feature (386)..(387): n is a, c, g, or t
  misc_feature (389)..(389): n is a, c, g, or t
  misc_feature (409)..(409): n is a, c, g, or t
  misc_feature (421)..(421): n is a, c, g, or t
  misc_feature (429)..(429): n is a, c, g, or t
  misc_feature (455)..(455): n is a, c, g, or t
  misc_feature (462)..(462): n is a, c, g, or t
  misc_feature (485)..(485): n is a, c, g, or t
  misc_feature (495)..(495): n is a, c, g, or t
cgcaggaattccatttcaccgcagactagctccgattcctcacagcagcccagctcagaaaccccgccgtcatgtccagagcccgcctcgccaccatctaagccacagccttgccaggagtccaccacaccacaccaagttaaccctgagcctaaaccgcaacagcatacaccacagcctctcccgcctccagagaaacctgcctcatctccgttcctggtacccatggaacctaaaccaattcttccaagcaggaaagcagtgcctctgacctatgtggccccacgctcctgntcctgtgcagcntgcccgggnagntnngcttnntngcntcntctggggctnnnccatagccgaatntttgatntcntcctacntnnggactnntnatccatgccagggagaggantcccaaaccttntcaccttntacaggttccgcatgaacgggagggntaaaaanccttgggtgtagagttcccaggnccaggctcgntcctcagatctggttggcaactgtgtgtaacttcctccaaacatcataggcttttca

SEQ ID NO: 7460 - DNA, 469 bp, Mus musculus
  misc_feature (98)..(98): n is a, c, g, or t
  misc_feature (175)..(175): n is a, c, g, or t
  misc_feature (225)..(225): n is a, c, g, or t
  misc_feature (241)..(241): n is a, c, g, or t
  misc_feature (258)..(258): n is a, c, g, or t
  misc_feature (265)..(265): n is a, c, g, or t
  misc_feature (267)..(267): n is a, c, g, or t
  misc_feature (269)..(269): n is a, c, g, or t
  misc_feature (281)..(281): n is a, c, g, or t
  misc_feature (284)..(284): n is a, c, g, or t
  misc_feature (286)..(286): n is a, c, g, or t
  misc_feature (293)..(293): n is a, c, g, or t
  misc_feature (296)..(296): n is a, c, g, or t
  misc_feature (298)..(298): n is a, c, g, or t
  misc_feature (308)..(308): n is a, c, g, or t
  misc_feature (310)..(310): n is a, c, g, or t
  misc_feature (320)..(320): n is a, c, g, or t
  misc_feature (328)..(328): n is a, c, g, or t
  misc_feature (333)..(333): n is a, c, g, or t
  misc_feature (335)..(335): n is a, c, g, or t
  misc_feature (354)..(354): n is a, c, g, or t
  misc_feature (356)..(356): n is a, c, g, or t
  misc_feature (371)..(371): n is a, c, g, or t
  misc_feature (385)..(385): n is a, c, g, or t
  misc_feature (389)..(389): n is a, c, g, or t
  misc_feature (392)..(392): n is a, c, g, or t
  misc_feature (399)..(400): n is a, c, g, or t
  misc_feature (403)..(403): n is a, c, g, or t
  misc_feature (410)..(410): n is a, c, g, or t
  misc_feature (412)..(413): n is a, c, g, or t
actctccagatttctaccaggtggccctgggcaggaaccttctggaccccaatctgtatagacctgatgtggagaacgactacatgcgctccatgacnagcctgctgggttgtggagagggctccatcagctccctcacagacatcctggtgtggtcagacacagccacacgcangggtgtggctgtgggcattctggcctcgggctgcagctctccagctgacnggctacaagacgaggntccccgcctgcggactntcgccancntnttgcgcagcgcnagntnagctttntcntntggggtgatntntggaactggntcagcccntgcantntgtcacgcacctgctggantntgtggagagacggantatggaaggcatcngttnagntatgcgnnacntggcccntnntctcacctcacgctgggcccgcactggccccagtggtaactagaccagcaagcccc

SEQ ID NO: 7461 - DNA, 379 bp, Mus musculus
  misc_feature (47)..(47): n is a, c, g, or t
  misc_feature (108)..(108): n is a, c, g, or t
  misc_feature (119)..(119): n is a, c, g, or t
  misc_feature (138)..(138): n is a, c, g, or t
  misc_feature (154)..(154): n is a, c, g, or t
  misc_feature (182)..(182): n is a, c, g, or t
  misc_feature (187)..(187): n is a, c, g, or t
  misc_feature (189)..(195): n is a, c, g, or t
  misc_feature (197)..(197): n is a, c, g, or t
  misc_feature (199)..(201): n is a, c, g, or t
  misc_feature (204)..(209): n is a, c, g, or t
  misc_feature (211)..(211): n is a, c, g, or t
  misc_feature (213)..(216): n is a, c, g, or t
  misc_feature (218)..(219): n is a, c, g, or t
  misc_feature (221)..(228): n is a, c, g, or t
  misc_feature (230)..(230): n is a, c, g, or t
  misc_feature (233)..(233): n is a, c, g, or t
  misc_feature (303)..(303): n is a, c, g, or t
  misc_feature (330)..(330): n is a, c, g, or t
  misc_feature (340)..(340): n is a, c, g, or t
aaaggattttggctactcctggacagtggctgaaatggtcttcaaantatgagccttcaactgtaccctagatctaagacccaggagcctgcctcacttcaagaagtntctccccccanaagaaaatcatttcccaantaccttcttttggtgnttaggaagctgccgggagactacctgantaagntnnnnnnncnannntcnnnnnntnannnncnntnnnnnnnntnagnaattttttaaggaatttactaaccaacctcaggactgaaattagattctaccaaggagaagaaggatatnagagaagattggaagatgaaatggagncctttatttncataatcctgcagggcagaaatggtttttaccacctaag

SEQ ID NO: 7462 - DNA, 417 bp, Mus musculus
  misc_feature (331)..(331): n is a, c, g, or t
acaagatgttggtacccaggcttccccccaaggtagtctcaactcaagggtccctgtagaggcaagagtggtggtcgaagaggcagccatagctcctcagggtgagcaggcaccaattatcccgggacctagtggagatgctgcaacaacagctggaagtcgactcttggaattttccgtaacagtgccgttccggactgctgtggaggcaaacattgcatgcagaaccctggcctcaaatatccagcagcagcaagtgatggttcagcaggagttcactgtcaatgacactattctcactgttaggtggaccacagaagatcctgttctnttccgaacatccatcaatgcctttcttgaccaactttcccttgtggtgagaaacatcccacgcccagtgtttatggctgtcttcaa

SEQ ID NO: 7463 - DNA, 432 bp, Mus musculus
  misc_feature (323)..(323): n is a, c, g, or t
  misc_feature (326)..(326): n is a, c, g, or t
  misc_feature (328)..(328): n is a, c, g, or t
  misc_feature (330)..(331): n is a, c, g, or t
  misc_feature (341)..(341): n is a, c, g, or t
  misc_feature (361)..(361): n is a, c, g, or t
  misc_feature (369)..(369): n is a, c, g, or t
  misc_feature (394)..(394): n is a, c, g, or t
  misc_feature (407)..(407): n is a, c, g, or t
aaccaggaggttgcagatcgagagtggcgtcgaaaggaaaaggaaaatgcgcagaagaagatagagacagaggaaaagctgcgcaaaagccggctggagcaggtggcattcaaggaacacacgctggccgttcaggttcagcgtgaccgagatgagttcgagaggatccttcgggctcagagagagcagattgagagggagaagcaggaacaggagaagaaagccaaggggtgcctccagcatgccaacgagctccgacggcaggtgcgtgagaaccagcagaaacacgtgcagaaccggctcgctaccttcgaagagggccnccncntnnaggaggaagntgagaagcgccgcgagcgcntcgagganatcaagaaacagaagctggaagagntgagagccaccgnccttcctgagaagtactgcatcgaa

SEQ ID NO: 7464 - DNA, 454 bp, Mus musculus
  misc_feature (284)..(284): n is a, c, g, or t
  misc_feature (289)..(289): n is a, c, g, or t
  misc_feature (293)..(293): n is a, c, g, or t
  misc_feature (296)..(296): n is a, c, g, or t
  misc_feature (301)..(301): n is a, c, g, or t
  misc_feature (320)..(320): n is a, c, g, or t
  misc_feature (323)..(323): n is a, c, g, or t
  misc_feature (331)..(331): n is a, c, g, or t
  misc_feature (349)..(349): n is a, c, g, or t
  misc_feature (356)..(356): n is a, c, g, or t
  misc_feature (367)..(367): n is a, c, g, or t
  misc_feature (369)..(369): n is a, c, g, or t
  misc_feature (372)..(372): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (408)..(408): n is a, c, g, or t
  misc_feature (420)..(420): n is a, c, g, or t
aagtgtctcaggaaatccatcaaggtctcaaagacacaggcctaactgctctgagcagtgaaaacagggcatcacttgtaggacaactgcggaacattgccaggaaagagaattgcattcgtatcatcattgaacaacggatgcatttatttcttaaatgctgtttgattcgtggcatgcaagaatctcttctagacttccctggatgctttcttttcattgagccagagttagcagaactaggatggaagtttgttaatctgatgcaccacaaccagcatgtntttancccntantatgntgaaatcctaaaaaacatnatntcaacacnaaatgatgaagacgaagnaaagccnatcaaataatncntgntcccaantnctgncaccaggaatccaaagagaggtntcattatgttcntaggataacatcacccatggccaacaactgcagg

SEQ ID NO: 7465 - DNA, 279 bp, Mus musculus
gacacagatgtccatgaggacttctgcatgttttttgtgcagggtctgggacctgaacatttttaattataagactcaaccttgaggaccaaagctagtgtaccaacagggaagggggcttaggaaaagccagtgatggagcaggcagcaggagtaggagtccaggcccagtggtggacagctgcaagaaacagcagggctggggaagagactataaggtgtccagacctcctacctcaggaatctaattctataccaaagtcaaaatctggaggagct

SEQ ID NO: 7466 - DNA, 271 bp, Mus musculus
gtgtcagcgcggatctatggcagaagtcccagcctgggcattgggccagtgccaaaaacactgtctgctacagctgaaaggtcacgttctgagatgcagtttctaagtgggagacaggaaaaactacagaatgtgagaaagggaaaactggctaccacaagactgtgataggatgacagaaggctaaatttgctgtcttaaaaatagagagtgtgaggtcagagagaagtgattgtgaacttcgatgaaaccttctgatatcatgtctgta

SEQ ID NO: 7467 - DNA, 411 bp, Mus musculus
  misc_feature (288)..(289): n is a, c, g, or t
  misc_feature (291)..(291): n is a, c, g, or t
  misc_feature (293)..(293): n is a, c, g, or t
  misc_feature (295)..(301): n is a, c, g, or t
  misc_feature (306)..(309): n is a, c, g, or t
  misc_feature (313)..(314): n is a, c, g, or t
  misc_feature (318)..(318): n is a, c, g, or t
  misc_feature (320)..(320): n is a, c, g, or t
  misc_feature (322)..(322): n is a, c, g, or t
  misc_feature (330)..(330): n is a, c, g, or t
  misc_feature (332)..(332): n is a, c, g, or t
  misc_feature (337)..(337): n is a, c, g, or t
  misc_feature (347)..(347): n is a, c, g, or t
  misc_feature (350)..(350): n is a, c, g, or t
  misc_feature (374)..(374): n is a, c, g, or t
  misc_feature (381)..(381): n is a, c, g, or t
ggagcgactccagttcacacttgcacattcctaccatttaactagttttagactgaaaggaagcatccagagaatgaaagaaagtctgatgggcattaaaactgacttcccagacctaaaagcgatgacgagaacagaaaatactcttgcgaggatcagaagcagcactgtgagtgaacctaatcaccttcctgaggtgctattgacaaaaaagcaagcgtcggccaaaggacgatgtcttatagaagagatttctagttcggaaatccaggtggaggttaagaaacnngngnannnnnnnaaggnnnnaaannatcngnangagaaacntntgaanattgagctgnaantcgagttacccgggattaagtcangtctctntctgtgaacttagtgtttctgaggttgata

SEQ ID NO: 7468 - DNA, 479 bp, Mus musculus
  misc_feature (33)..(33): n is a, c, g, or t
  misc_feature (40)..(40): n is a, c, g, or t
  misc_feature (44)..(44): n is a, c, g, or t
  misc_feature (213)..(213): n is a, c, g, or t
  misc_feature (309)..(309): n is a, c, g, or t
  misc_feature (330)..(330): n is a, c, g, or t
  misc_feature (379)..(379): n is a, c, g, or t
  misc_feature (391)..(391): n is a, c, g, or t
acgctggttcccaagaggctgcagatggcaaanggaagantccntgatatagcaagcccctccagggacagcccactgaacatcaagcacaaagtggcacatcagatttggggttctgaagtcccttgtccaacatttctagcttacagaggtctccgtatgtccccctgtatgcagcccaaaaagccaggctttgagctcctcatgagttanaggaacagagggaaggccctgctgaaacggcttcagcgacaatgggattatgaaagcaagttgggctcctcggaggactcagggacggatcgattntcctccaataccagtggaagntcagggcgcaaattcaagtgatttcaagaaagaagccacagacctaganccctacctcgtntctgtgttaagccattgagacaggagttccaagaaggctttgatggattgtgcacatagggaagatcttgctagaaacttccctgggc

SEQ ID NO: 7469 - DNA, 499 bp, Mus musculus
  misc_feature (180)..(180): n is a, c, g, or t
  misc_feature (472)..(472): n is a, c, g, or t
  misc_feature (474)..(474): n is a, c, g, or t
gtgtgccatatgcttccatctataaaggcaggatgtatggctgggacactcagccctgagctgcaaagctgtctcatggaacaccaagaaaacatcaggtgaggagcctgggctctggagatgatcagacatgggtaccacctgcttttacacacatgaggcaccaaaccccaagagctncctaggatataggcaacctgatggtgcttgaactttcaagagggaggccttctggaaagttccacttccatttcagaggtcggcacttaacttaccactccttcccttatgagtctaacttaaaaatacttctggaggcatggtgactcatgctggtgatcgtaggaaaccacttggaaactgaggcaggaggatggagaattttagaatagcttgagctttgtagtgtgtttcaatgtgaataactgaatgagtactaaaaacacttgagcttttcagaatcaatgagttntnttggtatctgcaggcatcatgccac

SEQ ID NO: 7470 - DNA, 557 bp, Mus musculus
  misc_feature (29)..(29): n is a, c, g, or t
  misc_feature (48)..(48): n is a, c, g, or t
  misc_feature (66)..(66): n is a, c, g, or t
  misc_feature (113)..(113): n is a, c, g, or t
  misc_feature (236)..(236): n is a, c, g, or t
  misc_feature (380)..(380): n is a, c, g, or t
  misc_feature (383)..(383): n is a, c, g, or t
  misc_feature (414)..(414): n is a, c, g, or t
  misc_feature (444)..(444): n is a, c, g, or t
  misc_feature (473)..(473): n is a, c, g, or t
  misc_feature (475)..(475): n is a, c, g, or t
aggaggtcaagcacaagttcatggtgcanacagtgtttgctcctccgnacatttcggatctggaanccgtgtggagggaggcacaccctggggaactaatggattcgaaactnaggtgtgtgtttgaaccgccgacagaaagtgacaaactggaagatggcttgagactcagaaaggcaacgcatcccgacaagcccagaccctcctcctccacgtccttgaagccggctcgcagnacgcctcttcctgttgttctgctggtgatcggagcagttttctttggattctttctagggaaattcgtcttgtagagtgaggcacgcacactatccccctcaccctacactccccctcccccaactaagaccagaaaaaaaaanttntttatccatcatctattggaagtatggcccncccgcggtggcagattttgtgtgcgagtantcacataggcttcttcacccctaatgatntnttgtgattggaggacgcaataaatgaacaaaccaaataaagaactgatgggctactggacagattgcctattatcggatcat

SEQ ID NO: 7471 - DNA, 524 bp, Mus musculus
  misc_feature (474)..(474): n is a, c, g, or t
  misc_feature (476)..(476): n is a, c, g, or t
  misc_feature (495)..(495): n is a, c, g, or t
gctggacgaactcaagcgcttctttgaggctgcggcggaggacggcgctggcttgcagaggcagccagagaccggaggccggctgcaccccgccgttcaggacggctgtccggtactggggcagttgccaccgctcgttgccccgtcactgctggagcaggaggtgcgacgagtgcgcgagcgcgagcgggagctgcagttgcagcggcgcagcatctacggcgacgccgaggtccaggagccagcgccgagcctcaccccgagcaggggagatggaaaattgtcggtgatctggcctccgcggagacgggcctctgagaaggagcgcagaccctgaggtctatgaaggttgggacctgcggacagaagtaacataccctttggagaaccagggtagggttactctccagatcagcagaaggcctagagagggaagggctagctttctttaatggcaacttgaaatccagcccntntttgatactgactatgganttaaccacctttctccataaaattctcta

SEQ ID NO: 7472 - DNA, 430 bp, Mus musculus
  misc_feature (61)..(61): n is a, c, g, or t
  misc_feature (63)..(64): n is a, c, g, or t
  misc_feature (69)..(69): n is a, c, g, or t
  misc_feature (80)..(80): n is a, c, g, or t
  misc_feature (89)..(89): n is a, c, g, or t
  misc_feature (103)..(103): n is a, c, g, or t
  misc_feature (133)..(133): n is a, c, g, or t
  misc_feature (308)..(308): n is a, c, g, or t
taacttcgtgtagtgttgtaaccttaaaaatccagacatgaaacggaagggaaacaggtantnnaaccnacatgtacttntgagagctnctcaacacctgttnattttaaatttgtcatacttcggggggggngtactgggggaggtgaggaaccaggcatttaattccaacgcttgggaggcaggaggctcactggagttccaggccagcttggtctgcacagtgagttccagattagcaaggactacgtaagtaagaccctgcccttttctcccacccacccagaaaataaatttatcatggctgntttcttgattctgcacatgacagaaggctttgcattacaccaatagaatgaacacgaacaaatacttctcaaatacactctcttcctggcatgtgtttggagctcaggttccaagttggaaa

SEQ ID NO: 7473 - DNA, 345 bp, Mus musculus
  misc_feature (215)..(215): n is a, c, g, or t
  misc_feature (221)..(221): n is a, c, g, or t
  misc_feature (237)..(237): n is a, c, g, or t
  misc_feature (239)..(239): n is a, c, g, or t
  misc_feature (280)..(280): n is a, c, g, or t
  misc_feature (294)..(294): n is a, c, g, or t
  misc_feature (318)..(318): n is a, c, g, or t
  misc_feature (320)..(320): n is a, c, g, or t
gatggagcagcacactagtaaccctactaaggaaaaagccaaagaggaagatagcgttgcgtgtttttgtccagcaaaatcctcccccagttacattgatcttccagcaaatttcacgccagctaatttcttgaccatccagacaaagctgtcttcaggagctggtcagaagcccaagggatgcctcggagtcctcgagtgcatgtatgccaacntccagntccagacccagcttgntnaacgacagatagctattttggaaaacttgcaggcatccctntcacagccgggttntgggagggagagcaagaactgttntntccctggcttatgttgcaaactgtt

SEQ ID NO: 7474 - DNA, 433 bp, Mus musculus
  misc_feature (343)..(343): n is a, c, g, or t
  misc_feature (361)..(361): n is a, c, g, or t
  misc_feature (366)..(366): n is a, c, g, or t
  misc_feature (368)..(368): n is a, c, g, or t
  misc_feature (379)..(379): n is a, c, g, or t
  misc_feature (393)..(393): n is a, c, g, or t
aaatctgtacgttgatctcctaacccccaaattctagaatgtaggaagagatgagccctttaggagtggttcaaaatgaagccgtcaggctgggtcctaatccaattttactggtgtcataaggtgactaagcccctcagagggttggggggggggcacctagtgggggaactcccacgaggaacgggccacctgtaggcccaggaggcggggtcatacaggaccttttcatagctgactaaggctttgccttcaccatgcaaccacttaggaattcaatggagctttaggagtgactctattgtaaaggccagtttgcttaggtcttttgcatattatgctntataccgcctagggattnctgcnancaaggccattnccttgaccttgtancagagccatgagctaaaacaatacaacttacccaagctgt

SEQ ID NO: 7475 - DNA, 516 bp, Mus musculus
  misc_feature (295)..(295): n is a, c, g, or t
  misc_feature (342)..(342): n is a, c, g, or t
  misc_feature (452)..(452): n is a, c, g, or t
  misc_feature (481)..(481): n is a, c, g, or t
  misc_feature (491)..(491): n is a, c, g, or t
taggagccgggcttccataagacagctgtgcccgcctgggatcacttggctggccctggcctatttgctcagctgcctgcttgcctccagcaaggccaaggtcttcagtcgctgtgagctggccaaagagatgcatgacttcggtctggatggctaccggggttataacctggctgactgggtctgccttgcttactacacaagtggcttcaacacaaatgctgtggatcatgaagctgatggaagcaccaacaatggcatcttccagatcagcagccggaggtggtgcagaacnctcgcctcgaatggccccaatctttgcaggatatactgcactgattngttgaacaatgatctcaaagattctatcgtctgtgccatgaagatagttcaagaacccctgggtctgggctattgggaagcctggaggcaccactgccagggcagggacntcagtgactgggtggatggctgtgacttntaggaccctntctggatggaccaagccgcatacag

SEQ ID NO: 7476 - DNA, 542 bp, Mus musculus
  misc_feature (375)..(375): n is a, c, g, or t
  misc_feature (414)..(414): n is a, c, g, or t
  misc_feature (424)..(424): n is a, c, g, or t
  misc_feature (431)..(431): n is a, c, g, or t
  misc_feature (448)..(448): n is a, c, g, or t
  misc_feature (455)..(455): n is a, c, g, or t
  misc_feature (513)..(513): n is a, c, g, or t
atgtccccattatgttccatgtctgctcctctacttgctatcgggacatcagggaaaccagctttgttttagaaggtttccctagtagaagaatagctctacatatggactgggtaaaagagagcaaagtcagcaatgtctcgttctatttgtaaaacccacaaatatttctgtataagtaattcacctcttagagcacgggttctgcaaggagggacccatggttcttctctgctgagttctctctgatcctcctcctcacgaaagcctgattgttagaaatcggtgctgagctctgactcaaggagtaggaaaggcctttggagttcagtagggaccttgagaagttcctggagaacacgtttatagtaaagnggggggggggttcaaaacatttgccaaaagaactgcatnttatactttntcttttnatggacctatattcaangacaggntagcagcttgaagccattatggggaactatgttgcacgaggccacaaagttatgtgtncaggtactaaatgttagctcgtgcaccct

SEQ ID NO: 7477 - DNA, 517 bp, Mus musculus
  misc_feature (468)..(468): n is a, c, g, or t
agaggtcacagcgttccagcggttgcttcaccatcttgttgcctttgctcagtgtggggagtggcatttctgtttgggtgggaaaaatcagaaagtctaggcttttcaagaaatggggtcacagtattaaatacttggcaaaaagttgttctgaaagaagattttgttttgggaaaagcttctttaaatgtatgagggtaaatctaaatagtcgaggagacaagatccagagcgtgtttgtatgctatcctgtcacagtggtagctgtggtgcgagagagagccagactgctggcttaccacaggacacaggcggaccctgatccccaacgtgtatgtctgcaagcatatgtgtgtgtgtgcttaaaaaccctgtggcattttctgaagatcttttcctcattgaaaagatgtggttttggtaaaccttcagttttgtgtatttaggacttgtggttagatttaagcntcttggtctgtgttttggaaatcaggagatgtgacctggcacccggcat

SEQ ID NO: 7478 - DNA, 344 bp, Mus musculus
gagaagttggtctttgagctcccctttcacgaatcaaatattgccctgacaacgaattcgttttctatacatacctatgctgaatggccccactcctactcccaagggcaaagaatgtccactaagtccaacaagcagaaggatgctgggcagaacttcagggtaaacaggcaaccggaaaccagcgggccttcgaaggtggctattcagcccatgtactacgactactacggtggggaggcaggggaaggtggggctgtggctggccagaacaggctgcattggtctcaagaaaggatcttgatgtccttcgtgcttgttttcttgggcagcggagtctagct

SEQ ID NO: 7479 - DNA, 111 bp, Mus musculus
ggtgttacatcctgaagttcaaagactagatctgaggagctgtgatatctcagatgtggctctccagcacctgtgtaagtgcagaaaactgaaggcactaaatctaaaatc

SEQ ID NO: 7480 - DNA, 436 bp, Mus musculus
  misc_feature (91)..(91): n is a, c, g, or t
  misc_feature (112)..(112): n is a, c, g, or t
  misc_feature (237)..(240): n is a, c, g, or t
  misc_feature (243)..(246): n is a, c, g, or t
  misc_feature (279)..(279): n is a, c, g, or t
  misc_feature (309)..(309): n is a, c, g, or t
  misc_feature (341)..(341): n is a, c, g, or t
  misc_feature (358)..(358): n is a, c, g, or t
  misc_feature (362)..(362): n is a, c, g, or t
  misc_feature (364)..(364): n is a, c, g, or t
  misc_feature (379)..(379): n is a, c, g, or t
  misc_feature (383)..(383): n is a, c, g, or t
  misc_feature (385)..(385): n is a, c, g, or t
  misc_feature (388)..(388): n is a, c, g, or t
  misc_feature (395)..(395): n is a, c, g, or t
  misc_feature (401)..(401): n is a, c, g, or t
  misc_feature (404)..(404): n is a, c, g, or t
gactttgaccctgagcagagacatgacaatccagaagacgggttgcagaggccgggaagcagctgaggtagttgaacagagaaggagaagncaccactgtgatgacaggaancagacgctgttggcactgctcatcttggtgctctacctgggtatggggatatcaggaagcagctgggaagtgtcaggacagaccaaggactgcaaccactttcagaatcctgtgacaccccaggnnnntgnnnntcaaaccaaggaacctgctgaagagccattaangaccctcaggaagtggctgaagataaactngcatggctttttggagaagttagagaaggagntcagagagctggagcanctgntncgggacctggaattntggntngangcccttntggganatntgcgcccagaggatccctgcttcacctaaaag

SEQ ID NO: 7481 - DNA, 237 bp, Mus musculus
  misc_feature (35)..(35): n is a, c, g, or t
  misc_feature (47)..(47): n is a, c, g, or t
  misc_feature (51)..(51): n is a, c, g, or t
  misc_feature (104)..(104): n is a, c, g, or t
  misc_feature (117)..(117): n is a, c, g, or t
  misc_feature (120)..(120): n is a, c, g, or t
  misc_feature (123)..(123): n is a, c, g, or t
  misc_feature (128)..(128): n is a, c, g, or t
  misc_feature (131)..(131): n is a, c, g, or t
  misc_feature (172)..(172): n is a, c, g, or t
  misc_feature (174)..(174): n is a, c, g, or t
aaagggagggatgtctaaacatgactttctgtganccagagtttttncttnttcctagtcaagagttaatatttaccctgagaggaagatgtccttgggtcttnagataacagtttnttnttntgaanttnattcttgttatgagaaaatgactccaaaaatgataatattntntgccaggtgcaactaagtaaaaatgttattttttgagcaaaatttgcaaagtcataccccatg

SEQ ID NO: 7482 - DNA, 194 bp, Mus musculus
  misc_feature (92)..(92): n is a, c, g, or t
gatgtaatcactgccatactgcatccatggtgtcatgaattctcttactgctaacatatagcactctataacacacattcattcatgatccngtgaaccagatactgagtaatatacagccattgttctagagctgctgcggatataaaaacactcagaaaggaatataaaataaatcaggaaggccagagcca

SEQ ID NO: 7483 - DNA, 534 bp, Mus musculus
  misc_feature (50)..(50): n is a, c, g, or t
  misc_feature (55)..(55): n is a, c, g, or t
  misc_feature (69)..(69): n is a, c, g, or t
  misc_feature (81)..(81): n is a, c, g, or t
  misc_feature (84)..(84): n is a, c, g, or t
  misc_feature (96)..(96): n is a, c, g, or t
  misc_feature (103)..(104): n is a, c, g, or t
  misc_feature (110)..(110): n is a, c, g, or t
  misc_feature (112)..(112): n is a, c, g, or t
  misc_feature (119)..(119): n is a, c, g, or t
  misc_feature (129)..(129): n is a, c, g, or t
  misc_feature (142)..(142): n is a, c, g, or t
  misc_feature (147)..(147): n is a, c, g, or t
  misc_feature (149)..(151): n is a, c, g, or t
  misc_feature (154)..(154): n is a, c, g, or t
  misc_feature (156)..(157): n is a, c, g, or t
  misc_feature (162)..(162): n is a, c, g, or t
  misc_feature (164)..(166): n is a, c, g, or t
  misc_feature (281)..(281): n is a, c, g, or t
  misc_feature (290)..(290): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (302)..(302): n is a, c, g, or t
  misc_feature (305)..(305): n is a, c, g, or t
  misc_feature (313)..(313): n is a, c, g, or t
  misc_feature (333)..(333): n is a, c, g, or t
  misc_feature (338)..(338): n is a, c, g, or t
  misc_feature (345)..(345): n is a, c, g, or t
  misc_feature (347)..(347): n is a, c, g, or t
  misc_feature (349)..(349): n is a, c, g, or t
  misc_feature (380)..(380): n is a, c, g, or t
  misc_feature (403)..(403): n is a, c, g, or t
  misc_feature (413)..(413): n is a, c, g, or t
  misc_feature (420)..(420): n is a, c, g, or t
  misc_feature (448)..(448): n is a, c, g, or t
  misc_feature (456)..(456): n is a, c, g, or t
ctgggatgtcagcagacgaatcaatacagctgccgtgtttcagcctggancgggnagcattaaccaacntctcggtcatcntancacatctggagnaagtcanngtgttnancgagaanacagtagatncttcttgggtganaagangnnnaananncatcngnnntttcaacccactgaatttaaacatttctgtgcctggaaatactgatgaatcctatgattgtaaagtgttcgtgcttacggttttaaagcagttctcaaactgcatggcagaactncaggctaanganantantacntgntgagtgangggggggggggggtgcagtntcctnagcagtncntntccttcgagggctgagcttgcaacccagganttaactccaaagggactgtgcgntcattactantcatgtnatttatgtttttattttgtccactgaantcttgttntgctaccctgtagggactggaagtggcagctatatttatttatttatgtactgagtttgttaacgctccatggaggag

SEQ ID NO: 7484 - DNA, 406 bp, Mus musculus
  misc_feature (226)..(227): n is a, c, g, or t
  misc_feature (229)..(246): n is a, c, g, or t
  misc_feature (248)..(248): n is a, c, g, or t
  misc_feature (252)..(255): n is a, c, g, or t
  misc_feature (257)..(258): n is a, c, g, or t
  misc_feature (261)..(261): n is a, c, g, or t
  misc_feature (263)..(263): n is a, c, g, or t
  misc_feature (267)..(267): n is a, c, g, or t
  misc_feature (291)..(291): n is a, c, g, or t
  misc_feature (294)..(294): n is a, c, g, or t
  misc_feature (331)..(331): n is a, c, g, or t
  misc_feature (334)..(334): n is a, c, g, or t
  misc_feature (345)..(345): n is a, c, g, or t
  misc_feature (371)..(371): n is a, c, g, or t
  misc_feature (381)..(381): n is a, c, g, or t
ccaatccatgcgtgaataatgggtgaggaacagcagaagcctgaagaacttaatgcacctactgacgatgctcctcaggagaagcagcagccagctgatctatcctcagaaacagagaaggcaaagtccaagaaaaaacaggagctttctgaaaaggaccaagttgtaaagatccaagcttggtggcgcggtacactggtacgtcggtcgctgttgcacgcagccnncnnnnnnnnnnnnnnnnnntnctgnnnncnnttnanactnccaaagattatggagaagaggcgncantccatgctggataccttccaacaggagcagtgggcantcntcaggttgcantcctggatccgcatgtggcgtatccncaggcgttantgccggttgcttaaggctttccgga

SEQ ID NO: 7485 - DNA, 177 bp, Mus musculus
  misc_feature (64)..(65): n is a, c, g, or t
  misc_feature (96)..(96): n is a, c, g, or t
  misc_feature (108)..(108): n is a, c, g, or t
  misc_feature (122)..(122): n is a, c, g, or t
  misc_feature (125)..(125): n is a, c, g, or t
  misc_feature (128)..(128): n is a, c, g, or t
  misc_feature (136)..(136): n is a, c, g, or t
gttagtaagtttcaaccctgaatgctgcaccagatctagaacttgacgagatcagctgtgaacnngggtgaccgtcacaacaggaggactttgctntccacagaagtntttctaggtgcacnggnttntcttctcnagactttctgctccttgacatcctttgataataactcaggt

SEQ ID NO: 7486 - DNA, 540 bp, Mus musculus
  misc_feature (65)..(65): n is a, c, g, or t
  misc_feature (67)..(67): n is a, c, g, or t
  misc_feature (69)..(70): n is a, c, g, or t
  misc_feature (72)..(72): n is a, c, g, or t
  misc_feature (81)..(81): n is a, c, g, or t
  misc_feature (85)..(85): n is a, c, g, or t
  misc_feature (88)..(88): n is a, c, g, or t
  misc_feature (90)..(90): n is a, c, g, or t
  misc_feature (100)..(100): n is a, c, g, or t
  misc_feature (104)..(104): n is a, c, g, or t
  misc_feature (107)..(107): n is a, c, g, or t
  misc_feature (134)..(134): n is a, c, g, or t
  misc_feature (174)..(174): n is a, c, g, or t
  misc_feature (180)..(180): n is a, c, g, or t
  misc_feature (184)..(184): n is a, c, g, or t
  misc_feature (202)..(202): n is a, c, g, or t
  misc_feature (217)..(217): n is a, c, g, or t
  misc_feature (248)..(248): n is a, c, g, or t
  misc_feature (290)..(290): n is a, c, g, or t
  misc_feature (295)..(295): n is a, c, g, or t
  misc_feature (305)..(305): n is a, c, g, or t
  misc_feature (368)..(368): n is a, c, g, or t
  misc_feature (401)..(401): n is a, c, g, or t
  misc_feature (410)..(410): n is a, c, g, or t
tgaatagcacttattttcatctgtgctctggctcagcaagagtgagacatgtgctgaggcacatnangnncntactggggnaacnggnangattctgagngtgntanatttttcttgtccttataggtcatcanggaaaattacaaaatcattctacaaaattgcaaagacttngagccnaaantctgtaacatgttttctncttagtcttgggtgntccatatttttcaaacccatactcccaaaanggagacctacttaaatttctcttgtaaagattgttaccagangtaanttattttctnctgtgttgccaaggacagccatgggctgtaagtctgtgctgctaaatgacagccaaagaaggntctttagcacaattcttgtttttagattttggnttgagcttngattacttttgttatttggtttccttttgtttcattagaagttttttgtttgtttctttgctgttgttttgttttgtaattgatttaatgttttgataaggctatacagtatacttattgactgcccact

SEQ ID NO: 7487 - DNA, 490 bp, Mus musculus
  misc_feature (288)..(288): n is a, c, g, or t
  misc_feature (336)..(336): n is a, c, g, or t
  misc_feature (362)..(362): n is a, c, g, or t
  misc_feature (372)..(372): n is a, c, g, or t
  misc_feature (375)..(375): n is a, c, g, or t
  misc_feature (408)..(408): n is a, c, g, or t
agaagcgacttttctcttgcaacgccaagttccttcagaccacctgaagaaattctaacacatcggcctgctccattaaatgaggtgtcctctctttgtatggactcacagagaatcttcactcaagcaaacgacagcactgtgaatttcattataacctctattactcaaaaccgcggggacatgtctcacttgtggaatagttgtattgaaatgcaaggagagccttcctttcagcctgggtttcctcacttttcatccagttcatctacttattctgactcaaanagcaaagggcgaacctgagttaccgatacacaaggaaagagtagcatntaccacgttggcatcaacatcaaacnatcactcatnttnttgaggccatcagttttatgattaccaacaatntacttggttctttaggaagacattcatcatagcagagattagaattcatgttgacaaacacctggagtgtacctgagattat

SEQ ID NO: 7488 - DNA, 450 bp, Mus musculus
  misc_feature (275)..(281): n is a, c, g, or t
  misc_feature (283)..(283): n is a, c, g, or t
  misc_feature (285)..(286): n is a, c, g, or t
  misc_feature (288)..(288): n is a, c, g, or t
  misc_feature (290)..(290): n is a, c, g, or t
  misc_feature (292)..(292): n is a, c, g, or t
  misc_feature (295)..(299): n is a, c, g, or t
  misc_feature (303)..(305): n is a, c, g, or t
  misc_feature (310)..(310): n is a, c, g, or t
  misc_feature (312)..(313): n is a, c, g, or t
  misc_feature (317)..(317): n is a, c, g, or t
  misc_feature (333)..(333): n is a, c, g, or t
  misc_feature (340)..(340): n is a, c, g, or t
  misc_feature (351)..(351): n is a, c, g, or t
  misc_feature (354)..(354): n is a, c, g, or t
  misc_feature (361)..(361): n is a, c, g, or t
  misc_feature (376)..(376): n is a, c, g, or t
  misc_feature (397)..(397): n is a, c, g, or t
  misc_feature (402)..(402): n is a, c, g, or t
  misc_feature (425)..(425): n is a, c, g, or t
atcctggatttatcacctgtatctagatcttcattaagaaccaacttcattaagagacttgtctacctgggccccagatcctctgctctgtgcggagctgaaaggagccgggtctccagtacgcagccctgagccctggcccagccaccttcccttccattagacaccaccacctgttcctggtctatttcctgctctgactgtgccacgtgggtttccgctctttctcaggcctaaggaagccctcctgccctgaggttccctcaggcctcgcnnnnnnncntnncncncnctnnnnncccnnnccctncnnggtncctcctgcttgcccancaagctnagcttctaggnagntggaaantgcgacaattacatnacacccgaggcccaccaagangactntgccttttgagtttgttttattntttctcattgttttcccaggcttta

SEQ ID NO: 7489 - DNA, 538 bp, Mus musculus
  misc_feature (274)..(274): n is a, c, g, or t
  misc_feature (295)..(295): n is a, c, g, or t
  misc_feature (297)..(297): n is a, c, g, or t
  misc_feature (326)..(326): n is a, c, g, or t
  misc_feature (329)..(329): n is a, c, g, or t
  misc_feature (331)..(331): n is a, c, g, or t
  misc_feature (359)..(359): n is a, c, g, or t
  misc_feature (384)..(384): n is a, c, g, or t
  misc_feature (390)..(390): n is a, c, g, or t
  misc_feature (493)..(493): n is a, c, g, or t
tggcctctgtgaccccacatgagaagtcactgtcatgattatgggcatacccagttctgaaggcagcagagaccattgcagtgggctaggtttcaaaactaggagagtcagcagggattcttttaaggatgaaccaagcaagtctccaaaagacacaaggatgtatcctgaaaccaaaagtcccacgcaaaacgttcaaacacaaagattctggcatcaggaacttcttgagttgctatttatggaagttcaagaggttcccccaaacaatatnagtgaccttggaaaccatatnanttctgctgttggctgtcccgttcagcctntcntnttcactgtgcaggaaccatccaagggantgcatgccaaggactggggaatcantacaantcatttgaagattcactaccttttcggaagcttggaaggaaaaacataatgaataagcccatgatgatttggtgcttttaatgtttttttgtttgtttgtttntcttttcaactcttcatgttgtgttgatttatcccagggcatcat

SEQ ID NO: 7490 - DNA, 557 bp, Mus musculus
  misc_feature (92)..(92): n is a, c, g, or t
  misc_feature (98)..(98): n is a, c, g, or t
  misc_feature (173)..(173): n is a, c, g, or t
  misc_feature (175)..(175): n is a, c, g, or t
  misc_feature (183)..(183): n is a, c, g, or t
  misc_feature (250)..(250): n is a, c, g, or t
  misc_feature (297)..(297): n is a, c, g, or t
  misc_feature (329)..(329): n is a, c, g, or t
  misc_feature (342)..(342): n is a, c, g, or t
  misc_feature (392)..(392): n is a, c, g, or t
  misc_feature (432)..(432): n is a, c, g, or t
  misc_feature (448)..(448): n is a, c, g, or t
  misc_feature (475)..(475): n is a, c, g, or t
  misc_feature (477)..(477): n is a, c, g, or t
  misc_feature (480)..(480): n is a, c, g, or t
acactgactggtccattgactgcttcccgctctcagagtctgagcctgatgttcaccctggtgaacagcagtgtcgaccttcatcaccacanaagggntcgggcaaaggatgctggggccaggcgcaagaagccagggccaggtgttcgtcagcacaggcactccagcacaancngactgagngcctcacgaactcttcaccccacagagacccgggatatcttgccactcctaagttcccgaaagcttnttccctctggggaagtccttacacagcaggaaggtgtgaaggctganacgtcagagctcctgcccgtgatcccagagtntccctccagactntgtcttggtgaggactcactgggtaggcaggagtacaaggtccaggtgtnccggaaaagcgtggacctgagttgccccatggtggccctntcagtccagaacacanccgagagcagatacggcttccgcttcntntgntaccctcccatcactgaggaattgtgtcggcggttgtaggtcagccaggccaggcaggcagtgacaacttcataatt

SEQ ID NO: 7491 - DNA, 499 bp, Mus musculus
  misc_feature (280)..(281): n is a, c, g, or t
  misc_feature (286)..(286): n is a, c, g, or t
  misc_feature (291)..(291): n is a, c, g, or t
  misc_feature (297)..(297): n is a, c, g, or t
  misc_feature (304)..(304): n is a, c, g, or t
  misc_feature (394)..(394): n is a, c, g, or t
tgaggaatgtgatggttctccaggatgagaattttgtcagtaaagaagaattccatgaaatagagaagaaactggtggaggagaaagctgctcatgccaaaaccaaagccctcctggccaaggaagaagagaagttacagtttgctctgggagaggtggaggtgctgtccaagcagctggagaaagagaagatggcctttgaaaaagcgctctccagtgtcaagagcagagtcctgcaggagtccagcaagaaggaccagctcatcaccaagtgcaatgnnattgnatccnacattntaaagcnagaagatatacttaatggcaaagagaatgagattaaagagttgcagcaggttatcagccagcagaaacagaatttcaggaatcacatatntgacttccggatccaaaagcagcaggagacctacatggcccaggtgctggatcagaagcgtaagaaagccacaggaatgcgtcgggcccgtagccgtcagtgttc

SEQ ID NO: 7492 - DNA, 323 bp, Mus musculus
gaacttcggaagagaattgcccattctgcagaaaccagagtcccacgaaagcagccaatcagtgtgagaagagaggaagtgacagagcctggtggagctggagaagcagctttatggaaaaataccaattctagcatgggaccagctacacccctggaagttcctctccgcaaaggaggtggtgatatggttgttgtaggaccaaaagaaggttcctgggagaaacctaatgatgacagctttcagaattctggtgcccagagcagtccagagacgtccatgtttgaaagtatgtaatgaagaggagcctattaaccatatga

SEQ ID NO: 7493 - DNA, 465 bp, Mus musculus
  misc_feature (133)..(133): n is a, c, g, or t
  misc_feature (156)..(156): n is a, c, g, or t
  misc_feature (182)..(182): n is a, c, g, or t
  misc_feature (306)..(306): n is a, c, g, or t
  misc_feature (311)..(312): n is a, c, g, or t
  misc_feature (314)..(314): n is a, c, g, or t
  misc_feature (329)..(329): n is a, c, g, or t
  misc_feature (344)..(344): n is a, c, g, or t
  misc_feature (355)..(355): n is a, c, g, or t
  misc_feature (365)..(365): n is a, c, g, or t
ttcggtgggcgagatcggcctttccgaaaacccattaacttgccagttgtcaagaatgagccacatagagaagggaaaagggaaaggagggagcgatctcgatctagggacagacactgggaccccaggcccnagggaacgggatcatgacagggnccgagagaagcactggcaagagaggnccagggtgtggcctgagaatgattgggaaagagagagggagttcagggaggagagggtcaaaagccgggacaagagggacagaagtaagtagaggcagcagcaggcagcctccgtcaggctggngcagnncntttagcagtactggngattgaactagagantgcggcatgtnaggcaagcgntccaaccacagccacataggatgagagggagaaacaagtgtgtaagaagaaatgtccagctcctgtggaaatagaagagttttcacatgctgtcaaccca

SEQ ID NO: 7494 - DNA, 558 bp, Mus musculus
  misc_feature (145)..(145): n is a, c, g, or t
  misc_feature (195)..(195): n is a, c, g, or t
  misc_feature (198)..(198): n is a, c, g, or t
  misc_feature (201)..(201): n is a, c, g, or t
  misc_feature (205)..(205): n is a, c, g, or t
  misc_feature (238)..(238): n is a, c, g, or t
  misc_feature (252)..(252): n is a, c, g, or t
  misc_feature (286)..(286): n is a, c, g, or t
  misc_feature (288)..(288): n is a, c, g, or t
  misc_feature (315)..(315): n is a, c, g, or t
  misc_feature (318)..(318): n is a, c, g, or t
  misc_feature (320)..(320): n is a, c, g, or t
  misc_feature (357)..(357): n is a, c, g, or t
  misc_feature (422)..(422): n is a, c, g, or t
  misc_feature (450)..(450): n is a, c, g, or t
  misc_feature (462)..(462): n is a, c, g, or t
  misc_feature (488)..(488): n is a, c, g, or t
  misc_feature (498)..(498): n is a, c, g, or t
  misc_feature (503)..(503): n is a, c, g, or t
  misc_feature (527)..(527): n is a, c, g, or t
accgcgcagtactcaacgtcaacgtccactcactgacacggcaggcctcagatcgaaaaccttgcaccagactgaaaaatcaccaagcttgaagaccctgcggaaccctctggaggaactcaagcctagctctgggggatcaaangtggggcttgtgacccatccccagacaggtacctgttccagacctggggncanccnactnggctgagtgagaatgggagacccaaagtggagntcttgcatactgcnaagagacctgggttttgtccagaaacctctttgntntgagaaaccatcactttcagcaaaatnccntnttttgcctggcatggtggttcatgcctctaatcccancactttaggaggcagaggcaagtggtctctgtgaattggacaccttttacctattgaactccagncctaaacaattatattgtatctaaaaanaaaaaagacatnttctggccctttttagcaaccctggncaagacagtncacantcatttgctcattgttatgctgantctttataatctgtccatacttcagctttaa

SEQ ID NO: 7495 - DNA, 508 bp, Mus musculus
  misc_feature (218)..(220): n is a, c, g, or t
  misc_feature (222)..(222): n is a, c, g, or t
  misc_feature (224)..(225): n is a, c, g, or t
  misc_feature (228)..(236): n is a, c, g, or t
  misc_feature (239)..(241): n is a, c, g, or t
  misc_feature (244)..(250): n is a, c, g, or t
  misc_feature (252)..(253): n is a, c, g, or t
  misc_feature (255)..(255): n is a, c, g, or t
  misc_feature (257)..(257): n is a, c, g, or t
  misc_feature (266)..(266): n is a, c, g, or t
  misc_feature (268)..(268): n is a, c, g, or t
  misc_feature (271)..(272): n is a, c, g, or t
  misc_feature (274)..(274): n is a, c, g, or t
  misc_feature (277)..(278): n is a, c, g, or t
  misc_feature (280)..(280): n is a, c, g, or t
  misc_feature (282)..(285): n is a, c, g, or t
  misc_feature (287)..(287): n is a, c, g, or t
  misc_feature (311)..(311): n is a, c, g, or t
  misc_feature (329)..(329): n is a, c, g, or t
  misc_feature (365)..(366): n is a, c, g, or t
  misc_feature (368)..(370): n is a, c, g, or t
  misc_feature (385)..(385): n is a, c, g, or t
  misc_feature (398)..(398): n is a, c, g, or t
  misc_feature (414)..(414): n is a, c, g, or t
ttgtccccttttgctcagtgtcacagctcacagtatggtcggaggactttgggacagatttcagacaagattgttctcagcgccagccaaaccaatcaattttgtgagtccaagtactaggagtaaatacattcctctgtatactggtcatgtgcagagcacagacgctgacaatgtggacaatccctacggagatatcaagtctgtggccagtcctnnncncnntannnnnnnnnatnnnaannnnnnncnntntncgaatatcncnggnnanacnngncnnnntncatttcacagccacccacccaacnaattctaatattccatcnagagagccatcagcagattcggagatgaaccgcctnntnnntacaagaaatgagantcgaccgcttccntcaccagggcccaatntcccaaatggtgacaactgtgaagccctacaacccttttaacaagaaggaaaaagaaacccttgagtactgaaggagaccacacccctgagaaa

SEQ ID NO: 7496 - DNA, 554 bp, Mus musculus
  misc_feature (251)..(251): n is a, c, g, or t
  misc_feature (253)..(253): n is a, c, g, or t
  misc_feature (265)..(265): n is a, c, g, or t
  misc_feature (276)..(276): n is a, c, g, or t
  misc_feature (338)..(339): n is a, c, g, or t
  misc_feature (375)..(375): n is a, c, g, or t
  misc_feature (393)..(393): n is a, c, g, or t
  misc_feature (395)..(395): n is a, c, g, or t
  misc_feature (449)..(449): n is a, c, g, or t
gtttcctcctataatctgagcacctggaaggcagagatccattacaaattcaaagccagcttggcttacaaactgagctaaagtcagtcaagacaacatagtgaaagttttgtcttcaaaaaaggaaaatagaagcaaaatagcaaagatccaaaagaacgaatctggggaaagagttcttgaaataaaaaggagcaaacccagaagagacaactctgcatttcagggcttgtaaacttttaaataacaancnacacaacaatancaaaacaacancagcagcagcagcaacaatgatactcaccgatggagatgaaaatgactcttccaatggtttnntcaatgattagctttatccagcggacatttggttcntcaataccaaaagagaantntaccagcttcctacacaataggatttatgtcagaaattcttttgtttgatattntttggtttattgacatatactatgcccaaacagtctgtcaattgtcactggtggtaattcatttgaaaattttcattatggtgacctgacttaacctagctgtat

SEQ ID NO: 7497 - DNA, 514 bp, Mus musculus
  misc_feature (282)..(282): n is a, c, g, or t
  misc_feature (299)..(299): n is a, c, g, or t
  misc_feature (342)..(342): n is a, c, g, or t
  misc_feature (344)..(345): n is a, c, g, or t
  misc_feature (347)..(347): n is a, c, g, or t
  misc_feature (363)..(363): n is a, c, g, or t
  misc_feature (404)..(404): n is a, c, g, or t
  misc_feature (421)..(421): n is a, c, g, or t
  misc_feature (443)..(443): n is a, c, g, or t
  misc_feature (445)..(445): n is a, c, g, or t
  misc_feature (457)..(457): n is a, c, g, or t
ttggagtcggttcccaaagttccagctcttgtatcatttcattgggcggtagatttgcgctctcaggactcagagcttggagctgacacactagcgcaacagcttgccttgggcttgaaaggggatataaactcagtcttagccagcccatgccttcgatccccagctttaagaagatacccggatttaccaaacttcagcggccggtcttggagttattaattgatgacagcaaaagatctgacctcttcaaaacactcggacaagcttcagtggaggccntgtggaacgctgacctntctacgtcaagctacccaataatagagaaggcaccgatgagtncnntntgggcccagctgggtnggtacccagatattcccaagctgctgcagttagacattcantcgaccttcagaaaatntcttgcttccatccggtcacantntaagaagattcntaagtgaccacaaaacccaagccaggcacgtagagagcggatttcaatggttcagta

SEQ ID NO: 7498 - DNA, 466 bp, Mus musculus
  misc_feature (26)..(26): n is a, c, g, or t
  misc_feature (56)..(56): n is a, c, g, or t
  misc_feature (90)..(90): n is a, c, g, or t
  misc_feature (301)..(301): n is a, c, g, or t
  misc_feature (305)..(305): n is a, c, g, or t
  misc_feature (342)..(342): n is a, c, g, or t
  misc_feature (355)..(355): n is a, c, g, or t
  misc_feature (362)..(362): n is a, c, g, or t
  misc_feature (371)..(371): n is a, c, g, or t
  misc_feature (389)..(389): n is a, c, g, or t
  misc_feature (414)..(414): n is a, c, g, or t
ggctggaagagaactgccttgagctnagcatgcttccacagagcatcctcagtgantcccaaatctgcctgcttgctgtggaaggcaatntctttgaaataaagaaacttcgagaactagagggttatgataagtacatggagaggttcacagccaccaagaagaaatttgcatgatattctccaggatcatgggacagacttggaacctctgttgaaatctgactgagtcaaaggctcctgatgttggatacactgcagagaacattttacttaatgactttttcctttttaggactatntcanataagctgaaggaaagggatttaggagtaggagacangaagaacccttcntcttganccgtgtagntcatggccagtgttgatnttcaaaactatcattagttgggctntaaggaacctgctgttcatgaagggaggaaatgctgcttgccatagctggag

SEQ ID NO: 7499 - DNA, 527 bp, Mus musculus
  misc_feature (44)..(44): n is a, c, g, or t
  misc_feature (346)..(346): n is a, c, g, or t
  misc_feature (432)..(432): n is a, c, g, or t
  misc_feature (446)..(446): n is a, c, g, or t
  misc_feature (465)..(465): n is a, c, g, or t
aggactgcttacatcatactgctgatcaggattaagtatagtanagctggttagcattaagtttaggaatgctagctttgaggatggtattacagcatgaaacatgagaattttaaacctttttcagtattctttgccatcaaattcacactttgtaagtaagcaattgagttgtttttactatattcacagagttgtataagaaccacttatcccaaaaatatttagtcactccagaagaaaacagtgtacccagctgtgaccccccccccatttttctttttcccttccctggcaaccactgttatacattttgtttctatggattgcctgtttttgacacttnatataaatgcaataatacaatgtttggctttttgtgacgggatttcttattttacgtagcatgtattaaaagcttattcatgctanaaatcgaggatttnttttatgactaaataatgntccactgtatggatgtgtcatatattgtttatccatttatcagttgatggacttttggttgt

SEQ ID NO: 7500 - DNA, 448 bp, Mus musculus
  misc_feature (254)..(254): n is a, c, g, or t
  misc_feature (262)..(262): n is a, c, g, or t
  misc_feature (278)..(278): n is a, c, g, or t
  misc_feature (302)..(302): n is a, c, g, or t
  misc_feature (307)..(307): n is a, c, g, or t
  misc_feature (325)..(325): n is a, c, g, or t
  misc_feature (342)..(342): n is a, c, g, or t
  misc_feature (346)..(346): n is a, c, g, or t
  misc_feature (348)..(348): n is a, c, g, or t
  misc_feature (354)..(354): n is a, c, g, or t
  misc_feature (365)..(365): n is a, c, g, or t
  misc_feature (371)..(371): n is a, c, g, or t
  misc_feature (387)..(387): n is a, c, g, or t
  misc_feature (407)..(407): n is a, c, g, or t
  misc_feature (410)..(410): n is a, c, g, or t
cgccagcgcctgacaaacaggagatcagtgctggttccccgaggctcgcagcacctagagaaacctgaagttttccagaccgccccgctgtcatggcaacagcaggagaaacaaacaaagctcacatcaagcgactgaacacaaagccataccattattttaataatcggcaatggccacgcggggctgagagcagcaggctttcagggcactgccgccaacgtgtctctctcttgagatgtcttgaagtgctnaccgacangtgtgggccttggcantcagatcatgcctccagcttggantcccntcttgtgtagacccttantgcctacagtggtcacncaantngtgggncttgggaagcnaggtgnccagatggttagaggntccagcctcaggccaagcanccntgggtgcaaatccaaaccctgcaccttccaagctggtg

SEQ ID NO: 7501 - DNA, 457 bp, Mus musculus
  misc_feature (187)..(189): n is a, c, g, or t
  misc_feature (191)..(195): n is a, c, g, or t
  misc_feature (197)..(202): n is a, c, g, or t
  misc_feature (204)..(204): n is a, c, g, or t
  misc_feature (206)..(209): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (220)..(220): n is a, c, g, or t
  misc_feature (231)..(231): n is a, c, g, or t
  misc_feature (238)..(238): n is a, c, g, or t
  misc_feature (241)..(242): n is a, c, g, or t
  misc_feature (246)..(246): n is a, c, g, or t
  misc_feature (249)..(249): n is a, c, g, or t
  misc_feature (251)..(252): n is a, c, g, or t
  misc_feature (254)..(255): n is a, c, g, or t
  misc_feature (264)..(264): n is a, c, g, or t
  misc_feature (271)..(271): n is a, c, g, or t
  misc_feature (289)..(289): n is a, c, g, or t
  misc_feature (333)..(333): n is a, c, g, or t
  misc_feature (335)..(335): n is a, c, g, or t
  misc_feature (365)..(365): n is a, c, g, or t
  misc_feature (368)..(368): n is a, c, g, or t
  misc_feature (370)..(370): n is a, c, g, or t
  misc_feature (372)..(372): n is a, c, g, or t
  misc_feature (375)..(375): n is a, c, g, or t
  misc_feature (401)..(401): n is a, c, g, or t
gccgctcccttttatggaggctcattgtcagcgtccgtccggcagtcccgcctccagaccaggctggccaatcacgtgaggacacgccccctagccccgccccagccacaggtctgggccagaaccctgtgcagcgcgtttgtctctggccggtttgctcggcggcgaagcctggagttttcctggnnncnnnnncnnnnnncntnnnnacccngnangncatccccaccnatggctngannaaanggntnntnngcatcttanttcttgnctttcccctgactagctncctgcctgggaggcaacacagacgagaaaagaccggtggggatntntgaaggatacataggctcagaagtgtgganacntntnttntaatttctttgggcctcgttcctttntactagcacatacgctttagggaaagaaaaatcactttggatcctcctaaacaaag

SEQ ID NO: 7502 - DNA, 437 bp, Mus musculus
  misc_feature (372)..(373): n is a, c, g, or t
  misc_feature (394)..(394): n is a, c, g, or t
  misc_feature (410)..(410): n is a, c, g, or t
agttggtagtaccactagccccagggtaaagtgtctagaaagaacttctgaggggatatgtcaaaggacccaggtggccaaagaacatcacccatgggagagctgtgcttcccatctgattctttctgggcatctataccccacattccatccaggagcaaaggctgaatacactgtttctgtctctatgttggcctcagaaaagcagaaatcagaagccagggacagcccttttgctcagatggtcagaaccagactccctgtggcagtacatcatggtaactgccaccatagactcagagaccatcctgcaggaactggtagggcaggaactctacaccatggacaaatgctgcataagtggataagagnnctaaggccctgcccccatccnttctcagaacagtggnaaccattccccaggctaaacacataga

SEQ ID NO: 7503 - DNA, 460 bp, Mus musculus
  misc_feature (389)..(389): n is a, c, g, or t
  misc_feature (404)..(404): n is a, c, g, or t
atgatgactggcttgatcctgtgcaggtggagaaagctacagctggtctgagtttgcaagtgctgtagccctgccatttccaagacacgatttcaccccaggcctccccaaactctggctcttatatctttccaccccgacattcaccatgatgcctgagtcttggaaagaggaaaagatgagatagaagtcctactgtggctaaacactctactgacactttaactagttgtgagtttctgacttaactgtcctctgttgcacaaagttctgtaatgctggctcacttaatagtctcacttaatagtgtcagctgccctgagtgtgtggggctcgaagagggcagggctgcatacagagcctggtgaatgaatgctaagctggtgatntactttagctccacntcaacccttgacctttaattttgacctcagtttttgtacttactattctctccagc

SEQ ID NO: 7504 - DNA, 522 bp, Mus musculus
  misc_feature (102)..(102): n is a, c, g, or t
  misc_feature (179)..(179): n is a, c, g, or t
  misc_feature (237)..(239): n is a, c, g, or t
  misc_feature (283)..(283): n is a, c, g, or t
  misc_feature (299)..(299): n is a, c, g, or t
  misc_feature (301)..(302): n is a, c, g, or t
  misc_feature (306)..(306): n is a, c, g, or t
  misc_feature (319)..(319): n is a, c, g, or t
  misc_feature (407)..(407): n is a, c, g, or t
ggtttctgtaaagtcatccttggaaccaccatccccagagcaacaacttgaacaagagtctcctggacagttattcttgggaccaccatccccagagcagcnaatggcaagagatacctgtatactcatctttcaaaccatcatctccagaacaacaatttgaacgagagtcctctaangagtcatccttgggacagttcttagaacaaccacctgagcaatgagaatctcttaaannngtcatctttgggaccaccattccaagaatatctacccaagcaantagatcccaatgacantnntccntgagataacaatnttagaaacaggtgactctgggacagcacatgaaacaaatactatggtgacaaaacatcagccatgctgtgaagagaaacaagtcaggnactggacaggaccgtaggcaaatgaaaataaaattagacaatttattttcatattatgctgaggtatgccagtagggtattacaattgtcaacctcatattttgatggccggact

SEQ ID NO: 7505 - DNA, 315 bp, Mus musculus
  misc_feature (166)..(166): n is a, c, g, or t
  misc_feature (175)..(175): n is a, c, g, or t
  misc_feature (198)..(198): n is a, c, g, or t
  misc_feature (203)..(205): n is a, c, g, or t
  misc_feature (245)..(245): n is a, c, g, or t
  misc_feature (247)..(247): n is a, c, g, or t
  misc_feature (277)..(277): n is a, c, g, or t
  misc_feature (283)..(283): n is a, c, g, or t
  misc_feature (287)..(287): n is a, c, g, or t
agcagaaattctggcagctaggaaagatggacaaaggctcccaagccatgatcacagaagaacccgatggagcaccattggcttgtgacaagaatgtggtgccaccaaaaccaacgaggaatccactggagtccctccatccatgtcagagttgctgcgagaaatntttgttgtntgccctaaagaccaaccgcaatnagggnnngagaccttcacaccatgcctgggtgcctttttcacccttntngtctggagctgctttctaatttatctgtanttcaanttcnccgaggtggagcatgtgctgccgaccta

SEQ ID NO: 7506 - DNA, 559 bp, Mus musculus
  misc_feature (300)..(300): n is a, c, g, or t
  misc_feature (317)..(317): n is a, c, g, or t
  misc_feature (322)..(322): n is a, c, g, or t
  misc_feature (324)..(324): n is a, c, g, or t
  misc_feature (338)..(338): n is a, c, g, or t
  misc_feature (347)..(347): n is a, c, g, or t
  misc_feature (352)..(352): n is a, c, g, or t
  misc_feature (383)..(383): n is a, c, g, or t
  misc_feature (396)..(396): n is a, c, g, or t
  misc_feature (432)..(432): n is a, c, g, or t
  misc_feature (435)..(435): n is a, c, g, or t
  misc_feature (475)..(475): n is a, c, g, or t
  misc_feature (496)..(496): n is a, c, g, or t
  misc_feature (498)..(498): n is a, c, g, or t
  misc_feature (501)..(501): n is a, c, g, or t
aatgcagtccagatggctaccagattcaggctcaaggtgacacctacacaagtctctaatgtccctatctcctcattccactccatgcaggaggcccctaactctgaacccaaactgcagaaacaagctatggcctcaaactgcaaccatatctctcagccctgtcatggcctgcacctcaccttgcctgcccctgggatcacagttgaggtggcctcctgccagggacgcctcaggggcccggtccagcatcgtcttgcctccccctgctgtcttcattcccatttccctttccctctnttccccccattcctttntttgngnaaaagcttttccanttcccctcntacantgcatccagaggtgacctcaagagcagggcnggaggtgttagancaacctctgaagggaaggggctcctttacccaccanttntagtagccactgttactggcgggtgcccaaggacaagatntcttgccctgcattgcagaantnttntgaggtagagataagctgcttgggaatcaggtgttcttgtccatctatttccagtttc

SEQ ID NO: 7507 - DNA, 486 bp, Mus musculus
  misc_feature (346)..(346): n is a, c, g, or t
  misc_feature (353)..(353): n is a, c, g, or t
  misc_feature (358)..(358): n is a, c, g, or t
  misc_feature (375)..(375): n is a, c, g, or t
  misc_feature (420)..(420): n is a, c, g, or t
  misc_feature (422)..(422): n is a, c, g, or t
  misc_feature (424)..(424): n is a, c, g, or t
  misc_feature (426)..(427): n is a, c, g, or t
  misc_feature (429)..(429): n is a, c, g, or t
  misc_feature (444)..(444): n is a, c, g, or t
gattgtttttggttctctgcctatatacagggtaccaagtcccacgagtctaagattccttccccttattggctctgaagtacaaagagattcagtggagggtgtttatatgaagaagaaacatgacaaatcacggaggaaaagcctgaaaaggaatttggttccacagataaatctggcttcatccttcttcccaaccacacccaagtgaagaggaaacctcagaactggctgctgtacaggaggccacaaggtccagatctagtcaagatgaggatgccacaccaccagatggttacacgtctctcttacagaccatcctgataatggaggctgctcaaggggntctggtnacctnacagggtctgcagccantctgccaactttttacacatagaaaaacataacaaacgggcaatntntntnntnattgtcaacaagatntcacaaggacataaacaaaatcagtagcctgggtagacccaa

SEQ ID NO: 7508 - DNA, 322 bp, Mus musculus
aaggactgacatgcctgtgttcccacagacgggcagcatgctcaggttcaagccaggtgcctcccagcacggagagaggaagcagacaccaggccccaccttaactcaaaaagccatctccaactgacaaacatttacaaaggaaacattagtttctccaagtgagtctccttgggtacacaaacccacttgatgcgcaggccccatgcccagtggtagatagccaacacaaaatgaacaatagtatttttgtagatttttttttttttggtctcttattgctttatctggaggttttatttttaaaccctgctggtcattt

SEQ ID NO: 7509 - DNA, 346 bp, Mus musculus
  misc_feature (26)..(26): n is a, c, g, or t
  misc_feature (71)..(71): n is a, c, g, or t
  misc_feature (78)..(84): n is a, c, g, or t
  misc_feature (86)..(86): n is a, c, g, or t
  misc_feature (88)..(92): n is a, c, g, or t
  misc_feature (95)..(97): n is a, c, g, or t
  misc_feature (99)..(105): n is a, c, g, or t
  misc_feature (107)..(109): n is a, c, g, or t
  misc_feature (112)..(118): n is a, c, g, or t
  misc_feature (120)..(120): n is a, c, g, or t
  misc_feature (125)..(129): n is a, c, g, or t
  misc_feature (140)..(140): n is a, c, g, or t
  misc_feature (169)..(169): n is a, c, g, or t
  misc_feature (174)..(174): n is a, c, g, or t
  misc_feature (235)..(235): n is a, c, g, or t
  misc_feature (244)..(244): n is a, c, g, or t
  misc_feature (307)..(307): n is a, c, g, or t
ctcccatccacattggctctctgaanaagtctgcagagtcgggcaaacaaggccatcactgcaatgtccancctctgnnnnnnnantnnnnntgnnntnnnnnnnannncannnnnnntnacatnnnnnaggttgctaanaactctccaggagacaatagaatgtccangaagngactgctgatgtcatggactacatacagcctttggttccctgataatgttctccctgtacngacaggaanctgagctgccctttcctggggcatagccattgagcacatcctccttccaaagccagggtttgntctaggcttgattggcaacacctaagtaattcctatgta

SEQ ID NO: 7510 - DNA, 281 bp, Mus musculus
  misc_feature (235)..(235): n is a, c, g, or t
tgttgttacaacagtcctcggcgactcgaaaaatcttttgttttggatggggtagctgtgagcacaatggcccaggcctacagcatcatgaggcccaagctgtggtctgcaattccgccttataatcctcaactggaccaccacagtcgtcggtacttccggagccgcgtggttccgcccattttgcggaaaactgatcaggatcatggtggcacgggaagggatggctggatantggattatttccacatttttggtcaaggacagcgatatctcaatag

SEQ ID NO: 7511 - DNA, 536 bp, Mus musculus
  misc_feature (315)..(315): n is a, c, g, or t
  misc_feature (318)..(318): n is a, c, g, or t
  misc_feature (320)..(321): n is a, c, g, or t
  misc_feature (323)..(324): n is a, c, g, or t
  misc_feature (327)..(327): n is a, c, g, or t
  misc_feature (333)..(333): n is a, c, g, or t
  misc_feature (344)..(344): n is a, c, g, or t
  misc_feature (348)..(348): n is a, c, g, or t
  misc_feature (363)..(363): n is a, c, g, or t
  misc_feature (395)..(396): n is a, c, g, or t
  misc_feature (402)..(402): n is a, c, g, or t
  misc_feature (404)..(404): n is a, c, g, or t
  misc_feature (426)..(426): n is a, c, g, or t
  misc_feature (428)..(428): n is a, c, g, or t
  misc_feature (439)..(439): n is a, c, g, or t
  misc_feature (443)..(443): n is a, c, g, or t
  misc_feature (485)..(485): n is a, c, g, or t
  misc_feature (495)..(495): n is a, c, g, or t
acaggttgagcctctgtaaggagctcagacggtcaaggaaccgctcccaagcccaatacaacctgagttcaatccctgggacctttatggtagaagtgtagtagggcccaagacaactccctccatggcagaagtactattcaggctgtaaaactcagcatgtaggcagtcctatctgccaaaaggaaacaaagacctaattcatcgaggtctatagctctggggaagtgtatgtgtgcgaagaagcttgtgtttgggcatctgtagtccacatctagttaactgcttttcttaaatgaagtctgtcaacccagnacncnntnnttntgcctntcaccctgatnaacnccaaggactacacantcggatctggaacactcagacagctaatatannttccantnccttaaaaccatgtccaagcantnttccctgttgnaaanttcacagcagaaggacagaacagattcctaaaggttttcctntgaccctgtntacagggagttgtagcatataaccactccatacacttaggc

SEQ ID NO: 7512 - DNA, 399 bp, Mus musculus
  misc_feature (259)..(259): n is a, c, g, or t
  misc_feature (269)..(270): n is a, c, g, or t
  misc_feature (278)..(279): n is a, c, g, or t
  misc_feature (285)..(285): n is a, c, g, or t
  misc_feature (294)..(295): n is a, c, g, or t
  misc_feature (299)..(299): n is a, c, g, or t
  misc_feature (327)..(327): n is a, c, g, or t
  misc_feature (334)..(334): n is a, c, g, or t
  misc_feature (355)..(355): n is a, c, g, or t
  misc_feature (359)..(359): n is a, c, g, or t
gaaaaggatcctcctgatccgtataccctcagtggaactgtttacacggatatgaggttctctgatacccactccccgcaggaggcctatactctggatgagtcgttcttctggtcctacaatgtcactacagggaactatttgacagtgattttgaacaatccagcgaacctcaacagagtgcaagtaagaacgggctccatcacggatggaaagtacatcctagaaaaaggacaggtggagctaggctatgatcctnaaggaacacnnccacaatnnaccagntttaccctnntggnccggcttgtgcaagggcagatggatcanttcattntggaaagcattgggtataaantaanctgcgtgaagctggcagtgaacgctaatcaggtcggtggt

SEQ ID NO: 7513 - DNA, 484 bp, Mus musculus
  misc_feature (351)..(351): n is a, c, g, or t
  misc_feature (362)..(362): n is a, c, g, or t
  misc_feature (369)..(370): n is a, c, g, or t
  misc_feature (372)..(372): n is a, c, g, or t
  misc_feature (374)..(374): n is a, c, g, or t
  misc_feature (387)..(387): n is a, c, g, or t
  misc_feature (409)..(409): n is a, c, g, or t
  misc_feature (442)..(442): n is a, c, g, or t
acatatgggacttgcgggcatccaccccagttgtgtcctaccacaatctggagggccacactggcaacatcagttgtttgtgttactcagcatctggtctcttggcatctggctcttgggacaagaccatctgtgtctggaagcctacaaccaacaacctgcctcttcagctcaagggccataccatttgggtgaatagtctagccttttctcctgatgaactgaagttagccagtgctggttactctcgtacggtcaaagtctgggactgcctcacagggaaatgccttgagaccctaaagggcatgctggatgtggcccatgcctgcattttcaccccagatggcaaantcttagtgtcnggggctnntntnacaagatgacaantctgctcaaagtcgagaacctntcccatgtagcttacgcacaggcctaaggtaantaagaaagcagccaccagatttttgcagcagggactacccta

SEQ ID NO: 7514 - DNA, 525 bp, Mus musculus
  misc_feature (344)..(344): n is a, c, g, or t
  misc_feature (347)..(347): n is a, c, g, or t
  misc_feature (349)..(349): n is a, c, g, or t
  misc_feature (357)..(357): n is a, c, g, or t
  misc_feature (410)..(410): n is a, c, g, or t
  misc_feature (419)..(420): n is a, c, g, or t
  misc_feature (454)..(454): n is a, c, g, or t
aagggcatggagctcttgcacttgatccagcaaggtgtctatgtgacgatcatcattgaagtggggagaatgcatatgccgtggctcagccactatgttatgtctctatttaccttcctggcagccaccgtcacctaccttttcctatactgtgcctggagaccccgagtgtccaattcttctaccaggaggcaaaggcagctaaaggccgatgtgaagaaagctattggccagctgcaacttcgagtgctccaggacgaagataaggagttagacccgaatgaagacagctgcgtggtttgttttgacatgtacaaagcccaagatgtaatacgtattttaanttncnaacatttnttccacaagacttgcatcgatccctggcttttagcacataggacatgccccangtgcaagtnngacatcctgaaaccttaagaagcccagagatctntccacagattaaaattagacgaatttgctcactgtgctgtacatccaaagcaaacatgacccttagttcct

SEQ ID NO: 7515 - DNA, 500 bp, Mus musculus
  misc_feature (299)..(299): n is a, c, g, or t
  misc_feature (339)..(339): n is a, c, g, or t
  misc_feature (420)..(420): n is a, c, g, or t
aagcatgcagcagcccactatggaaggaaatattcctagtcaaacagtaacataatacctgcttattcttttcaaaccctcctgtcatttatttgaagattattttccactgaagcctttgcagaaggtacttagagcaaagcctcaagagactctcacgctcattttggagctgtctgatattcatggctccgagctgggcaaatattagctggaagatgtagacggtgataaggccaacggcctacacttctccagaccctaaaagggtttctgttgacacaacctgatttgtctcnggcagcagctgcactgcatagattttgcacggaacccctntcatggttggtgctcgtgtggggagccaggcacctccctggatgctttatcataggagcgacggtcagcacagttctatantcatgggctttaggaagataagaacccccaatcaaccctcagttatgaagttattattgttgtagctttctgttccactg

SEQ ID NO: 7516 - DNA, 324 bp, Mus musculus
taaaattccaagagattagggtccttgaaatgagaccaaattctaagaaggcagagtccgtaaaggaacccaagcaaaaaacatccaaaaagtggaagcccaagcaaggatctaaggggtcacctgcagccgtgacatggagaaaaaagcaggaaacatttaaaatctccaaggtaataaagagtggtggcttgcaagccagggcccagaagaggaagacctacgttaagaagccccgagttgtcttcttaaagacctaccatcacagcactaccatggggaagatgaaggcactggatataactgaccagttggtctggtttg

SEQ ID NO: 7517 - DNA, 442 bp, Mus musculus
  misc_feature (217)..(217): n is a, c, g, or t
  misc_feature (356)..(356): n is a, c, g, or t
  misc_feature (404)..(404): n is a, c, g, or t
gaagaactgctttggaaccggcctgacccaggcactggcagaggtggcaagagtgcggcccagtgacccaatagagtacctggctcactggctttaccattataggagtataactgtagctgaggaaaagagaaggcaagaggagctacagcttaaggaagcacgtgacagaagcgctgaggaagcaaaaacaacagaaatgctgaaagaagaaggntatcagattcagcagaagtgtgaaaagtgtcaccaggaactgccctcgacctctttttcctcagacaagaccccagccctgcaggaagacacggcaccccttgaggagaagactatgaggcaggaatctcaaccgggtncctcgcgtgtgatttctgagatgcctcaaagggctattccctcataanaaaatttttaaaaaggcccgtaagaggagcactcatct

SEQ ID NO: 7518 - DNA, 448 bp, Mus musculus
  misc_feature (308)..(308): n is a, c, g, or t
  misc_feature (323)..(323): n is a, c, g, or t
  misc_feature (333)..(333): n is a, c, g, or t
  misc_feature (350)..(350): n is a, c, g, or t
  misc_feature (361)..(361): n is a, c, g, or t
  misc_feature (403)..(403): n is a, c, g, or t
  misc_feature (410)..(410): n is a, c, g, or t
  misc_feature (415)..(415): n is a, c, g, or t
agaccgggaagctcatcgacaagatcaacctcccggatttcctcaaagtttaccttaaccataggccacctttcggcaacactatggacggcatccagaacagcttcaacgtgctgggttacaccaattcggaagggaaaaaggccattcggagagaggatttcctgaacttactcctcaccaaaggggagcacatgacagaagaagagatgatcgactgtttctcgactctgtttggcctgactccggaggggtggaaatcggagcctgcagccacctgcatcaacggtccagaaatctgcctccanaaagagcttcccgangaaatcactncagaaatattcaccacngaaattcttgncttaaccctttccgacagctcggaacagctcattcagtgacntcattgncgatnctggcagcacaaagggctccgtgtgtgcttgca

SEQ ID NO: 7519 - DNA, 439 bp, Mus musculus
  misc_feature (370)..(370): n is a, c, g, or t
  misc_feature (374)..(374): n is a, c, g, or t
  misc_feature (376)..(376): n is a, c, g, or t
  misc_feature (391)..(391): n is a, c, g, or t
  misc_feature (404)..(404): n is a, c, g, or t
accgtcagtctgttgagagagccctgcttcacttccaaaaggatggggcctacaaggtgcgcctcagctctgggcctcacagttcccagcccttcactttggcagtactcctcagaggccgtgtcttcaacattcccatccggcaactggacggtgggcaccactatgccctgggtcgggagggcaggaatcatgaggagctcttctcctctgtggccgccatggttcagcattacacgaagcaccccctgccccttgtggacggacacagtggcaaccggggactcacctacctgcgcttccccaccaagccctgaagaaacagcagcacacagatccccctcaggcacgtgatgtgtgccccattcantttntntcccactttaggctnttttcttttcccncccttcctccaccccaaaagctctgcaggttcaaa

SEQ ID NO: 7520 - DNA, 273 bp, Mus musculus
gaagtttgcagtgtgtgacatccctctgtatgacatctgtgactacaatgtcaccagggagcgctgcaggagtctcgactgctgtttctacaggggcgtctgctacgagaaagctgttcccatttatgtacaggtgttcttcactctgatttggttcgtggcaggggccttcatcattgccgtcatttatagggttatacaggggactaaaaaagagaagaagcctttactcccagaggactcacaggttgaaatactgaagtctcccactcc

SEQ ID NO: 7521 - DNA, 137 bp, Mus musculus
  misc_feature (63)..(63): n is a, c, g, or t
  misc_feature (68)..(68): n is a, c, g, or t
gaagcagccgttagtacgtggctcaacttgttagcagaatctcttcacatttcctatcagctntctgngacgcatttccacaccccctccccctttcccacacgtcagggctttcctgtacacttgtaaccctccta

SEQ ID NO: 7522 - DNA, 397 bp, Mus musculus
  misc_feature (342)..(342): n is a, c, g, or t
  misc_feature (348)..(348): n is a, c, g, or t
atcccagatgaagacgttcctcagaggaagagacactttgtctatgggacacggacccgtttgtggccacccagcagggtggagtccacagatcccaatgacgattccaacagggtcatcatggaggtagtcccctgtgtcagctcagaagagcaagagcaagaggaagaggaagaagaagagtctgttgggaaggtggaatccttggacaaagagaatgtcatcctggagagctcaggggatcccttccattgtcatagaagatcagaagaatccatcgaatacccgagttggattgtccagaggcagtgggactggagtagcgatgaggaagattgtganggctantccatctccgtcaccgccctagtgcacgctgaaacatgctggtctgaca

SEQ ID NO: 7523 - DNA, 537 bp, Mus musculus
  misc_feature (330)..(330): n is a, c, g, or t
  misc_feature (364)..(364): n is a, c, g, or t
  misc_feature (367)..(367): n is a, c, g, or t
  misc_feature (370)..(370): n is a, c, g, or t
  misc_feature (373)..(373): n is a, c, g, or t
  misc_feature (389)..(389): n is a, c, g, or t
  misc_feature (410)..(410): n is a, c, g, or t
  misc_feature (429)..(429): n is a, c, g, or t
  misc_feature (432)..(432): n is a, c, g, or t
  misc_feature (446)..(446): n is a, c, g, or t
  misc_feature (500)..(500): n is a, c, g, or t
  misc_feature (508)..(508): n is a, c, g, or t
atcacaggcaaagcacaacctttaggaagaaactggactttggccactacatattgcacaaaaatagagtacaaatagtgaagcctgccgtcgataccaaacctccaatggcacacacacattacattttaaaattgagcaaaatccagggtgaacaaaagagaatcgacaaaattgaatatgaaaatagacaattgtgtcagaaaattgcgaatgcctatcgaggccctgccaaggtggactgctggaatgagtatctttcaaaaagcttaaacagagaatcaaggaaccgagagctagtaagaatcaccatggaaaaccagggcatcntaaggaggttgagtgatcgcaaacccaactatgnccncangtnatcggagatggactgncagaattcaaggcggtatatnagaaacacaacaagatatnttntcttccaagaagantaggttactcaccatggaaaagacaccgagaagaccctaagatttcttggctgntcaggatnttaagacatcgcagaaatggctgcatttt

SEQ ID NO: 7524 - DNA, 558 bp, Mus musculus
  misc_feature (36)..(36): n is a, c, g, or t
  misc_feature (39)..(39): n is a, c, g, or t
  misc_feature (47)..(47): n is a, c, g, or t
  misc_feature (51)..(51): n is a, c, g, or t
  misc_feature (55)..(55): n is a, c, g, or t
  misc_feature (68)..(68): n is a, c, g, or t
  misc_feature (99)..(99): n is a, c, g, or t
  misc_feature (115)..(115): n is a, c, g, or t
  misc_feature (161)..(161): n is a, c, g, or t
  misc_feature (163)..(163): n is a, c, g, or t
  misc_feature (191)..(191): n is a, c, g, or t
  misc_feature (299)..(299): n is a, c, g, or t
  misc_feature (306)..(307): n is a, c, g, or t
  misc_feature (311)..(312): n is a, c, g, or t
  misc_feature (319)..(319): n is a, c, g, or t
  misc_feature (338)..(338): n is a, c, g, or t
  misc_feature (347)..(347): n is a, c, g, or t
  misc_feature (437)..(437): n is a, c, g, or t
  misc_feature (439)..(439): n is a, c, g, or t
  misc_feature (450)..(450): n is a, c, g, or t
  misc_feature (459)..(459): n is a, c, g, or t
  misc_feature (462)..(462): n is a, c, g, or t
  misc_feature (524)..(524): n is a, c, g, or t
aaatgttgcctccagacaaaattaacatactgacancanttggaagntccnattnttggctatctagnccaactcaagccacaaggaaaggattccctntggtgtactctatttntaaactttatatactttataaaccctcaaggcaggaaagccacagntntcagctggctgaacacaaagcagtcagnccccgcacccagacttccctaacagccctaaaggtcatcttctaagggctactgcagtcattcattcgcaacctgagctatgaaagtggccaagaaagtgccctacangaaaaannaaannaatcccnccaccccctgaaaaggaantttcattantccctggcttgtcacagaaaccagttcctgagcatgaaaaccaacaaatccctgagcagaaaaattcaccaatccctgaaaataccaaantntggacttgaantcccaacantcntcagcctggaaaactggacagttccgccccctaagaaatcctatggaaggcctgccttcagntcagtcaggggctgttttctcacctgagcagagg

SEQ ID NO: 7525 - DNA, 526 bp, Mus musculus
  misc_feature (153)..(153): n is a, c, g, or t
  misc_feature (166)..(166): n is a, c, g, or t
  misc_feature (336)..(336): n is a, c, g, or t
  misc_feature (398)..(398): n is a, c, g, or t
  misc_feature (415)..(415): n is a, c, g, or t
  misc_feature (445)..(445): n is a, c, g, or t
  misc_feature (483)..(483): n is a, c, g, or t
  misc_feature (501)..(501): n is a, c, g, or t
ggaatgccgagaacgcctcctatacgcatgctccaagagatgcagtaagaactgtcacactgaacgcccctccccgaagccggcccacgagccggtcctacaacaaagctgatgtcaacaaggaacccaaactcaacctctgtccagataaanatatgtcaacatngtataatggttcagcctggcgaagaagaattcctttttcaaaaacttattcaaagacggaaaaggtatatccagagccaagaagaaatgggagtaagtaagcctggaggttgagagaagaggaaaatgaggaaagagagaagctccagccatcatctgattcacaatcanaaatgaaaattcaaagaatgagatattcaagtactgcatagtatatagtgggtagccaacgntgataaaacgcaaattntgaaaataagacgcaggaagaacattgtgntctttcaaaactgataaaatgcaaattgcaaacagctncctgtttatttatgtatntctgggattcattcaatacattacc

SEQ ID NO: 7526 - DNA, 454 bp, Mus musculus
ggactccctggctgacaaaacactgcttgagcccagggaaatctcgagacctaagaagagatccagagtttttcgggtgctgagaaggatggccgaatcgttggggagatcgcgttccagcttgaccggcgtatcctggcctatgtgttcccaggggtgactcgcctctacggtttcacagtgtccaacattcctgagaagatcaagcagacctctatcaagtccctagatggctccgtggatgagaagaagctgcgtgagtgacgcatcgctatctgactctgacggcacggctggagaagctgggctacagccgcgaagtgcacccggtgttcagtgagtttctcatcaatacctatggcatcctgaagcagcgtccagacttgcgggccaacccactgcacagcagcccggctgccctgcgcaaactagtcattgacattgtgccgcccaa

SEQ ID NO: 7527 - DNA, 508 bp, Mus musculus
  misc_feature (72)..(72): n is a, c, g, or t
  misc_feature (88)..(88): n is a, c, g, or t
  misc_feature (344)..(344): n is a, c, g, or t
  misc_feature (358)..(358): n is a, c, g, or t
  misc_feature (362)..(363): n is a, c, g, or t
  misc_feature (365)..(365): n is a, c, g, or t
  misc_feature (368)..(368): n is a, c, g, or t
  misc_feature (374)..(374): n is a, c, g, or t
  misc_feature (378)..(378): n is a, c, g, or t
  misc_feature (386)..(386): n is a, c, g, or t
  misc_feature (408)..(408): n is a, c, g, or t
  misc_feature (422)..(422): n is a, c, g, or t
  misc_feature (425)..(425): n is a, c, g, or t
  misc_feature (427)..(427): n is a, c, g, or t
  misc_feature (434)..(434): n is a, c, g, or t
  misc_feature (436)..(436): n is a, c, g, or t
  misc_feature (445)..(445): n is a, c, g, or t
  misc_feature (463)..(463): n is a, c, g, or t
  misc_feature (466)..(466): n is a, c, g, or t
tcaacaatggacttgccccaacgggctgggttgtttttgtgaccctgggtattcattgaaaaactgaagttntccatcaaacactgantcctggcaattagaaagcaacacaaatgtgagtgacaaggagtggattctgtctcctccaagatatcgtctggttcagcatgagcataaatagaaacttcagttcagaggcgagcatctagagcgaatgaagacgtttccctccaaagacaaaactttgatgtttcctgcctgtgcatcagtgcaccacatatgtgcctgatgcccctggaggccagagcagtgtttggatcccttagcactagagttagagatgnttgtgaaccaccangtgnntncantcagtnaaanttgggttntcgggaagagcagccagtgctnttaaccactgagtnatntntccgggntnttacttttngtttttttgatacagcanttnaggaaattgttcagattgagcttccaagtacctcagattata

SEQ ID NO: 7528 - DNA, 443 bp, Mus musculus
  misc_feature (309)..(309): n is a, c, g, or t
  misc_feature (311)..(311): n is a, c, g, or t
  misc_feature (331)..(331): n is a, c, g, or t
agaaagtgtgtatggtcctttgcatttccctggattgtttgtgtatctgctgtcagtccatccatgtgtccattgttagggacaaaagttagcactgtttccttagaacatgtttttctgaccatcatgataaagcaaagtaatttctttatttacatacaggaaaatgtatttatcagtcagagtgtagagtatatcatacattataaatttgcttttatatatcctagctttgtatcccacagtttgtcattaagatcggaagtgagatttaaatgtagttttaatgttcatgagctctactctaantnatctgcatatttgttagatntcaaaacatcttttttaaaataaaaatattgtgtgaaattttgggctgtaatgtaatatcattgtttaaagaaaagagagggcgggagaaagcctaggaataccattgaatg

SEQ ID NO: 7529 - DNA, 440 bp, Mus musculus
  misc_feature (172)..(172): n is a, c, g, or t
  misc_feature (177)..(177): n is a, c, g, or t
  misc_feature (180)..(180): n is a, c, g, or t
  misc_feature (191)..(191): n is a, c, g, or t
  misc_feature (195)..(195): n is a, c, g, or t
  misc_feature (197)..(197): n is a, c, g, or t
  misc_feature (202)..(203): n is a, c, g, or t
  misc_feature (212)..(212): n is a, c, g, or t
  misc_feature (224)..(224): n is a, c, g, or t
  misc_feature (230)..(230): n is a, c, g, or t
  misc_feature (236)..(236): n is a, c, g, or t
  misc_feature (244)..(244): n is a, c, g, or t
  misc_feature (256)..(256): n is a, c, g, or t
  misc_feature (307)..(307): n is a, c, g, or t
  misc_feature (320)..(320): n is a, c, g, or t
  misc_feature (341)..(341): n is a, c, g, or t
  misc_feature (348)..(348): n is a, c, g, or t
  misc_feature (382)..(382): n is a, c, g, or t
  misc_feature (389)..(389): n is a, c, g, or t
  misc_feature (415)..(415): n is a, c, g, or t
tgtgtgggtgcccagtctctagatccctgaacctgcgagttcaagagctgaaaggaacttggcaggcataaccaaaagaaagtcgtcgaagtataaagtttattctgattgtctgtaagcacaacggttcgttgttaaaggatcgagtgagagaagacactccaaaggaagnctatnaantgacaacagancctnanccttnngctttgaanatggaggaagantaccantcaagnagtgcaantggtttacaggngctccaaaaggcggggaaacttcggactacagacctgttggcaccctgatntcagtaccctggntcctcagaagtgggagaaaanataattntgttgttttgggacctccacacgggggtgattantcacagntccatagaaacacagattgtggaaanttgttcctccttaattcacaccctt

SEQ ID NO: 7530 - DNA, 342 bp, Mus musculus
  misc_feature (203)..(203): n is a, c, g, or t
tggaagcttctatccatctactagaagaggaaaatttgctgcttattgaccagttaattaactgcagacttgtggatctcaaaatacccaagaacgtgtacattactcaagcagctgggctacaagtgacacccgaaggcgaatctttaaatttggcagaagcagacacagaggagaatttgcagctgccctccaaagagggnagtgaagacatgttggacctattactggggagcaaccatggcactagcagcccagagattcagcccaagaagacagtgagtaaagacggctccaacccagagatggagagctccatcacccagcacttactgcatgaag

SEQ ID NO: 7531 - DNA, 361 bp, Mus musculus
  misc_feature (27)..(27): n is a, c, g, or t
  misc_feature (114)..(114): n is a, c, g, or t
  misc_feature (160)..(160): n is a, c, g, or t
taatagaactttgggatcttggccaancaatgttctggaaaattacagaactatcgtctaacaagagtctggaagagatgtgagaatttgcactctgtatgtcccccttgcctntatagaaagatggcatgattgcccatccaagcctaagtctgagcangagtttgaggagataaactactatctgcttcactgaactgtgacatgcatggatccgcctttaacaaacccctacgaaggcttttagactccggacccttccaaaaaacaacttcaaacatctgacaaagcctagttaagggacaacactggtaggaagaattgttggaaaggcatgctggctggaacattttcccaactt

SEQ ID NO: 7532 - DNA, 330 bp, Mus musculus
  misc_feature (26)..(26): n is a, c, g, or t
  misc_feature (66)..(67): n is a, c, g, or t
  misc_feature (233)..(233): n is a, c, g, or t
  misc_feature (251)..(251): n is a, c, g, or t
tgctccttctgatattggtgaggaanccagtcctgttgctgacccagatgaagatatagctgaggnnttttatgacgctttagagtcatctgatcacactggccatagcgggtccactgtccaggtacctggttttctttgggaaccagatatgctactgctgccggtaatgcccttgatgtggtttcttacattcctgttatcaatgatgatgtggattagaaatggaattngcaagtgtgctacgaagnaaatggccaaggacctccctccaagagaaaagataaacccgatgccgctggagctgaacactccaacacacactgatat

SEQ ID NO: 7533 - DNA, 475 bp, Mus musculus
  misc_feature (242)..(242): n is a, c, g, or t
  misc_feature (257)..(257): n is a, c, g, or t
  misc_feature (277)..(277): n is a, c, g, or t
  misc_feature (336)..(336): n is a, c, g, or t
  misc_feature (352)..(352): n is a, c, g, or t
  misc_feature (370)..(370): n is a, c, g, or t
  misc_feature (380)..(380): n is a, c, g, or t
  misc_feature (410)..(410): n is a, c, g, or t
taaaaacgtcgttctggttgcttctccccaagaccgctatgtgccatttcattcagccaggattgaaatgtgtaaaaccgccctcaaggacagacacacagggccagtgtatgcagaaatgatcaacaacctcttgggccctctggtagaagccaaggactgcactttgatcagacataatgtgttccatgctctacccaacactgccaacaccctgattggacgtgcagctcatatagccntgctggactcggaantcttccttgagaagtttttnttggtggcaggactcaactatttcaagtagtagcttccagggagcagcctgggtgactntccagagctgctcaanatcatttgagttcttagntaggtcatgnttttccacatctctgtattccagagtggantagaaggagagtggagggtgtggagggataaagctggggtgggactggacactagagatgcttgt

SEQ ID NO: 7534 - DNA, 308 bp, Mus musculus
tgaacacacagcagcagggtcctgtctgtgctgctctgtgcggactatgtcatcctcgtgagtgagagggggttccagttgttcacttcatccccactaggctgtaacacggtgaagtctaggccgcggcagggcctccctttgcttcacagctatgggcaacactcacatgtcgccagcaatgactccctaacaagccacacccccagtgtagcacccagcagtgctgtgacccctcaagagccacactcactgtaagtgctgttcacacttattttcattgtatgcatctgggtgtttgcctgcat

SEQ ID NO: 7535 - DNA, 462 bp, Mus musculus
  misc_feature (398)..(398): n is a, c, g, or t
  misc_feature (430)..(430): n is a, c, g, or t
caaagggcttgctcacgtgtaagatgattcagcaacttttaatcaaggaagactgcactgatttgccagctagacacttacagtgatcttcattcgggacagaaatcctcatgggcaggaagtgtcaggatatattgattatgctcacagactaaaatctgaagattttgaagtctactttaatgggaaaagaagacttcttccaaggaccacagacatgagcttttacaactgggacagccatattgctgtttgcaattcaagtccaaattatcaagtgattgctgacaaccctgaaggcttactttttaaatataagagggacagaaaaattctcaatgtggacccaaaggctcatccaggtgacaactccaccaggatccccatccagacggatntctacgcacatgtggttctctttgaccacgtntccagaaggaagacttaagcaccacacagtaa

SEQ ID NO: 7536 - DNA, 370 bp, Mus musculus
  misc_feature (303)..(303): n is a, c, g, or t
  misc_feature (313)..(313): n is a, c, g, or t
  misc_feature (317)..(317): n is a, c, g, or t
  misc_feature (319)..(319): n is a, c, g, or t
  misc_feature (322)..(322): n is a, c, g, or t
  misc_feature (330)..(330): n is a, c, g, or t
  misc_feature (332)..(332): n is a, c, g, or t
  misc_feature (341)..(341): n is a, c, g, or t
  misc_feature (345)..(345): n is a, c, g, or t
aaagcctcctgacatctcttttctactctcatgccatctttttttaaattttttataacctactgagtccaggatgtataagccttttgacctccggacaataatcacgatcatcattggttgcgggatcctgacagccatgtttctactgataggacttgtgctttgtctttactccaaaatatccaaggctctgaagtcccctggaatcgcaaaggaggcagatgatgaatgctatattgatccatgcaaggacccccatgagagcatcatcctggccaacagcatccctgctgaggcttntcattcctancagncnaanaccattgntnttgcgagtngcgntcccctccagtgttgtaatgtatgt

SEQ ID NO: 7537 - DNA, 324 bp, Mus musculus
  misc_feature (31)..(31): n is a, c, g, or t
  misc_feature (78)..(78): n is a, c, g, or t
gaagacgaattttaacactcagttttctgtngctcgaactttcagtctggggccagagaaatggctcagtgggcaaangcatttaatggcaaacctgactgactgcctgcggtcatcacccagggtggaaggagagggtgaagtcctgagacatgtcctttgttgtacacacatgttcgcagacaaacactaaacgttaggaaaaaaatgtattcagctcaagctaaatattaaaacaggcttctggctgactgaagtcaacccagtccttaagtccattgagtccaccagaccattcagacaacaggtatcagctctatggaa

SEQ ID NO: 7538 - DNA, 392 bp, Mus musculus
  misc_feature (231)..(231): n is a, c, g, or t
  misc_feature (238)..(238): n is a, c, g, or t
  misc_feature (253)..(253): n is a, c, g, or t
  misc_feature (255)..(255): n is a, c, g, or t
  misc_feature (257)..(257): n is a, c, g, or t
  misc_feature (259)..(259): n is a, c, g, or t
  misc_feature (266)..(266): n is a, c, g, or t
  misc_feature (268)..(268): n is a, c, g, or t
  misc_feature (276)..(276): n is a, c, g, or t
  misc_feature (290)..(290): n is a, c, g, or t
  misc_feature (303)..(303): n is a, c, g, or t
  misc_feature (318)..(318): n is a, c, g, or t
  misc_feature (325)..(325): n is a, c, g, or t
gcatagagaacagccaacccagactgtagcaagaagcccttgaaggcatctccggctaagagccaacaaacagacaaaaacagcacagctgctctctggtctcgtgcatttgaccgtccaaaaaaaggaactcaacgaaatccactcaggccaacgactctcatgtagaaagctaaacaacagaacacagggcaacacaaaaagttctactagaaggaaacatacggctgngggtgcnctgatttggtagttnancntntatgaancncagggttngattccccagcacngcataaaattcanccttgccagtgaatncctatantcctaacctcagggagatggaaacaagaggagcggttcattgccatgctcagctatgaggatagcct

SEQ ID NO: 7539 - DNA, 343 bp, Mus musculus
  misc_feature (103)..(106): n is a, c, g, or t
  misc_feature (191)..(191): n is a, c, g, or t
gcgccaagtcatgggccaggtcaaaggctaggtcaagggcaaggtctagagctaaggacctagtgcgttccaaagcccgggaacaggctcaggccagggaacnnnntcgtgctagagccagggaacaggctcatgccagagccaggacacaagactgggtcagggccaaggcacaggagtttgtcagtgcnaaagagcagcagtacgtcagagccaaggagcaggagcgtgccaaggccagggaacaggtgcgtatcggagccagggatgaagccaggatcaaggcaaaagattacaacagagtacggcctacaaaggaagacaccagtcctaggccagcaga

SEQ ID NO: 7540 - DNA, 502 bp, Mus musculus
  misc_feature (47)..(58): n is a, c, g, or t
  misc_feature (60)..(68): n is a, c, g, or t
  misc_feature (70)..(70): n is a, c, g, or t
  misc_feature (72)..(77): n is a, c, g, or t
  misc_feature (81)..(81): n is a, c, g, or t
  misc_feature (244)..(244): n is a, c, g, or t
  misc_feature (259)..(259): n is a, c, g, or t
  misc_feature (262)..(262): n is a, c, g, or t
  misc_feature (280)..(280): n is a, c, g, or t
  misc_feature (283)..(283): n is a, c, g, or t
  misc_feature (292)..(292): n is a, c, g, or t
  misc_feature (294)..(294): n is a, c, g, or t
  misc_feature (304)..(304): n is a, c, g, or t
  misc_feature (306)..(306): n is a, c, g, or t
  misc_feature (377)..(377): n is a, c, g, or t
  misc_feature (379)..(379): n is a, c, g, or t
  misc_feature (382)..(382): n is a, c, g, or t
  misc_feature (420)..(420): n is a, c, g, or t
  misc_feature (422)..(422): n is a, c, g, or t
  misc_feature (431)..(431): n is a, c, g, or t
  misc_feature (455)..(455): n is a, c, g, or t
  misc_feature (458)..(458): n is a, c, g, or t
tcccatggctccctactaaggaaattcatacatttcttgcctttaannnnnnnnnnnnannnnnnnnngngnnnnnngccngatgccgttgggactgtgaccacccacgatactcaattttcacccatggtacattgcttcgctacacggaagaagttatttagaacagctcatttcgagcctgcttatacatacaatgtttatgcatatttacatcaaggcatgattactagtcagagatctnaatgctgagcatttnttncccagctggagagagcgntangttcacagntnaaaacaatcnangcccctagtgcagaatgagattggccgcagagactcggtccagccacctgacccagcctgacacatttttntnttntgtatggaacacattttcagaaaggtttctatgtaatntntaaatcctntcattgcctggaagaaaatttttnttntccaaagcaaaaaagccaaacctctgtggcctgaaatgtccaaa

SEQ ID NO: 7541 - DNA, 418 bp, Mus musculus
  misc_feature (28)..(28): n is a, c, g, or t
  misc_feature (32)..(32): n is a, c, g, or t
  misc_feature (53)..(53): n is a, c, g, or t
  misc_feature (58)..(58): n is a, c, g, or t
  misc_feature (63)..(63): n is a, c, g, or t
  misc_feature (113)..(113): n is a, c, g, or t
  misc_feature (153)..(153): n is a, c, g, or t
  misc_feature (190)..(190): n is a, c, g, or t
  misc_feature (242)..(242): n is a, c, g, or t
  misc_feature (247)..(248): n is a, c, g, or t
  misc_feature (266)..(266): n is a, c, g, or t
  misc_feature (277)..(277): n is a, c, g, or t
  misc_feature (284)..(284): n is a, c, g, or t
  misc_feature (286)..(286): n is a, c, g, or t
  misc_feature (322)..(322): n is a, c, g, or t
  misc_feature (380)..(380): n is a, c, g, or t
  misc_feature (385)..(385): n is a, c, g, or t
  misc_feature (389)..(389): n is a, c, g, or t
caagggtgtcccctcccagtctggtccncccngagggcttgggactcaggccnaaganggtcntggagagccttggaggagaccatgtgtcccttgtgcaagagaacccgctntggggccttggagaggacataggagccaaagtgccagggnctggggaacaagaggggaaggatggccgaggaggagngaggccagtgttactgaggaagggttcgtcccagcggcagtcctccccattnagatnncccccagagttgcccagncaggagacctngggctantntggggaaagcatgagggagggagggaggaaggaagnagaaccatgagagggacagaagaaatggaatgcccatgcccttgcagcctgcccaaantccgntcanccacttgtacctgggaggtcaggccgagc

SEQ ID NO: 7542 - DNA, 451 bp, Mus musculus
  misc_feature (222)..(222): n is a, c, g, or t
  misc_feature (230)..(230): n is a, c, g, or t
  misc_feature (240)..(240): n is a, c, g, or t
  misc_feature (243)..(243): n is a, c, g, or t
  misc_feature (247)..(249): n is a, c, g, or t
  misc_feature (251)..(251): n is a, c, g, or t
  misc_feature (253)..(253): n is a, c, g, or t
  misc_feature (256)..(256): n is a, c, g, or t
  misc_feature (263)..(263): n is a, c, g, or t
  misc_feature (269)..(269): n is a, c, g, or t
  misc_feature (308)..(308): n is a, c, g, or t
  misc_feature (333)..(333): n is a, c, g, or t
  misc_feature (410)..(410): n is a, c, g, or t
gcgacacacgggtggaaatcctaatggagggatcgctgacttcctttgcttgggaaaatcatcaggagcaactccgatttggctcctctgagcatcggaggggggtccatgacgtggcacgggggaaatagacaaccgaaacctcccgtgtgaactgcaaactataacctagggagggagaagaactgttttctgcattttaatttcacgcaaaaaggttcnagtgtctntgcggtaaanttntttnnntntnttntacccantccagnagaacccagagggtcctatcttggggatagcatcattcngaagagccccagccagcggcctgtnttcctgttcccacattgcccggactgcatccctgtttggggtactccatctatcctatagagctatggtcaggtatntatgaatactgggcgaatttctgaaacccaactcttgcaac

SEQ ID NO: 7543 - DNA, 455 bp, Mus musculus
  misc_feature (256)..(256): n is a, c, g, or t
  misc_feature (258)..(258): n is a, c, g, or t
  misc_feature (262)..(262): n is a, c, g, or t
  misc_feature (267)..(267): n is a, c, g, or t
  misc_feature (274)..(275): n is a, c, g, or t
gaaatggaaatgaggtgcacagaccggtgctgttctgcaccaccgtactctgctggacctggacaggatgtggaactgcagccagactactgactgggctccaggactagtaaggaaagcaccatggtcacttaaagactcatcctttcccagacctgccttagtttgggaagttgacttgaagtaaccataatggcaaaagtccatttctatctcaggtctcattgactacaaacccatctattgctgtattgantngttngtttnttttttnnagttcaattcaatttaatttttttcttaaaaagttttggtatatattaagatgaaattgagattttttttctcattagattaatattcccattgtggaaaattgggcatttagtatttacggttgaaactgccagttatataataatctattttacatgtgacactttgtatttaacttt

SEQ ID NO: 7544 - DNA, 295 bp, Mus musculus
aatagtcagatgcatcagtggccaaggctatggtgtgcagtttctatcagcgtgtacaggacatcctgcctggttttggcctcaaggaagcaatggtgagatttcgtagctcatcgtctcctggttggagcaaagggtgccaaacagaggtcaagctcgggccacagggaaactgggaaaatacgttcattgccatgtgcgaggagtccagtggatttcagaaatcttctgtgtcttcttataggatacagtgacagccccttactggaagaacattttagagctgccattgatg

SEQ ID NO: 7545 - DNA, 483 bp, Mus musculus
  misc_feature (278)..(279): n is a, c, g, or t
  misc_feature (283)..(283): n is a, c, g, or t
  misc_feature (294)..(294): n is a, c, g, or t
  misc_feature (296)..(296): n is a, c, g, or t
  misc_feature (308)..(308): n is a, c, g, or t
  misc_feature (321)..(321): n is a, c, g, or t
  misc_feature (345)..(345): n is a, c, g, or t
  misc_feature (446)..(446): n is a, c, g, or t
attccgctgaaataggctaatgctttaaaaaaaaaaatactaaaactattagccaaattgagttcagaccagtaacaagattaatttcagtaaggccttccccttttctctggtgcttactgcagtttgccaccccgctacttcgtgtctcttataaaccactccattgtcttgactcttagatcaaatacaacctgcttttgccggctgtcatcccgcaaactatttctctattttggatgttgtggtaaccatttctgatattttcaccacgactnntggnagatgattccntnttcttcactttnacacctgacatcnatggcaggaccacatgtgagactnccaattcccagcagacactatcttcactgaccctccaaatcactcagtattttgggaatacgatgaatttgtagcacctccaggtatataaagtaaaaatnaaattcactatacagttcttaattcttttctatacaa

SEQ ID NO: 7546 - DNA, 345 bp, Mus musculus
taagctcctgtgtgctctgaactcccagcccatcctccctcaaacctacccaatgtcaagaagtgaacagcgcaacaagtgggacagcctcagccatgccctgcatctgctcagtgtgccctgcctgccaaagaggaaatgctatcccaggtacaggaccaagaatggtggcagtggaatgttatactgctggaccacagaggaggcagaaaacaccaaggaaactccaaaaaaatcagaggggaaggaggaacatggctgattctacttatttgacacatcccgcaaactgaaaagacaaaggcggggtgcgaaatgtggatgactaccgggaagacctgactc

SEQ ID NO: 7547 - DNA, 501 bp, Mus musculus
  misc_feature (285)..(285): n is a, c, g, or t
  misc_feature (298)..(298): n is a, c, g, or t
  misc_feature (300)..(301): n is a, c, g, or t
  misc_feature (306)..(306): n is a, c, g, or t
  misc_feature (319)..(319): n is a, c, g, or t
  misc_feature (321)..(321): n is a, c, g, or t
  misc_feature (323)..(323): n is a, c, g, or t
  misc_feature (328)..(328): n is a, c, g, or t
  misc_feature (341)..(341): n is a, c, g, or t
  misc_feature (364)..(364): n is a, c, g, or t
  misc_feature (385)..(385): n is a, c, g, or t
  misc_feature (425)..(425): n is a, c, g, or t
aaccgccacagtttccagaactctggatactattttgactctggcttggggcgcaagaagttcaccccagatcaaaagcaacacatttctagaaatttcaatctctgggcctgtgactacatcccatccaattttgatggtctttcaaataaccaaacatcctacgtacctaagaaagctgtggtgatctcaactttccgacgatttccaagatattatgatgagaaatggagtgactacaagtttgcttacaaccaaaactgtgcaaagtttttgggataccanccaaatggagagntnnctgtngacccaaaggttntntntcccnaggcttgtgcagnatccctaaaccttccagaggctnttgatgaggtttgtgatgttntcccatcaggcggtcataaagactctgacccaacactacntcatgattgctgaaatacttttgtgatttttataaggttgaaaaattcttaggaaggtacgtgaagctattgcatg

SEQ ID NO: 7548 - DNA, 236 bp, Mus musculus
  misc_feature (32)..(32): n is a, c, g, or t
  misc_feature (49)..(49): n is a, c, g, or t
  misc_feature (63)..(63): n is a, c, g, or t
  misc_feature (82)..(82): n is a, c, g, or t
  misc_feature (84)..(84): n is a, c, g, or t
  misc_feature (96)..(96): n is a, c, g, or t
  misc_feature (177)..(177): n is a, c, g, or t
tcttccctgacctggaagctgtgatcctgccnaaagaggttaaaagcanaaagcaaaaaaacnactgtttcctgatgctttngngtcgcaccctgncctaggactgatgaaaataaaagaggaagaagaaagtgataccccaggcgtgagagtgtgagtctttgcactttccaagtnccatttcacatgcaatgatggcaagcctctccctctttcagatagctttgggataccct

SEQ ID NO: 7549 - DNA, 264 bp, Mus musculus
gtgtttagtagcttgggcccagtacactcaatcactcttgttcttgaaacttacaggccttacttctctatacaatatgaagtcctggaagctgctcagctggctctagagaccatgaatggcagtctattagaaggttcctgtatcagggtgcgcaggcttgtgactgaacttacccttgagtgtgacacccttgtaagagagctagagcaagattcggagaaccaaggtactatatatgtggctggaattggtgaaaccttt

SEQ ID NO: 7550 - DNA, 529 bp, Mus musculus
  misc_feature (274)..(274): n is a, c, g, or t
  misc_feature (309)..(309): n is a, c, g, or t
  misc_feature (340)..(340): n is a, c, g, or t
  misc_feature (342)..(342): n is a, c, g, or t
  misc_feature (373)..(373): n is a, c, g, or t
  misc_feature (388)..(388): n is a, c, g, or t
  misc_feature (391)..(391): n is a, c, g, or t
  misc_feature (443)..(443): n is a, c, g, or t
  misc_feature (448)..(448): n is a, c, g, or t
ggccgcagatagaccagtgctgtgatctcggagctggcgaacagaccagcgctgttgacatctcatctaaacatgcaaaaggaaacccttattctcacagagctcagtcctcccacctgacctggcctcgggtctcagctgtttctcatgcacacaactcatgaccaaagaaagattctaaatctcttgatcaatttacactgtgattctctgaagagcatcttttattgatttttgttttccatgttagttattcttagctttgaaaaatgtnatttgagtttttctcttcccacaactgattttccnggcgattcctgttctgagatctcagataccnanaacctccctacgttttttcattttatgtacnactggttcttttganttnatctaactacgattgtatggttcagagttccaggactatgatgattcacccnaaatnttaatgtttttgttctaattatgaaaacatggtagagcaccatttaacttgtgaccaacatcatatctactgcatctctca

SEQ ID NO: 7551 - DNA, 439 bp, Mus musculus
  misc_feature (314)..(314): n is a, c, g, or t
  misc_feature (332)..(332): n is a, c, g, or t
  misc_feature (342)..(342): n is a, c, g, or t
  misc_feature (348)..(348): n is a, c, g, or t
  misc_feature (357)..(357): n is a, c, g, or t
  misc_feature (363)..(363): n is a, c, g, or t
  misc_feature (366)..(367): n is a, c, g, or t
  misc_feature (376)..(376): n is a, c, g, or t
  misc_feature (380)..(380): n is a, c, g, or t
  misc_feature (384)..(384): n is a, c, g, or t
  misc_feature (388)..(388): n is a, c, g, or t
ataaagcattccaccgtttttcatctagaaggggagacctttcattccaggattctctttgcctagaacacagagggtaacaagattcggtgccaatctccccaatgtccccttccagggaagaaagagccaaggggagagggtcttggatcacttagcaggctctttcctctcttgggtgttctgagaagggtttaccaggcaggccttaggctgaggatgaaattaaggtgcactcaggtgatagatgtgactctgtgcaagcttcccctaatagtcacctatttattatccttgaggggccgacttctctngggcagttcacttccccntcccccactnggatantgaactaanaaaatnatnnttgtaattntganttanatantggatctgaaaccagaggtacaggtgtaagatccacaacagcagtcggcca

SEQ ID NO: 7552 - DNA, 564 bp, Mus musculus
  misc_feature (142)..(142): n is a, c, g, or t
  misc_feature (149)..(149): n is a, c, g, or t
  misc_feature (215)..(215): n is a, c, g, or t
  misc_feature (230)..(230): n is a, c, g, or t
  misc_feature (267)..(267): n is a, c, g, or t
  misc_feature (274)..(274): n is a, c, g, or t
  misc_feature (285)..(285): n is a, c, g, or t
  misc_feature (317)..(317): n is a, c, g, or t
  misc_feature (356)..(356): n is a, c, g, or t
  misc_feature (365)..(365): n is a, c, g, or t
  misc_feature (375)..(375): n is a, c, g, or t
  misc_feature (405)..(405): n is a, c, g, or t
  misc_feature (427)..(427): n is a, c, g, or t
  misc_feature (433)..(433): n is a, c, g, or t
  misc_feature (527)..(527): n is a, c, g, or t
ttggtacacacacagcatggacaccttccagccacagaggtcgtggtatgtcagcaacccacagagttctccagggaactgtgagagaacctcccaccacagtactcagtacatccttccgcctccaaacggcaaaatgatnaaatggnaagagagcttgctggtttttacaggagggaaaggagaggtgggtgtggtgagtggcaaaggacagncgggacaatgacttnggtgtgggacagaacccatcggctcgttcttacattngccaganctcaggcgtcnggttaactgagctaatattccacttgctgtgnactatgtcttcctttcgatgagctgcatcttcctcctgntacttcatnaacactaaantaccgatcagctcatgtgacagccatcagntcctgcttgtcacgtcaccctnttgtantctttggtttccgttgattacggctcttccacccacagaccaaccctcaagtttgtaagctgtttccaagcaccagaagataacagcccagctntgcaggactagagataaccatcaagttccttggcaaa

SEQ ID NO: 7553 - DNA, 542 bp, Mus musculus
  misc_feature (387)..(387): n is a, c, g, or t
tgagccctcaattgaccgctgaagacaacgaaacgctccaaaaaagcacccgaggtgcctccagggagagtctgccgtgcggacagctgctgagcttcctgcagaagaatatcatctctgctaccgttgccatggcagcagtcctcctggtgacggtgctggtggtgttcacactggtcacatataaaaggcggagacagacaaagtatcctccagcgaacatgacatacaatatttttataatgaatgggaagtctttgtggcaaaattcccaagataaggacctcaaaaaattcatgggaaagccgaagcacctgaagtacaattccttcgtctgagccggtggaggggccagcaaacggccacccagccactgccagagagttnttttgcgctacccggatagaagtccaaggatttgaagtgaactcccgaccttgaagcccaggaagaaaatgcggccgagggaggagccagcaggtggtaggcaacaaccctgggactgtggtttgagcccagagctggtatcctgaagcccattt

SEQ ID NO: 7554 - DNA, 451 bp, Mus musculus
  misc_feature (183)..(187): n is a, c, g, or t
  misc_feature (299)..(300): n is a, c, g, or t
  misc_feature (305)..(306): n is a, c, g, or t
  misc_feature (309)..(309): n is a, c, g, or t
  misc_feature (331)..(331): n is a, c, g, or t
gaaatcattcatccagtcttctctggaactcctctttggaaagcacagcgaagccattgcggagaaaagggttgggggtgtgcacatcgttggtgagagtggagccttccagcttggggctcagttcctcaagacgtggcgaaagaatgtgaaaatcgtttgtatcgtctcatgtcaaaaagnnnnntgtggactcatcttccaggacatgggctttatagtttatgagtactctatctggaacgccagtgatctctgctcagaccccagcatgttcgtggaagtactccagcatatcnnggtcnncancatccttgtgattgggaacatnactgattgcaagttcacacagaatcagtggacgaaactgatgtccatcattaagagcaagcagatattcccattctttgacattccctgtcaaggtttatccactggtgacctcgaggaa

SEQ ID NO: 7555 - DNA, 457 bp, Mus musculus
  misc_feature (244)..(244): n is a, c, g, or t
  misc_feature (259)..(259): n is a, c, g, or t
  misc_feature (273)..(273): n is a, c, g, or t
  misc_feature (278)..(278): n is a, c, g, or t
  misc_feature (282)..(282): n is a, c, g, or t
  misc_feature (289)..(289): n is a, c, g, or t
  misc_feature (297)..(298): n is a, c, g, or t
  misc_feature (302)..(302): n is a, c, g, or t
  misc_feature (331)..(331): n is a, c, g, or t
  misc_feature (345)..(345): n is a, c, g, or t
  misc_feature (389)..(389): n is a, c, g, or t
tgaccccattggataacctgctaggcttgagagcataaagaatcatttgcgcagcaatatttaaaaacgagaagaaccaggtaccaagatcatagaagaaattattatctgattcctgatgttctgatggatgaagtactcagtccgaagtgctcggttcaagatcaaccaacattgttagctaacactgggatataattaggaaattatgagcaagagggattcattcatgatttatcttttnggttgtgagcttacnttttccaggatganccatntctntagcctnttcatggnntatntcaattatacttaccagacaccattgttngctacagcacattntcatttagtaccaactgtggcataaattgatgagaaagttgctnccagaagccacaaaatatcaacaaccttgccctatggttgactatcagcacagatacaccaatagttt

SEQ ID NO: 7556 - DNA, 327 bp, Mus musculus
acattattttgcagagcactctaatacaaagcaaaacaaaacaagcactgggagttgctttaacagatagggctgaggggctctgacactggaatcctctggactctggcctgctctggggctatttcaaaaaccactttctccagtaatttcactatacgccatacaaggagagtgacccaactgtgccaaacagatggcaactggctacaaatgtatgtatggtgccatgcattcgccagtgcaaacctacattatggtgacagcatccttcaccaggacaactcaattctaaaaccatcaacatacacttcacagatggcaagg

SEQ ID NO: 7557 - DNA, 325 bp, Mus musculus
  misc_feature (300)..(300): n is a, c, g, or t
agagggcagaaaccagccttcacctccagggagaagtgcctataaggacccacttgctcttgccaccctgcccagaaagatccagccacaagctggggttcccttgggcaattcaacactggcaaggcctctagattctcctatgtgtcctgtctctccaagaggagtccctagatcatatcagagtcccctaccaaattgtcccttgacaaatgtaccttcccacacctgggaaaatcagatgcttaggcagcttctgggtcgtgggcccgatggccaatggagtggcagccctccccnaggacgcagctttccaaagtcatac

SEQ ID NO: 7558 - DNA, 536 bp, Mus musculus
  misc_feature (278)..(279): n is a, c, g, or t
  misc_feature (285)..(285): n is a, c, g, or t
  misc_feature (288)..(288): n is a, c, g, or t
  misc_feature (302)..(302): n is a, c, g, or t
  misc_feature (307)..(307): n is a, c, g, or t
  misc_feature (329)..(329): n is a, c, g, or t
  misc_feature (336)..(336): n is a, c, g, or t
  misc_feature (355)..(355): n is a, c, g, or t
  misc_feature (358)..(358): n is a, c, g, or t
  misc_feature (361)..(361): n is a, c, g, or t
  misc_feature (377)..(377): n is a, c, g, or t
  misc_feature (448)..(448): n is a, c, g, or t
  misc_feature (493)..(493): n is a, c, g, or t
  misc_feature (511)..(511): n is a, c, g, or t
aggtctaagatgtatcggccccaacgcctcctatcttgtggatcgagttcctgtggaggaagctaacacagcggtaagcaaatgtggactgacagaggacacagggccattcgagaaactgtcagaaactaagaatcacctcagaacacgctgagaaggagagctaaggaggtgaggcctgggttgtgggagttggcacctgacacagtggttcccactgctgggttctcttctggttttgattgtctacgctcaggcttcagagccctgggcatgannaaaaanaangggagaatgaatangttantattccatgaaggcatagaagnaggtatntgggaatggctgtcgttcnatnttntgggtagtcatggctntcaggtgggaggcccagggagagccagtgtcccgtcagtcaaaaccatggcagggtggcttacattctatntcagataaattctttttgtttggtagagaagcattctctctgctntatttcagcttcggttanatggactacgaggacccacgtcata

SEQ ID NO: 7559 - DNA, 496 bp, Mus musculus
  misc_feature (375)..(375): n is a, c, g, or t
  misc_feature (384)..(384): n is a, c, g, or t
  misc_feature (387)..(387): n is a, c, g, or t
  misc_feature (399)..(399): n is a, c, g, or t
ggatgccctgttggaaagatggataataccgggctggactgcaacacatttcggggagtcctgcagaacatattcggaatgactaacgatatgttgatgaatagagtgttctttgtatttgacaaagatggtgatggctatgtaaatttagaagagtggattaaaggcttggcagtgtttctccgagggacttttgaagagaagatgagattctgttttgaagtttattatttaaacggagatgcttatatttcccaagaaaaaatttttgacatgttgaagagtagtctcttccagcactctcctgaagaagagaatgaagaaggagtaaaggatttggtagaaataagcctgaagaagatggattatgacaangatggcaanatntcttttgcagantttgaaaaagcagtgaaagaagacggacttttgttggaggcatttggaccatgtttaccagatgcaaagttctgctttcactttgaacccctggtgt

SEQ ID NO: 7560 - DNA, 512 bp, Mus musculus
  misc_feature (316)..(316): n is a, c, g, or t
  misc_feature (320)..(320): n is a, c, g, or t
  misc_feature (326)..(326): n is a, c, g, or t
  misc_feature (334)..(334): n is a, c, g, or t
  misc_feature (336)..(336): n is a, c, g, or t
  misc_feature (388)..(388): n is a, c, g, or t
ctatactcgactttccttatggtttaagagacgaagtgcccttagttgctccaacacaacacttcaggaaaaggattcaaagcatgacattccgaaaacttctcttgtcttccgttaccccaggcaggctgttctacgaagaaaaatcagtaagccatgtctcctcagaaccaggaaagcagttcctggacctggcagaccttcagtggaggtatttcaaggggcttgcgacgtgggggaaagtgcccaggatgttttcattcatggacatagagttcaacagtgagaagagatttgtaggcagccaaggcatgcntggntttatnttcccgcntntggttcgtaagacactggtggtttacccccaggtggagtacgatgatttggnccactattctgttaagtggaaagcctaatttactgaacgtttctagatgtggatagctgcacttgggaacccggagtcgatacaagaggcagaaaagcatgcgatccactttcctatgcaatat

SEQ ID NO: 7561 - DNA, 548 bp, Mus musculus
  misc_feature (86)..(86): n is a, c, g, or t
  misc_feature (88)..(88): n is a, c, g, or t
  misc_feature (116)..(116): n is a, c, g, or t
  misc_feature (206)..(206): n is a, c, g, or t
  misc_feature (337)..(337): n is a, c, g, or t
  misc_feature (339)..(339): n is a, c, g, or t
  misc_feature (368)..(368): n is a, c, g, or t
  misc_feature (377)..(377): n is a, c, g, or t
  misc_feature (380)..(380): n is a, c, g, or t
  misc_feature (390)..(390): n is a, c, g, or t
  misc_feature (520)..(520): n is a, c, g, or t
tcttggcacagatggtcaggaccacgatgagaacacccaccacaaacgccaccaccggccagaggaagcagtgcaggagagcaatntngtcgtgtgtgcgctgtaggagaacgtcntctggtctgcaagagagtggaggacaggaaaggaagaccagtgagtctctcagcccagcacattctacacaacctgcagacgacaagtgntctccggcgtagggaataatcacccttgaaagtgatgactctgattgcagacaccgtcccagactgctccacacccatttccaaaagccgtgagctctcgaatcaatcattactgaggatggcactgaatncnattatcacaataaggaacaacccagccantgaaagagntcntaagagggantctggaaccaccacaccccggagcactggctggagaaaacccgggaggaaacgggcaggagagaaggaagcgaccggaaactgttggatccaaaagcgtgttttcctcagaaactttctagaattccatntcctggatcttgggcaacacttatgttt

SEQ ID NO: 7562 - DNA, 372 bp, Mus musculus
gggcaaaataaattcacactcacacacacacacacacacacacacacacacaactgcttgatgtaaaaaatgagttatctgtcctcacgaaacacacatacacaaaccaagatggtctagatcagcagttctcaaccttcctaatgccaccactctttagcacagttcttcaccttgtgttctttcaatgctactttgtaactatagttttgctactgttatgaattgtaatataaatatctgatactttcaatggtcttaggtgacacctgtgaaagggtcatttggtccccaaagggttcgtgacccacagattgaggactgctagtctagattaatcttcatatggcctctatgatatcgaatactctg

SEQ ID NO: 7563 - DNA, 500 bp, Mus musculus
  misc_feature (330)..(330): n is a, c, g, or t
  misc_feature (340)..(340): n is a, c, g, or t
  misc_feature (343)..(343): n is a, c, g, or t
  misc_feature (346)..(347): n is a, c, g, or t
  misc_feature (360)..(360): n is a, c, g, or t
  misc_feature (406)..(406): n is a, c, g, or t
  misc_feature (429)..(429): n is a, c, g, or t
  misc_feature (439)..(439): n is a, c, g, or t
  misc_feature (447)..(447): n is a, c, g, or t
gacaagctgctggacataggaagaactcagtgctcatccctctttgtggaaacaaacacgagccagaaaccacacagccgccatgtgagatgagagggttgccaaagcctggtgtgtccagccacaacctcccggttaaagatgggagacatgggaaaaactcctcttttaactcacaccacacatgtgttctctctgtctgtgtgagagatgaacagacacggtcagcgaggagcaatgtgggcagaaaccccccaggtgcaggccagagaaccagggggttcccaagaccttcaggggatctgtgaggttggaactgttttcccatgntgccacaggntcnttnnccttcactcacgntgaaagcacagggtggcactttccagagcctaggatatgtatggtnttgtgacagtgagtccagaggcntcttttcaantctagctntcttctgtcaaaccagacactaaggaagcttgcgcaggtgtaagacagtgcct

SEQ ID NO: 7564 - DNA, 429 bp, Mus musculus
  misc_feature (236)..(236): n is a, c, g, or t
  misc_feature (241)..(243): n is a, c, g, or t
  misc_feature (245)..(245): n is a, c, g, or t
  misc_feature (248)..(248): n is a, c, g, or t
  misc_feature (251)..(252): n is a, c, g, or t
  misc_feature (255)..(255): n is a, c, g, or t
  misc_feature (264)..(265): n is a, c, g, or t
  misc_feature (271)..(271): n is a, c, g, or t
  misc_feature (273)..(273): n is a, c, g, or t
  misc_feature (277)..(277): n is a, c, g, or t
  misc_feature (287)..(288): n is a, c, g, or t
  misc_feature (292)..(292): n is a, c, g, or t
  misc_feature (308)..(308): n is a, c, g, or t
  misc_feature (310)..(310): n is a, c, g, or t
  misc_feature (312)..(313): n is a, c, g, or t
  misc_feature (320)..(320): n is a, c, g, or t
  misc_feature (330)..(331): n is a, c, g, or t
  misc_feature (333)..(333): n is a, c, g, or t
  misc_feature (336)..(336): n is a, c, g, or t
  misc_feature (340)..(340): n is a, c, g, or t
  misc_feature (355)..(355): n is a, c, g, or t
cttactctcagcgtcatcaatgtgtaatagggaactgcttacaagatacagacgctccgaataaaaataaaataagaaacaaaaacccactccagagacagtgagccctctgagttaccgacccagaacaattctgcagacatcaactggtcctccattttgaaatgagagtgattccatccttaattactaaaaacacctttctacaaacatatcacctattgttcacaagtatntgtannncnaanacnnttntactggaanntctggncnaacnataaggattnntcgntaagcacgttggggantntnncccaccnccatgtgcanntnttntgcncaatgcggcagattntctaaggtttcaatgtttccctatgtgttcctgaaggaacaggaaataggggtttcaaagtgcatcgtcaaatg

SEQ ID NO: 7565 - DNA, 559 bp, Mus musculus
  misc_feature (282)..(282): n is a, c, g, or t
  misc_feature (294)..(294): n is a, c, g, or t
  misc_feature (297)..(299): n is a, c, g, or t
  misc_feature (302)..(302): n is a, c, g, or t
  misc_feature (305)..(305): n is a, c, g, or t
  misc_feature (313)..(313): n is a, c, g, or t
  misc_feature (326)..(326): n is a, c, g, or t
  misc_feature (334)..(334): n is a, c, g, or t
  misc_feature (336)..(337): n is a, c, g, or t
  misc_feature (343)..(343): n is a, c, g, or t
  misc_feature (358)..(358): n is a, c, g, or t
  misc_feature (360)..(360): n is a, c, g, or t
  misc_feature (367)..(367): n is a, c, g, or t
  misc_feature (372)..(372): n is a, c, g, or t
  misc_feature (379)..(379): n is a, c, g, or t
  misc_feature (381)..(381): n is a, c, g, or t
  misc_feature (396)..(396): n is a, c, g, or t
  misc_feature (411)..(411): n is a, c, g, or t
  misc_feature (429)..(429): n is a, c, g, or t
  misc_feature (505)..(505): n is a, c, g, or t
gctatgcatcatctttatacaggacaattgtgccagcgagcaggagttgtggcgtatattgaataacatggggctgtatgcagggagagatcatttcatatatggggacccaggtgttcttataactgaacattttgtgcaggaaggatatctagaatgcagacaggtgccaggcagtgatcctcctaccagagagtatctgtgggggccgagggcacatgctgaaaccaccaaaatgaaagtattaaagcattttgccagcatcgttaaacaggatcccanatcctacccaantannnatncanatgctttnaaagatgagatanacaggacntnngccagnttcccccaacagatngnactatgntctgnctagcananattccagcacactgnccattcccatccaanatcaggccaggcagagtntacgtactgttcccttatttgagagctggaaagagggagctgtgaactattccattcttcctgtactgactgtgantcaggctttcttgttatgaaatgttgctacttgtactccaaggctcattatctg

SEQ ID NO: 7566 - DNA, 432 bp, Mus musculus
  misc_feature (325)..(325): n is a, c, g, or t
  misc_feature (349)..(349): n is a, c, g, or t
  misc_feature (360)..(360): n is a, c, g, or t
  misc_feature (377)..(377): n is a, c, g, or t
  misc_feature (392)..(392): n is a, c, g, or t
tgcatactggctgggctcctccttgcctccctccatctcctctctcagcctctgagaggcccgagcatcttggccttgacctcgtcctctggaaagtcttaatacgcgactctagcgatgtctgccctgcttctgttttgctgttagtcttcacgaccacaaagcaggccacttggtccttccgtgctgctcccaaggccccgcgctttgaatcttccagatggataagtgtcaggaagggaggaggtgctgagaccctctcttcctcaggagtcaagctgtttcactccttttctcctacaatggctggaagtgatcttgttgnaaatctcagcggtagaaaatgctntcatcaagggntcttgaggactgcattnttctgataagttttnggaactgtgaaggaaattgaacccacattcatctaaaccc

SEQ ID NO: 7567 - DNA, 477 bp, Mus musculus
  misc_feature (300)..(300): n is a, c, g, or t
  misc_feature (311)..(311): n is a, c, g, or t
  misc_feature (318)..(318): n is a, c, g, or t
  misc_feature (323)..(323): n is a, c, g, or t
  misc_feature (385)..(385): n is a, c, g, or t
  misc_feature (395)..(396): n is a, c, g, or t
  misc_feature (400)..(400): n is a, c, g, or t
  misc_feature (450)..(450): n is a, c, g, or t
  misc_feature (452)..(452): n is a, c, g, or t
cccggcagctgatatgaatcaactgttttgggaccagcagctggcaaaactagcgaaagcatggactagagagtgcaaacttgcccataatccctgtatcaaacaacgatacgaatgtcttgaggactatgactttattggagaaaatatttatttgggtagaattgaaacccaaccagaagatgttgttattaattggtataatgaaagtaaatattttaattttgattttaatacctgttctgaaatgtgtggccattatacacaggtagtttgggccaaaacggttaaaattggttntgcagtttcanattgtcntaatntcaagggcttttcagctgggctatttgtatgtaattattcgccagcaggaaactttataggnttcagacctnnacangagaggagactcttgctctatgtgtggacaaaagacgtgtgagaatagtntntgccgtcccatgaatcggaagacac

SEQ ID NO: 7568 - DNA, 479 bp, Mus musculus
  misc_feature (335)..(335): n is a, c, g, or t
  misc_feature (352)..(352): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (362)..(362): n is a, c, g, or t
aaagttcttctacggtgagccacctcctgcgacacagcctcctggccgacaggtgtcccatgagaaactgaaggatcacataatcttgggagactcaaagctgctcggaaacttcttccaaacctccatgagctcagactattgccctccgactacccccataaaacaaagaaccctcaagttctctttgttggagagtaacctccctgagggcacaggtgaattagactttttcaccacgaaccaaatgatgatgaagccgcatggaatagttcgagcctctatcactgaagatttgttacagaagtgcaaatacagtcacatagagcccccantgggcagacaacgtttnttntntantnagaatcaagacgagtatcccttcaagtaccagggcccattggtccagaagctaagtagcatgcatgagagccatctgccaatgggcacacccaagtaccttggctgctggcatgaga

SEQ ID NO: 7569 - DNA, 420 bp, Mus musculus
  misc_feature (287)..(288): n is a, c, g, or t
gaatacttcattctatcctaccttaatgatttccatgccctgctcttcctgccttactaaactttccttgaagcaccatattcccttcgaacctcccgcccattttccctctaccccagctacccttccttctaataaaagacccccatcaaccagttccgtagtctttcaccctgatcagaaaactagccactctcaggttgataggtgcttaaacaagaattctgacgaatggactgacactcaagaaaatggactgattacagggcccgtgataccaggacagnnacatcaagagccactgactgaaataactgaagaagaagagatgcaagcctttggcatgtaaggctttttccttgctaagatttgaggagaacaccagcaacaaaggtgagctaacatcaggactgctggatt

SEQ ID NO: 7570 - DNA, 257 bp, Mus musculus
aaatatgaccataaggagcttcgtaagcggttggtgctggaagaatggatcgtggagcagctgggtcagctgtatggctgcaaggaagaagaaatgccagacgtagaaattgacattgatgatcttcttgatgccaaccgcaaggaggaaagagcttcgaaattacaggaagctctcgtagtctgctataaaccaacagaggaattcatcagagagctgctctcccgaataagagcatgaggaagctgaaccctccg

SEQ ID NO: 7571 - DNA, 433 bp, Mus musculus
  misc_feature (98)..(108): n is a, c, g, or t
  misc_feature (246)..(246): n is a, c, g, or t
  misc_feature (264)..(264): n is a, c, g, or t
  misc_feature (305)..(305): n is a, c, g, or t
  misc_feature (334)..(334): n is a, c, g, or t
  misc_feature (341)..(341): n is a, c, g, or t
  misc_feature (390)..(390): n is a, c, g, or t
  misc_feature (392)..(392): n is a, c, g, or t
tcgaatcgtgacagccgtgacagccgttctctgatgaccctagttcactcagtctctatgttcatgttctccatgctacagtccggctggcgactatnnnnnnnnnnntcttctatgagtgctggctcagtttcctcccacacgaggaccaggtcggcattggggacgtcagaggctgagatgctgcgggaagtgtacctggtgctctgggtcatccgcaaacaactaagagagctggcccgcagncaggagaggcgaagacgncgccgtatgtggtctcatccctcccatacttcccgtcactntgaaccagtgcagggcctcaaacatgatncccgaantcctctttaggcaggggagccccagatcctttgaaagcccccacctcantnttacggaagattgacaggaagggttcaatggccatcaggcc

SEQ ID NO: 7572 - DNA, 473 bp, Mus musculus
  misc_feature (215)..(215): n is a, c, g, or t
  misc_feature (220)..(221): n is a, c, g, or t
  misc_feature (229)..(229): n is a, c, g, or t
  misc_feature (231)..(231): n is a, c, g, or t
  misc_feature (234)..(234): n is a, c, g, or t
  misc_feature (238)..(238): n is a, c, g, or t
  misc_feature (242)..(242): n is a, c, g, or t
  misc_feature (248)..(248): n is a, c, g, or t
  misc_feature (250)..(250): n is a, c, g, or t
  misc_feature (266)..(266): n is a, c, g, or t
  misc_feature (268)..(268): n is a, c, g, or t
  misc_feature (273)..(273): n is a, c, g, or t
  misc_feature (414)..(414): n is a, c, g, or t
aatgcctgtacgtcaaggagcgtgtttcactcacaggtgctgaagcttctaaacaaactgcttctccctatgcacttagaaagctgcacgacagacccagaatcctgcccccagtttaatttaacagatttcatgagcaaaagctacgtcaaaaacttgtatcaaaaaaggcctttcccctggtttgatctgactactgtgcaactcaaggaaantcctnntagccagnanatntcanccantccttntnttcaggaccacattantnttttntactgtgaagtatttggcctcaccataagcgaagaagaattgccttatatttccacagttatccggcccctagtagaggagaaatgacagagagccatgagttctgcttgatacccgagtgaagaataaaataggagatcntcctctatatgtcagtattcttgggtgtttcttagaaacaatctagtccattgcttccc

SEQ ID NO: 7573 - DNA, 526 bp, Mus musculus
  misc_feature (75)..(75): n is a, c, g, or t
  misc_feature (157)..(157): n is a, c, g, or t
  misc_feature (172)..(172): n is a, c, g, or t
  misc_feature (174)..(174): n is a, c, g, or t
  misc_feature (185)..(185): n is a, c, g, or t
  misc_feature (187)..(187): n is a, c, g, or t
  misc_feature (189)..(189): n is a, c, g, or t
  misc_feature (208)..(208): n is a, c, g, or t
  misc_feature (211)..(211): n is a, c, g, or t
  misc_feature (228)..(228): n is a, c, g, or t
  misc_feature (247)..(247): n is a, c, g, or t
  misc_feature (313)..(313): n is a, c, g, or t
  misc_feature (315)..(315): n is a, c, g, or t
  misc_feature (324)..(324): n is a, c, g, or t
  misc_feature (397)..(397): n is a, c, g, or t
  misc_feature (432)..(432): n is a, c, g, or t
  misc_feature (435)..(435): n is a, c, g, or t
  misc_feature (452)..(452): n is a, c, g, or t
  misc_feature (482)..(482): n is a, c, g, or t
gttcagtgacacagtggttactccacgtacctttggcaacatgttatggaaaacttgaaggactggcaagatggntcagcaggtaaagctgtttgacaccaaaatctgacctcctgtattccatcaccaaatttaactgtgacacagaaggactaanttcagagagttgacntntgaacttcccnantnatgctgtgggttttgtgtnccnacactcacacacatagntgcctacttcagtcaatgncagtgtgcttttagagctaacatcttgctacatttgagaaggtttcttttgtttgctgccttgaantnttcaagctntcttatggaagactgaagaatattttcatacagaaattcaagaataagcttcagttattaaacaatgagtatntgaaaatcagaatatgatttgaattagttactttntcntatgccttttacagttntgtgtttgttggcctctgccacaatcattntcatcaggtctgaccataagcacattcaccattattttacttag

SEQ ID NO: 7574 - DNA, 285 bp, Mus musculus
  misc_feature (260)..(260): n is a, c, g, or t
gaatgatcgaaatgacctgccagttcaaagtcaccccgacgtgtcccgtgggacgagaactaaatactgacagcaagaaaaccagctttgactcggaggcgagtgtccccccagcccgagtgctgggcaggccgctgttcctttcagctcactttcacagatggtagtctcagctgtgacaggacctctgccatccaagtgatgggtaagcaggcaaacagaaagagcagcatgtcctgcgtgatacagacaaccaaggnttctccagaggatgtgcagtcagtg

SEQ ID NO: 7575 - DNA, 506 bp, Mus musculus
  misc_feature (91)..(91): n is a, c, g, or t
  misc_feature (132)..(132): n is a, c, g, or t
  misc_feature (136)..(136): n is a, c, g, or t
  misc_feature (141)..(142): n is a, c, g, or t
  misc_feature (149)..(149): n is a, c, g, or t
  misc_feature (164)..(165): n is a, c, g, or t
  misc_feature (199)..(199): n is a, c, g, or t
  misc_feature (208)..(209): n is a, c, g, or t
  misc_feature (211)..(212): n is a, c, g, or t
  misc_feature (214)..(214): n is a, c, g, or t
  misc_feature (216)..(218): n is a, c, g, or t
  misc_feature (220)..(233): n is a, c, g, or t
  misc_feature (235)..(236): n is a, c, g, or t
  misc_feature (240)..(242): n is a, c, g, or t
  misc_feature (245)..(252): n is a, c, g, or t
  misc_feature (254)..(254): n is a, c, g, or t
  misc_feature (256)..(257): n is a, c, g, or t
  misc_feature (259)..(259): n is a, c, g, or t
  misc_feature (261)..(261): n is a, c, g, or t
  misc_feature (263)..(268): n is a, c, g, or t
  misc_feature (270)..(273): n is a, c, g, or t
  misc_feature (276)..(279): n is a, c, g, or t
  misc_feature (305)..(305): n is a, c, g, or t
  misc_feature (313)..(313): n is a, c, g, or t
  misc_feature (324)..(325): n is a, c, g, or t
  misc_feature (327)..(327): n is a, c, g, or t
  misc_feature (331)..(331): n is a, c, g, or t
  misc_feature (334)..(334): n is a, c, g, or t
  misc_feature (336)..(336): n is a, c, g, or t
  misc_feature (339)..(339): n is a, c, g, or t
  misc_feature (348)..(348): n is a, c, g, or t
  misc_feature (363)..(363): n is a, c, g, or t
  misc_feature (367)..(369): n is a, c, g, or t
  misc_feature (412)..(412): n is a, c, g, or t
  misc_feature (431)..(431): n is a, c, g, or t
  misc_feature (461)..(461): n is a, c, g, or t
  misc_feature (463)..(463): n is a, c, g, or t
gttggcttttctaaaattgatctgagacaaggaaagttccaagttaccatctttgacttaggaggtggaaaaagaattcggggaatttggnaagaattattatgctgaatcctatggggtaatatttgttgngganttccnntgatganggagagaatggaagnnaaacaaaggagacaatgtccgaagtgctaagacncccgagganntnngnannncnnnnnnnnnnnnnngnnaacnnncannnnnnnngngnngncntnnnnnnannnngannnnacggattgctccatccacaacccgancaggggtngccttcagaanntntccntantntcntactccatntcctgatggtgcaanaccnnntcactggcagggatccatggaccctgacacacagagacagttntgaatgaaactgtgacctnctacttctggaccctgctagttcatgtccntntcagtgcagataccttcactagaacttgaccagtccatgcggt

SEQ ID NO: 7576 - DNA, 373 bp, Mus musculus
  misc_feature (158)..(158): n is a, c, g, or t
  misc_feature (164)..(164): n is a, c, g, or t
  misc_feature (192)..(192): n is a, c, g, or t
  misc_feature (233)..(233): n is a, c, g, or t
  misc_feature (293)..(293): n is a, c, g, or t
  misc_feature (296)..(298): n is a, c, g, or t
  misc_feature (323)..(323): n is a, c, g, or t
gatccctttccgttagaaatggtgaatttgttctgttacaaaatctgtgtgccacccccagcatcccagttgtctgtgtattcatccagccatgtatccgattaacatttgttacacacctactatgtgtcagtggagatccccactgacacacctantatgtntcaatggagatccccacatcaatagctntcctaaatatatttccttgccatatttcaagatggttattntgagaaacggcccacaaaaatatgtgctgaagacgttgtttccatcaatctgcatcagcnggnnnaaaaaaaaaaaaaaaaaaaaaaacngcaggcacaggcagaaactctcttgaagagtctctccatctgcccaggaa

SEQ ID NO: 7577 - DNA, 553 bp, Mus musculus
  misc_feature (218)..(218): n is a, c, g, or t
  misc_feature (220)..(220): n is a, c, g, or t
  misc_feature (222)..(224): n is a, c, g, or t
  misc_feature (228)..(229): n is a, c, g, or t
  misc_feature (231)..(232): n is a, c, g, or t
  misc_feature (234)..(234): n is a, c, g, or t
  misc_feature (347)..(347): n is a, c, g, or t
  misc_feature (354)..(354): n is a, c, g, or t
  misc_feature (356)..(356): n is a, c, g, or t
  misc_feature (368)..(368): n is a, c, g, or t
  misc_feature (466)..(466): n is a, c, g, or t
  misc_feature (521)..(521): n is a, c, g, or t
aagatcttgttacagtgtccaggctgggtgtgaacagtgatactccagtgaccttcctgcttcatcctcccaggtagcaagaactccgtatagatgtgcatcatcatacctggcttagcaaatgtttaaagactcacctgcacttgcctcttgtgtactggaattaaaagtgacctccaccctgaccagcattaactactttgaccactcagtacctncntnnnaaanntnnanaactacttattctactggcatattcactcgatacgtgtttccagatgactccatactcactttaagaaaatgcagactccagcaccacaatgaagcgcatgaaaaacgcacgntccaacntnttccccattcantatttcttggcaacagatgttctgagaacacaggatggccccacagaaaagacagaggacaggatgctttcgctcatcatctgcagaccgtggacacntcaacaggggaagacacattcagtgtgttggaaaacaagaagcacatcatgtatntatttagtaataaagcctgttccatcactcac

SEQ ID NO: 7578 - DNA, 414 bp, Mus musculus
  misc_feature (259)..(259): n is a, c, g, or t
  misc_feature (261)..(261): n is a, c, g, or t
  misc_feature (273)..(273): n is a, c, g, or t
  misc_feature (302)..(302): n is a, c, g, or t
  misc_feature (313)..(313): n is a, c, g, or t
  misc_feature (316)..(316): n is a, c, g, or t
  misc_feature (320)..(320): n is a, c, g, or t
  misc_feature (333)..(334): n is a, c, g, or t
  misc_feature (348)..(348): n is a, c, g, or t
  misc_feature (350)..(350): n is a, c, g, or t
  misc_feature (353)..(353): n is a, c, g, or t
aagatttccttctctaccctgagtgctgttgcaactccaaggattgtagaccttgcccacccaaggattaagatagagggcctatgctatgaaagagaaaggagtgaattgcccatccgtcccgtagcccctgctgccctacttgctaatcctagtaaaagaacgatatttctagcaaagtccaagcgtgttcatgaagactatctccctatccgagatgctcggtggcctgtatcttacgctgcgactcattctcagntntctgagagagtncaggagttagctaatccacacacaagggntccagcgaacnttntatnctacgacccaaanntctttaaagtcaancnttntgctttaaaagcacactgttccgacagggtcaaggagctggcggaacccattgtgcgttaa

SEQ ID NO: 7579 - DNA, 270 bp, Mus musculus
  misc_feature (131)..(131): n is a, c, g, or t
  misc_feature (173)..(173): n is a, c, g, or t
  misc_feature (226)..(226): n is a, c, g, or t
  misc_feature (245)..(245): n is a, c, g, or t
gtacctgctggtaatggtggatccagatgcccccagcaggtctaaccccgtgatgaaatactggagacactggttggtgtccaacatcacaggtgctgacatgaaaagtgggagtatccgtggcaatgtantatcagactactcgccgcctaccccaccgccagaaactggtntacaccgctaccagttctttgtctaccttcagggagacagagacatttctctntcagtggaagaaaaggcanacttaggtggttggaatctggacaa

SEQ ID NO: 7580 - DNA, 139 bp, Mus musculus
aaatgaacatctttacatggagggtgatctgtggtgatggcccagactcaaggtctatcctgaaaatgcccacacgtgatcaaccctaggatttcagatacctttggtgtgttggacttgaaagagaacagttgttgca

SEQ ID NO: 7581 - DNA, 470 bp, Mus musculus
  misc_feature (164)..(164): n is a, c, g, or t
  misc_feature (335)..(335): n is a, c, g, or t
  misc_feature (356)..(356): n is a, c, g, or t
  misc_feature (361)..(361): n is a, c, g, or t
  misc_feature (375)..(375): n is a, c, g, or t
  misc_feature (390)..(390): n is a, c, g, or t
  misc_feature (420)..(420): n is a, c, g, or t
  misc_feature (433)..(433): n is a, c, g, or t
gtatagccaacattcaacaagcttcatgctcatataaattattagtagatagccttaagaaaaataaagtttttagctatgctaaaccagaggaacctaagagatgggataactaaatgtaatttgactgaaatgtaatttggtctcctaacgggcccctaggnaccatacggtagagatgaaccaagcctggacttcctctgctacttgtgatagtgtgggagactgggtgatggatagataggatttctactgttttcatgatttttctataaatctaaaattatcctcaaacggagtttgttaaaaattaaaggcttagtcaaacattcatnaactaaatgaagaagcaatgnaaatnatttctcaacatgnatgaaatattatttnagaggcagaaatgaattactggtatcattnagaagtgtgtatnactttgtgcacagtagtccagtttctgactttgttca

SEQ ID NO: 7582 - DNA, 481 bp, Mus musculus
  misc_feature (101)..(101): n is a, c, g, or t
  misc_feature (103)..(103): n is a, c, g, or t
  misc_feature (105)..(105): n is a, c, g, or t
  misc_feature (107)..(108): n is a, c, g, or t
  misc_feature (110)..(119): n is a, c, g, or t
  misc_feature (121)..(122): n is a, c, g, or t
  misc_feature (124)..(129): n is a, c, g, or t
  misc_feature (131)..(144): n is a, c, g, or t
  misc_feature (146)..(146): n is a, c, g, or t
  misc_feature (152)..(152): n is a, c, g, or t
  misc_feature (161)..(161): n is a, c, g, or t
  misc_feature (166)..(166): n is a, c, g, or t
  misc_feature (189)..(189): n is a, c, g, or t
  misc_feature (307)..(307): n is a, c, g, or t
  misc_feature (356)..(356): n is a, c, g, or t
  misc_feature (379)..(379): n is a, c, g, or t
  misc_feature (384)..(384): n is a, c, g, or t
  misc_feature (414)..(414): n is a, c, g, or t
  misc_feature (417)..(417): n is a, c, g, or t
  misc_feature (447)..(447): n is a, c, g, or t
agaggttctaggtctgcacactggcgcaagttcaagaatccagtgaaggatcatgactgttgtgattcaagctggacttcagtgctctgtttaaatcacangnananncnnnnnnnnnntnntnnnnnncnnnnnnnnnnnnnntncagtgntaagccagntattntgatacagttaccacatcttacncagcacatctttagggattaatataccctcttagcttttgcctcccggaattccattattcccattgcattcgtgggtcttgtttcaatggcaacagctctcattttaaatgctgatntacagagaagaggacacaaagagatattaagagattctagggcctccancgaccagtttggtgtcaatagtntgtanttagggacatgttgatgttcatggtctgtnttnccaccagaaagcatgtggaagtccatgatntgtgcaggccctggctgttatgtggcagtggtat

SEQ ID NO: 7583 - DNA, 517 bp, Mus musculus
  misc_feature (294)..(295): n is a, c, g, or t
  misc_feature (300)..(300): n is a, c, g, or t
  misc_feature (302)..(302): n is a, c, g, or t
  misc_feature (305)..(305): n is a, c, g, or t
  misc_feature (308)..(308): n is a, c, g, or t
  misc_feature (316)..(316): n is a, c, g, or t
  misc_feature (320)..(320): n is a, c, g, or t
  misc_feature (327)..(327): n is a, c, g, or t
  misc_feature (331)..(331): n is a, c, g, or t
  misc_feature (341)..(341): n is a, c, g, or t
  misc_feature (368)..(369): n is a, c, g, or t
  misc_feature (378)..(378): n is a, c, g, or t
  misc_feature (381)..(382): n is a, c, g, or t
  misc_feature (387)..(387): n is a, c, g, or t
  misc_feature (471)..(471): n is a, c, g, or t
  misc_feature (478)..(478): n is a, c, g, or t
atggacccaaatactgcagcatttcaatgacaagttttagaaggaacacgtcttcatatttttaagggcccattgagtcctcggaactaactaaaacaaaaatcccttcttacacaaagcctaggagaaaaggaatggagattttaggtatgaacagctatctctaaaacagtgttaattagattgccattggagtaaaacctacccagatgaatctttttccattggcaagccaacattaagagagtggagttaaaatgttttcaggaaatagcacactggatgactcccttnnaaagnanatnacntcagattntcanaccaatnatcngcggtaacanatgtaacacacctagcaccaagaagtnngtataggtnaannatatnttattcctactgagaaagttaactttttccttttttggagcaagtcttattacgttgctcaggctgtcgtcaaacttggaattntcctgcntctactatggacagattacggtgtgggtcaaaatgcctg

SEQ ID NO: 7584 - DNA, 508 bp, Mus musculus
  misc_feature (411)..(411): n is a, c, g, or t
  misc_feature (413)..(413): n is a, c, g, or t
  misc_feature (416)..(416): n is a, c, g, or t
  misc_feature (482)..(482): n is a, c, g, or t
gagatcttaacactctgatgggtaaattgaaactgaagaatacagttactattcagcaagaaaaactattggctgagaaagaagaaatgctacaaaaggagcgaaaggaatcacaggacgctgggcagtttcttcgtgccaaagagcaagaggtatgcagattacaggaacaattagaaactacagttcagaaactcgaagaaagtaaacaacttttgaaaaataatgaaaaattaatcacgtggctaaacaaagagctaaatgaaaatcagctggtaagaaaacaggacacattgggaacctctgccaccccacattctactagcaacagcaccatcagaagtgggctctctcccaatctgaatgtggttgatagactaaattacccaagctgtggaattggctatcctntntcntctgcattgacattccagaatgcttttcctcatgtagtagctgccaaaaacaccagccaccctatntctggaccaaaggtagccaagtgcta

SEQ ID NO: 7585 - DNA, 505 bp, Mus musculus
  misc_feature (277)..(277): n is a, c, g, or t
  misc_feature (289)..(289): n is a, c, g, or t
  misc_feature (303)..(303): n is a, c, g, or t
  misc_feature (313)..(313): n is a, c, g, or t
  misc_feature (317)..(317): n is a, c, g, or t
  misc_feature (321)..(321): n is a, c, g, or t
  misc_feature (432)..(432): n is a, c, g, or t
  misc_feature (476)..(476): n is a, c, g, or t
gacttaatatctgataccttagggttcctggggagctctcgggactttctgaagaaaggagccattatattggtagggtacttggggaaatcaggagaacatttactactcagagatgaaattgacatcatgattgaggttattgaacgattgacccgggtggaagatgctctgatcaaggagttggcagagaaaacccgcaaactttttaaagaaatagccaatcgaatgtcctcttcaaccatcaaacaaaccttccggaaatgggttaagatgntccgaaccaaanaactgaagctcatntatgatgtgnccantatnagaaccctcgaagggaacgaaatagaaatcattaaagatagtctgatagagtccaatttagagaagtctgaaaagccatacagagtcactaaggaaaattatttcaatgantccctatatacagtttgaacattttctttaaagagaatcacatntcccttgcctcttaataacctcagtctgt

SEQ ID NO: 7586 - DNA, 495 bp, Mus musculus
gggagaggccttacctatgcagcgactgtgggaaggccatgtcttctaaagcccagctgaatgagcaccgaaggatccacacgggggagaaaccctatgtgtgcagcgagtgtgggaaagctttcagttgccgatcttccttacaagcacatcgtagaactcacagtagggaaaagccgtttgtctgtcacacatgtgggaagggcttcctgcacaagtcacagttgtcatctcaccaacaaactcacactggtgagaacccttaggagcgctgtgcgtgttgtgtgcagttgtttgctcatacgtatcagctgaagggacatcatccgattgaagcagaagaaaatgaccttgactgagagagttctcaacagctgaaggctctcgtctttcattctgtgcagagaaacctgaggtgggttttgaatgcagaaagtcctccaaacacaagtcagatttcagtagacccagcagacctgacactatagatacttg

SEQ ID NO: 7587 - DNA, 507 bp, Mus musculus
  misc_feature (148)..(163): n is a, c, g, or t
  misc_feature (165)..(170): n is a, c, g, or t
  misc_feature (172)..(172): n is a, c, g, or t
  misc_feature (174)..(176): n is a, c, g, or t
  misc_feature (178)..(183): n is a, c, g, or t
  misc_feature (186)..(192): n is a, c, g, or t
  misc_feature (194)..(194): n is a, c, g, or t
  misc_feature (291)..(291): n is a, c, g, or t
  misc_feature (333)..(333): n is a, c, g, or t
  misc_feature (364)..(364): n is a, c, g, or t
  misc_feature (376)..(376): n is a, c, g, or t
  misc_feature (380)..(380): n is a, c, g, or t
  misc_feature (383)..(383): n is a, c, g, or t
  misc_feature (392)..(393): n is a, c, g, or t
  misc_feature (401)..(401): n is a, c, g, or t
  misc_feature (435)..(435): n is a, c, g, or t
  misc_feature (475)..(475): n is a, c, g, or t
tctcccggaggtagaaagcagttctcagtggtgaagtttctattaggtacaaacactagtggaagccactattgatctagacattgcctcagcctagcctggaagaaaaggcagcagggagtgcctgactggttctggctatcttttnnnnnnnnnnnnnnnngnnnnnnanannnannnnnnttnnnnnnntncagatcacagaaggacttggaaagatcaaaacctgttgtccagcatttgggaacacttgggactctggaaaggtggccactgaaaagcaccacaggntcttaatggctccccggaatcttcttagcactgagaagctcnagctatggacactcctttcagacaggcttgngactgtgatgtnatgnatnttctgcctnnagatcctnatctcagttttgagtgcagtgtatgcttttgcanatgactttagggcagatagggatgcaaggtggagtttttntcttttgaggattcaggctttacctctagata

SEQ ID NO: 7588 - DNA, 460 bp, Mus musculus
  misc_feature (143)..(143): n is a, c, g, or t
  misc_feature (364)..(364): n is a, c, g, or t
  misc_feature (370)..(370): n is a, c, g, or t
  misc_feature (417)..(417): n is a, c, g, or t
tccgtgccatgctcatggaagggctgaggccaatgtgtggaggaaaagagtgacaactgggcctggccgaagtccccacccagagtggggtcccagaagttcccagtgtctactctttcgccgaagtcaagtgtgtgttttgnggcttcacctccaaagatctgccacagtgaagactagtggcaaggatgagcccttctttcatcatggaaacaccaaggtatcagcccaagatcatgaggagacccttctactctgtggtgcatgatgctgctgagccatgatcttcagtagaatatgtgtattatgtgtattttggacttaagatattttcaatttatgatgagttcctcagaatgcaaanccgttntcatccaagaatcatctatatagaagaatgttagcagtaatagagtntaggtgttaagtacatatgcattttcactttcaacttttctag

SEQ ID NO: 7589 - DNA, 515 bp, Mus musculus
  misc_feature (126)..(126): n is a, c, g, or t
  misc_feature (322)..(322): n is a, c, g, or t
  misc_feature (344)..(344): n is a, c, g, or t
  misc_feature (363)..(363): n is a, c, g, or t
  misc_feature (390)..(390): n is a, c, g, or t
  misc_feature (429)..(429): n is a, c, g, or t
  misc_feature (441)..(441): n is a, c, g, or t
ctggacctgtatgactcgcaaagcagtgtcaatgatgtgatccgtgccatgaacgtcaaccccaagatctcattccctcctgaagttgacttctgcctcctcactgacttcatccaggagatttgntgcattgcttttgcaatgcagtccttagagccacccctcgatatcgcattcggggcagatggggaaatctttaacgattgcaagtaccgccgcagctatgactcggactttactgctcccttggtcttttatcacgtgtggcctgctctcatggagaatgactgtgtcattatgaagggagaagctgtcaccaaanagaggggctttttggagttccntgcgaccagtaatgcggtnccgtagcaggagcttaagccccatttntcctcgtaatcattttggaataagcacggtatctcgaantcgaagcccttntccaataagatgtacattcgcaaggtactgaatccaccagccacgttcctttgccaccgttggaacagccagct

SEQ ID NO: 7590 - DNA, 528 bp, Mus musculus
  misc_feature (358)..(360): n is a, c, g, or t
  misc_feature (363)..(363): n is a, c, g, or t
  misc_feature (414)..(415): n is a, c, g, or t
  misc_feature (433)..(433): n is a, c, g, or t
  misc_feature (438)..(438): n is a, c, g, or t
  misc_feature (447)..(447): n is a, c, g, or t
  misc_feature (455)..(455): n is a, c, g, or t
  misc_feature (467)..(467): n is a, c, g, or t
  misc_feature (469)..(469): n is a, c, g, or t
  misc_feature (472)..(472): n is a, c, g, or t
  misc_feature (476)..(476): n is a, c, g, or t
  misc_feature (481)..(481): n is a, c, g, or t
gaatgaacgcattgggaagacccagtgcaagagtagacatgaagcaatagctggtgaactctttgtaaaaataagaagacttcaaaaacgcatcaaaacagtattatcatctcaaagaaattgtttggaaccaaacacattacccagtaatacagtctgtaaggttacagattcagaggctatgaatttgaatgtgacccaaaagtcagttaaaagtcgaagtaaaagaatatcttctgtgaaccatacccctttaaactcttcagaaaaagcaggtagaaagactaatttgccatcaacttgtgttgagtttgcttctgaaagtaacactgatgacgttatgttgatttctgtgaannnttntaatttgacaacttcaattacatcagagcaaacagaaattagaaaaaatanntcaagaaatttgagcaantcacntaatagcangattaaanttgggcccgtananaanaaanttgantttgttattgacttgacaagagaaggcccgtccaactacagcatagg

SEQ ID NO: 7591 - DNA, 518 bp, Mus musculus
  misc_feature (34)..(34): n is a, c, g, or t
  misc_feature (306)..(306): n is a, c, g, or t
  misc_feature (309)..(309): n is a, c, g, or t
  misc_feature (324)..(324): n is a, c, g, or t
  misc_feature (329)..(329): n is a, c, g, or t
  misc_feature (373)..(373): n is a, c, g, or t
  misc_feature (410)..(410): n is a, c, g, or t
  misc_feature (438)..(438): n is a, c, g, or t
atcttcgacgattcttagtaaacaggttagaaangatataatgagataaacaattcacagcaaaaaattgaactaaaagttcaatgtatgaaccaattcctcttgctcaactcagaatcaaaagtgcttgtcaagtaccaaagcatccagaagagactgctggatacatttttgcaagactcctttccttcgtgcaacagagaatcagatttagaaagaattgtgtgtggataccaaagtactatgctcatgttatattcaatgataaaagaggattttaatgtactatgtgaaattttagctccntcntcactggtgcagttntttantgaaacttacctggatacggttacagaagaaatgacaaaaattnttgaatatttttgtgagctgcagttcaaagaaaatgntgttcctgtagttaaaacaagcaagagntgcaacaagcgcagaggagcagtgcatgctttgggttagtgacatttacatttctgtttgatttcacttcagcctttcac

SEQ ID NO: 7592 - DNA, 340 bp, Mus musculus
  misc_feature (147)..(147): n is a, c, g, or t
  misc_feature (162)..(162): n is a, c, g, or t
  misc_feature (165)..(165): n is a, c, g, or t
  misc_feature (168)..(168): n is a, c, g, or t
  misc_feature (176)..(176): n is a, c, g, or t
  misc_feature (257)..(257): n is a, c, g, or t
  misc_feature (272)..(272): n is a, c, g, or t
aggatgacttcaagcagtgggcagccgtgaacacaaagccgatcagacccactctgcacctgagcttgcctgctgaacctttggactgccagaccaccactaagacgtgctttgtggcgcatccacctatcattactgaaaactacnagcccccctgggttngcnttnggagaaanatccccgtagagggccagactacttattccatcaactttactcccaaggatttgggcaagtgcccagcatcatacatggancctccgggctatatnttcgaggaagtggattctatggggcacaagatctataggtcaatttcccagacaggttctaggcagaa

SEQ ID NO: 7593 - DNA, 456 bp, Mus musculus
  misc_feature (201)..(201): n is a, c, g, or t
ggagagtccaattcttcaaacttcaaatgacagtccgaagatccactagttaacttaatctggactatacgaggagttctaacaactgacaaaagacggcggcattcctccggaacttgtgaagctctagtttctgtctaggaaaatgactcatttccctttcctccagcaaaagtgacttatggctctccaattaacatntcagcacaaggtgcaagcccggcagcctccagactccctcagtccctacaagcacttatacatttcaaagcctgctcaccagtcccctggcccttcccacccgcccaccgattactcattcttcttgttcactcttctccgctcctgctgctgcttttctcaataagcttcccctattttctatcagtggccattttcccgtttcttgtagacagtcctggcaaagcccagtctgctacacatggtcaatctact

SEQ ID NO: 7594 - DNA, 411 bp, Mus musculus
acacgtttgataacctgcttcaccttcactccctctctctggagaacaacaggatcacatctctgagcgcgttacagaagaccttcactctgatcgagttgtacataagcaacaactacatagctgtgaaccaggagatctacaacttaaagggtttatgcaacttggtcattctagacatgtatggaaacattattatatggaaccaagaaaactaccggttctttgtaatatttcatcttccagaactgaaagccttggatggagtctcaattgagacatcagagacagagactgcaaaagatttgtttggtggacggcttacctctgacatgattgccgaacgacaaggacactcaaactttatccaaatgcaagagctaaactggacttcatcagccatcaggaccg

SEQ ID NO: 7595 - DNA, 327 bp, Mus musculus
  misc_feature (119)..(119): n is a, c, g, or t
  misc_feature (141)..(141): n is a, c, g, or t
  misc_feature (156)..(156): n is a, c, g, or t
  misc_feature (158)..(158): n is a, c, g, or t
  misc_feature (166)..(166): n is a, c, g, or t
  misc_feature (252)..(252): n is a, c, g, or t
  misc_feature (255)..(255): n is a, c, g, or t
  misc_feature (264)..(265): n is a, c, g, or t
  misc_feature (283)..(283): n is a, c, g, or t
  misc_feature (290)..(290): n is a, c, g, or t
  misc_feature (294)..(294): n is a, c, g, or t
aggtatcagtaagatgcatgtgcatgaactcaagcaacgtgaccgctggactttccatagcacattgttgcgtgccttgtaattcccccagagacgtcctcctcagagtgaagcttccncagtggcttctccagacccccngcgccaggagtggtntncccggtanttcacattctgactgaattttgctggcacagctctgtgtggactgttccaagagcatgactgcataggaatcattatgtggacagnccnttctatgtnnaacactgtgaatgagaangtgtttntctntccgatttgaaaatgcactgtattccctgtgat

SEQ ID NO: 7596 - DNA, 329 bp, Mus musculus
gagcgctgcaggcattgctacagatagaggaaggcctacagatactatccagggaggtgcctgagctgggaccattgtttcgggactcagctaaaccacgtggggctagaggagcccaagaaactaggggtagaagacaagcccatagagaagatactacacaacactccttggcctttcttcagctcttccattccttggccagagcctgttcccagtcttcccaaactgcactgcccacatccctctttactgaaggtcggtaccagcaagaactggaggaactgaaggccttgggttttgctaaccgtgatgcaaacctgcaggcc

SEQ ID NO: 7597 - DNA, 322 bp, Mus musculus
  misc_feature (30)..(30): n is a, c, g, or t
  misc_feature (39)..(39): n is a, c, g, or t
  misc_feature (44)..(44): n is a, c, g, or t
  misc_feature (72)..(72): n is a, c, g, or t
  misc_feature (78)..(78): n is a, c, g, or t
  misc_feature (98)..(98): n is a, c, g, or t
  misc_feature (100)..(100): n is a, c, g, or t
  misc_feature (136)..(136): n is a, c, g, or t
  misc_feature (162)..(162): n is a, c, g, or t
  misc_feature (214)..(214): n is a, c, g, or t
  misc_feature (225)..(225): n is a, c, g, or t
  misc_feature (267)..(267): n is a, c, g, or t
  misc_feature (270)..(270): n is a, c, g, or t
  misc_feature (276)..(276): n is a, c, g, or t
  misc_feature (288)..(288): n is a, c, g, or t
  misc_feature (297)..(297): n is a, c, g, or t
cgaagtattgtatacctcgattccatgggncagacaggnaagtntatctgtgagaccatcttccaatatttncaaaangagagcaagacacgcaggancnttgagctggaccctttggagtggaagcagtacagtntgacatcagaggagattcctctgcanctgaatgggagtgactgtggaatgtttacctgtaaatatgcagattacatcnctagggaccancctgtgaccttttctcagcaacacatgcccaccttcaggaanagnatggtntgggaaatcctncacagtcanttactgtaacaacatccacctggtt

SEQ ID NO: 7598 - DNA, 512 bp, Mus musculus
  misc_feature (401)..(404): n is a, c, g, or t
  misc_feature (411)..(411): n is a, c, g, or t
  misc_feature (420)..(420): n is a, c, g, or t
  misc_feature (433)..(433): n is a, c, g, or t
ctctgccttgggttcttgcaggaaaagcccagcgcctgcggccactgtaccaatacatcaactactgcaacccagagctgaatcaggaggaggacggggacagggagcccgaggtagagcctgaggccgagttagcactggttcccgaggagccgggcgtggaacagctgcagctgcagaccttgctgcccgtggcaggtgagctgggcttaggccttgctttaccctgccctaatccgttagtgccactgacccataatcttcctcctctggtagaggaggttggagaggagcctgggggtctgtctagtctgagggtgagtggcagcctcaaggctgaggtggataagacgacgcaagtggatatcgacaagatgttgagtgtctgtgctgcccctctnnnnccccctntatcccctnagtacaagtgacnatctagccactgagaatacccctggtctaggcctaaaccatggctctaagtccatcggcctaagccatcaggtggagga

SEQ ID NO: 7599 - DNA, 521 bp, Mus musculus
gtgaatctgaatgaggcaactgccagagggtacacgctcttacactgcgctgcagcctggggccgtctggaaactttgaaggccctggtggaactggatgttgacatagaggctttgaacttccggggagagaaagctcgggatgttgctgctcgttattctcaggttgaatgtgttaattttctggactgggcagatgcaaggctgattctgaaaaaaattattacaaagtcctccctcatcattactgacccagaaaagggaccggggaaactcttcaaggaagacaagagcaccatcctcaatgcgtgccgtctgaaaaacgagtggttggaaagccatccagaggcttccattagtgagatttttgagcagaaacaacaattggaagatatcgtctcccccatcctagcaaaaatgtctacaccacgtcattttgctgcctcataaagagaccttacacttatcaacaggccaagtgaagagtgccaaatcgataacctaagccgtggtcaccagag

SEQ ID NO: 7600 - DNA, 400 bp, Mus musculus
  misc_feature (221)..(221): n is a, c, g, or t
  misc_feature (224)..(224): n is a, c, g, or t
  misc_feature (228)..(228): n is a, c, g, or t
  misc_feature (291)..(291): n is a, c, g, or t
  misc_feature (330)..(330): n is a, c, g, or t
atctaggttattacatggtcaatcacacagcagagctatgaccatgaaataagtgattcacttaaatcagcagtctgaagaacttcagctaactaattacattaccatacaatctgctacatagggatttgtcattattgtcaccagaaaaattcatttggttgctttttcattgattttaacatgatttaggatgttttcaatctagggcttcaatattnttntggnacatataagtaagaaaggactataaataatttgctgtgtcctgtgagacacatgtttatttgnaaaagtaatatttatagatatatgtgtagattcattttntcttgtttctttcttcctaactgtacattattatttttataaattttccgtgttccttgtattttctgta

SEQ ID NO: 7601 - DNA, 264 bp, Mus musculus
gctgctgggaaagcaggaagcttctgagagtaaatttttcttgtcctgataggtcatccaggaaaattacaaaatcattctacaaaattgtaaagagtttgagccaaagtcggtaacaggttttctgcttagtcttgggtgtccttattcttcaaaaccatactccaaaaaaggagacctactaaaatttctcttgtaaagattgttaccagaagtaacttattttctactgtgttgccaagggcactcattggctgtaagtct

SEQ ID NO: 7602 - DNA, 408 bp, Mus musculus
gtagggtcagcgagtcatgtgccccccctgggacttcagccaggcccagctcctggacagtatcctagggctgggggcactaggagtgacaattcgaaccatcttctcaacggctggcctagccctgctgctcctgttgctgaccagcttccttgtttttgacctgctctatgggcccacaggtgccaacctgccacgacacagacttctcccaatgggtcagagccagggggctggtgaaggcccaggacagcaagcagctcccctctctccaacaaagatggcctcgggactgctcagcctgcaggatgcgctgctcctgctgttcctgggcctgcgcctgttcttgggaggctctggtatacccttagccatgctgggcctagctttctgtatccatccttgggc

SEQ ID NO: 7603 - DNA, 428 bp, Mus musculus
  misc_feature (215)..(215): n is a, c, g, or t
  misc_feature (232)..(233): n is a, c, g, or t
  misc_feature (355)..(355): n is a, c, g, or t
  misc_feature (358)..(358): n is a, c, g, or t
  misc_feature (363)..(363): n is a, c, g, or t
tgcttccctggtatttctggctttctctgttcctgcgtggtgttcttttcttcaggattgaaatggcagtctgggaactaaccctaagctttctgacctaggatagaataggaaaaggcaatgtgggacaatctaatccactcacctaaggtccagcatctacctgaggatcagggatgcttgctgggctgaggaactattgggatgggatgggnagtcagaacctggggtnnagacacctgtctgcagacagccttgcctagcccactgaggtaggacccagggaatcagctcaccagacactggccctactcccctggagccttgacctgaagagtcaactgggtttggtaanttntgttntgagaacccacgcccaaagccttcccaccctagcccctgcccaatgatggttccctcagcactgt

SEQ ID NO: 7604 - DNA, 312 bp, Mus musculus
gcagtaacagcttccacaactggtattccttcaacgacacctctgtgaggaccccaggcccaattgtcatctaccagacactggtgtacccaagagctgccaaggtttactggacgtgcccaacagaagacgtggactcctttgagatggaattctatgagctcgttaccacccctcctaataatgtgcgcacagagctctgtggacaaattcgcgacatcctgcagcagaacctggagctacacaacctgacccccaacactgagtatttgttcaagattagagccatcaatgataatggtcccgggcagt

SEQ ID NO: 7605 - DNA, 440 bp, Mus musculus
  misc_feature (361)..(361): n is a, c, g, or t
  misc_feature (372)..(372): n is a, c, g, or t
  misc_feature (374)..(374): n is a, c, g, or t
  misc_feature (378)..(378): n is a, c, g, or t
  misc_feature (390)..(390): n is a, c, g, or t
  misc_feature (409)..(409): n is a, c, g, or t
  misc_feature (414)..(414): n is a, c, g, or t
atctggcagccaacacgaagggaatgtgcttcattcgtaccactcggccaaaaacagcagttatttatacagctgaagaaaactttgtgattggacaggccaaggtgatccgccagagtgcagtcgacaaggtgacagttattggagcaggggttactctgcatgaagccttagtagctgctgaggagctttctcaacaagggatttttattcgtgtcattgacctgttcactatcaaacctctggatgctgtcaccattatccaaagtgccaaagccacaggtggccagatcatcactgtggaagatcactaccgagaaggtggcattggtgaagctgtgtgtgcagccatctctagagngcctgacatantngttngtcaacttgcantaacagaagtacctcgaancgggnaacctagcgagctactggatatgttt

SEQ ID NO: 7606 - DNA, 445 bp, Mus musculus
gagatcgcaccaacctgacctagaaccctaagactatggaggcctgagatcatcggcctgaggaaaatccctgtgtccgaaggagatgctctatgccaacattaagactgctgggggaaaggagagaggactgactatcttccatgggaaacctagaagaacccagactcttccagaaggagtgggatggaatcaccacactgcgctcctgggagctgggacccttgtaggagtctctggagaggccatgagaaatcaggattcctccaggctccatgctttccagaggcaccatctaaatgttatcccgaatgtcctcggtccccacctcccaactgtagcagctgaaggtccgtggtttcctgtaattggtctccactgctcaggccatttgaaggaggcacctcagggctcagatgtggagggaactaccttcaaaatacag

SEQ ID NO: 7607 - DNA, 283 bp, Mus musculus
aacttggacccagaattgttcatatctaatgatatgtagtgacaaaagtggagcagagactgaagaaaatgccatccactgccttgatcaatccatcctatgggcagaaaaacaaaacaaaacaaaacaaaacaaaacaaaacaaaacaaaaccttgacactattactgaagccatgttgtgctcagaaagagcctgacatgactgtcctctgacagactctatcaggagcttattgacactgttgcagatatgtagagtcaaccattgagctgaagtccagg

SEQ ID NO: 7608 - DNA, 332 bp, Mus musculus
tgttggcccatcatttcactggtattagcactgacatctttagaattccaccacagactgaagagtacagagagatccagccgcctggactgaaaaactacgagattcttggcctttctattagaagacagccattcggactcgctaacccacaacctgtcttccaactcttggaaagagaattccactcctcaacaaagcggtctgtcaatgcctctcgaagctcactcagctttatctttacatgaaaccacccttttgaggttgagtgttggaattaagtgtgcaccagctgttacaaagatgttggactgctccatcaggtggcaaac

SEQ ID NO: 7609 - DNA, 310 bp, Mus musculus
gaagtgcagaagaaacgcccttcttcccacgtgatcataatttactaacagaagaaaatatcaaggaaagacacagcatggagggagcctggcaaagagtaattccatctcattctggagaacattttcccattatgccaagatttgacaattcttcaattcaaggaaactttggaattcctgaggataattctgcacgtcccagaggcaatatgagaattcagagcaatgtcaatactatccccatggttaatgttggaattcccatagataatcctcaagttcttaaaggcaatactggagttcccag

SEQ ID NO: 7610 - DNA, 344 bp, Mus musculus
aatcgtcgttgcttctcacaacatccccacgaggctgttcatgcagtggcatatctctgcaatcaaagtccccgttttgtacctagatgacgaatcacagtctccgtctatagaggaagtcaccacagaattcctcaccatgactcacaaactggcactccaactttacaagacagtgaaattgggcgcgaaaggtccaggtgacaacttacaccaacttgcccctgaactcattcttccagaacaaattatcaagtatttatgcaaagctgaagaattcatggacccagcgtctttcttgagcatgtataacagacccatacacgttaccctggattccgata

SEQ ID NO: 7611 - DNA, 514 bp, Mus musculus
  misc_feature (350)..(350): n is a, c, g, or t
  misc_feature (355)..(355): n is a, c, g, or t
  misc_feature (364)..(364): n is a, c, g, or t
  misc_feature (385)..(385): n is a, c, g, or t
  misc_feature (394)..(394): n is a, c, g, or t
  misc_feature (396)..(396): n is a, c, g, or t
  misc_feature (434)..(434): n is a, c, g, or t
  misc_feature (449)..(449): n is a, c, g, or t
gtaatccagatatttccggcaggctttcagaatctgaggctgacagagttctactgtgagggaaacccgctcttcctgaagaggccattttttgctgtacaacctaaagacctctggactctacgggaaatagcagcaagatttgtcctctctctgttagaagaaaacgaccctttgattatgaatgtcatagagagttacccagaggtcaaggacaaactctccaaagcaaaaaagtgttcaatatgcaggaaaccttttttaactgagtggctggagtgcgtttactttgtggctccatcgaagaactggaagataagcagaaacctaaagctgattcctgtccaganatcantctgttccnatcaatgctttgaccagcgtnatcctgatntntttggaattgctcaagagtagagcaggaagaagagctntcctgttggtccatntctgaaggagaagacattcagaaaatcttgtgatgtctgtaggtgctcgctggacattcagggaa

SEQ ID NO: 7612 - DNA, 362 bp, Mus musculus
  misc_feature (224)..(224): n is a, c, g, or t
  misc_feature (301)..(301): n is a, c, g, or t
  misc_feature (304)..(304): n is a, c, g, or t
  misc_feature (315)..(315): n is a, c, g, or t
  misc_feature (318)..(318): n is a, c, g, or t
  misc_feature (322)..(322): n is a, c, g, or t
  misc_feature (324)..(324): n is a, c, g, or t
tctggcttctcgttgcaacaggaggacctggacttggtggagaacatcaaacatcattactgctatttggccccagatttccaaaaggaacaggcccgcccagatgaggagtgcaagcaatccctgaagcttcctgatggacggactgtcactctgggaaaggagttattccagtgcccagagctcctattccatcccccggagattccaggattgtcgcccancggcctcccagccatggctgaacagagcctcctcaaggtgcctcaggagctacggcctcatgtggcccggaatgtgntantatgcggaggntcntcantnttcaccggcctggagggtcgcttcagggcagagctact

SEQ ID NO: 7613 - DNA, 555 bp, Mus musculus
  misc_feature (308)..(308): n is a, c, g, or t
  misc_feature (318)..(318): n is a, c, g, or t
  misc_feature (330)..(330): n is a, c, g, or t
  misc_feature (332)..(332): n is a, c, g, or t
  misc_feature (363)..(363): n is a, c, g, or t
  misc_feature (367)..(367): n is a, c, g, or t
  misc_feature (390)..(390): n is a, c, g, or t
  misc_feature (392)..(392): n is a, c, g, or t
  misc_feature (395)..(395): n is a, c, g, or t
  misc_feature (405)..(405): n is a, c, g, or t
  misc_feature (448)..(450): n is a, c, g, or t
  misc_feature (455)..(455): n is a, c, g, or t
  misc_feature (458)..(458): n is a, c, g, or t
  misc_feature (469)..(469): n is a, c, g, or t
  misc_feature (478)..(478): n is a, c, g, or t
  misc_feature (487)..(487): n is a, c, g, or t
gagccaaagaggaacttgccagaactagaatcgggcttcaggacaaaaggcctgcaccacaacaaaccacttccttcagctgggaatcatattcaaacagttccacagcctcccaaaacagtgccaccagcttgagactaagttcccaaactaatgagccatcctttgaatcatactcaaagcatgacatgtgtgaaccagtctttacacattcatatactggatgcagacacatctaatatatacatacaggtgaggtggttctatacaattttattggactagaaaatctgcagcctagtgactgnttgaagaacnatacactacttntntgtggtaatgctatgatcaaaaatcaaagtnctgntggggactgaagagatgggggtnanatnccaagacccntcaagttataattttcctgatttcaaaatggagtgaacagacnnntcaantcntgctcactccngcagctcantcctgcctnccttgtgttcagaacacttaaactaatcacactgaggcaaagccatgccacccaaagcctaatttata

SEQ ID NO: 7614 - DNA, 453 bp, Mus musculus
  misc_feature (327)..(327): n is a, c, g, or t
  misc_feature (344)..(344): n is a, c, g, or t
  misc_feature (350)..(350): n is a, c, g, or t
  misc_feature (365)..(365): n is a, c, g, or t
  misc_feature (385)..(385): n is a, c, g, or t
  misc_feature (387)..(387): n is a, c, g, or t
  misc_feature (389)..(389): n is a, c, g, or t
ggcctatagtgtccatgagatgaatcttcaacaaatacagactcaaccatatgccaatggagaacaaatggcattttccccctggaagcttcaccctttcttaaagaacacaataatgaaaagtcatgtgagagaacacacagtaatgcatggggaagaaacttagatgcacagtatgacattcttaatttttggaactttccaagtggtcttggattaaaggtgaaagtaggaacctattctctaagtgcgcagaatggtctacagttctctatatgtgaacagatgatacagtggcctacagggtttacaaagattcctcagtcngtgtgcagtgagagctntaggcntggattcaggaaagntgcccaggaaggcaaggctntntnctgctttgactgtactccctgtgcagacaatgagatttccaatgagacagattccttaccacct

SEQ ID NO: 7615 - DNA, 566 bp, Mus musculus
  misc_feature (304)..(304): n is a, c, g, or t
  misc_feature (309)..(309): n is a, c, g, or t
  misc_feature (329)..(329): n is a, c, g, or t
  misc_feature (332)..(333): n is a, c, g, or t
  misc_feature (380)..(380): n is a, c, g, or t
  misc_feature (393)..(393): n is a, c, g, or t
  misc_feature (417)..(418): n is a, c, g, or t
  misc_feature (425)..(425): n is a, c, g, or t
  misc_feature (428)..(429): n is a, c, g, or t
  misc_feature (444)..(445): n is a, c, g, or t
  misc_feature (447)..(447): n is a, c, g, or t
  misc_feature (451)..(451): n is a, c, g, or t
  misc_feature (470)..(470): n is a, c, g, or t
  misc_feature (502)..(502): n is a, c, g, or t
  misc_feature (505)..(505): n is a, c, g, or t
  misc_feature (507)..(507): n is a, c, g, or t
  misc_feature (530)..(530): n is a, c, g, or t
  misc_feature (541)..(541): n is a, c, g, or t
agcccatggaggaaggcccagcaatgacagagccctatgagaaaagagtgccaggaatcccctgtgaagattcaaatcttccatcaaccgtctctctcccaaaggcatctgatccacaggaagccaggtctcccagaggattgcatcctggctccacggagcttttgaaatgcaagtgtcctgcatggcagcagtgccaggcgacagcctgtggaagttgtggatgcacctcaccctgacaccagtgaatgccagatatggggaaagtttggactgaatagtagttgctgcaccccccgacgcngccantgtagatattcataagcttngtnnccatcctgttagcttttacatcattccatacatcaatttcctttatntctgcttctagtnatctgcccaattagctcctagctnnttgagcnttnnataatgaacattatnnancaantcagacagagactgccagntgcgtttccccctttccagaggagaggacagnatntntcttatccacatacctttgtatntagtgagactntcacctacgatggaggaccttgctt

SEQ ID NO: 7616 - DNA, 505 bp, Mus musculus
  misc_feature (391)..(391): n is a, c, g, or t
  misc_feature (397)..(397): n is a, c, g, or t
  misc_feature (449)..(449): n is a, c, g, or t
atatcccttgggatcatatccgtctgcagagaacttcaaagggaaagccggttcttgcgaaagactcgttgaatccatatcccaatttcaactttaacatctctcaccaaggggactatgcagttcttgctgcagaacctgaggcactgaaagaaagcttcataaaagccattggagttggattgggatttgaaatgcagcggcttgaatttgatgtatctccattaaacatggacattggtcaggtttataaggaaacctgtttgattttggatggggaagaagaaaaagaatgggcctttgaggaaagcaaaatagatgaacaccattttgttgcagtggctgttaggaagcctgatggatctagacatcaaaatgtttcatatcaagntgattntaagctatcccagaggaagtttaccattcttaattttaatgatttggtagcntctgctattcctatgacacctgaggatccttcattttgggactgtttttgcttcac

SEQ ID NO: 7617 - DNA, 283 bp, Mus musculus
atatacttcccatgtgaccctgaaatttcacttgtgttttctctactctgaataaatgaaaacatcttcacagaggaaaatgctaatggacaatgtcacagacagttactcagagcttgaaaggagccaagtggtcttcagtgggtaaatgtgcatattgtgtcatgagcaaaatgggctggtatagcatcgagactgttggggtactcatgttcaactgtgttgataaatttcaaatgaattaggctagaagctgaacctgcctaaaaggttacacgttatg

SEQ ID NO: 7618 - DNA, 548 bp, Mus musculus
  misc_feature (84)..(85): n is a, c, g, or t
  misc_feature (107)..(107): n is a, c, g, or t
  misc_feature (134)..(134): n is a, c, g, or t
  misc_feature (143)..(143): n is a, c, g, or t
  misc_feature (181)..(181): n is a, c, g, or t
  misc_feature (214)..(214): n is a, c, g, or t
  misc_feature (338)..(338): n is a, c, g, or t
  misc_feature (355)..(355): n is a, c, g, or t
  misc_feature (357)..(357): n is a, c, g, or t
  misc_feature (360)..(360): n is a, c, g, or t
  misc_feature (362)..(362): n is a, c, g, or t
  misc_feature (364)..(365): n is a, c, g, or t
  misc_feature (373)..(373): n is a, c, g, or t
  misc_feature (379)..(379): n is a, c, g, or t
  misc_feature (384)..(384): n is a, c, g, or t
  misc_feature (390)..(390): n is a, c, g, or t
  misc_feature (400)..(400): n is a, c, g, or t
  misc_feature (405)..(405): n is a, c, g, or t
  misc_feature (417)..(417): n is a, c, g, or t
  misc_feature (420)..(420): n is a, c, g, or t
  misc_feature (422)..(422): n is a, c, g, or t
  misc_feature (432)..(432): n is a, c, g, or t
  misc_feature (455)..(455): n is a, c, g, or t
  misc_feature (485)..(485): n is a, c, g, or t
  misc_feature (503)..(503): n is a, c, g, or t
  misc_feature (520)..(520): n is a, c, g, or t
tgaatgtagccattaacacaggccctccccctgctgtcaccaagaccgagccggaagatcagaattcagattctttgtgggagnnggatctctctgaaggcaggaanttcgttgtacaagacagcagccccagnaggtgaagncctctgatctcttgcaacatgttttggggattccaaancagccccagtcttcaaaaatgtcacagcctcgnactgactccccattcccacttcccatctttcaggaggtgccctttgccctgtccctctgccacctgcctcccatgttgaaccactctgtctcctaccctttggccaaccgccctgaaaggaatnttcctttctgttccctncnaanantnncccacggnacaaantgctntaatgncaagcctttngcttnagagctgtagtntcntnttagtgaggntgggagctgcaagtaccaaaggntccctttggtagaaaacagagataaccacnaaggagttggtactgacnaaggagaccacagccancctggtgagaggtttaaagccacagatt

SEQ ID NO: 7619 - DNA, 269 bp, Mus musculus
tggaggctgcctggtcgcctagcaacggctcagctaggaaacatggagcctgtggctgaccgggagcttcaggccaagctgtatttagaaagacatcggatcatggaattgctgaatcaacttactagcttcctcctctttgcccgaccaaaaaaaccaagagagtatttaatctctcttttggaacgtctgagagttgccaaggcaacacacgtggcatttccctactttatggacaactctaacactgtgtccatgtttgagatgat

SEQ ID NO: 7620 - DNA, 393 bp, Mus musculus
  misc_feature (226)..(226): n is a, c, g, or t
  misc_feature (234)..(235): n is a, c, g, or t
  misc_feature (238)..(238): n is a, c, g, or t
  misc_feature (265)..(265): n is a, c, g, or t
  misc_feature (286)..(286): n is a, c, g, or t
  misc_feature (297)..(298): n is a, c, g, or t
  misc_feature (300)..(304): n is a, c, g, or t
  misc_feature (307)..(308): n is a, c, g, or t
  misc_feature (310)..(310): n is a, c, g, or t
  misc_feature (324)..(324): n is a, c, g, or t
  misc_feature (333)..(333): n is a, c, g, or t
  misc_feature (351)..(351): n is a, c, g, or t
  misc_feature (367)..(367): n is a, c, g, or t
gctgaatcaaaaagtgccaccacccaagctgtgaagaagaatgagaaattcaaatataaagtcaaggaaactaagaaaccagtgtttatgaacatattcaatcaagccactgtgaaaaagccactccccccaagagctcagactcccttggttaaggtgaagaaagaaagaaaaccacaaagattatgcctttaccatcgcgtaaatgagaagcctaaccaggatntacagtannatnttgacaagagcgaggacagcagtaccngcagcaccacaagctatgagntggacagccanngnnnnnggnngnaggacagagacctnagaaacacntatcagcatccagaggtntccaccctgaccagtntgcaactgtgaagacagcaactttgc

SEQ ID NO: 7621 - DNA, 560 bp, Mus musculus
  misc_feature (208)..(208): n is a, c, g, or t
  misc_feature (461)..(461): n is a, c, g, or t
ttggtcacaattttctttgctgtctagcatgatctgcatggcctgtaatctttgaaccactttcgtacctcatgtttttatccagcactcttattgtactgtgtactagtctgtgaacaatgtcaaataaaaaagaacgaacaggtcgtatggtggagctgagctagtgtacaatgcaccagttgtacagaaacaaaaatgaagtganccatcttttgttcatttaaaatggtgttttgaatttcatatgcagaaaacgttttgttacattgcagattttaatgtatttaataaatgcaacatgcagattaagtgcagtgtatactgagtatttaaattaaaatgtacatttcataaatacagtttcaagagaaagcatcattttgtgtatactaacacattaagtgtatgtcagaaattgatgtaaaatatatattttaacacattttctgaaattaaantacagttttgttcaaatatttggctctatatgtgttcagaatttgactagatttgtattttcacagttcaaaatattccttaagtgaacacccatgatg

SEQ ID NO: 7622 - DNA, 502 bp, Mus musculus
  misc_feature (70)..(70): n is a, c, g, or t
  misc_feature (364)..(364): n is a, c, g, or t
  misc_feature (386)..(386): n is a, c, g, or t
  misc_feature (460)..(460): n is a, c, g, or t
  misc_feature (462)..(462): n is a, c, g, or t
  misc_feature (473)..(473): n is a, c, g, or t
  misc_feature (475)..(475): n is a, c, g, or t
  misc_feature (477)..(477): n is a, c, g, or t
cccacaacttggacgtcctgagtaagaaaagcaggaatattttctggcagccggaagaaaaggtgctgangggtggaaaaagacgattgtatggcttgtgcagatggactgaaaggagtagacgggaaaggtgaaaagagacactttgagctggccagtcacgtgaaggtcaccaacgtactgcctttcccacccactgcggcccagacccacctgctgtcagccgagtcccaaaggtgctgcctgcactggtccctcctgccccagaaaagcactgtgttcccacctaaccccagcgacatccactaccttgccaccctgcaggttttggggcaacagggaaagcaaagctgcagaactaggntcaaaaccaaggacacaaaacntcccaggaccactgccaagcatattatcacagaggccaagcagcaaaacaggccccacgtgctagaaagcaaantnttccctaaacntntnttgccatccctcacagtgagcagag

SEQ ID NO: 7623 - DNA, 494 bp, Mus musculus
  misc_feature (317)..(318): n is a, c, g, or t
  misc_feature (322)..(322): n is a, c, g, or t
  misc_feature (326)..(326): n is a, c, g, or t
  misc_feature (334)..(341): n is a, c, g, or t
  misc_feature (343)..(343): n is a, c, g, or t
  misc_feature (345)..(362): n is a, c, g, or t
  misc_feature (364)..(365): n is a, c, g, or t
  misc_feature (368)..(370): n is a, c, g, or t
  misc_feature (372)..(372): n is a, c, g, or t
  misc_feature (374)..(378): n is a, c, g, or t
  misc_feature (389)..(389): n is a, c, g, or t
  misc_feature (391)..(391): n is a, c, g, or t
  misc_feature (393)..(393): n is a, c, g, or t
  misc_feature (414)..(414): n is a, c, g, or t
  misc_feature (425)..(425): n is a, c, g, or t
ttatgtgctcttccaggttgtaagtttaaagatgttagaagaaatattcagaaagatacagaagaactaaagagctacgggatccaagacgtgtttgttttctgcaccagaggggagctgtcaaaatatagagtcccaaaccttctggacctctaccaacaatatggaattgtcacccatcatcatccgatcccagatggagggactcccgacattggcagctgctgggaaatcatggaggagctggccacctgcctcaaaaacaaccggaaaaccctgatacattgttacggaggacttggaagatcctgtcttgnngctncttntctcctcnnnnnnnngncnnnnnnnnnnnnnnnnnngnnagnnntngnnnnnaggaaggaagnantnatgaacttcctgcttccacanttcaagggtantactggccacaagcagagctgcgagtgtttagagtagagacatttctcctttcctcctgtggcattgct

SEQ ID NO: 7624 - DNA, 490 bp, Mus musculus
acctctgagagctttgtcctttaaacttctaatcagttccagggagtaaaactggcctcccagatgtgtggaactacccctggatctatagctctttgtcaccgtcttctttctaccttctgagagaccccgaaacccttgccatggaaaagtaccacgttttggagatgattggagaaggctcttttgggagagtgtataagggccgaaaaaaatacagtgctcaggtggtggccttgaagttcatccccaaactggggcgctcagagaaagagctgaggaatctgcaacgagagattgaaatcatgcggggtctgtggcatcccaacattgtgcatatgctcgacagctttgagactgacaaagaggtggtggtggtgacagactacgctgaaggagaactctttcagattctggaagatgatggaaaacttcctgaagaccaggttcaggccatcgctgcccagttggtgtcagctctgtactacct

SEQ ID NO: 7625 - DNA, 465 bp, Mus musculus
  misc_feature (44)..(44): n is a, c, g, or t
  misc_feature (72)..(72): n is a, c, g, or t
  misc_feature (78)..(78): n is a, c, g, or t
  misc_feature (86)..(86): n is a, c, g, or t
  misc_feature (126)..(126): n is a, c, g, or t
  misc_feature (133)..(133): n is a, c, g, or t
  misc_feature (180)..(180): n is a, c, g, or t
atttgctaccaaccaagataccaagaagctggcttacaacattntcttttaatatctgatgatcttaaaatntcgttntctgaaantcatctttaaaaagaatgagaagaaatgttgctgaagctntacaccntctacaggatgatgataacttacagaataaaaactctaacatttacngagagtgcttacaactcatggggtactgtggtggttcgaatgagcatggccctctaggctcacatatttgaatgcttggtccctagttagtggaactgtttgagaaggattagagggtgtgtctttgttggagaaggtatttcagtagagttggaattagagacttcaaaagcccaagcaaggcccagtctctctctccctctccctctccctccctctctctctctctctctctctctctctctttctctctctctctctccctgcctattgcctgcagatcaa

SEQ ID NO: 7626 - DNA, 521 bp, Mus musculus
ggaacgcctggctattacgaaagaagaattatacagaatgttggcccatgaggatttaaggaaagctgcagtccttatctttgcaaataaacaggatatgaaagggtgcatgacagcagctgaaatctccaaatacctcaccctaagttcaatcaaggaccacccgtggcacatccagtcgtgctgtgcgctcacaggagaagggttgtgccaaggtctagagtggatgacctccaggattggtgtgagataatttttttgcttgaaaaagacttctctatttattcggtgatatgaacatttttcctaatacctttggctgctgaggcagcagcatgtttaatttatgacaacacaaacctccaagtgacgcttgaatcaagtgccactgtactggaacataaagatgttttcttaccttcgtttcccatgtactaatctcggtcggacgagcataacgtgtcactatgttgtagaagccggactcttctgactgtattctaactcttcagtgactgcct

SEQ ID NO: 7627 - DNA, 445 bp, Mus musculus
  misc_feature (227)..(228): n is a, c, g, or t
  misc_feature (237)..(237): n is a, c, g, or t
  misc_feature (241)..(241): n is a, c, g, or t
  misc_feature (246)..(247): n is a, c, g, or t
  misc_feature (249)..(249): n is a, c, g, or t
  misc_feature (294)..(294): n is a, c, g, or t
gctctgccagtgacagtcctggaagccaaaagactcaggcctcagaagatacagccggatcacaaactcgtagaaagaagcacataaaaccctgggccgagaagcagaatgccctagatctaggggaccctcttgggacacagctgctccctgggttggggcagctataggcaactcaggtaaaagacctgagaagcagattgggtggcagactttctaccacgcannccctggcgntctntccanntntcctgtttctaacagcctggacctcaggggctgggaccctcagtntagaccccacgcagccagctcaagcatagttaaacctttgttgtggtgttgacaactgcatccggggcctctcccgatcccatatttaaacacatttatagtttcctatagaaaatttcaccaggttcctggattcctggcatttcatgta

SEQ ID NO: 7628 - DNA, 517 bp, Mus musculus
  misc_feature (131)..(132): n is a, c, g, or t
  misc_feature (158)..(158): n is a, c, g, or t
  misc_feature (161)..(161): n is a, c, g, or t
  misc_feature (172)..(172): n is a, c, g, or t
  misc_feature (176)..(176): n is a, c, g, or t
  misc_feature (183)..(183): n is a, c, g, or t
  misc_feature (187)..(187): n is a, c, g, or t
  misc_feature (189)..(189): n is a, c, g, or t
  misc_feature (192)..(192): n is a, c, g, or t
  misc_feature (204)..(205): n is a, c, g, or t
  misc_feature (214)..(214): n is a, c, g, or t
  misc_feature (236)..(236): n is a, c, g, or t
  misc_feature (249)..(249): n is a, c, g, or t
  misc_feature (253)..(253): n is a, c, g, or t
  misc_feature (272)..(272): n is a, c, g, or t
  misc_feature (275)..(275): n is a, c, g, or t
  misc_feature (294)..(294): n is a, c, g, or t
  misc_feature (296)..(296): n is a, c, g, or t
  misc_feature (309)..(309): n is a, c, g, or t
  misc_feature (311)..(311): n is a, c, g, or t
  misc_feature (314)..(314): n is a, c, g, or t
  misc_feature (323)..(323): n is a, c, g, or t
  misc_feature (365)..(365): n is a, c, g, or t
  misc_feature (398)..(398): n is a, c, g, or t
  misc_feature (403)..(403): n is a, c, g, or t
  misc_feature (467)..(467): n is a, c, g, or t
  misc_feature (473)..(473): n is a, c, g, or t
gacagttgtactacacattgtttgttttcttgggcaattgatcctctggttgccccgccccttgcctcggcttattggcagagactgaagagtgacgtccgctttggtgcctggttatctccggctttggnngttttcccgctcttgattggtaattngangtgctcggttnttcntgatagnttantnttntttctttacganncaaaaaccntatttcaaaacctgaagattcngcggtttcccagntctngctaggggaaccgtgtaanttntacggcccacagccaatcntntttttcttggcgntntantcggttttntcctaacatatgcgggtgcggtagcctagctttagccatctntctgagaacaattaaagcgcttggaagattgcnaaaangcagcgttttaaaaacaatcgtttttgctgggtagtaaagcgtgttttacagtaatggcgaggntcaccnaggggtttaaggtatttatcttgctcatgacgttgattcgttat

SEQ ID NO: 7629 - DNA, 545 bp, Mus musculus
  misc_feature (421)..(421): n is a, c, g, or t
  misc_feature (441)..(441): n is a, c, g, or t
  misc_feature (500)..(500): n is a, c, g, or t
tggcttctgggcatctaccttaaacccacattggtgtcaggaacaggacagacagtttagccaggagcaagagcttggaccaaccactgagagcacccgtatggatgtggtaacatcacttggtcttcctggcagaatcttttagtcacatcacctcagccctaccagcttcaggcttcctgagaatttccacctacatacccctggacttgtctggatttgtcccggatcctctctttctacttccaggaggaacacacactctggaatgggtctcactgccaggacgatagctagggatctcacctcactcacctctcagaaatgggaaagaggccaatcatgatagtgtgtgtgtgtgtgtgtgtgtgtgtgtgtgtgtgtggacccaaggctttgtgcataagcatacactccaccntacacactcttatttttttnttaagaatctccaggtctgttacaaaaaaaatcaaagtcctgtttcagcctcctacatnttggctgattcactacttttgaaccttggtgttaagtgagcccca

SEQ ID NO: 7630 - DNA, 549 bp, Mus musculus
  misc_feature (84)..(84): n is a, c, g, or t
  misc_feature (157)..(158): n is a, c, g, or t
  misc_feature (167)..(167): n is a, c, g, or t
  misc_feature (174)..(174): n is a, c, g, or t
  misc_feature (177)..(177): n is a, c, g, or t
  misc_feature (179)..(179): n is a, c, g, or t
  misc_feature (188)..(188): n is a, c, g, or t
  misc_feature (191)..(191): n is a, c, g, or t
  misc_feature (218)..(218): n is a, c, g, or t
  misc_feature (224)..(224): n is a, c, g, or t
  misc_feature (238)..(238): n is a, c, g, or t
  misc_feature (241)..(241): n is a, c, g, or t
  misc_feature (247)..(247): n is a, c, g, or t
  misc_feature (260)..(260): n is a, c, g, or t
  misc_feature (263)..(263): n is a, c, g, or t
  misc_feature (273)..(273): n is a, c, g, or t
  misc_feature (316)..(316): n is a, c, g, or t
  misc_feature (405)..(405): n is a, c, g, or t
  misc_feature (407)..(407): n is a, c, g, or t
tttgccgtggtgatgctctgcagcacaaatgtgcgtcatctactcagacaaaacaacaacggagctgctgtatcagacacacanctcagggggcagatggtcaaggtgcgcaaacataaaggccgtctgtggctcccacgtctccctggcctggctnngcccttttnattctcnagnancattacaangtngagtgagcaccatgatatggcctaaantcattnatgggtgtccagancanagcacngcacacacaaacntgnacacgccagntccctgaaggaaaccaacatggcagaatacaaagtaatatacntcaaattttcttgtgcaacaaaacagcaaaggaaagccaggtgttggaggaaccccgaggaaattgggctccctgtgccggactgtagntntaccatgctgtcagatggaaagcaatgaaatgcatccctatgaccacctgtcctgagttggtgctcacacttgtttaattccaactgcacattttaaagtaattgtaagatgatgccctgccttttaccgtgagcttgaaga

SEQ ID NO: 7631 - DNA, 490 bp, Mus musculus
gaagacaccaagtatctaccagctccgtttacaactctaacagaaattatacctgatagtcaacatccaaattttgccaaacattctcagatatcacttttcaaatgcagaaaactacgtcggtctattagtgccagtgacctgagtttcaaaagtcatggtaatgacgatctctctgaagaattgctacaggacttaaaaaaaatgcaatttgagcagacttcagcgatagaaagtggtcataaagacctacctttaacccattcagagtcatttaaacctctcccgtataacctagaagatgatagttctgaaagtaatgacttcagtactcttagtggaatgctgagatacataaacaaagaagtgagactgctgaaaaaatcttctctgcaaacagctactggtttaagtcagggaggaaaattgtaattaaaagaagatgtctatgtcatgaaaaatggaattgttggtactgtgctgtttgtta

SEQ ID NO: 7632 - DNA, 501 bp, Mus musculus
  misc_feature (95)..(95): n is a, c, g, or t
  misc_feature (143)..(143): n is a, c, g, or t
  misc_feature (187)..(187): n is a, c, g, or t
  misc_feature (207)..(207): n is a, c, g, or t
  misc_feature (216)..(216): n is a, c, g, or t
  misc_feature (218)..(218): n is a, c, g, or t
  misc_feature (254)..(254): n is a, c, g, or t
  misc_feature (278)..(278): n is a, c, g, or t
  misc_feature (291)..(291): n is a, c, g, or t
  misc_feature (402)..(402): n is a, c, g, or t
  misc_feature (415)..(415): n is a, c, g, or t
  misc_feature (419)..(419): n is a, c, g, or t
  misc_feature (457)..(457): n is a, c, g, or t
aagagagactccttcaagtacgaaagcaggtttcgcaggaagaacatgaaaaccgacatatggggaattacaggagaatttatcctcctgaaganaaagcactgcttgagaagtatgaaggtttgctggccgtcgccttccanaccttcctctcgggaagagcagcttcattccagcgagaaatgancaatcctctgaaaaagatgngggaggaananctcctggatcttctggagcagtgcgaaatcgatgangaaaagctgatggggaaaaccggncgggtccgaggancgaagcccctgtgctgcatgccagagtgtgcagaggtcacgaagaagcagaagtattacggtagcagtgacagcagctacgacagcagcagcagcagcagcaattcagagntggatgagaacgnaaangagctgtgtcagaagagactagaccaagtcccatatanccttaagcacaccagtcactgcaagataatccagcaatccagta

SEQ ID NO: 7633 - DNA, 538 bp, Mus musculus
  misc_feature (76)..(76): n is a, c, g, or t
  misc_feature (82)..(82): n is a, c, g, or t
  misc_feature (86)..(86): n is a, c, g, or t
  misc_feature (119)..(119): n is a, c, g, or t
  misc_feature (124)..(124): n is a, c, g, or t
  misc_feature (126)..(126): n is a, c, g, or t
  misc_feature (131)..(131): n is a, c, g, or t
  misc_feature (135)..(135): n is a, c, g, or t
  misc_feature (231)..(231): n is a, c, g, or t
  misc_feature (258)..(258): n is a, c, g, or t
  misc_feature (482)..(482): n is a, c, g, or t
tttaacttagctgactcccagtttccaccaacccaagagctaagaatgttatcagatagcatctgcagcgatgtanaaagtntccncatcttgctgtagcttctgtgatgtacacaccnatgtntnttaancctnccttggtttatgactgtctgttctttaaaaactataaaatgtcatgaaaccacttccgtgttataaaagaaatttggcataactgtgttccttgtnccatggacattcaaatgtggctccacnataaactctcttattccctttaatgtgagaactctgtttttagcaccccccccatgcactaaaaatctaagtctttgagttgggaactgcccaagaaatatcaaattactctagaaacaagactgtagtaaactgaataaagaaaatataggtagatgtgaaaataggaatgccctttacaagaaattctgtaattctcaaatgaagtatttgaaaaccatgtngtctgtgtgattagaataaaaccctactaagtaaacacctgctagcctcaagtttg

SEQ ID NO: 7634 - DNA, 341 bp, Mus musculus
tacactgctcagttacatcctattgaagaataggaactctgaaagcaggaacatttattttttgagcaagaacttactgggtatcacttgaaaacctgtccctgtttcgagggtgagttacttaagacaccagcttatatatagcctctgtgagtctggcttctgcataaactttgtaatgtttgtcataatgtttaatggaacttgtcttaaacttgaatattgccacctgaagcaataaccaccccaagccagaaacttggacagcattgtcaacatttttgagtattcctgatctaggaatggcttgactccctagagtgtctgcctgccataaggat

SEQ ID NO: 7635 - DNA, 513 bp, Mus musculus
  misc_feature (189)..(189): n is a, c, g, or t
  misc_feature (212)..(212): n is a, c, g, or t
  misc_feature (214)..(214): n is a, c, g, or t
  misc_feature (234)..(234): n is a, c, g, or t
  misc_feature (241)..(241): n is a, c, g, or t
  misc_feature (279)..(279): n is a, c, g, or t
  misc_feature (330)..(330): n is a, c, g, or t
  misc_feature (346)..(346): n is a, c, g, or t
  misc_feature (376)..(376): n is a, c, g, or t
  misc_feature (382)..(382): n is a, c, g, or t
  misc_feature (397)..(397): n is a, c, g, or t
  misc_feature (409)..(409): n is a, c, g, or t
ctctgccttaattttgtctgttagcagcatgttcacatttgtttctgtgatctggaaccacatggtagatttttatggccacaccactggttgactttccatctgattttcctgttaagaaagaagctttaacaagcaaacatttaactgtggtgttaccagtaggcctccttatagccaccatgtcantctttggtgtgatcatgtttctntntgagataagcgatttgaaantaaagcntcctgtgaaggccaatgatgcttccaaaatgggccttntagatgcgtgaagtgataagttttggatttccaacatttgtgagaatgttntttaagaagtttcctnttcctacaggaaactcatgtagttctcaantcattntaaataaatttgttntataccaagcancagcagtataagaaccagatccaagaccagctgctgctgtacatgggactagcatttctcacaatgactccttgtgagctcacgggacctactggcaacaaagt

SEQ ID NO: 7636 - DNA, 441 bp, Mus musculus
  misc_feature (252)..(252): n is a, c, g, or t
  misc_feature (415)..(415): n is a, c, g, or t
gagaagtgtgctcttgaccgtccccgaaggtcccagccacaaaggccccagagacaccgttgtgccctgcgcgcggcccgagcgaaaggactgtgggactagcttcgtcacacgcaaccttgcatccggatgaagctctgcaggcctttggggataccagcatccgagatcatcaagtcagttgccttctgcctttcagccttcaactccatccacttctctcaccatccgagcacccggctcctttatccngtttaccccacaaccatctcacccttccccgtccacgctgtgcattgtaatgtcttcaccattctgtcacctgtagaccacctccttctgcttccctacaggaaggctttgcatggctgcacatttctcatcctccagcccagcagtccccgtaaagagtttncatttctctgcactgttgcaaattct

SEQ ID NO: 7637 - DNA, 562 bp, Mus musculus
  misc_feature (216)..(216): n is a, c, g, or t
  misc_feature (223)..(223): n is a, c, g, or t
  misc_feature (235)..(236): n is a, c, g, or t
  misc_feature (243)..(243): n is a, c, g, or t
  misc_feature (251)..(251): n is a, c, g, or t
  misc_feature (258)..(258): n is a, c, g, or t
  misc_feature (275)..(275): n is a, c, g, or t
  misc_feature (278)..(278): n is a, c, g, or t
  misc_feature (280)..(280): n is a, c, g, or t
  misc_feature (303)..(303): n is a, c, g, or t
  misc_feature (311)..(311): n is a, c, g, or t
  misc_feature (324)..(324): n is a, c, g, or t
  misc_feature (337)..(338): n is a, c, g, or t
  misc_feature (340)..(348): n is a, c, g, or t
  misc_feature (350)..(351): n is a, c, g, or t
  misc_feature (353)..(353): n is a, c, g, or t
  misc_feature (355)..(364): n is a, c, g, or t
  misc_feature (369)..(370): n is a, c, g, or t
  misc_feature (372)..(379): n is a, c, g, or t
  misc_feature (381)..(385): n is a, c, g, or t
  misc_feature (405)..(405): n is a, c, g, or t
  misc_feature (420)..(420): n is a, c, g, or t
  misc_feature (443)..(443): n is a, c, g, or t
  misc_feature (485)..(485): n is a, c, g, or t
  misc_feature (515)..(515): n is a, c, g, or t
  misc_feature (524)..(524): n is a, c, g, or t
agcttggcaaaacccaaccctgttggcttcggtgacctttcctggaccgctggcggagtgaggacaagcaaggctactgtgtgaagcctactgaagaccttgagggagccacagtaaacattgcaactgtgtttgatgaagaacttggctttgggtcctgctagcaggaagagctcaaactggcttggcaagggcaggcaggcctgaggccatagnttggctncagggcctgggnnggaactntgagactntgcactnaaaaggaacccggagcnttntntcccaaagcagctacccaccttntttgtatntctaagctcctgnttggctggaggtnntnnnnnnnnnannanannnnnnnnnnttaannannnnnnnnannnnnagcaatcttttggcacggancacactggaacctgnttctaataccagatgttgagctntttaaagctcgctgcccgtgatgagggctattcgagggacantccccagcaggtgccccgtaggggaggtgntagcctgtncggtggcgttcaggataaggaagctccagcgactgcaa

SEQ ID NO: 7638 - DNA, 522 bp, Mus musculus
  misc_feature (434)..(434): n is a, c, g, or t
  misc_feature (436)..(436): n is a, c, g, or t
  misc_feature (466)..(466): n is a, c, g, or t
tgtcatgcagtggtcctatcaggaagcctgggaagatcttctggcctctagcaagttcaacaagcatgagaccttcgcggtggttttccagcctttcttcgatgaaattgaaccacccttgaaaaggtcctcgccccaggatcccaccacactcgccctcaggatctggaatagcatgatggaaccagtgggtcaaaaggatgggctactcaatactgcagagagaaagacaatgaaatgtccctctgaggagagtccctatctgttcacctacaaaaatagcaactaccaggccagacgactgaaacctataacaaagcttcagatgaaagaaggatcagaattcacctgtcctgacaagaacccctcgaactcaatccccacaacaggtacatggctgtcatgttcagtgtgagcttcaattcaacttgagntntgaacttcaagtcacagcaactttaaaatnccaaggattcccaaggtgtgagctcaagatggacgagatggcctaggacagcattt

SEQ ID NO: 7639 - DNA, 450 bp, Mus musculus
  misc_feature (32)..(32): n is a, c, g, or t
  misc_feature (341)..(341): n is a, c, g, or t
  misc_feature (345)..(348): n is a, c, g, or t
  misc_feature (352)..(354): n is a, c, g, or t
  misc_feature (358)..(358): n is a, c, g, or t
  misc_feature (361)..(361): n is a, c, g, or t
agaatggctacccaagactccctgactcaagngagttttcagacaacagctttggtttaaggagctgggtgaattcatctcttcttgcctctgtgcaggcagagaaggtcgtggcggagctccataggaccgagtggacccagatccaaaggctcgaagctgcaggggagagtttacagaaggagatccgcaaaaggagattctcctacaagaaaagctgaagaagacagaggagggtcttcgaaggatgcagaaggaaaagaaacaggccattttccaggaagacagagagctacaaaggatggtactacctagaaggagggttcgagatggtgaccatnacannnnacannnaccntgnttgtccccagagttcaggtccgaggtattcagtagaaacaggggagaggatcaaacttgtgatcaggctcaggaaaaccctagtccacg

SEQ ID NO: 7640 - DNA, 462 bp, Mus musculus
  misc_feature (125)..(125): n is a, c, g, or t
  misc_feature (166)..(166): n is a, c, g, or t
  misc_feature (269)..(270): n is a, c, g, or t
  misc_feature (274)..(275): n is a, c, g, or t
  misc_feature (278)..(278): n is a, c, g, or t
  misc_feature (280)..(286): n is a, c, g, or t
  misc_feature (288)..(293): n is a, c, g, or t
  misc_feature (295)..(296): n is a, c, g, or t
  misc_feature (298)..(298): n is a, c, g, or t
  misc_feature (300)..(301): n is a, c, g, or t
  misc_feature (303)..(303): n is a, c, g, or t
  misc_feature (305)..(305): n is a, c, g, or t
  misc_feature (309)..(310): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (334)..(334): n is a, c, g, or t
  misc_feature (336)..(336): n is a, c, g, or t
  misc_feature (342)..(342): n is a, c, g, or t
  misc_feature (347)..(347): n is a, c, g, or t
  misc_feature (350)..(350): n is a, c, g, or t
  misc_feature (352)..(352): n is a, c, g, or t
  misc_feature (362)..(362): n is a, c, g, or t
  misc_feature (366)..(366): n is a, c, g, or t
  misc_feature (370)..(371): n is a, c, g, or t
  misc_feature (374)..(374): n is a, c, g, or t
  misc_feature (377)..(377): n is a, c, g, or t
  misc_feature (393)..(393): n is a, c, g, or t
  misc_feature (395)..(396): n is a, c, g, or t
  misc_feature (407)..(407): n is a, c, g, or t
  misc_feature (437)..(437): n is a, c, g, or t
ggagtgcgactctcaccagcttctccggagcttatcctggaccatgaccactcatctccatccactggccacctccctccagatgctgtcattacctcagcagatgatacgcatgcagatagcangcctcatgagtcagaccatctccaaggctcagattcagcangtcagcgcacacacatctgaacatccctctcttcccacttggtttaacggatgagccgagccatggagcacttgccctggaggatgagcctgaaggtcctggnntccnngtntnnnnnnntnnnnnncnncnannantntcanntctngagnctnaantcanancttntnaagaanaaaancananaattaaaaangatntggnntcnctnatggagaaacacagtntnntggagaaaggnttcttgaaggaaaaggagcaggatgctgtntcctttcaagccagataccgtgagc

SEQ ID NO: 7641 - DNA, 500 bp, Mus musculus
  misc_feature (284)..(284): n is a, c, g, or t
  misc_feature (288)..(288): n is a, c, g, or t
  misc_feature (310)..(310): n is a, c, g, or t
  misc_feature (314)..(314): n is a, c, g, or t
  misc_feature (334)..(334): n is a, c, g, or t
  misc_feature (356)..(356): n is a, c, g, or t
  misc_feature (368)..(368): n is a, c, g, or t
  misc_feature (389)..(389): n is a, c, g, or t
  misc_feature (419)..(419): n is a, c, g, or t
  misc_feature (457)..(457): n is a, c, g, or t
tgacctctgagaatatgcatgcgcagggcatgtgcacacacgcaaaacagtcataacacaaaacaatataaagaccttaaaggttagttagaagtagccgcttggaaactagtctagtgacacctttaacatgttctctatgcgttacgagggctgaaaccccatgagtttatgcttgtggagtcgagatgaactttctagagcaagtccctcagaacaggcaggcctggttcagaaccttaccaaagatcaaaaggaaccagatgatctctggaaagcagatnttcntttaccatgaaatagaaaatcnttangcaagaatcccatcgggagnttcgaaacagcaccttttgtanacgggaggaaantggtgcgctgcctgctgatgntgagacccggactagagctgacacaacatntccgcatagagaaagcccttgatgcttcctttcatttntgactgaccacacctacttcctgacactttctgatccttagta

SEQ ID NO: 7642 - DNA, 506 bp, Mus musculus
  misc_feature (305)..(305): n is a, c, g, or t
  misc_feature (371)..(371): n is a, c, g, or t
  misc_feature (378)..(378): n is a, c, g, or t
  misc_feature (383)..(383): n is a, c, g, or t
gagaatttgtagagcgtcgcccatcgattccacctaggctatatatcactcaccaaggaagggacatcaaaggctattaccctggacaactggcaagactccattttgattacagtgggaggaaggctccaagaccccttatagacttgacaattccactcaagagcacaactccgtatcagcctcaattagaccagcaaacgctcattcgaagcatttgttcaagaagattgtcaaggcctacagacttgtggcataatgaaacatcttaccaaagagactactccctgccattttatgagagnggttgggatcggaaattaggcacgatttcattgcatcctagaccagttaattcagtaccagaagtntactgcntgtgntggtgagagaagcagctatgcaagaagcactttttaaaactaaaggcaaattgcttgggaaatcaagatccaaccttgagaacatgtcatctgttgaagggaattgctgtgctgtgcagtaca

SEQ ID NO: 7643 - DNA, 262 bp, Mus musculus
  misc_feature (216)..(216): n is a, c, g, or t
gaggactgccaccagcacacctagaaacaaccgagccagcagtgacatgtgacagaaacacctgcattatttatgaaagccatgtctaatcttaactccgaaaagctatgcatatcaagaaaatcaggggctgctccttaatacaaatgtagtatgcacttgccgctaagccttaccaggagacgctcatcccttaggtaagagtgatgccccctngagagggaagacgcctgcatggagttcacgtgactggaatcacccc

SEQ ID NO: 7644 - DNA, 427 bp, Mus musculus
  misc_feature (104)..(104): n is a, c, g, or t
  misc_feature (169)..(169): n is a, c, g, or t
  misc_feature (172)..(172): n is a, c, g, or t
  misc_feature (254)..(254): n is a, c, g, or t
gaaacgcacatatttttgcagggtttgagttgggacggcaaaaccagccggaaaccgggagggttttgttagcggtggtcgtgcgggcgggagggcaccgcagnactgtggggcaggtccgggttgcgtgactgagccgcttcgtgcggcgcgggccgagggatgtccnagncagacgcactctgttcccaaagcacggctctaagcactgcttgcaaagaacgcatcggtaagctcagttctagccatgcgantcctgtgacctttctgagcagaaatttcaccaaatttgttcctgtggtactaagtctcatagggcgtgtgaggaaattttaccatcgcagcagcttgtcctcagacttccttctgaatactttaatctacagcggttagcctgcaaccgttgtgctttaaccaccctaagaag

SEQ ID NO: 7645 - DNA, 529 bp, Mus musculus
  misc_feature (313)..(313): n is a, c, g, or t
  misc_feature (318)..(321): n is a, c, g, or t
  misc_feature (323)..(324): n is a, c, g, or t
  misc_feature (326)..(332): n is a, c, g, or t
  misc_feature (334)..(334): n is a, c, g, or t
  misc_feature (336)..(338): n is a, c, g, or t
  misc_feature (340)..(341): n is a, c, g, or t
  misc_feature (343)..(350): n is a, c, g, or t
  misc_feature (453)..(453): n is a, c, g, or t
  misc_feature (460)..(460): n is a, c, g, or t
agtcacgttgtctttgctgagttgtactgggaccctggacatatcaaacaagcagaagaccgagctcaccgaatcggacagtgcagttctgtgaatattcactaccttattgcaaatggtactctggacagcctaatgtgggcaatgctgaatcgaaaggctcaggtcacagggagcacactgaatggcaggaaggagaaactccaggctacggaagatgacaaggagaagtggggttttctgcagtttgctgaagcatggaccccaagtgacagttttgaagagctcaaggattctgtgtttactcactttnaaaannnnanncnnnnnnntntnnnannannnnnnnnatagactctaaccttcagaagataatactggagaaaatatttttatgaccttgaaggtggggaaggataaagatttgcctcagtacacaagtaataaaggaanagattgnaatgccgactataaaaacatgaaaagcttttcactgagggggctgagtcataaaattccagccagcctg

SEQ ID NO: 7646 - DNA, 486 bp, Mus musculus
  misc_feature (273)..(273): n is a, c, g, or t
  misc_feature (276)..(277): n is a, c, g, or t
  misc_feature (292)..(292): n is a, c, g, or t
  misc_feature (318)..(318): n is a, c, g, or t
  misc_feature (342)..(342): n is a, c, g, or t
ccaaaccagcaacggcagttcaagaaacaccatcacccaagtctgagtaagacacggcccaattccaactgttctaaccttcaaacacagccacactggggctgagagcatgaggtacagatctttacaaagtacgagtgtgtggtttcctgtgacagccagaagacagcatcggatctcctggagcttgcgtttttttagaagccacctgacatgagcgcaggtcttctgaaagagcagcagctgctgatcaccaccaagccacctctccanccnnaaggcatgggtgttntttgaggaacgggagcattcagtctntagcagattcttttccagtttttntcttccctcatctggattctacaccacacacaccctactgacggagaagctgttcacggcgagagcgaagagacagagagacaaaaaggcgaaaatatccagccaagcagcaaatatttactgacttggtagatcttttccttt

SEQ ID NO: 7647 - DNA, 525 bp, Mus musculus
  misc_feature (85)..(85): n is a, c, g, or t
  misc_feature (100)..(100): n is a, c, g, or t
  misc_feature (348)..(348): n is a, c, g, or t
  misc_feature (355)..(355): n is a, c, g, or t
  misc_feature (366)..(366): n is a, c, g, or t
  misc_feature (384)..(384): n is a, c, g, or t
  misc_feature (388)..(388): n is a, c, g, or t
  misc_feature (391)..(391): n is a, c, g, or t
  misc_feature (420)..(420): n is a, c, g, or t
  misc_feature (427)..(427): n is a, c, g, or t
  misc_feature (433)..(433): n is a, c, g, or t
  misc_feature (451)..(451): n is a, c, g, or t
  misc_feature (495)..(495): n is a, c, g, or t
ggaacactgcagaaaacccctatcagcttccagagtatcctagaaggaaccaaacatttccacaaagacttcctgattggagaangggagatattcgaantatacagagtggacattcgaaaccaagcatatgctgttaaattgtttaaacaggagaaaaaaatgcaactaaagaagcactgtaagagatttttatcagaactggaagttctactcctgttccgtcacccccacatactagagctggctgcatatttcacggagactgagaaactttgtctggtttatccctatatgagcaacgggacgcttttcgacagattacagtgcacaaatggcacaaccccnctttccnggcacgttcgnatcagcgtattgataggnatanccnaagccatccaatacttgcacaacactcanccgtgcnccgtcntctgtggcaacgtttccnggtaaatgacctgagagctctgggttccacctaaatccctgtcngccctgcaggtgagtgttcttttcggccag

SEQ ID NO: 7648 - DNA, 245 bp, Mus musculus
  misc_feature (88)..(88): n is a, c, g, or t
  misc_feature (97)..(98): n is a, c, g, or t
  misc_feature (100)..(100): n is a, c, g, or t
  misc_feature (103)..(103): n is a, c, g, or t
  misc_feature (109)..(109): n is a, c, g, or t
  misc_feature (118)..(118): n is a, c, g, or t
  misc_feature (141)..(141): n is a, c, g, or t
  misc_feature (153)..(153): n is a, c, g, or t
  misc_feature (158)..(158): n is a, c, g, or t
agaagatgtttcactatgcaggaacctagaagttttctacatggagatggggaacatcagctgtaaaattgttcctaagtgcaatctntacagacannanatnacggcntggcaggcnccgatagtcaagttccacacggntttggatgtgantgaantgggttggctgaaggagaacgtggggccctgacttgcctttagttcacttttcttgggaacttggagggccaggtttgcaggagtca

SEQ ID NO: 7649 - DNA, 326 bp, Mus musculus
  misc_feature (57)..(64): n is a, c, g, or t
aaacggatcaagattccccaggagagaacaacggtagagaatctaatgtaaacctgnnnnnnnnaactatgacaatgaagctggtcgcagcagcactttgcttgagcctccttgcagccggcctgtgggtgggcctctcattgacagctgagtccattgaagaagggaaacctggaggagagaaacctggaggagggaaacctggaggcagcggacgaggatgttttctcccaccactgccaaaagaagatgtttcactatgcaggaacctagaagttttctacatggagatggggaacatcagctgtaaaattgttcctaagtgc

SEQ ID NO: 7650 - DNA, 303 bp, Mus musculus
gcaaatatctgcttgtccagccaggactttcatcattgtggtacagctgagaggaaatgtgtgcctgcatgggtacagctgatacctttgaaaaggactaaaatgatggataatggagttagggccagagaaagatgctgaattccgtttcagagacagacttaaggcattgggatcagacacaagtggactctgccgctgccagctaaggctgggagctgcttgccttactgcataactactttgtccgcagcaattactgcatttatggctctgactcagaacacacttgcagtcacaggt

SEQ ID NO: 7651 - DNA, 530 bp, Mus musculus
  misc_feature (323)..(324): n is a, c, g, or t
  misc_feature (333)..(334): n is a, c, g, or t
  misc_feature (337)..(337): n is a, c, g, or t
  misc_feature (348)..(348): n is a, c, g, or t
  misc_feature (350)..(350): n is a, c, g, or t
  misc_feature (352)..(352): n is a, c, g, or t
  misc_feature (356)..(356): n is a, c, g, or t
  misc_feature (367)..(367): n is a, c, g, or t
  misc_feature (369)..(369): n is a, c, g, or t
  misc_feature (386)..(386): n is a, c, g, or t
  misc_feature (389)..(389): n is a, c, g, or t
  misc_feature (393)..(393): n is a, c, g, or t
  misc_feature (406)..(406): n is a, c, g, or t
  misc_feature (420)..(420): n is a, c, g, or t
  misc_feature (422)..(422): n is a, c, g, or t
ggtttttggatacctgtcaccagccatggttgtcatcagcaccccaaatgctgaattcaaccccctgtttcctacagtcaccctgagggacgccgaccataaatttgagtggagcagaatggagtttcagacctgggctttacacgtggcaaactgctacaattaccgtgtggagtttactggggtagggacaccgccagctggatctgagcatgttggatattgtacccagataggtgtctttacaaagaatggcgggaagctctctacaacttgggtttcccagcagtgtgaccagcacgtttataaacctggtctcactnngtacccccnngcnggcctagactngntntgtngaccagactgncnttgaacacatacagatntcntatntctacttctcatntgccaggattaaantngtgcatcaccacacctggctaaatgacctaattttgaggttcctcatagaaagatccttcaggctggatgagtgttggccggtttggcctatggcacactttcagagt

SEQ ID NO: 7652 - DNA, 459 bp, Mus musculus
  misc_feature (120)..(120): n is a, c, g, or t
  misc_feature (135)..(135): n is a, c, g, or t
  misc_feature (214)..(214): n is a, c, g, or t
cttagcatgctggaccaagacctgcctgtcctcatgaaagcttccagatgcctgtgctgtcctgtgcttggtgcactctcgtcttgaattacatcaacccacagtgggcccagaaacctntgcttctttctcctnattgagggttcagactccttttgggataatactttaatcagtcatgtaggatagacttttgtttccaaggtaaattttnggctgaaactcaaacacagccttggacacatgagactatctccaaaagaaattgattggcagcctgaaagtatcactctgtgtattagtcaagagcagagatgccaggacgactatctatctgtctgtctatctataaataaagggggtttattcgagtggcttctacccaatgccctgtcactcacaggtcccttacagagctgaagaagcagcaacaagagagacaggaaccccatgttaaat

SEQ ID NO: 7653 - DNA, 285 bp, Mus musculus
  misc_feature (213)..(213): n is a, c, g, or t
  misc_feature (228)..(228): n is a, c, g, or t
  misc_feature (256)..(256): n is a, c, g, or t
tgcccatcctggactttatccggagcacacaactgaatgggaatttccatgcctgctcaggtgtgatggagaagttgcactatgccagcctcctcagccggctgcagagagtgaaggaacaggcccaggtgatcaatcaagcaatggcagagctggcaacagtcccttatctccaggacatcagtcaacaggaggcagaattgctgcagtcgntaatggcagacgccntggacacccttgaaggaaagaagagtgntaaggagcgtgtgtggaatacaatccaaa

SEQ ID NO: 7654 - DNA, 343 bp, Mus musculus
gagactgagctgtactgaagcccacagctcctctctctgggatgaagttactaaactccgatcccagcttcaggctcaggctcaggtgactgaggcgctgaagcattctgtacagagcctgttgaaggatcgggagcaacatatgttcaagatcagtgctctagaagcatcactaaaactgctgcaggagggccccaaagggagagcccttctggagcaatgcctggaagggctgaaaaaggaactgcagggccttcggagtcaggttcaagagctagtccaaaaccaaatgaaagcaagaccaggaaagttgggtcctgccagtggctttcaccaagagctg

SEQ ID NO: 7655 - DNA, 485 bp, Mus musculus
  misc_feature (113)..(113): n is a, c, g, or t
  misc_feature (451)..(456): n is a, c, g, or t
gagatgaattctccacagatccttacccgtctggaagattatgtatgcctgggggagtctcaaaagaaccgaggaaacgtaaacatgaaggaggattgagaaaaggctgcaangttctctgtccctcatacagacctagaggaaaattatggcaacctggctggtcctgggccagtgctgttcccttggctctatacatctaaggcatcgaagactcccaaggatacggagtgactctgggtatcagcttagcacatgttattttaggtgtttcaacagtgacaccattgaggtagtgtggcttagtgaaggaatgtgggcttggacgggatagaatggggttgtcattccacagttataagttaatattcttattaacttgggcaatcatgtgactactcagtatcctatttaaatcttataaatgcccactgaagtaggcatggactannnnnntgttgtggatactttttaagtctgcggaa

SEQ ID NO: 7656 - DNA, 285 bp, Mus musculus
acctgatgacagatatgtggcttggggactcagactgtgtctcaccagagatatttctgtcggctgttggcagtctttacccagcttttctgaaaaagacacagcaagatgcgcaggagttcctgatttacgtcctcaacgagcttcacgaagctttgaaaaagcactgccgaagaagagtgaatgagaaaagaacaggccaaagctgctgcaggaaggtgccggcccaggagacctccatcatcacccggctgtttgaaggacagctcagttacagcatcacat

SEQ ID NO: 7657 - DNA, 278 bp, Mus musculus
tatggactttgactgtacgcagaatttcaaagaagacatctataagtgatgtgattttcaatcctattctcttgacattgcctaaattccttaatgaaaactttgactatgaattggcttatgtgccttctgagagtaatgcagcaagaaatattactgagatggtgaaaaaggatttaaatttcaactttaaagttcaaggctttccttcggaagaatcttttgagagatacattaagtatgagaacaaggatgcgcatgtgctggctgctattgtg

SEQ ID NO: 7658 - DNA, 473 bp, Mus musculus
  misc_feature (375)..(375): n is a, c, g, or t
  misc_feature (417)..(417): n is a, c, g, or t
  misc_feature (428)..(428): n is a, c, g, or t
  misc_feature (430)..(430): n is a, c, g, or t
gatgagattctccaacttttaaggaaacaaagagaagaaaggatctcgaaagaactgatttcattaccttataaacctaaggacaaagtgcccaaatcaaaggaagttttatcagagtcaggcctaagggaccaagaagaagtcaaagccttggaatgatttgattgacatatggtatcgactgactgatatgtgttcacccttacagcaagttatgcttacagcaggatcagtaggttaaagatgtgcagacttccgggaatttgacagttactgaacattcatgttaaaatagactaaaataaattttcagaattcagacaggtgggttttgtcagttattgaacatttgtgtctattttatttattgcatantattgcatttgacatcataccataatcattttcgcatcatantcatcccaaantnctggtttttgtttgacttgaaaggtgtttccacaatgtatata

SEQ ID NO: 7659 - DNA, 440 bp, Mus musculus
  misc_feature (261)..(261): n is a, c, g, or t
  misc_feature (269)..(269): n is a, c, g, or t
  misc_feature (272)..(272): n is a, c, g, or t
  misc_feature (275)..(275): n is a, c, g, or t
  misc_feature (290)..(290): n is a, c, g, or t
  misc_feature (296)..(296): n is a, c, g, or t
  misc_feature (300)..(300): n is a, c, g, or t
  misc_feature (324)..(324): n is a, c, g, or t
  misc_feature (343)..(343): n is a, c, g, or t
  misc_feature (355)..(355): n is a, c, g, or t
  misc_feature (363)..(363): n is a, c, g, or t
  misc_feature (390)..(390): n is a, c, g, or t
  misc_feature (395)..(395): n is a, c, g, or t
  misc_feature (398)..(398): n is a, c, g, or t
  misc_feature (405)..(405): n is a, c, g, or t
agggccccaaggagcgcagctacttcagtcgcgagggccagacagggattgtctccctctatgactgtgtttttaagaggagactagattataaccagaaattacaccgagatgacagagaacatgcaaagaacctggggctccatattaatgaggaggaacaagaaaggactgtgccagtgctgatgtcctctgtctatgggaaacgcatcaatcagcccattgagcccctaaacagagactatggccatgtgagccacntgaagacnganttntacaggaagaacganatcccnagcntcaaggggcccggctttgggcacntcaatccagcctgaagaantcgtgtggtttntagggcantctgaggaggataagcacgtgcatatntaagntgntcctggntcagaacctggaaaagcacctttccttatgttgaa

SEQ ID NO: 7660 - DNA, 345 bp, Mus musculus
  misc_feature (40)..(40): n is a, c, g, or t
  misc_feature (43)..(43): n is a, c, g, or t
  misc_feature (46)..(47): n is a, c, g, or t
  misc_feature (54)..(54): n is a, c, g, or t
  misc_feature (63)..(63): n is a, c, g, or t
  misc_feature (68)..(69): n is a, c, g, or t
  misc_feature (87)..(87): n is a, c, g, or t
  misc_feature (106)..(106): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (126)..(126): n is a, c, g, or t
  misc_feature (131)..(131): n is a, c, g, or t
  misc_feature (141)..(141): n is a, c, g, or t
  misc_feature (143)..(144): n is a, c, g, or t
  misc_feature (146)..(148): n is a, c, g, or t
  misc_feature (150)..(153): n is a, c, g, or t
  misc_feature (156)..(160): n is a, c, g, or t
  misc_feature (164)..(164): n is a, c, g, or t
  misc_feature (180)..(180): n is a, c, g, or t
  misc_feature (184)..(184): n is a, c, g, or t
  misc_feature (195)..(195): n is a, c, g, or t
  misc_feature (217)..(217): n is a, c, g, or t
  misc_feature (225)..(227): n is a, c, g, or t
  misc_feature (229)..(229): n is a, c, g, or t
  misc_feature (231)..(231): n is a, c, g, or t
gcgcccaaggccagaacgcaaggctcgagttccagggtcnaangtnngcctccncaagccccnacagnnaggccgccccaagctccntcccaaccttgggccactnagcaaaggtcccntncnccntcccnccgggctaangnncnnncnnnnggnnnnnatgngcccctcgaagctggnttcntccccgccaantctagtgcagaagcacccctcntccccttnnncnancctgtttccagagatgtgctatgaagagcttgtacaagtaaacagtttgctgagcgaaactggctgcgcctagtgggatcaggcaccgagccgacgcacgtcttttgcaaacat

SEQ ID NO: 7661 - DNA, 307 bp, Mus musculus
  misc_feature (208)..(208): n is a, c, g, or t
  misc_feature (210)..(210): n is a, c, g, or t
ttgttcttaccctaaattggtgagttatggtcgatttgaagtaaaggattgtgttgtagcaatttcctccaagattaaaatgttctattcttcagagaagctctttgagggggaagtaaatcccaaaacagcttcaggaagttcctgaaactggtccacattcactagctccctccctcccaatagtaaacaataaagattgcctctntntgaaaagcaagacaactgagatgaacccagatgcctggaaaaacaggaaagccaagcatccagaaaataaacagaccagctaagcaaaagcagcctc

SEQ ID NO: 7662 - DNA, 553 bp, Mus musculus
  misc_feature (114)..(114): n is a, c, g, or t
  misc_feature (176)..(176): n is a, c, g, or t
  misc_feature (263)..(263): n is a, c, g, or t
  misc_feature (266)..(266): n is a, c, g, or t
  misc_feature (268)..(268): n is a, c, g, or t
  misc_feature (276)..(276): n is a, c, g, or t
  misc_feature (279)..(279): n is a, c, g, or t
  misc_feature (289)..(289): n is a, c, g, or t
  misc_feature (298)..(298): n is a, c, g, or t
  misc_feature (304)..(304): n is a, c, g, or t
  misc_feature (308)..(308): n is a, c, g, or t
  misc_feature (320)..(320): n is a, c, g, or t
  misc_feature (327)..(327): n is a, c, g, or t
  misc_feature (345)..(345): n is a, c, g, or t
  misc_feature (357)..(357): n is a, c, g, or t
  misc_feature (359)..(359): n is a, c, g, or t
  misc_feature (376)..(377): n is a, c, g, or t
  misc_feature (393)..(393): n is a, c, g, or t
  misc_feature (410)..(410): n is a, c, g, or t
  misc_feature (425)..(425): n is a, c, g, or t
  misc_feature (439)..(439): n is a, c, g, or t
  misc_feature (500)..(500): n is a, c, g, or t
  misc_feature (528)..(528): n is a, c, g, or t
aagagagtggtcctagtatctcccctccctactactgtactcaaatgttgcctctcttcttcccttctttttccccctctgtcttttcaaaatgtctgtcactgagagcacagngccagttttccatggctctggtccctcctgctcccgagcacaccaacccctcagggactgtnctttttcctgttctggtctatttgatactacaggacgcgtagaacatcttcagtgtttttcagagttgatcaacatgttgatttttntantnaaccatgnttngcgtaaatangtaaaaaangtgagnagtncgcagagagccnttttcanacattactggaatttgtnttaatccagagncnaaaatcattctagattnnaaaattatttttaaantcaagtcagaaactcanatcatgattttttgnaatcaaatattttnagcccactataatccaaagacatacttacatgatatatgttgaaaaatgaagctaggaaantattaaaagttttttttttttgcatacntaagccattatgtttctataagaac

SEQ ID NO: 7663 - DNA, 468 bp, Mus musculus
  misc_feature (34)..(34): n is a, c, g, or t
  misc_feature (36)..(36): n is a, c, g, or t
  misc_feature (39)..(39): n is a, c, g, or t
  misc_feature (46)..(47): n is a, c, g, or t
  misc_feature (49)..(49): n is a, c, g, or t
  misc_feature (53)..(53): n is a, c, g, or t
  misc_feature (59)..(59): n is a, c, g, or t
  misc_feature (65)..(65): n is a, c, g, or t
  misc_feature (72)..(72): n is a, c, g, or t
  misc_feature (80)..(80): n is a, c, g, or t
  misc_feature (84)..(85): n is a, c, g, or t
  misc_feature (435)..(435): n is a, c, g, or t
aggaggcacacttgcattgctcacagtaaacacngnggnacacttnnanttgntcacangtaaancaccagncacacttncatnnctcacagtaaacaccaggcacacttgcatggctcacagatcaatggtttactattactcttaggtcagtcacaacgctgcacataacacatttgtagtaacttatgttacaacatgaagttataggctccaaaggtgtcagaaatgaaagactttacaatggcccctgcttgttgaacctcccatcaggtgtgactgctttcctgtaaggttgcccgtgagtggccaggattctagccacttagtcagagaactgaagagcttatgatgggacatgcatgggtcgaggcaaataatgctacccctgatcaccacaaactgcacaaaacccatgtaccgctaattaatttntcagtatagtcatgagttgtgatttctctccat

SEQ ID NO: 7664 - DNA, 478 bp, Mus musculus
  misc_feature (82)..(82): n is a, c, g, or t
  misc_feature (86)..(86): n is a, c, g, or t
  misc_feature (89)..(89): n is a, c, g, or t
  misc_feature (95)..(95): n is a, c, g, or t
  misc_feature (99)..(99): n is a, c, g, or t
  misc_feature (107)..(107): n is a, c, g, or t
  misc_feature (196)..(196): n is a, c, g, or t
  misc_feature (243)..(243): n is a, c, g, or t
  misc_feature (392)..(392): n is a, c, g, or t
  misc_feature (398)..(398): n is a, c, g, or t
  misc_feature (413)..(413): n is a, c, g, or t
  misc_feature (428)..(428): n is a, c, g, or t
  misc_feature (435)..(435): n is a, c, g, or t
  misc_feature (437)..(437): n is a, c, g, or t
gtggaaggcaactgtgcccttgcatgcagagtggttgtgtagggttctcagctaccatttgcataccaggagcatcacaacnatcngtnaattcnaagnccagagtnatcaacatctgggactcctaaaaatgatgaaaatagaaaattttttattcactgtaatcttttgttctactagtacaacaatgctcaanagatagcaataaattggaggaaaatgtgtgtaatcttacagtcaccnaaattttacagattgatgtattaaaaattaattcctgagtccagagagacagcttagtatttaagagtgattgctgcttttccgggggaccagacctgacagctcacacttgcctgtaactccaatacacacacacacacacaaaccantacacntttgaaaaaattggntttctatgaaatatnttcattntnttcatagtgacaatggcatcacagttgtatgcatgggacaa

SEQ ID NO: 7665 - DNA, 548 bp, Mus musculus
  misc_feature (389)..(389): n is a, c, g, or t
  misc_feature (393)..(393): n is a, c, g, or t
  misc_feature (415)..(415): n is a, c, g, or t
  misc_feature (417)..(417): n is a, c, g, or t
  misc_feature (423)..(423): n is a, c, g, or t
  misc_feature (429)..(429): n is a, c, g, or t
  misc_feature (438)..(438): n is a, c, g, or t
  misc_feature (459)..(459): n is a, c, g, or t
  misc_feature (470)..(470): n is a, c, g, or t
  misc_feature (479)..(479): n is a, c, g, or t
  misc_feature (481)..(481): n is a, c, g, or t
caaaaacaacggtcactctccaattccaacagacacagatatttccaactacaaagcgcactactggggatgcatttggcccctggaaccctcttgaacgagagtgaggagatggtattcctgttctgcattatcctgcatcccttctccaattcttcttgaggtgttggtttttttcgtcccagagacatgtacaccagctatacccgcttaggtgacccgactggaccaacaacagttctctctcattggtccccactttactgactgtatctttgcaagacatccaggaaaatccctatgcacgtctggtggtggcgatgttctagtacaactttttagtatactgataattgattagatacttgatcagttgtcacgataattgntttntcttttggggttttaaaaatancnattaanaaaatntccagcatngggcgggggacagggcagagntcgtccactcnctggtgatntntgagttcaagcccaccccagtttacctaaatagtaccaggccagccagatcgtcatggtgagaccct

SEQ ID NO: 7666 - DNA, 537 bp, Mus musculus
  misc_feature (65)..(65): n is a, c, g, or t
  misc_feature (91)..(91): n is a, c, g, or t
  misc_feature (153)..(153): n is a, c, g, or t
  misc_feature (155)..(155): n is a, c, g, or t
  misc_feature (213)..(213): n is a, c, g, or t
aagaactcggtaactcaggcctggtacagctttgatgacacccgagtcagtgagatcccagatanttctgttcaaacagctacagcctatnttctgttctatagctgccagcctttttctataccagcacagaaacgcaagagccaggacagnantcctgaccactgcaagcaagctatccgaaagtggccgtgaatatgctttgttattaantccttaccacctacttacgtctcacagacagcctctataaaacaagtctgcagcacagaaggcagcatggaggccatgcagtgccatcaggggcctaagaactgcaggcttcaaaggtcaatgccccctgcaatgaatgggtttctgttacaatgtatttcatatatatgaagttatttcccccaaattttatacttactttgtatctatgtgcatgtggaagtcagaggataacttgtggaattaattctcctttccaccatgtgggtcctgggggactcaggtcctcagcattagtgggagacatttttacccagtgaacca

SEQ ID NO: 7667 - DNA, 492 bp, Mus musculus
  misc_feature (353)..(353): n is a, c, g, or t
  misc_feature (363)..(363): n is a, c, g, or t
  misc_feature (367)..(367): n is a, c, g, or t
  misc_feature (369)..(369): n is a, c, g, or t
  misc_feature (381)..(381): n is a, c, g, or t
  misc_feature (384)..(384): n is a, c, g, or t
  misc_feature (387)..(387): n is a, c, g, or t
  misc_feature (390)..(390): n is a, c, g, or t
  misc_feature (398)..(398): n is a, c, g, or t
  misc_feature (413)..(413): n is a, c, g, or t
  misc_feature (421)..(421): n is a, c, g, or t
  misc_feature (443)..(443): n is a, c, g, or t
tggaaagacgtcatgatcagctggggctcgtgtccttgaagctccgggaggcactgaagaaacaagaagctaaagcagatgagaatgaggacgtaataaaaagaaagctgcgacaaagtgaaaccgagaagagccaactggaacaggaattggagatctcacgcaggctgctgagtcaatctgaaagcaatagagaaacgcttttgcatcaggtggaagagctgcgtacacaacttatcaaagcagaaggtgaccaaaggggtttgcagcatcaagtaccttgcatttccaagcaaccattaagccaccaggatgatcaaggggatgaccggaggtttagaagaggagtagancgggagaaantgantntggagaagcagntgncanatntgcgagtncagctgaacttcaantccatggnttcggagttagaggaagtgaancggtgcatggaacggaaggaccaggagaaagcaacgctggccgcacaga

SEQ ID NO: 7668 - DNA, 509 bp, Mus musculus
  misc_feature (397)..(397): n is a, c, g, or t
  misc_feature (409)..(409): n is a, c, g, or t
  misc_feature (411)..(411): n is a, c, g, or t
  misc_feature (438)..(438): n is a, c, g, or t
  misc_feature (471)..(471): n is a, c, g, or t
  misc_feature (481)..(481): n is a, c, g, or t
aggtgtctgaactatgtccctcaacagaagaccacaatgaagaaaaccaactgtttcactggaagactagaggctggtctttgcagagtgtagagatgtgtactgaagttataaagaatgaagccaagcattcagcacttaccacacagtcttttaaggtcacccctggagtaagagggatttcactccctaaagtgaggagtgaaatctgagaaacccacctcgaggcagcttcccgggatgagaacagtgaagtgagtacttccacgactataggtgatgtcgcacagccccacatggccctactgtgagcaagagacacagaaagcaggagatgcatggtaccagagctggaactgcgctgtattgcttcccttcacgatggtgagcaagcgantggaaacaaagntnggtgagatgggccattaagcaccgcantcagaacctgagctgctgcaatgtcacaaaggngaggtgctgngcctttgatgcacacactgccaagggag

SEQ ID NO: 7669 - DNA, 516 bp, Mus musculus
  misc_feature (428)..(429): n is a, c, g, or t
  misc_feature (438)..(438): n is a, c, g, or t
  misc_feature (445)..(446): n is a, c, g, or t
gtcccctaaggtgttgctgaggctaaaatcaacggagcctgggatgaccttgtccttacaggaaaccaaccattcattttggcattgggcccgataatccaccgtgaaggcacccaggtaagccacggtcccagaggctagcaaaacatccccggtcaggttatcatagcggatccccagctgccgggcagcctctgtccatctgtccttctctcctccaaggccactgataagcttctctgccctgacgagcttctgggagcagatttctatatttttctccagtgaatttttctttctgttcatcagttcaaactcgtcattgagatcttggagtcggtcttccaccagcttcagtccgcccgtttctggttcagtttttgcatttggatctccagcttcccctcagcctccctcagtcgctcccnnttgggagcncacaacnntggccactcggtcatacacttccatggccctcacccacttgcacaggccctcacaggcagatgatacatt

SEQ ID NO: 7670 - DNA, 318 bp, Mus musculus
gcagaagctggctcctgtaaaaggactccctacaggaaaacggagacctgtaatgtagaacgaccgcctcgccttacggatgggaagctgaggacagtcgtcgctgtaaaactttgacaggtgcccaatatgagatgaaaagaacaagggaaacgggcctaagtcgtgtgataagggggtaagccagtccggtgacaacagagggcagggaggggcacacagagcctgaggggaaaacatcaaagcatccctgaggaggtgacatgcctaactcctgcaaaggagagtaagaaaagcattctttatcgaggttgaggt

SEQ ID NO: 7671 - DNA, 297 bp, Mus musculus
ctagccggaggacaagagcgaaacaggacagaccaggatcccaggcttcattccaccgagtctcactagcgcctacagtggtgcagactgatccagagagaaacagctcggagtcaatcaaaaaacagttctaacagggcttggtgagaggcagagaataggcgacagccgccgggagtgcggggctgagacaaaccaacgctcaggaatgggcactgaggggcagcgacctagcccactggagacctgcaggaagggtgtcccggatggaggaaaccgcaagtccaaaggcacaga

SEQ ID NO: 7672 - DNA, 535 bp, Mus musculus
  misc_feature (400)..(400): n is a, c, g, or t
gccactgctctcttgaaacggttgtgcaatcccatgctgctatcagggctgacaaggaggccactcctagccttggacccttcagctaggttcaactccaggtcaagtcaggggcccccagcagcttaggggcacaggatccacaggaagaaattccaggactttgccagaagctaacaacagttcccagctgttcccagccgcctcctgccattcatgccttttagagtgggggtctttgcacaaatttcatcagaaggagggtcagatggacgcttttgcctctgggtcagggcacaggacaggccatggagaaacaacagcctctttgttgctgtcagctcctgcacagacccttgacagagacctccctcttcctggatctcttggggaccatganaccagttgtactgctatggctagccttatgtagtgactttaagcctctcctgcaagctcaaggagggccgatagccttgctctgcagttcctctgggacacatgctacagaactctcttatcaacgcagttcttg

SEQ ID NO: 7673 - DNA, 214 bp, Mus musculus
  misc_feature (26)..(26): n is a, c, g, or t
tccccacaacgccaacatttcacttnttttatttggaggaggacgtttggaagttgtgtttctggaaatgttttgtatttattttcccagtaaacttaagaaaacttaaaagtaattaaatgtttttttccttttgaaaagacagaatcttaaaacacttggagtatgtcttctttcaaatgtacatgtcaatggtgcctaatattttttgttt

SEQ ID NO: 7674 - DNA, 190 bp, Mus musculus
cattgctatagctcaaggtggaacaatccagatttctaacccaggatctgatggtgttcagggactccaggcattaacaatgacaaattcaggagctcctccgccaggtgctacaattgtacagtatgcagcacaatcagccgatggtacacagcagttctttgtcccaggcagccaggttgttgttcaa

SEQ ID NO: 7675 - DNA, 162 bp, Mus musculus
  misc_feature (93)..(93): n is a, c, g, or t
  misc_feature (123)..(123): n is a, c, g, or t
  misc_feature (130)..(130): n is a, c, g, or t
aagctctacgaagctctccagaagcacgcctactgcttcaggataagcaccccgcaagcgttagaagaggcgctgtacagtgactatctccancgagaacagtattttattaaaaagcacagnaaagaanaaatatattgccagttaccaagtgatactgaa

SEQ ID NO: 7676 - DNA, 566 bp, Mus musculus
  misc_feature (61)..(61): n is a, c, g, or t
  misc_feature (82)..(82): n is a, c, g, or t
  misc_feature (175)..(175): n is a, c, g, or t
  misc_feature (205)..(205): n is a, c, g, or t
  misc_feature (212)..(212): n is a, c, g, or t
  misc_feature (245)..(245): n is a, c, g, or t
  misc_feature (270)..(270): n is a, c, g, or t
  misc_feature (287)..(295): n is a, c, g, or t
  misc_feature (297)..(298): n is a, c, g, or t
  misc_feature (307)..(307): n is a, c, g, or t
  misc_feature (309)..(309): n is a, c, g, or t
  misc_feature (330)..(331): n is a, c, g, or t
  misc_feature (334)..(337): n is a, c, g, or t
  misc_feature (346)..(346): n is a, c, g, or t
  misc_feature (359)..(359): n is a, c, g, or t
  misc_feature (400)..(400): n is a, c, g, or t
  misc_feature (444)..(444): n is a, c, g, or t
  misc_feature (459)..(459): n is a, c, g, or t
  misc_feature (533)..(534): n is a, c, g, or t
ttccctagcaacaggcatggccttgaggacagactgcctggaggatagtcgtctgacgtgntactggggatgcagtgtgcanaagctctacgaagctctccagaagcacgcctactgcttcaggataagcaccccgcaagcgttagaagaggcgctgtacagtgactatctccancgagaacagtattttattaaaaagcacagnaaagaanaaatatattgccagttaccaagtgatactgaanttgaagactttggtccagtgcccanatctcgctatcctttgnnnnnnnnntnnttgaccctngntgatgaggatgacagggaaannttnnnnatattgtangtattgaagcatntggcataccttacctttataagacgggtgattccaaattanttttaaaataggaaaaattaatttctgaaaatatatatttggtnttggactaatgtgtnttgaaaaattaaaccatggattatacccctgtttaatttttatagctgtaacatgccttcagaatatgatgctnnccccccccccctggatggcaacagcatagctt

SEQ ID NO: 7677 - DNA, 197 bp, Mus musculus
  misc_feature (101)..(101): n is a, c, g, or t
  misc_feature (120)..(120): n is a, c, g, or t
gtcagccatacggacacatgtgctgaagctgaattccttcctccatgagaatgcccgtcccccaatgcccttcatggcagagacagctaagctaggcaganccagatctatagatcctgnattacacaacgaggctctacttcctggagactggggacatatcctccgccctgaggaccaaggtgagcctgtgacta

SEQ ID NO: 7678 - DNA, 303 bp, Mus musculus
  misc_feature (86)..(86): n is a, c, g, or t
  misc_feature (99)..(99): n is a, c, g, or t
  misc_feature (102)..(102): n is a, c, g, or t
  misc_feature (134)..(134): n is a, c, g, or t
  misc_feature (153)..(153): n is a, c, g, or t
  misc_feature (169)..(169): n is a, c, g, or t
  misc_feature (228)..(228): n is a, c, g, or t
  misc_feature (241)..(241): n is a, c, g, or t
gacagaagctgcggagccccacaggcacctctgcaagccagctgcccaggagcaagcggagggccatggaggcaaggatatgctcngaggttttaactntantcagcaacctggctgacctggcaaatgctgtncactggttgccccgaggtntcctgtgggctggccncttccctccttggctgaaaaagacttacttgtgtatgtacctcacgcatgcctggtgcntatggaggttggntcccctagaactggagttaacatgatttggagccaccatgggagacaaacccaggccatgtc

SEQ ID NO: 7679 - DNA, 308 bp, Mus musculus
  misc_feature (91)..(91): n is a, c, g, or t
  misc_feature (127)..(127): n is a, c, g, or t
  misc_feature (161)..(161): n is a, c, g, or t
  misc_feature (171)..(171): n is a, c, g, or t
  misc_feature (176)..(176): n is a, c, g, or t
  misc_feature (184)..(185): n is a, c, g, or t
  misc_feature (205)..(205): n is a, c, g, or t
  misc_feature (221)..(221): n is a, c, g, or t
  misc_feature (246)..(246): n is a, c, g, or t
  misc_feature (248)..(248): n is a, c, g, or t
  misc_feature (253)..(253): n is a, c, g, or t
  misc_feature (255)..(255): n is a, c, g, or t
  misc_feature (263)..(263): n is a, c, g, or t
  misc_feature (273)..(274): n is a, c, g, or t
  misc_feature (277)..(282): n is a, c, g, or t
actcaagacctgtctgctggaggataccctgcacgtggtggacatggaggccaggctcacaggaaaggagaagagagtcgggggcttcganctcatgtggaatgatggccctgtcagccgagaggangggccttctgacctatcagggatggggaactttntgaccaacantcacntaggtacnntgagccagacaggaagtgantgggagagaaacatcntaggaagtggaggggggctggggcngnttggnanagcagtgngatccagccnntgnnnnnncaagcataccagctgtgtgacttggg

SEQ ID NO: 7680 - DNA, 367 bp, Mus musculus
  misc_feature (159)..(159): n is a, c, g, or t
  misc_feature (305)..(305): n is a, c, g, or t
  misc_feature (341)..(341): n is a, c, g, or t
ccaagcatggtcctaaggccgtggagacactcttcagtgacatggacaatatcttcatcaagagcctgcagagcgtgcagaaggtgatcatcagtgataagcactgctttgagctctatggctatgacatcctcattgaccaggacctcaagccgtggntcctagaagtcaatgcctctccttccctgacggccagcagccaggaggactatgaactcaagacctgtctgctggaggataccctgcacgtggtggacatggaggccaggctcacaggaaaggagaagagagtcgggggcttcganctcatgtggaatgatggccctgtcagccgagaggangggccttctgacctatcagggatggg

SEQ ID NO: 7681 - DNA, 356 bp, Mus musculus
  misc_feature (271)..(271): n is a, c, g, or t
ggagcagcaccgaaggccagaaattaaattcacagcccgggaccccgacgacccaaggactagggaaaaagtcacttcccattccagctcgatcaatcttccttccatgcgattgattaatagaaaacgaagtgaaaagaccgtggtcgctgtgcgtctgggaaggaagcgaagggcagagtggccattgttgaagcaattagcgagagacaataaccaccgagatgcgtttaattcgattccgtgcacgctgcaatccccgcccgggctntgcgatatgcaggcctgggataacccggagggtctggttgtgaagctgaaatacagagaagagagcaaaatcaaaccgcggtgga

SEQ ID NO: 7682 - DNA, 260 bp, Mus musculus
tagacaacaatctgctcggagacgacctcgtgttgccagggttaccccacttgcacaccttaaccctcaacaagaaccaaattaccgacttggagtacctccttgatcacctggcagaagtgacaccatccttagagtacctcagcctcctgggaaacgtggcatgtcccaatgagctggtcaacttggagaaggatgaggaagactataagagatacaggtgctttgttctgcacaagctgcccaagttgaagtttctg

SEQ ID NO: 7683 - DNA, 556 bp, Mus musculus
  misc_feature (271)..(271): n is a, c, g, or t
  misc_feature (273)..(273): n is a, c, g, or t
  misc_feature (276)..(276): n is a, c, g, or t
  misc_feature (287)..(287): n is a, c, g, or t
  misc_feature (293)..(293): n is a, c, g, or t
  misc_feature (295)..(295): n is a, c, g, or t
  misc_feature (298)..(298): n is a, c, g, or t
  misc_feature (317)..(317): n is a, c, g, or t
  misc_feature (324)..(324): n is a, c, g, or t
  misc_feature (327)..(327): n is a, c, g, or t
  misc_feature (331)..(331): n is a, c, g, or t
  misc_feature (339)..(339): n is a, c, g, or t
  misc_feature (341)..(341): n is a, c, g, or t
  misc_feature (360)..(360): n is a, c, g, or t
  misc_feature (366)..(366): n is a, c, g, or t
  misc_feature (398)..(398): n is a, c, g, or t
  misc_feature (437)..(437): n is a, c, g, or t
  misc_feature (465)..(465): n is a, c, g, or t
ttgacgctcagctccagagcaaagagttttaccagcccaagcccaaccccaaccccaagctggaggaaggctatcctgctttcagaagaccctacatgactgccctagacttgggagtccctggcttcttcccgccacaagaacgggtaactactaggaaggatgacggcaggtttaccaccacctgccattatgcttacccagcatccctggcgctgtacctggcccagcaagacccctactggcttcaccagagggccgacttcccatncntcntggaaccggancggcancntgntccagaagtgggcaaaggntaccttntantccntggctgtntntgtgaccatcaccagagantcaagntccccatcttgaataggtggggccccttgatnccattttaccagtagacgtgtgagaatacccgctgtttnaacgtatgaaggaattccatgccaatgntcacagagaaagcaccaaaaaataaactgggaaagatgttccttatgcgaaggggtattgtttcatagtcccggcctcatctcggagggaa

SEQ ID NO: 7684 - DNA, 476 bp, Mus musculus
  misc_feature (147)..(147): n is a, c, g, or t
  misc_feature (151)..(151): n is a, c, g, or t
  misc_feature (154)..(154): n is a, c, g, or t
  misc_feature (180)..(181): n is a, c, g, or t
  misc_feature (184)..(184): n is a, c, g, or t
  misc_feature (186)..(186): n is a, c, g, or t
  misc_feature (190)..(190): n is a, c, g, or t
  misc_feature (238)..(238): n is a, c, g, or t
  misc_feature (256)..(256): n is a, c, g, or t
  misc_feature (266)..(266): n is a, c, g, or t
  misc_feature (268)..(268): n is a, c, g, or t
  misc_feature (277)..(277): n is a, c, g, or t
  misc_feature (279)..(279): n is a, c, g, or t
  misc_feature (340)..(341): n is a, c, g, or t
ggaaagtgcattttgtgtgcacaaagagaaggaaagtctcaagagtatggcctttctgcataacttatcgtggcacaactattgtgacaccgtggaatcgtttctgcctctcatttcttcaaggaagactggaattaaattcctttntgantcnttgaagataatgttggatattgagannaananaatngcatcagagatatgtggtgaaaggaatcagtctgtttgtgagaacaantcacctcctccccaaatntcagatgttntntaccacgtntnttggagatggcccctgatcgatttttattggtccactgaaactataactcaggaagttacnncacacgtataataatgaatattaaaaggctgatgtggatgccagttcatcttttttcctcccagagtatccctgaatggattcacactgtgtttcacagctactcccacattccttatacgccatattcctcaaa

SEQ ID NO: 7685 - DNA, 199 bp, Mus musculus
  misc_feature (50)..(51): n is a, c, g, or t
  misc_feature (63)..(63): n is a, c, g, or t
  misc_feature (67)..(67): n is a, c, g, or t
  misc_feature (77)..(80): n is a, c, g, or t
  misc_feature (86)..(86): n is a, c, g, or t
  misc_feature (95)..(95): n is a, c, g, or t
  misc_feature (102)..(102): n is a, c, g, or t
  misc_feature (126)..(126): n is a, c, g, or t
  misc_feature (133)..(136): n is a, c, g, or t
  misc_feature (144)..(144): n is a, c, g, or t
gccaacaccagggttcggcatcaattccagatacccacggggcatgaaanntccgtggatcantttntcctgaggannnnaaaggncagattaantaggttntaaaacctgaagataaaatgtgangataaannnnacgggggnaagaagatcttgataataagaatgggaagtgtaatatctgtgagttagcattaac

SEQ ID NO: 7686 - DNA, 328 bp, Mus musculus
ggatccatcatgctagctcctgagagttcacagcttctctgcggtagtccgggtcctcccgcttctctcagactgcctctccccacctctgcctttactttgaagaccagatacccagctggctcagccacagagttcatacttcttcatggcaacaaagtagcggatgaaagtctctcccagagcctgcttcagacactcatcttgctccagggcggcaagggcatcttccatcttcaaagggatctcggaaggttctggttgatagagatcctgactctcatcggaaccagccgcagcaccatcactgctctgaagaccatccaag

SEQ ID NO: 7687 - DNA, 470 bp, Mus musculus
  misc_feature (263)..(263): n is a, c, g, or t
  misc_feature (268)..(268): n is a, c, g, or t
  misc_feature (286)..(286): n is a, c, g, or t
  misc_feature (340)..(340): n is a, c, g, or t
  misc_feature (353)..(353): n is a, c, g, or t
  misc_feature (358)..(358): n is a, c, g, or t
  misc_feature (368)..(368): n is a, c, g, or t
  misc_feature (371)..(371): n is a, c, g, or t
  misc_feature (394)..(394): n is a, c, g, or t
  misc_feature (405)..(405): n is a, c, g, or t
tagagtggtcttccctgatccagggacctgctaggctactagtccttcctcgtctcttctataatgagccatgacagctatgcacgtccagagcttccagcatctgcttctactagcacatgcagagagcgcaccgcaaaatgaggtcaactgggaggaatgcagagaccagatgtggaactaagaggaagaaaaacacacagacacagaataagactgtcaggatctccagcagctcgctctccaccagcttcctcgccagntcagnatccgctgatagcaggtngtgggcaatgaccaggccccggtgctgcacggacaactggtcatgcaggcaaanccgctgtaggatntccanccactgggtngtntgcagagtggaagctgaagaatnagtgaggaggnagaggaaagacttttcttaagaaaaacaaaaagtatcagccatgcccacagctaagtaacttgat

SEQ ID NO: 7688 - DNA, 527 bp, Mus musculus
  misc_feature (175)..(176): n is a, c, g, or t
  misc_feature (232)..(232): n is a, c, g, or t
  misc_feature (344)..(344): n is a, c, g, or t
  misc_feature (456)..(457): n is a, c, g, or t
  misc_feature (460)..(462): n is a, c, g, or t
  misc_feature (465)..(466): n is a, c, g, or t
  misc_feature (468)..(470): n is a, c, g, or t
  misc_feature (477)..(477): n is a, c, g, or t
  misc_feature (481)..(481): n is a, c, g, or t
  misc_feature (491)..(491): n is a, c, g, or t
  misc_feature (493)..(493): n is a, c, g, or t
tgatcacccctgagttatggatataaaaacactggtaagaggagaaatatttttgagccttttacataaaacctccacgactttagcaccatgcgatgaagtagaagtgtgggtcccacggtgattaaccagattttataggcaatgtttcaaacaagcaccaggctgtgtgtcnncagctattgttgggatgatttcattaggttctctgataaataatgcaggctctaangatgcatttcctctttaaaaaaaaaaacccacaatggaaactccatttcataaagcaaagaagaactatggcatctgtttaatttttattacttttaaattaatccgtaagntcttaagaagtggataccgacttgaaaggggagaataaaagggaggggaaaggtttacctgtttaaaaggtgaactcatgccccggtgagtggaaaatggatttaggtcaanngcnnncanngnnnccccacnttcntccatcgagntntttccagatcacaaaaggaaagcggtcctgccaa

SEQ ID NO: 7689 - DNA, 493 bp, Mus musculus
  misc_feature (442)..(442): n is a, c, g, or t
  misc_feature (444)..(444): n is a, c, g, or t
  misc_feature (449)..(449): n is a, c, g, or t
aagtcatacagcctcttggtgcactgctctgtgcatctccaagactcagtcagtattacattgactgattcacttggtttgtccccaccaagactcccttacacagtgaaaatgagcacatgccttccctagactggcttcattatggactggaggtttgacttagtagtcacctacagcccaaatctgctctgttcttgtttcccatggcaggacttgtgggactcacttgatggtcatgattgtagatcgtgatgcacagtgcagtgattggctcacgacagctcagccttcttgccacatgggagcttccttcaatatgacttggtgctcaaccacattttgggccaacagatgccaggcctttccccaaagcacagctttgtcagtctctcagccatcttttggtcttcaataaggaaataccaatggtacctggctntnttggnggctgactgcagctgccccatgtttccctactctaaactcagac

SEQ ID NO: 7690 - DNA, 428 bp, Mus musculus
  misc_feature (357)..(357): n is a, c, g, or t
  misc_feature (393)..(393): n is a, c, g, or t
  misc_feature (403)..(403): n is a, c, g, or t
aactccagtgacttcccgaaatgcaaggtgtctcgctaactataaggattgattgcaggtggggataataatgaagtgccttctccagggcccggggattaggaaatcagccctgaaagtgagagactctgctacagggacagatggagaggccaatagtgactcctcaacaacaaggagcctaaagataacgccaaaagaagggctacaccaagtgactggctccagtggaccccaggaaatcacacgggacactaggactaggcttcactacagaggacacacactccctgagggcaatggggagagtggactccttccttggcttatatggactgctgttatccttacagatgnttcgtgcagagctgtgcaaggttttacaggccagtnttttaatatntactacccataggtcttttgtttgt

SEQ ID NO: 7691 - DNA, 410 bp, Mus musculus
acactctggacttctactgtcaggaaaggctgcaagctgtggaactcatgaaccagccactggacaaagttctggagcaggctggccgccactcgtgggtagacatcacccgacccccaactcctcgaactcagggcttgaaaacgcctcctcctgaccccattggcacatataccccagcgtgtgctaaggccttgtttgaagccaagcgcttgttgatggagtccaaagacatcttaacagagatggcaaagaatgaggtggacattcaaaatcaacaacaggagataagcaaccgtgtatgctcctcgctggcacagaagatgcgtgagaccttggagttgaaggaaagaatgaccatgactttggggctaatgagggggactatccaccggtgcatgaaattcaat

SEQ ID NO: 7692 - DNA, 415 bp, Mus musculus
  misc_feature (206)..(209): n is a, c, g, or t
  misc_feature (211)..(213): n is a, c, g, or t
  misc_feature (215)..(215): n is a, c, g, or t
  misc_feature (217)..(218): n is a, c, g, or t
  misc_feature (220)..(223): n is a, c, g, or t
  misc_feature (225)..(227): n is a, c, g, or t
  misc_feature (234)..(234): n is a, c, g, or t
  misc_feature (237)..(237): n is a, c, g, or t
  misc_feature (245)..(245): n is a, c, g, or t
  misc_feature (248)..(248): n is a, c, g, or t
  misc_feature (256)..(256): n is a, c, g, or t
  misc_feature (259)..(259): n is a, c, g, or t
  misc_feature (262)..(262): n is a, c, g, or t
  misc_feature (264)..(264): n is a, c, g, or t
  misc_feature (272)..(272): n is a, c, g, or t
  misc_feature (278)..(278): n is a, c, g, or t
  misc_feature (284)..(284): n is a, c, g, or t
  misc_feature (294)..(294): n is a, c, g, or t
  misc_feature (305)..(305): n is a, c, g, or t
  misc_feature (321)..(321): n is a, c, g, or t
  misc_feature (346)..(346): n is a, c, g, or t
  misc_feature (367)..(367): n is a, c, g, or t
  misc_feature (383)..(383): n is a, c, g, or t
cttttatctgaacgtgacgggccctcctccgcctgaggacactgagctccaggtcacgttccgggaagtgatgaatcggacgccggcggagccggaaatgatccagccctggagccccagcctaggcgaactacttaccaacccccaggctctgacgcttggcaacctattcctgctcgcggccaccgctgcacttgggtctgccnnnntnnntntnntnnnntnnntttctcnatngctgaganttncctggctnggntancnggccaacntttgtnaccacntcaacagctntagcatttaantgttaatttctcccancaacaggacacaaaagtaattgagnatggccatgaacttctcatcntcctgccttcaacttncaggtgatacagattctaggtgtgcatcacac

SEQ ID NO: 7693 - DNA, 213 bp, Mus musculus
taaggacgttacgtacttccgtgatatgccgggggctcacgggtacctggcacgaatacggccagtgcaacccaaacacggtgggaccttttcctgcgtgatcctgcacgaccagcgccccctggcgcggctctacttttatctgaacgtgacgggccctcctccgcctgaggacactgagctccaggtcacgttccgggaagtgatgaatcg

SEQ ID NO: 7694 - DNA, 502 bp, Mus musculus
  misc_feature (91)..(91): n is a, c, g, or t
  misc_feature (152)..(154): n is a, c, g, or t
  misc_feature (393)..(394): n is a, c, g, or t
  misc_feature (401)..(401): n is a, c, g, or t
  misc_feature (414)..(414): n is a, c, g, or t
  misc_feature (433)..(433): n is a, c, g, or t
  misc_feature (471)..(471): n is a, c, g, or t
  misc_feature (473)..(473): n is a, c, g, or t
ggctggacccatgagaaacagatggggagcagcgtcaaggaaaggctccggcctgagctaagtcagctggaccaagatgcagacgacctgnaggaagaagaagctgccagactcccagtgacctccccggacgggctcctgatggaaggagnnnagcagcccagtcccggtcagggccctttcttctacattggaggcaccaacggagcatcaataatcagcaactactgtgagagcaagggctggcaacgcactcaggacagccactgtgaggactacaagctaaagtggtgtgagatcaagtgcagggacaactactgcagctttcgggaaggccagcagttgctgttccagctccccaacaacaagcttcttacgaccaagatcgggttnntcagtgntctgcgggagcangcacgcactttgagcaaanccaggatgctgcccagtacccaaaccaagtgagcccantntaccagccccagaggcacgcccacttcta

SEQ ID NO: 7695 - DNA, 365 bp, Mus musculus
  misc_feature (57)..(59): n is a, c, g, or t
  misc_feature (298)..(299): n is a, c, g, or t
  misc_feature (306)..(306): n is a, c, g, or t
  misc_feature (319)..(319): n is a, c, g, or t
  misc_feature (338)..(338): n is a, c, g, or t
agaagaagctgccagactcccagtgacctccccggacgggctcctgatggaaggagnnnagcagcccagtcccggtcagggccctttcttctacattggaggcaccaacggagcatcaataatcagcaactactgtgagagcaagggctggcaacgcactcaggacagccactgtgaggactacaagctaaagtggtgtgagatcaagtgcagggacaactactgcagctttcgggaaggccagcagttgctgttccagctccccaacaacaagcttcttacgaccaagatcgggttnntcagtgntctgcgggagcangcacgcactttgagcaaanccaggatgctgcccagtacccaaacca

SEQ ID NO: 7696 - DNA, 486 bp, Mus musculus
  misc_feature (129)..(129): n is a, c, g, or t
  misc_feature (362)..(362): n is a, c, g, or t
  misc_feature (374)..(374): n is a, c, g, or t
  misc_feature (403)..(403): n is a, c, g, or t
  misc_feature (406)..(406): n is a, c, g, or t
  misc_feature (408)..(408): n is a, c, g, or t
  misc_feature (448)..(448): n is a, c, g, or t
  misc_feature (450)..(450): n is a, c, g, or t
  misc_feature (456)..(456): n is a, c, g, or t
gtcacagcttctaccaccaagtagacactgagacatgacagcatcgttactataaggtgacccttctctagttttcacctccgatataaagcccaggaagactgacgccaggaatcttaccatgccagncagaatactgaagataattcatatctccatttatcattcattagaatagaactcaaatctcctaaattacaggaaaggcaagaaagcacttctcggatattgggccaacacttcaagaaagaaccattgtataaaagaggacactagtagcctgtgttttcaagttgttacgtagattcttcgtcatccacttagcagcctcattcaagaagacagttggtagccttggaagncctgccggttgnatggctgtacgaggactggaatcctgtgntgntnttccttgagcagagtgactgtcatacttggaagactgacntnaatgtntacgggttgctcaccattgtcccaatgaga

SEQ ID NO: 7697 - DNA, 471 bp, Mus musculus
  misc_feature (342)..(342): n is a, c, g, or t
  misc_feature (344)..(344): n is a, c, g, or t
  misc_feature (360)..(360): n is a, c, g, or t
  misc_feature (372)..(372): n is a, c, g, or t
  misc_feature (383)..(383): n is a, c, g, or t
  misc_feature (446)..(446): n is a, c, g, or t
gttttcatgtctttcgtaccagttgtaacctcaaaagccacaaaagaattcacacagggggtgaaaatcaacatgaatgttctcagtgtggaaaagccttcagtacaaggtcctcgctcactggacataatagcattcatactggagaaaaaccatttgagtgccaggagtgtgggaaaaccttcaggaagagctcatatctaacccagcatttaagaactcacactggagagaagccctatgaatgtaatgagtgtggaaaatctttcagcagtagtttttctctaactgtacacaagagaatacatactggagaaaaaccatatgaatgcagtcactgtngnaaagcttttaataatntctcagctgtgnaaaagcacttnatgactcatactggacaaaagccctatggatgtaaccactgtggaaaatcttttaccagtaantcctacctgtctgtgcacaaaagag

SEQ ID NO: 7698 - DNA, 267 bp, Mus musculus
  misc_feature (137)..(137): n is a, c, g, or t
  misc_feature (156)..(156): n is a, c, g, or t
  misc_feature (170)..(170): n is a, c, g, or t
  misc_feature (172)..(172): n is a, c, g, or t
  misc_feature (181)..(181): n is a, c, g, or t
  misc_feature (189)..(189): n is a, c, g, or t
  misc_feature (205)..(207): n is a, c, g, or t
  misc_feature (211)..(211): n is a, c, g, or t
  misc_feature (224)..(224): n is a, c, g, or t
ggacgaagatcaacatcctccaccaagagtgggaagtttatgaaccccacagaccaagcccgaaaggaagcccgaaaaagagaactgaaaaagaacaaaaaacagcgcatgatggtccgggctgcagttttgaagantgaaagaccccaaacaaanttatccgggacatngnagaaattgngatgaaantggagtttaacccagnnncagncagccacagttgnaatgagaaagtactgaaagacaagcgaaaaaagctgcgggaaa

SEQ ID NO: 7699 - DNA, 527 bp, Mus musculus
  misc_feature (63)..(63): n is a, c, g, or t
  misc_feature (65)..(75): n is a, c, g, or t
  misc_feature (154)..(154): n is a, c, g, or t
  misc_feature (190)..(190): n is a, c, g, or t
  misc_feature (256)..(256): n is a, c, g, or t
  misc_feature (417)..(417): n is a, c, g, or t
  misc_feature (424)..(424): n is a, c, g, or t
  misc_feature (427)..(427): n is a, c, g, or t
  misc_feature (452)..(452): n is a, c, g, or t
  misc_feature (487)..(487): n is a, c, g, or t
atttgttgcactttggcatggcgcatttgttctgaattaaatgagattgttttaaacttcaanannnnnnnnnnnaccagcaggatgtgccagttaatagccaagacttgttcatttgcaaagtctgctgacagtgctatttatatagtgatcnttttatcacagaaccagtaagtgggacatgattttngttccttcaagaagccaatgtagattgtaaaagtctcctaagtatactaacatttcacacaaaacntgccatagttttttgaagggggtgagggaaaagcttcaatttaggttttattttttcaatattaaattttccatcttgaatattggtacctcagtgattagtggatgaaaagtgtagggtggaatttgtcttatgatgagtaaagatgacaattaaattgngtctgcnagngcctgtgtagataagtattcttgtncttcatctctagtttttgaatgcatgctctttttnctttttctttaatacctttgcaagcaaacttggtttttat

SEQ ID NO: 7700 - DNA, 525 bp, Mus musculus
  misc_feature (214)..(214): n is a, c, g, or t
  misc_feature (253)..(253): n is a, c, g, or t
  misc_feature (262)..(262): n is a, c, g, or t
  misc_feature (269)..(269): n is a, c, g, or t
  misc_feature (285)..(285): n is a, c, g, or t
  misc_feature (460)..(460): n is a, c, g, or t
  misc_feature (464)..(464): n is a, c, g, or t
  misc_feature (470)..(470): n is a, c, g, or t
ggaactttgtgaccaacactcacctaggctgcgtcaatgaccggaaggagcagctcaggcagctgttccgatcccttcaagcgcagaggaaagcccctagctgacccccagtcagaagaaatgaggccctggcaggtgccgccctggcctctggcagcgcgattccagcacagcgcacctttttccagtcttcacctttttccagcgtggcagntgtttcactggacaggaccagcttgtacttggaccagantccctggantccccantccagccctgtgcatntttgaaccaggaacagccaatctttggaactgggtgggcttatccttgactgattggcaactgggcccaaagaggccaagcagcaagttccactgctcagagagcacgtctaataccacatctaataaagcacaggcttagagctactcggcactgggcgtagcttgggatgctnctgnacgttntgatgtctctttatcatgggtccggtgtgctgagaaactcgtcacagaggtctgg

SEQ ID NO: 7701 - DNA, 554 bp, Mus musculus
  misc_feature (192)..(192): n is a, c, g, or t
  misc_feature (194)..(194): n is a, c, g, or t
  misc_feature (208)..(208): n is a, c, g, or t
  misc_feature (211)..(211): n is a, c, g, or t
  misc_feature (438)..(438): n is a, c, g, or t
  misc_feature (492)..(492): n is a, c, g, or t
atagaagtctgccagccaactcgtcagattggtggagcagactgttgtacatggataattttacaaactcttgagtctgcagtactgagaaaccagatttatgtcggaatcacagaagcatggtgtgtttctttggaaggctttatacttgttactttgctgtaaggggataaaaacaggatataaagtggntntggtttggggtttntcnttggtagtgtcgggtgttttctgttgtggagaacagcactagatgtagaaagtttctcctcaagtacaacatggaacaagattagacaactgtctgttttactgaaatcagagaaacttgtttgcttttctgtatctggaaactaaatgcaatgttacctttcatacgcaatcatggatacacttagttccatcattaaatttttatggggaagatagcaggatgtnaaatccattgtttgtagaaactggaaaaggaatctacaggcctgttttcacaanttcggcagcgcagacaatgaggacagcactggcagctgaggagcacctttgcgaaactgcag

SEQ ID NO: 7702 - DNA, 508 bp, Mus musculus
  misc_feature (240)..(240): n is a, c, g, or t
  misc_feature (319)..(320): n is a, c, g, or t
agtcatgctattcttacacctgctattttatacttaaaatggccacatattttcaagatatttttgttatgctcaggaacctcttgtatattttactatttaaaaagcattatttttaaatagcatatgtctccaatttctatcaacaagaaggaaatgtacctggggaggcagcttgtttgtaaagaaatagtgttacccttttacaatgaactttgcacactgggtttataaacttgnttctacactgtaaacataattcatttttaaaataaatgcttagcagcttccataaggatagactgacatgctagatatnnagaatattatagtatagttcgcattgaggttctgtagtagtttttaagaaatgataacacaattcctatgtgaaacacatgccttgaatagtagaataattgggccagcaagaaggttcagcaggtaaaagtgcttgccgctaagcctgaagacctgtttaaggtccaggacccacgcgttagaaaga

SEQ ID NO: 7703 - DNA, 542 bp, Mus musculus
  misc_feature (235)..(235): n is a, c, g, or t
  misc_feature (239)..(239): n is a, c, g, or t
  misc_feature (260)..(260): n is a, c, g, or t
  misc_feature (398)..(398): n is a, c, g, or t
  misc_feature (410)..(410): n is a, c, g, or t
  misc_feature (419)..(419): n is a, c, g, or t
  misc_feature (430)..(430): n is a, c, g, or t
  misc_feature (435)..(435): n is a, c, g, or t
  misc_feature (444)..(444): n is a, c, g, or t
  misc_feature (447)..(447): n is a, c, g, or t
  misc_feature (451)..(451): n is a, c, g, or t
  misc_feature (474)..(474): n is a, c, g, or t
gcaagcggagaagttcccctcagaaccaaaccggttactcctcttgcatgggttcttggatgagaatgttcactttgcacacaccagtatattgctgagttttttagtgagggctggaaagccatatgacttacagatctatcctcaggagaggcacagcatcagagttcctgagtctggagaacactatgaactgcacctgctccactaccttcaggagaaccttggatcgcgnatcnctgctctgaaagtgatataantctgacgcatgtagaacttggtgtacactgtctaaccaaacaaagagggttagccaatagagaagccagagttgatgaacctacttttgtacctgccacataagatctatttctgaaagtaaatttggtgccatgcangaaatctgcagnttcatggantagtactctanatacnttaaccatngcncatnaaactgagtgacatgttcccaanggattgaacagtacctgaggatactgaaggaatcaaggcaccagcgccaatattcagactagcctact

SEQ ID NO: 7704 - DNA, 520 bp, Mus musculus
  misc_feature (200)..(200): n is a, c, g, or t
  misc_feature (210)..(210): n is a, c, g, or t
  misc_feature (229)..(229): n is a, c, g, or t
tccatgtgaggtgatttcttctatttgcagattccaataagtattgcaccccttcccaaatgtccctgagcccctcaaaaactgatgtcattcagtggggaaaaggaggctcaaggttggctttttccatcgctacatttattgcttggataaaattattatgggattcctgcctaaagacaagcttttaaacataaacngtaaaataantaatagccttttgaggaancaatatgcttgtgtattgaattatataacgaaaaactatttgcttctcattgtaacacttatgcaaaagactattattgcagttgctcttacgagcttcataaactgtgcaagagattgttgtcttaactttcagcagtgtcatgaaccattggtgactgattgtactatgctacgctgttaacatctgtatagctgcgacatgtttccccaaagatctttatagtgctgcgcatccagggtaatggccttgtgcttgcaaaaggccagctagggattgcggcactttctg

SEQ ID NO: 7705 - DNA, 263 bp, Mus musculus
tacaatgcctggtcccatcgcatctgggttttacagaacgtggccaagctggatctgaaggcggcacgttttctaccttcagcatcacttaaatggcaggctccctcccaacctgactcacctgtcacctgcagactgccctgggggcgctttgaatgactcgctccagattccaacaagccctcaactatctcaggcaatggaagtggacggactgagtgactctagcaagcaaggctattcccaggaaaccaagcgcctga

SEQ ID NO: 7706 - DNA, 559 bp, Mus musculus
  misc_feature (91)..(94): n is a, c, g, or t
  misc_feature (271)..(271): n is a, c, g, or t
  misc_feature (291)..(291): n is a, c, g, or t
  misc_feature (324)..(324): n is a, c, g, or t
  misc_feature (328)..(328): n is a, c, g, or t
  misc_feature (332)..(332): n is a, c, g, or t
  misc_feature (339)..(339): n is a, c, g, or t
  misc_feature (351)..(351): n is a, c, g, or t
  misc_feature (364)..(365): n is a, c, g, or t
  misc_feature (432)..(432): n is a, c, g, or t
ttattttgttaagagccggcattcctttgggtatgagataatcgtatagttccttcctactaaatagagtcttaattcttttttttttttnnnntcctctttgacccatggctctctaggtccatccttgggcttctcatttgtctcttgagattggcttacatactttgctcacctctgttcagttgctacatagatagtttctttaaacattgaacatttattttgcagttcagcttaagaatattaatccacccgcagaagcacttgncgctgactgcagttctgagnaacacaatggctacacgggtggatgggaggacntcanccanttccctntcaagcgtgttntcccgttatccanntcagaaccaaagccaggagggttggaatttatatagaaaaaaaaaataaattgcttccaatgtaatntattttttaaatgattatttaaaagaaactaaactaatttaagagtttatgtaattgtagtactgaaaaattatttttattactagttttgatagattgtttttacctcgcatttggtatatgccaa

SEQ ID NO: 7707 - DNA, 413 bp, Mus musculus
  misc_feature (102)..(102): n is a, c, g, or t
  misc_feature (105)..(105): n is a, c, g, or t
  misc_feature (112)..(112): n is a, c, g, or t
  misc_feature (114)..(114): n is a, c, g, or t
  misc_feature (120)..(123): n is a, c, g, or t
  misc_feature (127)..(127): n is a, c, g, or t
  misc_feature (130)..(131): n is a, c, g, or t
  misc_feature (134)..(135): n is a, c, g, or t
  misc_feature (137)..(137): n is a, c, g, or t
  misc_feature (171)..(171): n is a, c, g, or t
  misc_feature (180)..(180): n is a, c, g, or t
  misc_feature (185)..(185): n is a, c, g, or t
  misc_feature (188)..(189): n is a, c, g, or t
  misc_feature (199)..(199): n is a, c, g, or t
  misc_feature (230)..(230): n is a, c, g, or t
  misc_feature (248)..(248): n is a, c, g, or t
  misc_feature (262)..(262): n is a, c, g, or t
  misc_feature (283)..(283): n is a, c, g, or t
  misc_feature (354)..(354): n is a, c, g, or t
  misc_feature (367)..(367): n is a, c, g, or t
acttacattacatgctctcatccaaaggccatgctatccgtcatggttcataagagctcatggtccaccaattagctgaagttctaattcagtgaccttagntgnatccagntnaaaacnnnnacanacnnacnnanactatgctacccagttactccaaagaaagatttntcagaagcnacagnatnntcacaaacantcccacatacacacacacacaagttaggggnaaatttccttaggaaatntatttttacttttntattatttttaaataaaaatntgatgtttgtccagtcataatttttattaaagaagacagtggagagggttccatgtaatttgtttagtctntcgtaaataaatnttcactcctagtgatgtagaaatggcctcattcactttaattctgt

SEQ ID NO: 7708 - DNA, 559 bp, Mus musculus
  misc_feature (111)..(111): n is a, c, g, or t
  misc_feature (114)..(114): n is a, c, g, or t
  misc_feature (124)..(124): n is a, c, g, or t
  misc_feature (152)..(152): n is a, c, g, or t
  misc_feature (230)..(230): n is a, c, g, or t
  misc_feature (281)..(281): n is a, c, g, or t
  misc_feature (299)..(299): n is a, c, g, or t
  misc_feature (314)..(314): n is a, c, g, or t
  misc_feature (327)..(327): n is a, c, g, or t
  misc_feature (329)..(329): n is a, c, g, or t
  misc_feature (353)..(353): n is a, c, g, or t
  misc_feature (396)..(396): n is a, c, g, or t
  misc_feature (441)..(441): n is a, c, g, or t
  misc_feature (445)..(445): n is a, c, g, or t
  misc_feature (447)..(447): n is a, c, g, or t
  misc_feature (451)..(451): n is a, c, g, or t
  misc_feature (476)..(476): n is a, c, g, or t
  misc_feature (478)..(478): n is a, c, g, or t
  misc_feature (505)..(505): n is a, c, g, or t
  misc_feature (507)..(507): n is a, c, g, or t
  misc_feature (509)..(509): n is a, c, g, or t
aataacagggcaagacattccaaagtgaaatgctaggtgaggaagagaaggtactgatagacaatagaagacaagccaagtaaagacaaaagttatatgtgatcagaagantgngaagaagaanaggagaaccaagtggattgtagcccctnaaacgatcattaaaatttaagaggcagaggtgaaatcagagaaatagcagtgaagatcagggtgttcaagactgatgntgcagctgtgatgatgaacgcagaccaaagattgaattaaatccgcaaatnatcggtaaaacataccanaccactggatgtttntgtgagagtgttncntgggaagatcaagcagctagtgantccggcgctgactatgggtaatactatcccataagctaagggntccaatatgattaaagacctaaggaaaaggcttatgcatgaattntttntntaantcctaaccaatattatttgacctgntntccagcacataccatgctagaataaantntnttaagccatgagcctgaagcactgcttcccttacattgtcaagtcatgta

SEQ ID NO: 7709 - DNA, 424 bp, Mus musculus
  misc_feature (323)..(323): n is a, c, g, or t
  misc_feature (335)..(335): n is a, c, g, or t
  misc_feature (347)..(347): n is a, c, g, or t
aaagcttaaagctcaccctcagtgtgttttcatttcccggaacttccatgctggctatttacaatcacagacggagaaaagagaaaaggaagaagcagaaaaaaaagctgtcagaagtcactctaaagttgaattctgcctccaggatcccatcagctgtgagtcccctgaggtgacctcagtagcaaatggcagcagtgtgtcaacattgagcttatcaacatcaatctctagttcttactgctgccagaccgtagaagaagccgaagactggcttactgatgattgtctagaaaccaggattcccttaaagaatcctttantcggggagcctntaaaaaagaagntgcttgcgtacctgtcatccatttcattagaagagtggcctgggaacacagtgagcaacacattttgtagcgagcaa

SEQ ID NO: 7710 - DNA, 508 bp, Mus musculus
  misc_feature (154)..(154): n is a, c, g, or t
  misc_feature (214)..(214): n is a, c, g, or t
  misc_feature (221)..(221): n is a, c, g, or t
  misc_feature (224)..(224): n is a, c, g, or t
  misc_feature (232)..(232): n is a, c, g, or t
  misc_feature (255)..(255): n is a, c, g, or t
  misc_feature (348)..(348): n is a, c, g, or t
  misc_feature (403)..(418): n is a, c, g, or t
  misc_feature (451)..(451): n is a, c, g, or t
aggagaactctcctggtcatgggaaggcatcggagcacagaggccgagtcagcaacttgctgcacaagcctgagttcccagatggcgagatgatggaagtgctcatctagcgtcgtcctgtggcgcttgccagcatgctgacagatgagaacangaggctgaaagaagagctccagatgggcagttgcagtagcaactgcaaaaccaggacagntgtggantcntcacaatnttaccaaaacagctggctcactntctgcagagggagtgagagaggacgcatgtaggcttggaagcagagtagagaaggaggaggagtggaattttccattgtagagaaattgtatntcttagggaggctccatgcttccccattcttggcttataaacagatgaagaagannnnnnnnnnnnnnnnaatccccttgttccctttgccttttagcaggtntggtttaagaagaatctgctagaaatcctgaaagcccatctcggcataatggtgtgt

SEQ ID NO: 7711 - DNA, 519 bp, Mus musculus
  misc_feature (280)..(280): n is a, c, g, or t
  misc_feature (331)..(331): n is a, c, g, or t
  misc_feature (359)..(359): n is a, c, g, or t
cctaacacttcctcttcagatagaacccctccggccttcttatttttcttccagagaattgatatccttaaagagtagtagtagtttttaactcaatttctagctattttaatgtttacctctacttcctaactttgtttttccttaaaaaggcctccaaactgtacctttggaaggaaagggggtacagagcctaagcacctgtcatcaatccagtggttttgtataaactacaataaaatacaacagccgtgttgtaacctgttttcaaagtagcttntggtgatgaactgacagttttaaaagaaaattttcattgtgagattaaggntcccaacctatgaggaaataaatttatnttaaagcaatatgcgctccgcttctggttaaatagtagccaggaggggctggcaagatcattcagcatgaaaggtagttctcagggtccacgtgttagatggtgagaaccaactcctgccgtcgcctctgctctctacatgctgttcacgccacacataa

SEQ ID NO: 7712 - DNA, 514 bp, Mus musculus
  misc_feature (49)..(49): n is a, c, g, or t
  misc_feature (77)..(77): n is a, c, g, or t
  misc_feature (114)..(114): n is a, c, g, or t
  misc_feature (156)..(156): n is a, c, g, or t
  misc_feature (331)..(331): n is a, c, g, or t
tttaattcagtcatcccaagcacgcctaacatgagagcaaataaaacanttaacaataagtacaataacatctttcnacaaaaggcacagacattggactccaagttcagaaantttcctccccagagccattttttgaacaagactgctcccagnactcaagccagtacagcagccgcaagtaggaagggagccccaagtgcgacccagactcacccacatggtaaaaaaccagaaggagaggatcggagaaaacagctggaagaatggcagaaatccaaagggaaaacctataaacgacctcccatgaaatttaaaacaaaaagaaaantcatagaggaaatgaacacttccttctggaagagcattgaaagggaagaagaagaaaagaaagcgcagctggagctgtccaagaaaatcgacagcactctgacagagtgtctgaggctcattgaagagggtgtacttcctaatgaaatattcaccatagtatccagtattcctgaggctgaaa

SEQ ID NO: 7713 - DNA, 430 bp, Mus musculus
acagtctgtacttcaggacctagagaagaggcccagcacccagtcccaggtcggagatggagatggagacctaatacgaatagaggtacccaaaacccaggagaacaagaggccgcccggcctaggctgctgttaaccgtggccagaatcagagccatctacaggatgactggagcccaggctctacagcggatatgccttcaagctggagaagcctcgtgtcttcagagcccagccattttgctttagccggtcagcagccactggctgctgaagccccatactgcccggttggttgatgggtgccagcatgagccttccctatagggtcttcagatggttgttgtgttcttaagaggcctcaagactgcaaactcgggacacctcagggctagcccacaccccttacccaatcataccaacagctgtg

SEQ ID NO: 7714 - DNA, 441 bp, Mus musculus
tcagcttgtgggtctcaaacgacaggactgtagatcagatatccagcatatcaatatttatgttacaattcagtaaaattacagttatgaagaaacaatgaaaataattttatttggggttgggggtcactacaacacagggaactctattaaagggtcacagctttaggaaggttgagaaccacgctataaaccttgctaaaggttataaatttgcagatgatagggggatggggacagaggagaatatggttacactgctcatatacaaagttctaaaaataataaatataaagacaagaatatgctgcaggcccacagatgtacctcatggagagcagcgcttgcccagagtgcacagagccctgggctgcatctttagtaccacagaaaccatgtgctatgctgctcacctctcattcagcatgaggcaggtcaccc

SEQ ID NO: 7715 - DNA, 434 bp, Mus musculus
  misc_feature (33)..(33): n is a, c, g, or t
  misc_feature (59)..(59): n is a, c, g, or t
  misc_feature (118)..(118): n is a, c, g, or t
  misc_feature (347)..(347): n is a, c, g, or t
ctctgagtgcctggatttcatttttttcccccntctgtgttcacctttttcacccttantcttttctaagagccaagttctgtcctgctcagacccaacaggaagcagcatgcccccntgttgtgtcccctcggcccctctggttcaccaggtgttccccaccttttcacaccaatcctcccttgaccttcttccctctgccttttcaccccatttccttctcctccaggggtgacctggaaccctcctcacagaagctttcatcaagtgaagtatgtgtctcatctccctgaatccactttcagaaccaaaagtagctgtcaccgttaacttccgcagaggtcaancatactagctccttcagaaatgcattcatttcaggaagagctacccagtgcctactgtgtgccactgtacttagaggcctccgagaa

SEQ ID NO: 7716 - DNA, 541 bp, Mus musculus
  misc_feature (211)..(216): n is a, c, g, or t
  misc_feature (218)..(219): n is a, c, g, or t
  misc_feature (375)..(375): n is a, c, g, or t
  misc_feature (398)..(398): n is a, c, g, or t
  misc_feature (414)..(414): n is a, c, g, or t
  misc_feature (428)..(430): n is a, c, g, or t
  misc_feature (435)..(435): n is a, c, g, or t
  misc_feature (440)..(440): n is a, c, g, or t
aataggaattggcttcggcctccgcctgcctcggggccaggccagggctttgcatctgctgcccccaaaaaactctactccggtgggagtagagtctcaggaagaggccctccagcgacaaaaatccacaatccaagaatcagttcaaatcaccggcacactcttccaggcccggagcctccggtctgtagaccttcaatcaccaaaaccnnnnnngnnttccaggtctctacttcaggaaccaagacaggtcgctgcatccccaaaggccgggccttctgtctcaaagaggtctgtgactctagggtctattctccgaaagtcgccatcttaatcccagtgcagcgaagaccctctggaacaccacctccaaantctaccttccctaccaggacttntcagaccttggagggntggctggctggaannnaggtntgttntcctgccctgaaccctgggaaccccttgtggagtttgctctcccctagttgaagagaccagaggcacccaaggcctcatttagccttcagtgtatccaata

SEQ ID NO: 7717 - DNA, 409 bp, Mus musculus
  misc_feature (26)..(26): n is a, c, g, or t
  misc_feature (45)..(45): n is a, c, g, or t
  misc_feature (52)..(52): n is a, c, g, or t
  misc_feature (58)..(58): n is a, c, g, or t
  misc_feature (65)..(65): n is a, c, g, or t
  misc_feature (76)..(76): n is a, c, g, or t
  misc_feature (82)..(82): n is a, c, g, or t
  misc_feature (87)..(87): n is a, c, g, or t
  misc_feature (92)..(92): n is a, c, g, or t
  misc_feature (208)..(208): n is a, c, g, or t
  misc_feature (243)..(243): n is a, c, g, or t
  misc_feature (248)..(248): n is a, c, g, or t
tatgggatccaccatcacaccggganatcaaggcacagcaaaganacatatntgggantcacaantcagatccttntattcnttgtnactgntccattaaaggcacagaaaagaaaacggtgccattttactgatggattcagtgcaacagatggaccatccacctgaccaaactgcagaatcgaagtatccatgcacggagatatcntcttcacagaaaattaaaaatcccacatttaaatntccanatagtcacagactctattatatgactgcaagcagttccttcctgtctgagcctcagtttctctattacaatggagagagttaaactaaacagattttccccaaaggatgccacatgcttttcggtcctcccattcagagctgacattctatgatccttccc

SEQ ID NO: 7718 - DNA, 523 bp, Mus musculus
  misc_feature (103)..(108): n is a, c, g, or t
  misc_feature (110)..(111): n is a, c, g, or t
  misc_feature (309)..(309): n is a, c, g, or t
  misc_feature (311)..(311): n is a, c, g, or t
  misc_feature (313)..(313): n is a, c, g, or t
  misc_feature (343)..(343): n is a, c, g, or t
  misc_feature (394)..(394): n is a, c, g, or t
  misc_feature (396)..(396): n is a, c, g, or t
  misc_feature (398)..(400): n is a, c, g, or t
accaggacggtgatctcgcggcagagacagcagcctccagtagctccggccttctgggccgaccgctcgtaccaccgtggcatgggtcgcccgggacgcgctnnnnnncnnggggcggaagttgggaagaggagttcccgttcctaaggcgctggcatcgctcctcctgctgcttccctgttctgacccattcccggcgacggaggatgaaggtggcgaaagatgtttggacagccgtcgctctcctccatgcttttctcctgctgctggttagcttggatggtgatggtgtcacctggggtcctggantntntgggcccgcatcctcattacccgagaattngttagaacgacacattcacgaccacacctaaacctacagaatcagaaacgncncnnntagtggggtcggtcctgaaacctggttaacaagctcccaaggtgaatctgatggccgctttccctaagcagtagagaccctttttcgtgtatggtgctgaaaatttagcgtcctctgtcccca

SEQ ID NO: 7719 - DNA, 460 bp, Mus musculus
  misc_feature (385)..(385): n is a, c, g, or t
taactctcagcactatgtgaacgctgggacagattttcttgatgtgtaataatttgggaggattctctgcgagatgtcgagatacaagctaaagtgaagattatttttgaagcttccagagccgcctaggcgggcgtaggaacacgagctggttcctacgaactccatttctgcatggaggcggccgaggctacaatgcatggtcgcgagctgctgtctatataaacactggagaaattacaaggccgttcagaataatctctggttataagtgaactacagtgatgaaggaaacgtttataaaacaacacaccagactaactccagaaaaaggaaagaaaactttgagaggaaaacctgtccaagaagaaaaatagaagtcaantgatagaaaacagatgctacaaaagttagataagtattcgtgagcactaaacccagagccttgtagttggcaaat

SEQ ID NO: 7720 - DNA, 434 bp, Mus musculus
  misc_feature (90)..(90): n is a, c, g, or t
  misc_feature (119)..(119): n is a, c, g, or t
  misc_feature (124)..(124): n is a, c, g, or t
  misc_feature (132)..(132): n is a, c, g, or t
  misc_feature (167)..(167): n is a, c, g, or t
  misc_feature (176)..(176): n is a, c, g, or t
  misc_feature (204)..(204): n is a, c, g, or t
  misc_feature (228)..(228): n is a, c, g, or t
gtactggctagatggtgggcattctggaggaagcaatacgtgggtcacatatccagaagtcttggaagaatttgctcaaacaggaattantgttcacactcatgtaacaccttaccaantacangatccaangagatcctggattggaaaggagcacaagaaatttnttcagatantcagggatttgggtatgcaagtgaccanccaaattcattttgcgaaggaaantccttccatagagaatcatttcagggttcacgaagtattctgagactattaatgtgcttgcttaatgggagaataaaattttgaatgttataaatgcagatgatgagatgcaagattaatgatgcttcatcagtttgtgggctaagaagatgcacattccaaaaatatgagtgtcaaatacagtaggattgttttgcttgttaagt

SEQ ID NO: 7721 - DNA, 93 bp, Mus musculus
acatttgtaccatatataagccaaggaatgggaaagttcagactggtcaccacttgtagcaagacagtgaatggtaagagagttgtcacaaag

SEQ ID NO: 7722 - DNA, 427 bp, Mus musculus
  misc_feature (288)..(289): n is a, c, g, or t
  misc_feature (291)..(293): n is a, c, g, or t
  misc_feature (301)..(301): n is a, c, g, or t
  misc_feature (324)..(324): n is a, c, g, or t
  misc_feature (326)..(327): n is a, c, g, or t
  misc_feature (329)..(332): n is a, c, g, or t
  misc_feature (341)..(341): n is a, c, g, or t
  misc_feature (346)..(346): n is a, c, g, or t
  misc_feature (352)..(352): n is a, c, g, or t
  misc_feature (372)..(372): n is a, c, g, or t
  misc_feature (401)..(401): n is a, c, g, or t
ggaccctccaggctgtgatcatgttcaccattgctcaaggactgggtgctgtactcactctggcgggactatatctcactgcatctgactgtgtaccaaaatacggcctccttctaatttcaggtttggccataataactctagtggaattatttggactaatttatatgaaatggcttgacccaatgataggtttccataagacacaaaagtgcaggcagcgctgtctttgttcccgagtttcacactttgtctcactggctctcaaggaatactaaatccaaccanntnnngtccagancaagatgccagacgttccaagtncnncnnnntcaccttgnttttntcatcnctgaagccagctgattgctntccaaggatactgttttgcccaaggcagntgtggactttgacattccttcaagtt

SEQ ID NO: 7723 - DNA, 383 bp, Mus musculus
gctaaggaacaattgcaggctgtcttgaaggcagataagatcttccaggagcttgaaaaggagaaaagcctcaaagtgaccagagagaaactggaaattcaggatgctcacattcagcaaatagccataaataaatataatgcaaaacaaatgaaggaagaagaattagattattggagacttactgacgcccttacagttgagaaggagaaagaatttgagaagtatgctagagaagtaattaactttgaatctgaatcaacaaagaaatacgcctaccctatggtaaaagctgtgcaggaaggagtgggaggtggacgtggaccaccctttgtaggcagaggtgggataaggccaagctatcaggcaactgatgccactgg

SEQ ID NO: 7724 - DNA, 379 bp, Mus musculus
aatctcaaggcagcgctaaacgtcaaggagaaaaagcacaggaagccatggcccgcagtcagggtaccaaaacacagttcatgcaaacaggatggaagacactcacaaggcggctcttcaggagctccaagagaaggagacagtgctggagcaacggaggagctctactggcaacccagctgtgtcctgttatgggcaccctccagccagccggtatggaccacatccacagaaccacagggccccaaacctcatggttgggtttggccagtgggggatcccagtggatttgtacgcacaggttaaagtgaggatggactctctatgtccttagcttctgtgagcttcctagccatatcccacatgctgcctttgactt

SEQ ID NO: 7725 - DNA, 269 bp, Mus musculus
  misc_feature (52)..(52): n is a, c, g, or t
  misc_feature (98)..(98): n is a, c, g, or t
  misc_feature (100)..(102): n is a, c, g, or t
  misc_feature (105)..(105): n is a, c, g, or t
  misc_feature (107)..(108): n is a, c, g, or t
  misc_feature (110)..(110): n is a, c, g, or t
  misc_feature (114)..(114): n is a, c, g, or t
  misc_feature (119)..(123): n is a, c, g, or t
  misc_feature (127)..(128): n is a, c, g, or t
  misc_feature (132)..(133): n is a, c, g, or t
gctgcgtgtgaggatcgccgagccagcgccggaagagctcgtccaccttcanctgtagccgcggcgtcagcggcgccatggcaaccagaaggcgcggngnnngangnngncacngacgnnnnngatnngggnnggagtcgggcgaatcccggaagaacgtgcggcgtataacctcagtcggccgtgggttccacgagaggctgcgttccgggtgatggcgacacgggttacgcgacaacggaaggggcgtggttgcatccgcaaacgct

SEQ ID NO: 7726 - DNA, 536 bp, Mus musculus
  misc_feature (215)..(219): n is a, c, g, or t
  misc_feature (254)..(254): n is a, c, g, or t
  misc_feature (261)..(261): n is a, c, g, or t
  misc_feature (263)..(263): n is a, c, g, or t
  misc_feature (269)..(269): n is a, c, g, or t
  misc_feature (283)..(283): n is a, c, g, or t
  misc_feature (288)..(289): n is a, c, g, or t
  misc_feature (296)..(296): n is a, c, g, or t
  misc_feature (298)..(298): n is a, c, g, or t
  misc_feature (310)..(310): n is a, c, g, or t
  misc_feature (327)..(327): n is a, c, g, or t
  misc_feature (353)..(353): n is a, c, g, or t
  misc_feature (360)..(360): n is a, c, g, or t
  misc_feature (374)..(374): n is a, c, g, or t
  misc_feature (414)..(414): n is a, c, g, or t
  misc_feature (419)..(419): n is a, c, g, or t
  misc_feature (429)..(429): n is a, c, g, or t
  misc_feature (465)..(465): n is a, c, g, or t
gatggcgatagcgatgccaacccagccttcggggcaataccgccatctgctgacgaggctaagaagaaaatacaggaaaacaagactcccattatgatctgggagattggtaagaaattcagagccaaccagagaactcactcatacaaagaaaaggaccgccacggagaggagaagtcagaaaggccaccggggaagtacggacaaagagttgnnnnnagagactgaacagatacgggatccaggcttcaaangctcttncnggaganatattctggaaatntcctnnatctacnanacagaaccaatntgaagtggcagactcgntctgagagcagagctggttttcaggntccaggntcccacagcttacntccctgagtggcagtgctgtcgagtggagggtagcaactnccatntcctggcttnttgactttggcatctagtaaagttttcaagtgcatntcctgaccatagagaccaacaaatgatgcgtcaatgtgcccaatgaggtctagctagctcagccacaaatg

SEQ ID NO: 7727 - DNA, 562 bp, Mus musculus
  misc_feature (28)..(30): n is a, c, g, or t
  misc_feature (32)..(32): n is a, c, g, or t
  misc_feature (34)..(35): n is a, c, g, or t
  misc_feature (37)..(37): n is a, c, g, or t
  misc_feature (241)..(241): n is a, c, g, or t
  misc_feature (250)..(250): n is a, c, g, or t
  misc_feature (259)..(259): n is a, c, g, or t
  misc_feature (296)..(296): n is a, c, g, or t
  misc_feature (308)..(308): n is a, c, g, or t
  misc_feature (323)..(323): n is a, c, g, or t
  misc_feature (356)..(356): n is a, c, g, or t
  misc_feature (420)..(420): n is a, c, g, or t
  misc_feature (424)..(424): n is a, c, g, or t
atgaggcagaggaaccgcctgacctgcnnncntnntnaggagtgatccgcaaggagctctgtgcctcggaggagctgagggagacctctgcatctgaacctgccccctccgtcccctactccgcccaaggtggccacggggactgcccgtcctcatccagtctggaggctgtgcccagtatgaaggatgccatgtgtgaggaaaggagcagcagccctagaagcgcagggccatccttggntgagccctntcccccagnactgcagcccttgtcaccaccacctgtggaggacatntgctcggatgantcagatgacattatnttttcgccatttctgcccaggaagaaaagcccntccccgttctaagaccccagccattgcctccaggtgaggtggctggggacaagtcagaggactntaantcttgctagggaagagccctgcctcactccagaacacctcagccatccattttcttatgtgtcgtgcctttgaggggtgctggtggctctgtactctctggggacggaggggggagggtgggcaactcccacttccat

SEQ ID NO: 7728 - DNA, 312 bp, Mus musculus
gttgatctccgatgatgacaccaaggatgacagctccatgtcatcctactcggtgctgagcgccggctcccacgaggaggacaaactgcactgtgaggacattggagaggacacagtcctggtgcgtagcagtcagggtagagccaccctgcccaggagcagcagcctggaccgggactgggccatcacctttgagcagttcctggcctcgctcttgacggagcccgctctcgtgaggtactttgacaagccagtgtgcatgatggccagggtcaccagtgcgaagaacatccgtatgatgggcaagcccct

SEQ ID NO: 7729 - DNA, 157 bp, Mus musculus
gggctgacagcctgaccattgaagaacgagatgccttcaggagcaggatccagcaaaacctgaaaactcactgcatcgatgtgtacccacagaagtgtttcgacgaggatgtcaatgacagacttctcaacagtaagattcgggagcagatcccttt

SEQ ID NO: 7730 - DNA, 296 bp, Mus musculus
  misc_feature (124)..(125): n is a, c, g, or t
  misc_feature (148)..(149): n is a, c, g, or t
tgctcacactaacagatgaaccagagactccaagggaagaagaacctgctgtgcgctcctgggagcttgacggaggctaagcctccacggtgctgtgaggggtccatagtatttttttgctgcnnctgagtccccaaggcctttaagnngaagtgacagtagatgcttgccatcagccagcccagacttttaccaggacaacagggaacagaccctgtgggtttggatgagattggcagtggggactgtcgcctgatgcgtgtccccagcagaacacctttcagagtgtgcctttc

SEQ ID NO: 7731 - DNA, 320 bp, Mus musculus
  misc_feature (155)..(155): n is a, c, g, or t
  misc_feature (157)..(159): n is a, c, g, or t
  misc_feature (161)..(181): n is a, c, g, or t
aactccactgtctttgaactcaaaggctgttttcttcatgcatgcattgggacctttctgaaccatccgctgtttgtactgggctatgtttggacgagacattttgatctgaccatagctttggactgggaaaaacaaaagaaagaaaatccatntnnngnnnnnnnnnnnnnnnnnnnnntttatgaatcgagagtcacgtcatcacctgatctgaaatgtgctagcaggtattcattgcgtaaggcttgatctttgccttgtaagaaacactggtaacaacaattcagcttatcatatgcgatggtaactgcttttta

SEQ ID NO: 7732 - DNA, 369 bp, Mus musculus
  misc_feature (139)..(139): n is a, c, g, or t
atagaacatttcttcctgagccaacctatcagtgcagctctggaagcaaatgacctctcctggcagagccttcactgtgtggggaacatcagatttgtgtaaagaagatcacctgtctcttctcaggtgtgcactgtanagaagctgctgcgaaggccacaggtcactcaggaaaatttggggcagttttctaggttcaagggagactggacatcaaagctgcactgggacatatggacgccttgatccactttggccattccacctcagctcagaattactcactggtgtcagcacaggatgtttcttggcttcaaaccatttggataagtgatggcagcaagttcgccactgtaaagtcacctcttt

SEQ ID NO: 7733 - DNA, 455 bp, Mus musculus
  misc_feature (308)..(308): n is a, c, g, or t
atccacacttggtaactgcgagaagctttccctgtctacaaactgcattgaaaaaattgccaacctgaatggcctaaaaaacttgaggattttgtccttaggaagaaacaacataaagaacctaaatggactggaagcagtaggagaaacactggaagaactgtggatctcctacaattttattgagaagttgaaaggaatccatgtaatgaagaaactgaagattctctacatgtctaataacctggtaaaagactgggctgagttcctgaagctggccgagctgccgtgcctggaggacctggtgntcgtcggtaatcccctggaggagaaacactctgccgagggcaactggatcgatgaagcaaccaagagagtgcccaagctgaaaaagctggatggtactccagtaattaaggaggatgaagaagaggaaagctaaggctgtacttttc

SEQ ID NO: 7734 - DNA, 567 bp, Mus musculus
  misc_feature (363)..(363): n is a, c, g, or t
  misc_feature (473)..(477): n is a, c, g, or t
  misc_feature (479)..(489): n is a, c, g, or t
  misc_feature (493)..(502): n is a, c, g, or t
  misc_feature (505)..(506): n is a, c, g, or t
  misc_feature (509)..(516): n is a, c, g, or t
  misc_feature (518)..(518): n is a, c, g, or t
  misc_feature (520)..(520): n is a, c, g, or t
  misc_feature (522)..(523): n is a, c, g, or t
  misc_feature (525)..(525): n is a, c, g, or t
  misc_feature (527)..(531): n is a, c, g, or t
  misc_feature (533)..(534): n is a, c, g, or t
  misc_feature (536)..(536): n is a, c, g, or t
ggaggccttgaacaacacggtcaaggagctgagactcgaaaagaaacagctcatcgaggagtatgagggcaagctgagcaaggcccaagtgttttatgagcgtgagcttgataacttgaaaaggtcacagctcttcacagccgaaagcttgcaggccagcagggacaaggaggccgatcttcgcaaagagttccagggacaagaagccattttacgaaaaaccataggaaaactgaagacagagctgcagatggtgcaggatgaagctagcagccttcttgacaaatgccaaaagttgcagatggctctggccacagcagagaacaatgtacaggttcttcaaaaacagcttgatgatgccanggagggagaaatggccttgttaagcaagcacaaggaagtggagagcgagctagcagctgcccgggagcgattgcaagagcaagcttcagatcttgttctcaaagctagtnnnnntnnnnnnnnnnnggcnnnnnnnnnnacnnaannnnnnnncntnanngntnnnnnannanaatatctgaacatttcgacagctcttttaat

SEQ ID NO: 7735 - DNA, 440 bp, Mus musculus
tgttaaacacattcaggcgtcctgaactggatggtggagtcaaaggaaaagcattccccatttgcaacaaaggaaaaacccacttggccatttaattccattgcagaaaaatggctccctcatctgttggcctctccttggagtctgatgaaggatgttttgagatcagcgtctaataactcaagccctatagaagccgcgcgctgattggctgccgcaccctgccgccctgctccagccaattacctacccacggccaaattacaaaccccgaaaagagccccaatatgaaatacaccaccacgaagccccggcgaggcggctgttcgcctcggcagcccgagaagagagaccgagggcgtctgcaaccagatccacgcgaaaagccggggaagcctacgagttgaactcacaaaatggaagccgagcgctgattggcc

SEQ ID NO: 7736 - DNA, 336 bp, Mus musculus
  misc_feature (263)..(263): n is a, c, g, or t
  misc_feature (268)..(268): n is a, c, g, or t
  misc_feature (289)..(289): n is a, c, g, or t
  misc_feature (297)..(297): n is a, c, g, or t
  misc_feature (307)..(307): n is a, c, g, or t
gactggatcagttaagccgaaaccggggcaagatagaccgagtagccagatattttgagtacaaaagagactgggattcaatgcggtttcctggtgaagatcatagaaaggagttacgctggagtgtccgagggcaaatgctttcccgaacagaacctccgtccaagcctcaacatgtgtatgttccaaacaattacctggtgccaactgagaagaaaagatctgccttcggtggggtgtgcgttgtgaccttgcaaatggtntcatncccaagaagcttcccttcccnctttctcnttcttaagtntttaaaaaacatgtctctcctaccaaaag

SEQ ID NO: 7737 - DNA, 234 bp, Mus musculus
gtagaagtcagcagccatgaaagtcagacctgatctgggcctatgtgagatagatgctttatattcaagctgttggtctgattacatcctacctgcataaaggtttgacagaaaaacaacaaaaagccaaagcaaaacaccagaaagatagtggtaagggctggggaatacagcccagcagggcattaacctgacaggctctgtgccctgcatttgatcaaactctgtcctatt

SEQ ID NO: 7738 - DNA, 438 bp, Mus musculus
gaaggacttcgtctctacagtcatccgcttacttgatagtccgtccactcccatcagagccaaagccttcctggtgctgctgtacatcttgattcataaccgggacatgctgctgctgagctgccaagccaggctggtgatgtacatcgagagagacagcagaaagacctccccaggcaaggagcagcagagtgggaatgagtacctggccaggtgcctggacctcctcatccagcacatggtacaggagccacctcggatcctaggcgacattctcaacgccctggcaaacgtgtccggccggaagcacccatccacggtccaggggaagcagctgaagatgtgtctccccatgatgcctgtggtgcttcacctggtgatgtcacaggtatttcgacctcaagttgtgacagaagagtttctcttcagctacggaac

SEQ ID NO: 7739 - DNA, 255 bp, Mus musculus
  misc_feature (177)..(177): n is a, c, g, or t
cagcagtctccggacgaggaaggataagaacatgggcgctcgcagaatggaaacagactataatcccgtggagctaagcagtatgtctggatttgaagaaggctccgagctcaatgggtttgaaggagcggatatgaaggacatgcagctggaggccgaggcagttgtaaacgatgnactctttgctgtcaaccacatgtttgtctcaaaaagcatgccctgtgcagatgatgtggcttacatcaatgtggagac

SEQ ID NO: 7740 - DNA, 313 bp, Mus musculus
  misc_feature (51)..(51): n is a, c, g, or t
  misc_feature (95)..(95): n is a, c, g, or t
  misc_feature (103)..(103): n is a, c, g, or t
  misc_feature (118)..(118): n is a, c, g, or t
  misc_feature (158)..(158): n is a, c, g, or t
  misc_feature (216)..(216): n is a, c, g, or t
  misc_feature (241)..(241): n is a, c, g, or t
  misc_feature (285)..(285): n is a, c, g, or t
agcccaggtcatggtcacagccatgagcaaccatcctcagccaagccaganagatgcagctgaggccccaggagacctgcagttgcagtccagcntctggggntcccagggtcacccngtgtcagcacccacagaaggcatcggaggaagaagaattnaaatagcctgaggaccagtgggggcggggagacgatgcccacaccctcctggcagttntgcctgctctctctcctaattcatntatcacgatatggctggattccatccatcctaccaacttcctgntcaggaactggccatgacttttccacat

SEQ ID NO: 7741 - DNA, 535 bp, Mus musculus
  misc_feature (151)..(151): n is a, c, g, or t
  misc_feature (169)..(169): n is a, c, g, or t
  misc_feature (173)..(173): n is a, c, g, or t
  misc_feature (185)..(185): n is a, c, g, or t
  misc_feature (187)..(188): n is a, c, g, or t
  misc_feature (192)..(192): n is a, c, g, or t
  misc_feature (198)..(198): n is a, c, g, or t
  misc_feature (210)..(211): n is a, c, g, or t
  misc_feature (216)..(216): n is a, c, g, or t
  misc_feature (218)..(219): n is a, c, g, or t
  misc_feature (228)..(228): n is a, c, g, or t
  misc_feature (233)..(233): n is a, c, g, or t
  misc_feature (252)..(252): n is a, c, g, or t
  misc_feature (422)..(422): n is a, c, g, or t
tgggtaattaccagactgtgacggtacaccaggcactttcagtccctcctcccctacttgtttgatctctgtgtttttaggaaaaccgttaagccttccttcgtgaagcggtgcctgttgactttgagaatattgtagaagaatagcaagnatgtttacctacaagaancacnagcctttcgtgntnnatgnactagnacgataacttgnntactntnnaccacaatntctgnttgagaatggttgtaattnttagaatttatctaggaatagcgaacattttgcaatatgcttattgttggagaaaaagaagtagagttgtttggttttgtgttgctgtttttttgttttgttttaagataaacagcatgtccctagcagaggccctagtttggtaaaccatatataagacattggaactncaaaaaaaaaaaaaaaaatgctagcactaagaaaaggtgggcttacattacaactagttggttttgtaggaattacaaatttaccactgagccaaacctacctagtgttctac

SEQ ID NO: 7742 - DNA, 497 bp, Mus musculus
  misc_feature (113)..(115): n is a, c, g, or t
  misc_feature (117)..(119): n is a, c, g, or t
  misc_feature (121)..(128): n is a, c, g, or t
  misc_feature (130)..(132): n is a, c, g, or t
  misc_feature (134)..(134): n is a, c, g, or t
  misc_feature (139)..(139): n is a, c, g, or t
agatcacagtttgcttgtacttataaagatgactgcataatgagcaagaataaatggcatgttaactcatcatcaaagcccttgtctgctcttcacttggaagatgatgtttnnnannnannnnnnnnannngntgganaagcaagaattgaagcaagttctgaaaatgcccacgtgggcagatggaagggtgacaaactaccaagaaaatctacacaaaggcagatatcgaagaggaaacagctggacttagacagtgagaatcttcactgtgaccgtggaaatgaactgtaccaacataagaacattaagatccctaaagtgcccagtggctcacacagtaaagctggtggcaaacttgcccaaggaacaaaaggcaataggtgtcctgccaggggcaagttgattcctggccagaccaagttgacgcagttttttatgctatgattttgccgactatgtactttagatttcagtaagaccattcaccaaagccc

SEQ ID NO: 7743 - DNA, 448 bp, Mus musculus
catcagaagagccaagtgtgaatcttccccagctcctagaagaagaggtggaattctgcacagatcttattgattcctatccaggacatgaaaccctttggtgtcacaggcggcacgttttctaccttcagcatcacttaaatggcaggctccctcccaacctgactcacctgtcacctgcagactgccctgggggcgctttgaatgactcgctccagattccaacaagccctcaactatctcaggcaatggaagtggacggactgagtgactctagcaagcaaggctattcccaggaaaccaagcgcctgaagcggaccccagctccagactccctaggcctggagatggagcacaggtttattgatcaagtattgtccacttgtcggaacgtagagcaagtcaggtatgccaatgcatacaggaaatggctggtgactctgagtca

SEQ ID NO: 7744 - DNA, 457 bp, Mus musculus
gatggcgatcttattactaatttccatacttgggtggagctcaggaccctgtgctcgccagtcccgttcaattacacaatctgccatttgaggaagcagacccaagagtatgtctatctatctagtgacttatctttaaggactcaaacatgccaagtgatggaatgccacaaagtgatggagagtgtgactctgccttgggtgccctcactgctctggggaaagcttcgagtactccacagagaggacctgacagaccaagaggcagggaagaactgagaaagttagtcctgtcagcatccctgtgagtgagtcgggaaggtggtctccatactccactgacaaattcagtttaacctgtgaaaaagaggaccggaggatccacttgagccaaacctggataactagcctgagagacaaatgtttcttgttacactctgggtgatttgttgtgcaa

SEQ ID NO: 7745 - DNA, 488 bp, Mus musculus
aattgaactggtccctgcagatgcgaggcaattcttcacccctcggttacgtcctcagacctttatccagttttgagacagggtctcaccgttttgagatctgttaaactggtaaagatatgttctgatttctggtgtggagtctggagacgacgcagaccgagaaaatggaaggcaaagacggaaaacaaatgcgcctcttgataagcgtctgagggaaatgtatttggcatctgccacatctctgcaccattcagataacttttctgtgtcattggtctttctagcaaagaacacccatttgcccagcgacttgtgaaagcaaaggtaaaggtttcctgagatgagtcctctcctggctggctctcgctgccctgcatctcgaactccagaccatagaaggaaacaggaccaaaacccctgacccagtcagccttcagagtttctgtttgctatgggacatcaccccatcgtatctaacagtatct

SEQ ID NO: 7746 - DNA, 278 bp, Mus musculus
cttgggcccctgatactgatgatgagaaacctccacatcagcaccctgcaatctgttcccgccactggaatgactctaaggattgggaaggctttcaatctatgcaggaggtgtgggaaccttggactcaggatggtctagagcaacctccccagaccatccgcttccagccagcagtagaggccaggcctctcaaatcggaaatccggtcagaccagggcctagaggcctatgtgtatactgtaaatcctccacctcccagtccagaggctttgagc

SEQ ID NO: 7747 - DNA, 313 bp, Mus musculus
  misc_feature (30)..(30): n is a, c, g, or t
aagggaggtctcagacatgcagcctccggncaaggaagttcaggctctcacgcgtgtttgccaagctggttactcaactgtctttctccttccatcttttttattcttaaaccaataaggggttttaagtggcccaggatgtcctgaaccttgctatgtagctggggtgacagttatgaagtgctggagatggaccaagagccttgtacaccctaaaggagctccatccctagccgtttctgatcttgacaactttcctgagtttatcttactgtgtgaataggtcagagcttgcgctcaggtatgatggtgt

SEQ ID NO: 7748 - DNA, 414 bp, Mus musculus
agaactcctgaagcgctgaagacacctgaatctatggagaaaatgcagttccctaaaagccccttctttgaaataactaaaaatgcaacatctgaaggacataaacaaaaggattctcctggattttcatttcttatgagttacacctctagatcacctggactaaatttatttgattcttctgtatctgattcagaaatctcatcggatcagtttaatgaacattactctgcggtaaatctaaatccttcttcatcacaacaaggaattggaaacttatttggaaaatcagaaggagaagatgccttcacattttctttttcatcagactcttctcacacatttggagctggaaaagatgactttagttttccattttcttttgaacaggatccaagcacaatgacttcttct

SEQ ID NO: 7749 - DNA, 563 bp, Mus musculus
  misc_feature (212)..(214): n is a, c, g, or t
  misc_feature (217)..(221): n is a, c, g, or t
  misc_feature (225)..(225): n is a, c, g, or t
atacctcttcttcttcgatgaggccactataactgatccgctctggggtgatccaacgtatgtgaacataaatattgcaactgcttcaggctacctcatttctgatttattgattatactttttaattggaaagtgatcggcgacaaattttttataattcaccattgcgcaggactaactgcatactactttgtattgacaactggagcgnnngcnnnnnttgncaatttccgcctgcttgccgagctttccagcccctttgtaaaccagaggtggttctttgaagccctgaagtaccccaagttttccaaagccaatgtcatcaatggaattcttatgacggtggtctttttcatcgtgcggatcatttcgatacctccgatgtatttcttcctttactccgtgtacggaacagaaccctacataaggacctgcatcctgaaggtgaatttttaaacctctctccccgatgagattccagcatcagagaaaacccaaagctgaagaaatctagtttgtgcctattagcaagaccggagctacccagtcaatgccagtcaat

SEQ ID NO: 7750 - DNA, 371 bp, Mus musculus
gattgcagcgaaaactcagagaacaagaagaacttgctctgcatgaacagcgtataagcgaaagcctgaaggtgcttcaccaggaagacatggaggactttgccaggcgctgtgctttggctgaggagtataggaatcaacttcagatgcagattgcccaccagcagcaggctcgagaagcagaaaaggaagaggaacgccaggaatttgaagcagggttggcagcaaacaaagcctgcctggacaaaatacagaggatcctctctgagaatcaagctctgtcccagaatgtccaccccatgcgaaggggttaccctgacaagcctcctctatagttttatataaatcaatgtatgttttctgggtctttc

SEQ ID NO: 7751 - DNA, 202 bp, Mus musculus
tggtccgggtgctgtttgaacttgcgcgatatcatgccccctccacgatcttcctggatgagctggagtcggtgatgagtcagagaggcatggttcctgggggggaacatgaagggagccttcggatgaagacggagttactggtgcagatggatggcttagcacgctcggaggatctcgtgtttgtcttagcagcctcaaa

SEQ ID NO: 7752 - DNA, 558 bp, Mus musculus
  misc_feature (268)..(268): n is a, c, g, or t
  misc_feature (376)..(376): n is a, c, g, or t
  misc_feature (380)..(380): n is a, c, g, or t
  misc_feature (398)..(398): n is a, c, g, or t
tcaggcagggtccattcttatgaaggtgaataccttacagggcaagaagatggtggaaagcgggctccagtctggggacctttccctgtctcagtcatggccctcctacctccctctgccggccgacttggagatcctacagcagaaggtggccggggtacaaagggagttggaggacttcaaggaggaggcactgaaggccatccgttacttggaggacgccttctgccagatgagtggcgtcctggcacagcaggaggagcaggcngcgcgagtgaagcagcggctgagggaggaggaggaccgaggcatcgtccgcaacaaggtcctcaccttcctcctgccccgggagaagcagcttcgtgaacactgccangcgnttggagaacatgttggtnaggagccacaacccgctgcgagccatcaggaagagccaggcggactgagcggcccgcgcccgagtgtgcgcccgagctggcgggcaagattgttttttaatggaaggacaaacgctaagtccccatttattccccttgccccatttttattgctttcctg

SEQ ID NO: 7753 - DNA, 534 bp, Mus musculus
  misc_feature (320)..(320): n is a, c, g, or t
  misc_feature (322)..(322): n is a, c, g, or t
  misc_feature (324)..(324): n is a, c, g, or t
  misc_feature (328)..(328): n is a, c, g, or t
  misc_feature (331)..(331): n is a, c, g, or t
  misc_feature (359)..(359): n is a, c, g, or t
  misc_feature (372)..(373): n is a, c, g, or t
  misc_feature (427)..(427): n is a, c, g, or t
  misc_feature (448)..(448): n is a, c, g, or t
  misc_feature (451)..(451): n is a, c, g, or t
  misc_feature (472)..(472): n is a, c, g, or t
gatgagcctttgatggaccctgaagagttatttgaacttgaaggtggaaagtacagtaaaccagacatcattgaagatctttacggaacaattgcctttaaggattttatcctaagcaaaggctacagtatgccggccatcctggagaagttgtttatgaggaaaggatggaattatgacactgtcaacactccaataccaagagtactcaaagcacatgaattgatcatgcagcaaagggatgaagattatgatgatgaaaatgactagctgattttcgattttacttgactttactctcatttcaaatattgaacggnananatangangaagttatcactaaatgtgaccatcttnttggacaatatcnntctataatgtaagatgtaatgtttacaaacatttctcaatgagctcaaatgaanttctgtgcctgcataaatatnttntcaacttgaagatcaacaatnatatacacagttattaaatttatttactattgagaatgtggaggtcaaccagttacttataa

SEQ ID NO: 7754 - DNA, 569 bp, Mus musculus
  misc_feature (201)..(201): n is a, c, g, or t
  misc_feature (208)..(208): n is a, c, g, or t
  misc_feature (216)..(216): n is a, c, g, or t
  misc_feature (226)..(226): n is a, c, g, or t
  misc_feature (234)..(234): n is a, c, g, or t
  misc_feature (262)..(262): n is a, c, g, or t
  misc_feature (286)..(286): n is a, c, g, or t
  misc_feature (292)..(292): n is a, c, g, or t
  misc_feature (315)..(315): n is a, c, g, or t
  misc_feature (320)..(320): n is a, c, g, or t
  misc_feature (325)..(325): n is a, c, g, or t
  misc_feature (330)..(331): n is a, c, g, or t
  misc_feature (342)..(342): n is a, c, g, or t
  misc_feature (382)..(382): n is a, c, g, or t
  misc_feature (402)..(402): n is a, c, g, or t
  misc_feature (417)..(417): n is a, c, g, or t
  misc_feature (421)..(421): n is a, c, g, or t
  misc_feature (425)..(425): n is a, c, g, or t
  misc_feature (468)..(468): n is a, c, g, or t
  misc_feature (483)..(483): n is a, c, g, or t
  misc_feature (497)..(497): n is a, c, g, or t
  misc_feature (525)..(525): n is a, c, g, or t
gcccttgtaggtctgaaagactcatcccaggctccccgcctgaccccatctgtcccccctaaccctgcctggatctctctgctccacccctgtggcccaccagctcctcctgggggaagaggattccagcctgttggcccacctctccgacccagtccaggttcctctgtctctctgcacattgggcgtctgggatctatntccctcntcagctanacagcagagntggaggcnacctcactgggacaaagagacgacaaantgcaggcactgcatatttggtatnttattnatggttttgcatgggatttaatntaatncaagnttcannttttttttttnatataagctttcaggttccttttttagtgtgggtattttnttgactgagggtggctattnttgtagcccgtttanatantaantcccccaataaaggcagttgggcagtttaagatgacccatatntaaatacattttttnatgagtttatgctntctatatgcctatgttcttatgtctgtntctgaatgtgaaaatacaagaatatgttcactttgtatgtaggt

SEQ ID NO: 7755 - DNA, 524 bp, Mus musculus
  misc_feature (331)..(331): n is a, c, g, or t
  misc_feature (333)..(333): n is a, c, g, or t
  misc_feature (338)..(338): n is a, c, g, or t
  misc_feature (343)..(343): n is a, c, g, or t
  misc_feature (353)..(353): n is a, c, g, or t
  misc_feature (357)..(358): n is a, c, g, or t
  misc_feature (360)..(360): n is a, c, g, or t
  misc_feature (363)..(364): n is a, c, g, or t
  misc_feature (373)..(373): n is a, c, g, or t
  misc_feature (376)..(376): n is a, c, g, or t
  misc_feature (378)..(379): n is a, c, g, or t
  misc_feature (384)..(384): n is a, c, g, or t
  misc_feature (387)..(387): n is a, c, g, or t
  misc_feature (394)..(394): n is a, c, g, or t
  misc_feature (397)..(398): n is a, c, g, or t
  misc_feature (400)..(400): n is a, c, g, or t
  misc_feature (414)..(414): n is a, c, g, or t
  misc_feature (420)..(420): n is a, c, g, or t
  misc_feature (428)..(428): n is a, c, g, or t
  misc_feature (430)..(430): n is a, c, g, or t
  misc_feature (433)..(433): n is a, c, g, or t
  misc_feature (473)..(473): n is a, c, g, or t
  misc_feature (494)..(494): n is a, c, g, or t
taggtctgcctcaggcagtcaaacttggaacacccgtgccaccctccggacccaaacctcttgcacccgaacctgctctatccccgtttggtgcacctgagcctgccccagtccagtttggtgcacctgagcctgccccccaccagttagaggcagctgtccctgatgcatcccgcctcatggcacctgaacccgctgtacccttgtctgtgggagcacagtcactagctgaatcccctgcaggcctgtctcccgaaaacaaacctacttcaggtgagcctgctgcaacacagtctctgccagccttgcctgctgcaggcctggctgttgnanccaancttcntgcagcagantctnntncannccgacctcntcnanntgaanttntggcganccnntntgttgtgggaaaanttattncagctgancntantgaagcaaaaccacaggtacttgagcctgttgaggccaantctgccagccaagaagcacanccttttttttaccaggtgccaatgaacaaa

SEQ ID NO: 7756 - DNA, 465 bp, Mus musculus
  misc_feature (324)..(324): n is a, c, g, or t
  misc_feature (331)..(332): n is a, c, g, or t
  misc_feature (336)..(336): n is a, c, g, or t
  misc_feature (341)..(341): n is a, c, g, or t
  misc_feature (350)..(352): n is a, c, g, or t
  misc_feature (356)..(356): n is a, c, g, or t
  misc_feature (358)..(358): n is a, c, g, or t
  misc_feature (361)..(362): n is a, c, g, or t
  misc_feature (390)..(390): n is a, c, g, or t
  misc_feature (395)..(395): n is a, c, g, or t
gtattaactcattccggccatatcattcatgtgagctccttgaagcccttatggaacctatttattctctcagacattattggattccaaagggtagaggcaaccctgaagacgtgtggctgcgttctgccctcatccatcagccgtggactccaatggggatgtcatgttctccatagaggcatctctgctgggcctctttccttggctctgcgcaagaatctatgaccctggaaaagtcatgcaatctctcagtgtaggcttcctagactaacagacagaagcagaggctcacggggcaataggttctgaaggctgggactntaccccnntcantgttnctcctccannncccnanatnntcctttgcatgtcatcgtgagtcagganatggntgtcaaatgggagagagaaaaaagaggcaacagagcaccaagcccaatgacctaagtttgacacccagaa

SEQ ID NO: 7757 - DNA, 444 bp, Mus musculus
  misc_feature (333)..(333): n is a, c, g, or t
  misc_feature (337)..(337): n is a, c, g, or t
  misc_feature (339)..(339): n is a, c, g, or t
  misc_feature (345)..(345): n is a, c, g, or t
  misc_feature (351)..(351): n is a, c, g, or t
  misc_feature (366)..(366): n is a, c, g, or t
  misc_feature (368)..(368): n is a, c, g, or t
  misc_feature (372)..(372): n is a, c, g, or t
ataccagatgccttacattgcctttattttttgccttttactttactgcaacctttttgtctagtttctgtagtataccttccgccttgattgtcattcaaagtgtacctaccagttggaattcaatgagtttgggtttaatgtcgacagtttggagattcactggctctgttcctgcaccaatattatttgcagcaacatcagattttacttgtcaattctggggtattaatgaatgtggagaaaaagtacggtgttggatctataatacagaaaatttggtctacacatttaagacagtatggattaacatgcaaatattgtcaggcttgngttntntttacngggttnacagacatgattatntngtanaaggagatggtaaaaaagcagaagaaaagtaagaacattaatttcaaactgatttcttcattgagactggac

SEQ ID NO: 7758 - DNA, 351 bp, Mus musculus
atttgagacttctaatgccaccagaagcaacctggacaactgctttctgtttgagagcagttggaggaaggcagttttggaaacacagaagatgaggaaagcatttggtctagaagagcccaaggaatgtctcaaaatgccgtatttaccagaattgtcaaagagctcaagttcatcttcactagaggctcacaagcgcctgctgcacacggacgctgagatccctcccatcaggataaagaagaccaaggagtcgtgcagtatggcagcatttcaggagaagtcaaaaggctctgtcttcagtgaccctttcacaggagcaccctctgacttcttacagaggctttccag

SEQ ID NO: 7759 - DNA, 507 bp, Mus musculus
  misc_feature (323)..(323): n is a, c, g, or t
  misc_feature (326)..(326): n is a, c, g, or t
  misc_feature (335)..(335): n is a, c, g, or t
  misc_feature (342)..(342): n is a, c, g, or t
  misc_feature (353)..(353): n is a, c, g, or t
  misc_feature (355)..(355): n is a, c, g, or t
  misc_feature (366)..(366): n is a, c, g, or t
  misc_feature (391)..(391): n is a, c, g, or t
  misc_feature (393)..(393): n is a, c, g, or t
  misc_feature (410)..(410): n is a, c, g, or t
  misc_feature (415)..(415): n is a, c, g, or t
  misc_feature (450)..(450): n is a, c, g, or t
  misc_feature (466)..(466): n is a, c, g, or t
gccagccacatttaacatcatctttatgtggctatgggaatcaatctggagtccctgggcttgcaaagccaacgctttgttgagccatctccatagccacagtattagctttttaaggtcattagatgaatgcttacttcaaaatgatttctagtatgtatttttgatcttacgtgttagctttcatcacaataacaagagaattcagatcagtggttctcaacctgtaagtggagacgccattgacaaacctatagctacaaaaatatttacattatgacgtataactaggaaattatgaattagcagtgaagataattttntgnttggagganccctacnacctgaggaantntatcaaaaggntgcagaacggggaagggtgagaacntntgatttagataatcaanttttntcagagaaaaattttggttgatggtttgaaggttntagcccataactggantttccattgctttgggcccatggtaaggctggaggctattt

SEQ ID NO: 7760 - DNA, 316 bp, Mus musculus
agactctgagcacatctgtggctcagctccatccttggtggtatttccgaaagaggacgaatctaccctatgagaggaaacctacatcagtagcccacattccctttggactgggggacttctactatgctggtgccattataggtggagtgccctttcaggtcttggactttgctcagcaatacttgaaaggtgttttcttggatactgaaaatggagttaacagtacctatgaaaagtacctcaacaaatattttttcctcaacaaacctaccaagcttctatccccagaatacagctgggaccctaccttcaa

SEQ ID NO: 7761 - DNA, 385 bp, Mus musculus
  misc_feature (275)..(282): n is a, c, g, or t
  misc_feature (284)..(285): n is a, c, g, or t
  misc_feature (292)..(292): n is a, c, g, or t
  misc_feature (302)..(303): n is a, c, g, or t
  misc_feature (310)..(310): n is a, c, g, or t
  misc_feature (313)..(313): n is a, c, g, or t
  misc_feature (317)..(317): n is a, c, g, or t
  misc_feature (327)..(328): n is a, c, g, or t
  misc_feature (330)..(330): n is a, c, g, or t
  misc_feature (336)..(336): n is a, c, g, or t
  misc_feature (341)..(341): n is a, c, g, or t
  misc_feature (347)..(347): n is a, c, g, or t
gaccctctctggcagcgaaattggaacagcagaaagcaagtcaaggagaaatgaattctaccattaattagggtctaattaaggcctacctatctggaacagggaacaagcttattgtcgaatgagaagcgatctacataagtgccctgtcatgtcctgacttttaaaattaaaacaatagcaatagaaggaagcatgaaatgaaggaacggcttctcttcctggtctgcgaaagcctctgcgaacaacagtctcacagccaaagtctctgtttnnnnnnnncnntcccttnttctcccagnntccccanccntacntgccccctgnnanaacaanttaantgcagnttcagattccaaatatgaactaacttgctgtgtgacct

SEQ ID NO: 7762 - DNA, 487 bp, Mus musculus
  misc_feature (294)..(294): n is a, c, g, or t
  misc_feature (320)..(320): n is a, c, g, or t
  misc_feature (338)..(338): n is a, c, g, or t
  misc_feature (353)..(353): n is a, c, g, or t
  misc_feature (377)..(377): n is a, c, g, or t
  misc_feature (406)..(406): n is a, c, g, or t
  misc_feature (410)..(410): n is a, c, g, or t
  misc_feature (443)..(443): n is a, c, g, or t
  misc_feature (462)..(462): n is a, c, g, or t
atgtcgcccttactgcggactcagagagacgaggcctcctggaccactagatcactgtcatcccctgggagagtaaataacagggaatctacgcacaacccagagcttaccttcctgcagccagcccagggccatcaccctccggtctgacagaatagcacagataggagaaggtacaggaaccataggacatgacttccaaggccagagataattgaattacctggttgtcagccgtgatgaatatgagccacgaaggcggtataaatgtcctatttgttccatgtccccggnagcacctccagctttttgtttctatnttgggactgagtgacctntactccacagtatgnccatttccagcccctggggacctntaaggcacccctgggaggcaattgtgatntcanccatgaattccgtaccagcgtgacaaaatgttntactatgggattgtgtgantcatgtaaacttccttaattcccct

SEQ ID NO: 7763 - DNA, 327 bp, Mus musculus
  misc_feature (123)..(124): n is a, c, g, or t
  misc_feature (126)..(126): n is a, c, g, or t
  misc_feature (132)..(132): n is a, c, g, or t
  misc_feature (145)..(145): n is a, c, g, or t
  misc_feature (151)..(151): n is a, c, g, or t
  misc_feature (164)..(164): n is a, c, g, or t
  misc_feature (188)..(188): n is a, c, g, or t
  misc_feature (283)..(283): n is a, c, g, or t
  misc_feature (285)..(285): n is a, c, g, or t
tggccaaaaataaaactactcaggtcagaaatatgtttttgaatgtaatgtagccacaaccatgttttgaagagaaacctcagcacttggaagaaatataatccaatagcataacagaaaggnngntttgtntggttatgaggcntgaaantacaaggcagaantctcctcagtaaagattgcaaccntcctacagagagctgaactgtatgcaagagcctaacccagcaaggaagactttctgagcttactgatttggttttacaaaaagattgacagcagntntattacaacctgtaaatttagctgcaaaatacaacttggtgt

SEQ ID NO: 7764 - DNA, 184 bp, Mus musculus
ggatgagcaaatcactgaatcttcttcagagaacatcaatatgtatttatgtccctgctgattcaccagaatattggagggagggacagataagatctactgatcagaaattttgggaatctgatatgaaatacgtaagaacaaagcacaatgtttttatttcatgaaaagctcaaatcattat

SEQ ID NO: 7765 - DNA, 200 bp, Mus musculus
tatgagtctccaccagtttcttgatgaagctctctgatgataattggactagactctaatatatagtaaagcacaatatcgtctctgtggcatctagacactgtttcctggaagcagacatcagctgtaggcttccactcatggcatggacctcaagttgtaccaattattcatttggccacaccatcatcaattgcaga

SEQ ID NO: 7766 - DNA, 473 bp, Mus musculus
  misc_feature (367)..(369): n is a, c, g, or t
  misc_feature (372)..(373): n is a, c, g, or t
  misc_feature (377)..(379): n is a, c, g, or t
  misc_feature (383)..(383): n is a, c, g, or t
  misc_feature (399)..(399): n is a, c, g, or t
  misc_feature (401)..(401): n is a, c, g, or t
gaaattaaaaaccttctgcacaggagagaggaacagtgaactgagtgaagagagactacaaaatgacagggagtcttggctagctctgtgtctgtcagaggactaatattagaatacatcgaaaactcaaaaaaaactactcagtgaataacagaacgatgaagtaaacagacaattctcaaaatatgacccacaaatgaccaagaaacatgaaaaatttcaatttcactagttctgaggattagtgttgactgttgcctggatatagtgtaggtagcacccatgaggaattatttagatcactttggacagtctaccgggctgtgagggattttccttgatctaattgatgtaggaagacccattnnnaanntggnnngcancctttcatgagctgancnttggagcgaagggaaggggaaggtgagaggcagctgagcccttgcatgagagcataagtttactggtttctg

SEQ ID NO: 7767 - DNA, 360 bp, Mus musculus
  misc_feature (314)..(317): n is a, c, g, or t
  misc_feature (319)..(319): n is a, c, g, or t
  misc_feature (322)..(322): n is a, c, g, or t
ttttctttcttctgagcagccacttgcaaagttgtgcaagattccatgctttaaatggcaaacagtactgctcatctcacagaattcaagtcgatccagatgtggatttgattaatagaagcttactaactgtggctaattactgataatgatagcatcacgaggcaacctcctcatcaatgtcaccttggtctcttctgattgctaggataggaagaaactctacctgccgctcttccccagtcaaaatgaaaacagggttggatttaaaccttggtttgaatggtagtgaggtagtgaacacaggtgcaatnnnnantanccatccagaaaatgaaagctgctttttagagccatgtg

SEQ ID NO: 7768 - DNA, 358 bp, Mus musculus
tatagacgccccatttatgacggagctctactgacacttctctgcacttggacccgttgtgagtttctgtattaaccacaatccactgcacaaagaaacttctctaatgatgtttgagagctgcactaatgagagcctggacccagaagaatactctctactttcttcctccagaaattcagagtttccagtctagtagatcaacctggaattgacttgagcacaagacccctcaagattctacgtatgagatcacatcatctacaactggagatggttttacttcttcttcctttcccatttaatggtttcgacttctcctttcatctcccctcctttggtcctccagtacagtgtg

SEQ ID NO: 7769 - DNA, 562 bp, Mus musculus
  misc_feature (373)..(373): n is a, c, g, or t
  misc_feature (390)..(392): n is a, c, g, or t
  misc_feature (396)..(396): n is a, c, g, or t
  misc_feature (406)..(406): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (426)..(426): n is a, c, g, or t
  misc_feature (445)..(445): n is a, c, g, or t
  misc_feature (455)..(455): n is a, c, g, or t
  misc_feature (535)..(535): n is a, c, g, or t
gatcatttgtcatggcgtatggcttgccaagaaggaacacagtacaaaccattttgaagggcagctgttataaagtacaggagccatgggaccttgcggaactcacaaagacctggtacacaaacttgacgaacatcaggctgccattcttgggagaaatcgtatttggtagtcctatgaatctcttggcaagccaaaccaaacaggaatgccagtttccttcaatgcaatccatggcacttgaaaaggagtatgaagcaaagcgcctaacaaaactgaagtgtcaggagaatgtgtgtaaggaaatccaggcttcactgagagaaaagaaagtcggcctgagaagaccacttcagcccaagtgacccaacanattgttgaagctgaacnnntttncggcatccanggagatgangntncttggantctttcatagtgtcaagtngacacagcantgtgcctatggcgatgaggccagtgtttccagacacggctcggtggatgctatgacagagcccccaggttcctgctacantcttgttctttgtgtcccatacagcag

SEQ ID NO: 7770 - DNA, 540 bp, Mus musculus
  misc_feature (342)..(342): n is a, c, g, or t
  misc_feature (358)..(358): n is a, c, g, or t
  misc_feature (414)..(414): n is a, c, g, or t
  misc_feature (442)..(442): n is a, c, g, or t
  misc_feature (470)..(470): n is a, c, g, or t
gacagcagaatgaaagaccaagagacaattaaagtacaatattttaatgagatattgaaaatgggccaagaaaatattaaagtgttggagagtgacttgtcagaagagagggagaagatacagcacctgacgtcagctttcactgctattcagaagtccttgcaagtgaatagtgaggaattccaaaactcaaagtcagaactcctgtgcctttataaggaaattcagagtcttccaagggctgagggcagagagcaatttttagtagcttataacctgctactgagagagaattctgaattagaagccaaggtctcaaagcttgcacaagagctggaactnttaaaacattgctctntaggggacagaactgctaatttgatgacgagtgaaaacgcctgtgaagacctggtntctaaagggccacttttggaagtggagnctgtgagccccagtgaggacagacaggntctctggtaatttgagaagatctgactgagcacagtaactagagggttttattggctgattatcccaaga

SEQ ID NO: 7771 - DNA, 201 bp, Mus musculus
acctgacgtcagctttcactgctattcagaagtccttgcaagtgaatagtgaggaattccaaaactcaaagtcagaactcctgtgcctttataaggaaattcagagtcttccaagggctgagggcagagagcaatttttagtagcttataacctgctactgagagagaattctgaattagaagccaaggtctcaaagcttg

SEQ ID NO: 7772 - DNA, 342 bp, Mus musculus
  misc_feature (298)..(299): n is a, c, g, or t
gcaaccccagtcatgaaccggtttggcacccggttggtaggagccacggcgaccccgccgccgccaccgaaagcacgaagcaatgagaacctggacaaaatcgatatgtccctggatgatattatcaaactgaatagaaaggagggaaagaagcaaaactttccaagactaaatagaagactccagcaaagtggtacccggcaattcaggatgagagtacggtggggaatccagcagaattctggttttggtaaaactagtttgagccgtagaggaagagtattgcctggaaaaaganntccttatggagttatcaccggccttgcagccaggaaagcaact

SEQ ID NO: 7773 - DNA, 471 bp, Mus musculus
  misc_feature (280)..(280): n is a, c, g, or t
  misc_feature (322)..(322): n is a, c, g, or t
  misc_feature (324)..(324): n is a, c, g, or t
  misc_feature (329)..(329): n is a, c, g, or t
  misc_feature (333)..(333): n is a, c, g, or t
  misc_feature (337)..(337): n is a, c, g, or t
tactgcgtctacctggactggaggcggcaccgagaccccgcattccgccgccgcctgcaggacaagagaagagctggacagcccaaggcccaggcgcccgccaggcagttatgggatccagtaaagaaggaagaactacaagaatatttttttcgagaggtgcagatgggaaaactttgtttaattagaggggagcgcggaatgggctttgagcatctcaccaatgcccttttagtatgtgagcaaccaaaggagcttctgatgtttttcaaaaaaacantccctcctgaggtttttcagatgctattggacaagattcccntnatttnccancaantcgaggagacatgcaggagcacggagcacttgaaggatgaccccgactgaaaacatcccagcgcatccacacgcagtgggaatgcccactcccgtgttctatacagtaaagacaactgctcaatgatactcatt

SEQ ID NO: 7774 - DNA, 309 bp, Mus musculus
gccaggaagggcaaatttcacagtaattcacaaatgacagcccctgatttccagataaatatcaggaacattgtttcatatgagatttattactttttcttaccctcaaaagcctaccattgtaaagagatagaataggaaaaaagggactggttttccagatacctgagtgcttagggcaacccggagctcataaggggagtcagccatccagccagtggacgttcccacagtggtctttactggtaccacacttccacctcgctgaaacactgggatctgtaacacagcagcactctcaggaatgac

SEQ ID NO: 7775 - DNA, 459 bp, Mus musculus
  misc_feature (351)..(351): n is a, c, g, or t
  misc_feature (368)..(368): n is a, c, g, or t
  misc_feature (370)..(370): n is a, c, g, or t
  misc_feature (391)..(391): n is a, c, g, or t
  misc_feature (399)..(399): n is a, c, g, or t
  misc_feature (402)..(402): n is a, c, g, or t
  misc_feature (406)..(406): n is a, c, g, or t
  misc_feature (408)..(408): n is a, c, g, or t
agtccttgtgactggcatcgagtgttcttagctaccgaggcatctctccagccctgttttttccccatttggagaaagggttttatgtctagcctcagaccagctgggggatgagactcctgtcttctccttccaagtgctcaggtgacaggtttgtgtcaccacacccagtttatacagtactaggtactgacccaagggctctgttcatgttaccaagctacaccccaaaccttgccatatggtttttactggctctgtgggccttgtccatacagccaaataccaggtagtaggagtttcctactcaaccctaaccaaccaatgaagttatttattttgggaataacntacatggtcagattttntnttacttaaatgttgaaaattngcctccangtntctntnagacacaggaaaatgccacagctaacacgatacaacagagccacctaggaa

SEQ ID NO: 7776 - DNA, 337 bp, Mus musculus
tctacaatgagtgtgggctgcacaggaaagctcttctttgcctgtgtaaacagggtcagattcatgaggctatggaacatatacaacagtccaaggacattaacactgatgacctgatacaactaataacagcatgtccccagattgacttaattagatgtcttactcaagaaaggaatgagaaaccaccatttttatcttttgggcttgctgtactccatatgttttctgtggatatgaaaaaagttggcatgaggctacttcaagaagtcagtaaaggcgagaaagatgtgattgagcatcttgtgatgagtgatttattttgctccttagaaaa

SEQ ID NO: 7777 - DNA, 555 bp, Mus musculus
  misc_feature (285)..(285): n is a, c, g, or t
  misc_feature (288)..(288): n is a, c, g, or t
  misc_feature (291)..(292): n is a, c, g, or t
  misc_feature (296)..(296): n is a, c, g, or t
  misc_feature (329)..(329): n is a, c, g, or t
  misc_feature (332)..(332): n is a, c, g, or t
  misc_feature (342)..(342): n is a, c, g, or t
  misc_feature (354)..(354): n is a, c, g, or t
  misc_feature (357)..(357): n is a, c, g, or t
  misc_feature (360)..(360): n is a, c, g, or t
  misc_feature (366)..(366): n is a, c, g, or t
  misc_feature (373)..(373): n is a, c, g, or t
  misc_feature (376)..(376): n is a, c, g, or t
  misc_feature (387)..(387): n is a, c, g, or t
  misc_feature (409)..(409): n is a, c, g, or t
  misc_feature (415)..(415): n is a, c, g, or t
  misc_feature (500)..(500): n is a, c, g, or t
  misc_feature (502)..(502): n is a, c, g, or t
  misc_feature (518)..(518): n is a, c, g, or t
gctcccttgagcagatgtttatgaagaagggatggggttatgaatgttcttctccatcatcaaaaatgtttagagattattattggatcgtggattcagatgatgatgacaccgacaatgaagaagaagaggaggagaaattgaaggaacagcagacagaaaataagtagatgactttctaattataactcatctggctatatccagttctcgttttacacgtcaatcaaggtatacatcatgatttaattctcagtgagcttctgcctcgcctccacataatanatnacnntatnaaccgtaggatgaatattcacatgtactttttnaanatctttgttncattgaagatantanatnattacntcaaacnatnataggaatgcntaaaactataaataaaaacagntagtantaggaagatcctgggatgacactaataatgtgagaagaatatcaaaacactgaaattgcaagaataaaacagactttcacagttntntgtggctgaaaacttnatgaactaactagcaattgttttgtcaactgtaactt

SEQ ID NO: 7778 - DNA, 553 bp, Mus musculus
  misc_feature (347)..(348): n is a, c, g, or t
  misc_feature (376)..(376): n is a, c, g, or t
  misc_feature (397)..(397): n is a, c, g, or t
  misc_feature (402)..(402): n is a, c, g, or t
  misc_feature (422)..(423): n is a, c, g, or t
  misc_feature (425)..(425): n is a, c, g, or t
  misc_feature (463)..(463): n is a, c, g, or t
  misc_feature (482)..(482): n is a, c, g, or t
  misc_feature (521)..(521): n is a, c, g, or t
ggatggcttgaactgatcagctccatacgttttcttcattgtgctttgcatcaagaaaccaggaggactaaagagctacaaaaagagctagccgaaatgaagaagatctttaacatgcccccacaggaaggtcgtggacatgaaggcagaagacatagttgtcgtgaggtttcaaaagtcagtcaagctgaaatgggtgttccagttgccatgctgagacttgagggggaagcaacaactgcagaaaatttagtgtgcattcacaagactccaactgcctcattcctaactcagatggaacttgaaatgaaaagtattaaatctgccatcgctgaagtgagcacccnngaatgcttggttaaaagagaactggaantcatgaagcacctttaccgangaganttagagcacatagacagcgnntntgccattggatcggaatatgtaaatggagagagaggangtacagaaagagaacccgngcctttctacaaaagcagagcctcagagaacccagctcntgactcacgtaggctgcaaaagtaactggaca

SEQ ID NO: 7779 - DNA, 283 bp, Mus musculus
aaatgtctggttccatgggttcacagctggaaagcaatgcaccccaggataaacagcacctcgtactgttatccatggctgattaagtgatactgagaaaagacctcggatggctggaatgtgggtctggagtgcctgtcactggactgttgcaatcctaacctcaagtggacgataggaggaataatgggtctcttctgggaagtgacggagagtagagacatcatccatgagatcagtagatgatcaaaggcctggagctgcttggtcacttccactgtgt

SEQ ID NO: 7780 - DNA, 540 bp, Mus musculus
  misc_feature (376)..(376): n is a, c, g, or t
  misc_feature (378)..(378): n is a, c, g, or t
  misc_feature (387)..(387): n is a, c, g, or t
  misc_feature (400)..(400): n is a, c, g, or t
  misc_feature (406)..(406): n is a, c, g, or t
  misc_feature (420)..(420): n is a, c, g, or t
  misc_feature (438)..(439): n is a, c, g, or t
  misc_feature (443)..(443): n is a, c, g, or t
  misc_feature (448)..(448): n is a, c, g, or t
  misc_feature (475)..(475): n is a, c, g, or t
  misc_feature (477)..(477): n is a, c, g, or t
  misc_feature (497)..(497): n is a, c, g, or t
  misc_feature (527)..(527): n is a, c, g, or t
tcactctttctcttcaatccacatttttgatatggctcaagcaaagaaacgttgctcctgtgagtcagggtctggctgctttggaaggttgctgtagcggcgctgcctgagctatcagcagctgttaccacaatatgctccacggcaggagctgggagaaggaggccctggtcgtaagcaggaagattgaaatttgctacctgtttctttgcactgcagaaggcactcgacgacactgatgggggcgaaaacacctgcagctgtgaggccatacctacacggagagaaggaagaatgagaccacagggctcacgatgcgaagctcaccaacagctcatgtgagaacaggtgtagctgataagaccacactgtactntntccctcctntcaaaggaggaanatctgntttgattttaaatntcattactgatcaacttnntctnaaatntgtaaactacaatgtccagagatcaantnttcaggacgctatcaaaaanacgacctgccaaccagcgccaacatttttntcagctgctttac

SEQ ID NO: 7781 - DNA, 530 bp, Mus musculus
  misc_feature (350)..(350): n is a, c, g, or t
  misc_feature (353)..(353): n is a, c, g, or t
  misc_feature (357)..(357): n is a, c, g, or t
  misc_feature (362)..(362): n is a, c, g, or t
  misc_feature (372)..(372): n is a, c, g, or t
  misc_feature (376)..(377): n is a, c, g, or t
  misc_feature (390)..(390): n is a, c, g, or t
  misc_feature (400)..(400): n is a, c, g, or t
  misc_feature (409)..(409): n is a, c, g, or t
  misc_feature (422)..(422): n is a, c, g, or t
  misc_feature (431)..(431): n is a, c, g, or t
  misc_feature (434)..(434): n is a, c, g, or t
  misc_feature (453)..(453): n is a, c, g, or t
gtgaccgtagttctgagggataatctgatttacatttttttttcaacttcaaagttgtgcgaaagctacacggatctcatacaaactacatgttgagctttgatcatctccgagcctgaccccaatgacaagtgatctttcctaatgctgggtagcaggggcccaagctacagccatagcacacaagctgcagccatagctcagccccaggatcccaagaggggaaaaccaaatgttcatccgtgttccacggcacctagcctggacactgggtcagcgaagtgtattaaatgcatcttttgacttcatgctattttcaacttatgcttgtccactgaaaatactgaganacnaacnacccngggaccatgngcannaagcatttgctantaagaagaantgggggtcnttagcgacatggnttcttccanatncaggacagaccacagaagnttggagtttccttgctatttggatgacagcaaagattgatgcggttatatcagaaggaatcaactggctaaacatgg

SEQ ID NO: 7782 - DNA, 321 bp, Mus musculus
  misc_feature (54)..(54): n is a, c, g, or t
  misc_feature (61)..(61): n is a, c, g, or t
  misc_feature (63)..(63): n is a, c, g, or t
  misc_feature (75)..(75): n is a, c, g, or t
  misc_feature (80)..(80): n is a, c, g, or t
  misc_feature (82)..(82): n is a, c, g, or t
  misc_feature (85)..(85): n is a, c, g, or t
  misc_feature (100)..(100): n is a, c, g, or t
  misc_feature (104)..(104): n is a, c, g, or t
  misc_feature (127)..(127): n is a, c, g, or t
  misc_feature (136)..(136): n is a, c, g, or t
  misc_feature (164)..(164): n is a, c, g, or t
  misc_feature (178)..(178): n is a, c, g, or t
  misc_feature (182)..(182): n is a, c, g, or t
  misc_feature (184)..(184): n is a, c, g, or t
  misc_feature (206)..(206): n is a, c, g, or t
  misc_feature (208)..(208): n is a, c, g, or t
  misc_feature (251)..(251): n is a, c, g, or t
  misc_feature (253)..(253): n is a, c, g, or t
  misc_feature (261)..(261): n is a, c, g, or t
  misc_feature (263)..(263): n is a, c, g, or t
ctgggaaatacagctactatcattcccacaatggcacctctgtaggttgcagcnagggagnangaacttcttgtnggatntnatntcacgataccatgantctnggtacctgagggagagagcatantcagaagantcctatccagtgccagaagaggaactgntgcagaggcaacgnggantntacgcagatgggcctcactgtntnttccaccttcactccattagaagaagagaatacgctttgtttntntgactatntntacaccacagcccatgctttgatgaacggaattcaccatgggtatttccatcctcaat

SEQ ID NO: 7783 - DNA, 285 bp, Mus musculus
gaatatgtatccttagtcccagaaaacttgataccatttgcattggaaacagaagtgcaagacctcacagtgatagaggaaggcgaggatactatccgtttccacactgagcaaatagagtatgatgaagaataccttgtagagtccatggaagaagactatggatgcatgcacagtgaggatgagaaggacaatgatgatgaagatactgatgagggtactgaatactttgcaggcactgtgaatgaccataactatgaacacacatgtgttgctcccaataaa

SEQ ID NO: 7784 - DNA, 481 bp, Mus musculus
  misc_feature (36)..(36): n is a, c, g, or t
  misc_feature (190)..(190): n is a, c, g, or t
  misc_feature (281)..(282): n is a, c, g, or t
  misc_feature (284)..(284): n is a, c, g, or t
  misc_feature (315)..(315): n is a, c, g, or t
  misc_feature (348)..(348): n is a, c, g, or t
  misc_feature (354)..(354): n is a, c, g, or t
  misc_feature (365)..(365): n is a, c, g, or t
  misc_feature (369)..(369): n is a, c, g, or t
  misc_feature (374)..(374): n is a, c, g, or t
gtgttcggcctggtacagcagaactgctgcaggggnaaccaggccagaagaggcagtgtatacaaccttttgttacctgtcagacacctccaccaaccaggactccatctctgtaaccccatctcctacagagtgtgagtaattagctctctactctttgacatcattgttccctatgcactagtgcatngacaaagaagtcatacacataaacttcctgctatgaagagacagccatcctgactctgcagtccaggtgtgtctatcacagagcatgcatnngntgaaatctatgaagaacagcagattaaaccntttccagttgcctggcttggagtaccatagganactggntcttagcttgntgtnggagnccgcccacaatgcctctgtgctgtgaactttgtgtgttcatttatgccctgatgtgaaaactcaaaacatatgaagaaactggggcagtgtaacaatttccatactt

SEQ ID NO: 7785 - DNA, 225 bp, Mus musculus
gatacagttaatccttggctgcatagctttgaggaagtccctgcctgaaagcgcgataaggtatttgcaaattcatcttcctggatgagaatttcttgaagtcggtcatgcgtataaaccaagtgtggtagtgaacgcttgtcatcccagcattctgcaggctgagacaggagaatcttgagggcttcagaaattcaccagcattgctaagaaatcgtctcccca

SEQ ID NO: 7786 - DNA, 460 bp, Mus musculus
  misc_feature (298)..(299): n is a, c, g, or t
  misc_feature (306)..(306): n is a, c, g, or t
  misc_feature (312)..(312): n is a, c, g, or t
  misc_feature (317)..(317): n is a, c, g, or t
  misc_feature (331)..(331): n is a, c, g, or t
  misc_feature (336)..(336): n is a, c, g, or t
  misc_feature (357)..(357): n is a, c, g, or t
ggatggacagcattacgctacgctattgaaggccactgtacttttagacagacacttctggattttgaagaaagtctacatagtaacaaaaaagataaggaaccagaactacaagtggagcccagtacctcctgcattttagcaaaacaaatagatgctggaaatgactcactagcaaggatctccagctgtcctagccctgagactcctgtgcttacaatgaaggaagacgagaacagtgatgccagggtaaactgctcctctgtggagttacttccttggcctaagtttgtttttnntttattntgaatntttantagtgggctggatnccatntccgtacatggaaggttagtngacagaaacaagagtgtgagcaggctaaaacacttatcaatttggtaagcaatcagaaggattggtggtaactactttgatgtcctaggcaaatgtgtcaaaa

SEQ ID NO: 7787 - DNA, 452 bp, Mus musculus
  misc_feature (281)..(281): n is a, c, g, or t
  misc_feature (287)..(287): n is a, c, g, or t
  misc_feature (294)..(294): n is a, c, g, or t
  misc_feature (301)..(301): n is a, c, g, or t
  misc_feature (309)..(309): n is a, c, g, or t
  misc_feature (323)..(323): n is a, c, g, or t
  misc_feature (330)..(330): n is a, c, g, or t
  misc_feature (337)..(337): n is a, c, g, or t
  misc_feature (339)..(339): n is a, c, g, or t
  misc_feature (341)..(341): n is a, c, g, or t
  misc_feature (348)..(348): n is a, c, g, or t
  misc_feature (353)..(353): n is a, c, g, or t
  misc_feature (381)..(381): n is a, c, g, or t
  misc_feature (395)..(395): n is a, c, g, or t
gtaggacaccataatgcctcacgcataaagccacagaaagccacactttcaaccctacagtccaaacacccagaagtaactcatcaagcctcgtgtaaagcagaaccaaaacgctatgaggagccacatcctgaaaggatacagatgacaagcccattaacttatgaccaactcaagtctaaggacaggcaagatgagtctgtgaggaggaactttgttaaaatggaggcttatagttctgtgctaaacacgtatacaacgacaagccctgctccagggtntggatntggacantgctgcnacagtttngaacacagcagaantttcacnccgccantntncaggccntggcnttttgtggagagtgtggatagctacctntgcaggacatggcngcagttacactaccactattagagaagacaaagatggtacgtttctgaaatgctcaa

SEQ ID NO: 7788 - DNA, 515 bp, Mus musculus
  misc_feature (265)..(265): n is a, c, g, or t
  misc_feature (304)..(304): n is a, c, g, or t
  misc_feature (363)..(363): n is a, c, g, or t
  misc_feature (412)..(412): n is a, c, g, or t
  misc_feature (443)..(443): n is a, c, g, or t
  misc_feature (446)..(446): n is a, c, g, or t
  misc_feature (457)..(457): n is a, c, g, or t
  misc_feature (490)..(490): n is a, c, g, or t
atggctgactcactttcttgaccattttaatgacatgaagagcagtctgaccctggaagagatagaggtggtctacttttcatccctttccaggcagctggagtttgaggcaacctccaagaccgtgatccccctgtttcacttggcatacattttaatcatactctttgcagttgtatcatgctccaggttggactgtataagaaacaagatgtgtgttgcagtctttggagtgttttctgttgccatgtcagtggtgagtggntttggcctgatgctgcaccttggggtcccatttgtgatnatagttgcaaattcaccatttcttattcttggtgagtaaaaaaaattacgaggctgtgntaaatttgtagatatgttcagtggataaggaaatgtcttttgtttagcnggctcaaacaacagaaagtataaattatttntcntaagaattggnaaatatagtaccctagacaaatagaggaaaganatatggccattagttcacacataga

SEQ ID NO: 7789 - DNA, 451 bp, Mus musculus
  misc_feature (115)..(115): n is a, c, g, or t
  misc_feature (393)..(393): n is a, c, g, or t
gacactggacataacctcaaaactgctatacaagacttgctcagaaagacagagagacactggcaagaatgtcaaagtttctctctagcaatttaaagctgttctttgttctctntgcaagccacatagttcatgtacaaagaatcaggctatttgtgtgtgagcaggaggcccttgagacttagaagccagtcacacacccaagagtgagggtcttggaacaattacttacacaagtattggtgtatctccagaaaagacacaggaaaaagagcctaactcagaaaagctaaagctggcttcaatggatacattgtaactcaatcacatcccaggttctgcatgggatttactcacagaggtcatttttaccattggaagcatcattcctanaacaaagatatgggggagtgaatctaagttatccagcaccctgtatggcttttcagag

SEQ ID NO: 7790 - DNA, 357 bp, Mus musculus
  misc_feature (167)..(167): n is a, c, g, or t
  misc_feature (178)..(178): n is a, c, g, or t
  misc_feature (203)..(203): n is a, c, g, or t
  misc_feature (205)..(205): n is a, c, g, or t
  misc_feature (232)..(232): n is a, c, g, or t
  misc_feature (235)..(235): n is a, c, g, or t
  misc_feature (237)..(237): n is a, c, g, or t
  misc_feature (267)..(267): n is a, c, g, or t
  misc_feature (278)..(278): n is a, c, g, or t
  misc_feature (317)..(317): n is a, c, g, or t
tccaccatcaaagtgttcctgtacaaattacaaaggagatagaaaaaatgacacgcaaaaaagtagaaacagagaagaaaaatattgtcttggaatctgagttgaaagagctaagtgactctttaaagaagcttgaaaacaaagtcaacactcttgcggaagaaagngatgacataangaaggaagttgagggcaagcgaacntntctagaagtcaaagaacgagagtatgnccnantgcttaaactattggaactaaccaaagagnacgaagcctcntcgctagctgaaaggttgcttatatttctgcacattctntcatttaaattttaatcaatgatgtcctgaagattcaaaa

SEQ ID NO: 7791 - DNA, 500 bp, Mus musculus
  misc_feature (294)..(294): n is a, c, g, or t
  misc_feature (298)..(298): n is a, c, g, or t
  misc_feature (300)..(300): n is a, c, g, or t
  misc_feature (302)..(305): n is a, c, g, or t
  misc_feature (307)..(307): n is a, c, g, or t
  misc_feature (309)..(309): n is a, c, g, or t
  misc_feature (314)..(318): n is a, c, g, or t
  misc_feature (320)..(323): n is a, c, g, or t
  misc_feature (325)..(331): n is a, c, g, or t
  misc_feature (333)..(333): n is a, c, g, or t
  misc_feature (335)..(336): n is a, c, g, or t
  misc_feature (338)..(338): n is a, c, g, or t
  misc_feature (340)..(340): n is a, c, g, or t
  misc_feature (345)..(346): n is a, c, g, or t
  misc_feature (349)..(349): n is a, c, g, or t
  misc_feature (353)..(353): n is a, c, g, or t
  misc_feature (355)..(355): n is a, c, g, or t
  misc_feature (357)..(357): n is a, c, g, or t
  misc_feature (359)..(359): n is a, c, g, or t
  misc_feature (364)..(365): n is a, c, g, or t
  misc_feature (367)..(368): n is a, c, g, or t
  misc_feature (370)..(370): n is a, c, g, or t
  misc_feature (374)..(374): n is a, c, g, or t
  misc_feature (382)..(383): n is a, c, g, or t
  misc_feature (391)..(391): n is a, c, g, or t
  misc_feature (394)..(394): n is a, c, g, or t
  misc_feature (396)..(396): n is a, c, g, or t
  misc_feature (399)..(400): n is a, c, g, or t
  misc_feature (416)..(416): n is a, c, g, or t
  misc_feature (426)..(426): n is a, c, g, or t
  misc_feature (465)..(465): n is a, c, g, or t
  misc_feature (469)..(469): n is a, c, g, or t
aattgtggcatactcactattggattgacactgaataatttacagccacatacaaagtatatgggtgactcttaccaaaggacttggagcaaaagaagtcagataagagctaggaaccaatcgatcagtctggaaacttcgagattctcagaagttgaaagccagcttgggctatttagaactgctgaagattgagggcaggatggccccaagggaaaactgatggaggctgttgagaggtacggatgcctacgtgcatctagggcacactcctgagggcctgtcccatctgcncttncncnnnncntnctttnnnnntnnnngnnnnnnntncnnananccttnnaantctncngngngaaanntnngncttntctgcagnngggaaagnttnanatnnataagcgataaccttngacttgtggnttcccgggaggggagggaggtgaagcacattgaagcccntgcntaaattaggatggctcagattgtactatgat

SEQ ID NO: 7792 - DNA, 445 bp, Mus musculus
  misc_feature (367)..(367): n is a, c, g, or t
  misc_feature (373)..(373): n is a, c, g, or t
  misc_feature (383)..(383): n is a, c, g, or t
  misc_feature (399)..(399): n is a, c, g, or t
  misc_feature (406)..(406): n is a, c, g, or t
  misc_feature (408)..(408): n is a, c, g, or t
cagcgacgcttcgttcttaaagggttcgttgaccaggaccatttcctgggctttgttcgtccagattcacatttaacacggggtctcccagaagaccttcacccatttcccagccaaggcctcaacatttcaaaagggttcctgatacccatgtaaagctgggcacagtgctcccatggggagacgggagacagacataagcttttgaaccggcgaatctgatctaccctgaagtaaacaaaagactctacctcaaacaagatgggagacaaggcctgaaacctccacctaaccactctagtacacacacatctgcacttacacaaacacgcacacatacaccatacagatacacaccaggagcatnacatanatccatatantcccacaaagatccantaaaaantnttttgcacgttccagtatctactgttgtgaacctagt

SEQ ID NO: 7793 - DNA, 514 bp, Mus musculus
  misc_feature (54)..(54): n is a, c, g, or t
  misc_feature (110)..(110): n is a, c, g, or t
  misc_feature (112)..(112): n is a, c, g, or t
  misc_feature (155)..(155): n is a, c, g, or t
  misc_feature (158)..(158): n is a, c, g, or t
  misc_feature (161)..(161): n is a, c, g, or t
  misc_feature (188)..(188): n is a, c, g, or t
  misc_feature (206)..(206): n is a, c, g, or t
  misc_feature (223)..(223): n is a, c, g, or t
  misc_feature (361)..(361): n is a, c, g, or t
  misc_feature (371)..(371): n is a, c, g, or t
  misc_feature (376)..(376): n is a, c, g, or t
  misc_feature (435)..(435): n is a, c, g, or t
  misc_feature (437)..(437): n is a, c, g, or t
  misc_feature (439)..(440): n is a, c, g, or t
  misc_feature (466)..(466): n is a, c, g, or t
  misc_feature (469)..(469): n is a, c, g, or t
  misc_feature (476)..(476): n is a, c, g, or t
  misc_feature (478)..(478): n is a, c, g, or t
gcatagggacagaggccagcttattgaagttaaacatagctgcttcggccacancttggtgaccattactgaggtgatggcatttagcaaagaacaagatattagggaananattcttggctttacttcacagtccctctctgaattcaactgtnatnatnttttaagaacaagcaggaataagggangacgaaacatcagaagcnaaaagaaaagatctcanggttgtccaaggaagagcaagggaaataagaaggtctggaaagtggtgacaagaataaaatcggtacttgaagacagttttgaaaaggagaaggaagaaaaaaaacatatcataatggtgttttattgccactcaaangaagaaaggnaaaantcaaaagaaggagaatgcagagggttatgaagaatttcttattccaaatgatgccattntntnntctgggtcgggcccagtggcagaatnttntgcatcntntccccaaaattgagagcagtagttattttgtttttt

SEQ ID NO: 7794 - DNA, 539 bp, Mus musculus
  misc_feature (386)..(386): n is a, c, g, or t
  misc_feature (391)..(391): n is a, c, g, or t
  misc_feature (397)..(397): n is a, c, g, or t
  misc_feature (409)..(409): n is a, c, g, or t
  misc_feature (445)..(445): n is a, c, g, or t
  misc_feature (512)..(512): n is a, c, g, or t
  misc_feature (514)..(514): n is a, c, g, or t
gcagggtgagcaagacatccttgaagaagagaagccgctggcgctcagcagcctggcagctctcaaaagcctgctccatgtcctccatgtagcgtggggtgtagcgatttagctcggccagggtctgctcatactgggttttcatctgggtgagagagaagggaggcagtgaggacagactgccttccactcaggcccgcaccagcattctctgagcatagccataggctagacctgaagcagtcagacctggaactcacttcctaccctcaggaactgacagaagcagcctaataagggaagtggtacacaaacaaacacctagaagaatctggatgaagtgcaagacagggtcaatctagatgataaggtgagataaatccaantaggntccctngaggaggaggtnttatagaactgccacccctcagaaaggatgaaatgntagagagaaggacactccgggcaggcgacagagtatgcaatatgagaaccgattccaggtaactaantntccaacttcctgaaacccagctatt

SEQ ID NO: 7795 - DNA, 565 bp, Mus musculus
  misc_feature (350)..(350): n is a, c, g, or t
  misc_feature (353)..(353): n is a, c, g, or t
  misc_feature (355)..(355): n is a, c, g, or t
  misc_feature (371)..(371): n is a, c, g, or t
  misc_feature (407)..(407): n is a, c, g, or t
  misc_feature (409)..(410): n is a, c, g, or t
  misc_feature (487)..(487): n is a, c, g, or t
caaatctgatatcccagttggaagaagaagacaaagttataagagaggacagaggaattattccaggcatccatccagatttggagaaggtacttaaagccaaatggctaactcctaagaatcttatttttagtaaagaacatgataacggtggaaaaacagtacaactggaggaaagaggtcatcatggaatgaaagtcaatgagtgcaatcaatgttttaaagtcttcagcacaaaatctaaccttactcagcacaagagaattcatactggagaaaaaccatatgactgtacccagtgtggaaaatccttccgcagcaaatcttatcttactgttcacagaagaatncanantggggaaaaacctttngaatgcaatcactgtgggaaagcatttagcgatccntnntccctcagacttcataccaaccttgatactgtgtgagagaaaactacagaatacctgagggccaggaggtagctttntgagacgcgtttgagaaacttgccatgaaattagtgaagagaaatcagcaatagatcgtcattcttttgataagtatg

SEQ ID NO: 7796 - DNA, 494 bp, Mus musculus
  misc_feature (349)..(349): n is a, c, g, or t
  misc_feature (359)..(360): n is a, c, g, or t
gtgaatacacatacatactaatctatagatgtatgtgaaaataatttttaaagaagggtacttaacttgagcactggggcttgagagggactggaggacagagatctggcaggggctggaagaaagtgaggggagcgatgtaattctattgttaaaatgtattttttaagtgcctgtgaggggctggagacatggctcagcagttaagaatgctgaattctcctgcagatgactaggttcagttctgaacactcgcatgccagctcacaaccatctatctgtaactccacatccagggatctgacccttctgacttcagtggctcccagatgcccaaagtacacacacntacacatacnnatagaatcggtatataattaagagtgcctgcagacacctagaaatggcagctgtgaagaaggacatgtaattttcactaaatgtcaggatgagaaatttatcaagattctgttacaggttttcagggtcaaagc

SEQ ID NO: 7797 - DNA, 565 bp, Mus musculus
  misc_feature (355)..(355): n is a, c, g, or t
  misc_feature (421)..(421): n is a, c, g, or t
  misc_feature (488)..(488): n is a, c, g, or t
  misc_feature (531)..(531): n is a, c, g, or t
  misc_feature (533)..(533): n is a, c, g, or t
aggaaacccaagttgatgtactcgggtgtaagtgacccagacagcaaggctgatagttaaccatcagccccttccagtattcctcatgcctctatctgctgagtacaagcatacgtaattccgtgtgatgccaccagaattacccagatgtatgaggcccaatttacagaatcaagaacaaacatggttgttagcttagaccactaaagtaggaaaatgagacatgatgaaggtgaagaggttggaatatttagatggtaaatttgtataaatactgaaagggggcatgaagtcaactcatgatgtcatcccttaaactatggtgggttcaacatcatttagtggttattttaantaaatacagaaagaatttggaatttgatgaatttgtgaagacacattcctatcatgtgtgtaattntttgagtaaacatatgtgctataacctcaaatttagtgagatccaaaatcaggggcttattaatttntctatcttacctatatggacaatatcgtgcttgaacatatgtntntgaccagagaggtattgagaacgtttccaaca

SEQ ID NO: 7798 - DNA, 531 bp, Mus musculus
  misc_feature (339)..(339): n is a, c, g, or t
  misc_feature (454)..(454): n is a, c, g, or t
  misc_feature (465)..(465): n is a, c, g, or t
acttgaacatgggtcaccttcttgcctgctcgctatccctctgtcaccttcaaacatttctgatgtgatttacaatgggcatcaagactcacagaatttgtttcaatggtgatccgtaagcatacattctttgtgatcttcacccagaacactgtatgggaagcatcaaaatcagtcctgtgcagtgctcttctgtggcatcgagcgctctctctctctctctctctctctctttctctctctctctctctctctctctctctctctcctctctctctgcatttgtgtatttgtgtaatcacacacacatatgtaaccaacattgtatgcatttagaanacaccctgccatacacaatgagaaacaaaccattcattttatctcagaaccacagctacaccagaattcatatttgtgcaagtcattgttaggctaaataagaaatatatcggantcctaacaaantagtttctgttcagaaattggggacatgagctctaacaacagctggtgcatgttctaccacatgta

SEQ ID NO: 7799 - DNA, 322 bp, Mus musculus
agtctttgtggtctcatgagcttgagctccatgcgtgattggtcatgtatgattagggatataacatactcggctttggttgatcatcattgagaagaccacacatctctgatcggaggcagtgaagcaaacggttgacttagagagctttatttaatgtgtgattcagataggatgaatgaatataaattgctgtgttgatactgaagtcctgagaaacagagcctcaaggagcctcagcttgactcctacaattcttttgagcaagaagacgcagagcctttcttcattcgagtcgtactttcttacatgtctgtgcctt

SEQ ID NO: 7800 - DNA, 482 bp, Mus musculus
  misc_feature (275)..(275): n is a, c, g, or t
  misc_feature (287)..(287): n is a, c, g, or t
  misc_feature (312)..(312): n is a, c, g, or t
  misc_feature (371)..(371): n is a, c, g, or t
  misc_feature (373)..(373): n is a, c, g, or t
gattgggtcaactgtgccttgaactagaaatgctgattgcagttcagaaaatacctaaataattccatccacagattagtctcatccagattgatggagatgtatttacagtaaaagaatcaaggttacacaatgtttccaggttagcgccagaactacctgtgatggcaacttttacaacgcaacaaggttgctaagatgtgactgtgatcttgccttgtttcacaacagtctcttgtttcaaatttaatgtgttccttttacttatatgtcantcaagaaattgntgatgaggtaggcaggaaaatcagnatctacccagatgactggttacaacataatcttcactgtcttgacaaatactaaagttntntacaactcaggagggaaagaaacccagaagatccgtatccacagcttagcagtcttgtaagttaaagcaaataattaagctccagtaactgtaccacctaagtcagcag

SEQ ID NO: 7801 - DNA, 435 bp, Mus musculus
  misc_feature (364)..(364): n is a, c, g, or t
  misc_feature (370)..(370): n is a, c, g, or t
  misc_feature (379)..(379): n is a, c, g, or t
  misc_feature (381)..(381): n is a, c, g, or t
  misc_feature (403)..(403): n is a, c, g, or t
  misc_feature (405)..(405): n is a, c, g, or t
ggatgagcctgcagatttggtttcagaagtttcctgagcatcgcctgtgtctcccaggcatctccacatcaaacaaaagggaagataagcacaggtgttagagagcagagctgtgaatgtggctttgatgccatcccacctgtggacctgtaagctgctgtgcagacttgacagcctgttgccgccacatgtcctcttgacatccgagtctagtgaagccagttgttccatcagctgaagcaaaactggctgtcagtatttggtgaggcagccctgcaaggcttttcgggttctgttcttttaataaggccatcttggaacctgaagactttggggacagcagcagcagaacccctgccacacntgccanttcacactngntgtcaaaccttccaggttgaancnattggaaacatttggaaaggcctggtcagg

SEQ ID NO: 7802 - DNA, 479 bp, Mus musculus
  misc_feature (302)..(302): n is a, c, g, or t
  misc_feature (317)..(317): n is a, c, g, or t
  misc_feature (326)..(326): n is a, c, g, or t
  misc_feature (348)..(348): n is a, c, g, or t
  misc_feature (350)..(350): n is a, c, g, or t
gggacaatccacttttctactgcctggttgctgaagcacccagtgaacagacagaatcaggagtcaaaaccattggatttgccatgtactacttcacatatgacccacggattggcaaactgcttcacctagaggatttttatatcactgaagactatcaaggtataggtattggggctgacatgctgaagaagctaagtcagatagccatcaacaccgaatgctgtggcatgcagtttcttgtcatcatttggaatcaggattctgttgagtactatactcgcctaggggctttagacctntcctgtgaggaaggntggcatctnttcagatttaacttggatgatntnctggagcttgcagaggaagaatgaaaacaaaaacaaacaacaaaaaaaaacccaaaaacaaaaacaaaaacaacaaaaaaacagtaacaacttatcccaaaataggcctcaatgtttgaatgtcacctg

SEQ ID NO: 7803 - DNA, 442 bp, Mus musculus
  misc_feature (332)..(332): n is a, c, g, or t
  misc_feature (349)..(349): n is a, c, g, or t
  misc_feature (352)..(352): n is a, c, g, or t
  misc_feature (354)..(354): n is a, c, g, or t
ggatccccacctcctggatatgaagcccccactatggagtatggagcccaacctcccagatacggaactacacctatgggatccggttccccacctcccagatatgaagccccgcctatggggtatggaactcctccttcagggcgtgagtccatacctcctggatcaagggccacgtctgtagcacaggaagctccacctgctgggtctgaagcaggccatcccatgtctgtggcagtccagaatcctgaattccaggcatcttttccctctacctcgtcctcacaagtccactctccccgctctaagatgtaaaccttgaagtttcaccnagcaaaacagcaccctnatntngaagtcaagataacccggaacacttaggtatctgatcacagacctgttctaggtagtttgtttccctccttgggagtttagtcacagg

SEQ ID NO: 7804 - DNA, 177 bp, Mus musculus
gcagagaacgcagccggcaagatccggagccctaacattcgcatcaaagcagttttcagggaaccctacaccgtccgggtggaggatcaaaggtcaatgcgtggcaacgtggctgtctttaagtgcctcatcccctcttcagtgcaggaatacgttagcgtcgtgtcttgggagaaa

SEQ ID NO: 7805 - DNA, 381 bp, Mus musculus
tgatattcatcacagggcgagtccacccaggggaaacgccatcttcatttgtgtgccaaggaatcatcgacttccttgtaagtcagcatccaattgcccgtgtcctacgagaacatttagtcttcaagattgctccaatgctcaaccctgatggagtttacctgggcaactacaggtgttccctgatggggtttgacctgaatcgtcactggctggatccctctccatgggcccatcccaccctgcatggagtgaaacagcttattatcaagatgtacaatgacccagtgagtagcaggatgtcctcagcagctactggctgctggccacatctggggatggaagattgtatgggggacatcctcggacagctctaaatta

SEQ ID NO: 7806 - DNA, 515 bp, Mus musculus
  misc_feature (351)..(351): n is a, c, g, or t
  misc_feature (354)..(354): n is a, c, g, or t
  misc_feature (359)..(360): n is a, c, g, or t
  misc_feature (362)..(362): n is a, c, g, or t
  misc_feature (383)..(383): n is a, c, g, or t
agctactctcaaaggtcactcaacaatgacaagagcccagcagggtcaggacagaagagtgaggagagaccagggtcccagagggcttttggccccgtccatcattagtatcctctgcatggatgctggtacgaacctcagatgccagcgtcatgcatgggcactggacctgagacatgtttagagaggatcttaaaataatccaatcaaaccaccaaattatctgcttgtggcagaagtgcgcccgagtggctgttcttgtgaagaaacagctctttgatcatctcaagaggcttcctcagctgcccagacagttctgggtagagcaaagaggctgcctgtctctttttngcnagacnngnccatcagtggtccacctgggnaaacacaggcagacggcggacaagaaagggacagcaagttcaacatggtactggggcttcttacctacatattccgagaggaagacgacaaagaacggagtgaccaggtcattaattccctggacataccca

SEQ ID NO: 7807 - DNA, 84 bp, Mus musculus
aaagtgaagcagaaggcttgtctattggtgatgatgtgagttcgttcttgttgtgctgttcacaatttacatctcagctggaag

SEQ ID NO: 7808 - DNA, 293 bp, Mus musculus
agtgttattgtatacagcccaggctggcttcagtctgtgcctctgctcccggtgcactcccacgtgccatccttttctcctgaccccggtcacggggacaagggcaccaggccgggtcctcacatgagtttatcctcttgtttgcctttggtgtttcctatccaaaccagtaagaacgaggctagagagatggtagttgagtgcacactgatagtgcagagggcctgagtttggttctcagtacccatggcaagcaacctgcaactccagctctatcaggatggcctggcgct

SEQ ID NO: 7809 - DNA, 384 bp, Mus musculus
gaagggaggcaaacattcctgttcagtactggagaaagaggggaaggagactaaacggcaagcgcagcccacaggccgggccagagagggtgcaaacagactgtgtagatgcttccccagtgaagggctgccaagaattgtgcatgatgcccccacagcacagacaagacagcaggtaaaaaagagggaacgggtgcaaatcaaagaccaccaggagcgcatgcttcgagggagggaactcacagagcaaagactcaaagaacaactcatgcagaaagaccagagccagctcccttcacttgagaagctccatcgagtgaagaaagagatgaaggactgtgaaagggccaatgcacacccacttctgcagctacgcactaaaag

SEQ ID NO: 7810 - DNA, 264 bp, Mus musculus
  misc_feature (94)..(94): n is a, c, g, or t
  misc_feature (96)..(96): n is a, c, g, or t
  misc_feature (108)..(108): n is a, c, g, or t
  misc_feature (134)..(134): n is a, c, g, or t
  misc_feature (146)..(146): n is a, c, g, or t
  misc_feature (156)..(156): n is a, c, g, or t
  misc_feature (158)..(158): n is a, c, g, or t
  misc_feature (222)..(222): n is a, c, g, or t
ggcggctcccaacatttttgaaattttgatacttattctagggttcataatacttactgacttgtccctacctaaaggcagatagaactcttancnaaaatccctctncccctgggataactttgagcagatgntctttcctgaantattaagtgnanatgtatttgtttcacaaacttgttaaatttggtttttttttttttagattaccataagtttcanggctataaatgctcagaaatttcctctttttcactagcagct

SEQ ID NO: 7811 - DNA, 563 bp, Mus musculus
  misc_feature (330)..(330): n is a, c, g, or t
  misc_feature (340)..(340): n is a, c, g, or t
  misc_feature (354)..(354): n is a, c, g, or t
  misc_feature (370)..(370): n is a, c, g, or t
  misc_feature (372)..(372): n is a, c, g, or t
  misc_feature (377)..(377): n is a, c, g, or t
  misc_feature (445)..(445): n is a, c, g, or t
  misc_feature (495)..(495): n is a, c, g, or t
  misc_feature (498)..(498): n is a, c, g, or t
  misc_feature (518)..(518): n is a, c, g, or t
gaaaggcaacacaagctgaagcatgtgtgttaaaggcactatggaggtgaacctttaagagatgagctccgcacaagtcccttccagtccaatgcagcaccagggtctctggccccggggagtctccagacacagaaaagacctacacaggatccgcgatgggatcctaagacctctgggcagtgaaaatcaggtcactgcaatcatgaaggcaagagatgtggaacatggaacatgaagaaggcacatggaaccaagtgaagtggctaaagctatgatgaatttaaaatgaggtaaaacaagacgtgtgcttccttctcctcgttcacnagcagcttgnagaggacaaggtgnagcattaaaagactgnanaatgntgaaacgcttcggaactgtgcaagctgccccaagacccagaataatcaatgtggaaccctgcttactnttttcaaagggctgaaatttccaactggaaactgaagcaacgaggattcnttncaggcactaatcagtgggantcctcactactttctgagaagagtgaaattctccatcaatgaaag

SEQ ID NO: 7812 - DNA, 183 bp, Mus musculus
tggtgtcactgcactcagttgctggcttccacttcgggcttcgttttcacaggggccgatcaacagtgctaatcgagatatttccgttctccagtgccatggagattgtgaccctttagttcccctaatgtttggttctcttactgttgaaagactaaaagcattgataaatccagccaatgt

SEQ ID NO: 7813 - DNA, 337 bp, Mus musculus
  misc_feature (251)..(251): n is a, c, g, or t
  misc_feature (253)..(253): n is a, c, g, or t
  misc_feature (287)..(287): n is a, c, g, or t
  misc_feature (295)..(295): n is a, c, g, or t
ctggttctgcttgttggttcgaggatacaccatgagcatctctaaccacctgggaagacaggatgagaaatagtaccaggaagcctggatcttagaactgttccatgtcagctgatatttcggtcagatacttgaggctgtgtgtgtgaagggagtgattcctacaacttcactagaatcctaaatcaagattatcttcccacaaggacctcagaaacaagtgttcttcattcacccatggacaagacacntngtatttctgagacagaaaactatcgctatgaggnttgtgagnactgagtgacagaagctgtgccgacagccagtagtgaccaga

SEQ ID NO: 7814 - DNA, 348 bp, Mus musculus
tgagatgtgcgccacggaagacctttcagtgctgagacttcctgtgtccacctccggagcctctcagagaccagaagaagatcgtcgctgcctttgaccctagccagcaaagctgcttctgtggtggtcagcacttaacacagagactcataggtagtccaagtgctgagttaagtgactattggctgttcagtcctcaatgggacatatgtatcaagaaccctcaaggctcagggtacattttacaaaggaaggcagaaaaaagtgaagtaagagacagagaaagggagaagtgctgtgatatgcttcattctggatacgacatggctaccatactcatgaactcat

SEQ ID NO: 7815 - DNA, 443 bp, Mus musculus
  misc_feature (197)..(197): n is a, c, g, or t
gtcactagacgcctaccaggagaaatgtccagagtgaggaagttctctaaattccacatatagtcttctccaacaacaaagggtcaggctctggccctacttctctgccaatcagcaggagcctcttccaccaaggagatctgaaaacaagaggttttgtgctctttcgggcactgttgtccctggaggatgatatnagagagtggagagcaatgtgctgaagatacagaccagagcagaagagcacagagccaggagtcagaagcccctgaatcaaagaaccatggagtgctggtgattaccaaggaaactgagaagaaacagcagactttagagaaccttcatgcactgtgagaatgtcaattcagctggctggcttcaggtttacctgtcagccgagcagccagtggtcctgaaggcagagcaaggaacccagaggacct

SEQ ID NO: 7816 - DNA, 202 bp, Mus musculus
  misc_feature (54)..(54): n is a, c, g, or t
  misc_feature (57)..(57): n is a, c, g, or t
  misc_feature (59)..(59): n is a, c, g, or t
  misc_feature (63)..(63): n is a, c, g, or t
  misc_feature (69)..(69): n is a, c, g, or t
  misc_feature (116)..(116): n is a, c, g, or t
  misc_feature (177)..(177): n is a, c, g, or t
gtacttaccaacaggtactcggcaaagattctgcctgcagcccgaaactgagcnagntntctnttagtntatgcctgtatcacaacctaatcatcccagcgacgaccacctcccantcccctcgcagagtgcccactcgcttaaaacgcactggctgtaatgtttattacccaatgnggacacccgtgttattgatagcagc

SEQ ID NO: 7817 - DNA, 405 bp, Mus musculus
ttggcaacccctgatattctgggtctcaggtctgtcaagctggaaaagagaagtgaccagagccaatccacacaaacgaacactgggaaccctaggtgtctactaaacatgaagactccgccctggcagacagcaggcagcaacgctgctgcatcctaagaggatttcccaaggcatcttctctttggtcccactgtgtcctgattgcacctcctcaaaatgacagacatgttttcccaagaaaactgaatcagggtcattctaaactaaaaaccctgagtcatgcacctctaggaaatgcaaacgtgttgcccacatctgatgcggagatgcagatggactggataacacagacacaactgcaagcatgagaacccaagtccggatcctaagcacccatgtaaa

SEQ ID NO: 7818 - DNA, 457 bp, Mus musculus
  misc_feature (343)..(343): n is a, c, g, or t
  misc_feature (345)..(345): n is a, c, g, or t
  misc_feature (365)..(365): n is a, c, g, or t
  misc_feature (425)..(425): n is a, c, g, or t
  misc_feature (427)..(427): n is a, c, g, or t
aggtgagccttcattcgcaagtgcagcagttaaactcctacaatgatattccaacagagagcattagctacagactgcccatcttaggtcctaggactgctgtcttccacaggctcctgtcaagtgcctatgaaaatcctcgggatactcaacaccgtgcctttcccagaaagaaaggaatgagcaagacagtgaagcagtaagtgagtggccagagctcattcccccccccccaaacactcagggacaaggccacttctccaagacagtttctgacactggtaccttcccctaatcatgtatctcccaaaagatgagtaactttttccttcccatgtgctgntnttctagctcttaccacttcntcctaaagataacatgatttactttacataactataaagacttattgactaacaaagaanangcttagtgtacctcatgttgttttgctgaa

SEQ ID NO: 7819 - DNA, 463 bp, Mus musculus
  misc_feature (399)..(399): n is a, c, g, or t
tgaccgggtctctagcgcctattggctcacgctccgcggctcctgcgctctcattggtatctttagcgactaattcgcccgacccacagcttctcaggcctccgccgccatagagaccggaactagaatgagagcctcggccgtgagcaccatagagtaccgggaggacgcgcagagggaacgttcccagatggggctgcgctcgtcgcgcacgtgggccgcgatcgccgggcctactccggcctcctagaaggggctccttcccacggctgggtgaacgccggggcctccttaatgggtcaggcttttggtgatccagtcaccttggagggaccacgcaggcgctggagctgccacgactcagcgtgttcagggcgggggtgatcgtttcccccggcntccgaggaaatgtatttcatactggccacaaatcagatttaatttcgcctcacatttattggat

SEQ ID NO: 7820 - DNA, 235 bp, Mus musculus
gcacatgaagtatatgtcctgggaagacactgggacccttactcttcaatgagtgttttcaccaacactgaccaggtgctgatgggagatagtttaccttcaaattttttcaagttttttactttacaacaaataaaaagaaagaatctctttctgcccctcatgctaaagagactgctctgcaaaaaaagatccctgttgttttctaaggagagaccgaaaggatgtggattct

SEQ ID NO: 7821 - DNA, 504 bp, Mus musculus
  misc_feature (359)..(359): n is a, c, g, or t
  misc_feature (383)..(383): n is a, c, g, or t
  misc_feature (407)..(407): n is a, c, g, or t
  misc_feature (423)..(423): n is a, c, g, or t
  misc_feature (428)..(428): n is a, c, g, or t
  misc_feature (446)..(446): n is a, c, g, or t
  misc_feature (448)..(448): n is a, c, g, or t
atccctctggatattcgagttgcccaacatctgctactcatcgcaagctttcttggcattattgccacaatctctgtcatcattgctctttggaaattgaactcagggagactccggaagaaagctaccttcaatccattccgtcttccaggaattctgaacatcattgctagcagctttgtctttctttccatcttgtacaattacttatcgatcattcgcaaggatgggattgccttccccccgtctttccacacaccctccttcccagatcatcaaaaaattggcactgcactggcaatggcaactctatcctgtttcttatttctagtgggtggaataattcccctttctttcantcttcccccacgttcccgagtgcnctatactatttaaaagtaaatttncaacttaaagacttgnaaatntaaaattaccaggagttntngcaggccttcttcagatacatacttaaaatttccagattcaaaaccatgcccaatg

SEQ ID NO: 7822 - DNA, 455 bp, Mus musculus
  misc_feature (398)..(398): n is a, c, g, or t
  misc_feature (418)..(418): n is a, c, g, or t
gcggtgtggtgtgtctataactagcgggtgtgtgtgcagagggatctagaaaagtctctcgctttaagatgatacagtctgcaaagagagaaaacacaaagacctcacaaacaaaccaatgaatcatgccaggccgtgataaagactctccgaggacacagttacccagcgatgacgtcacagaaaaggcaagagggcctgacagggatctcagaggacaaacagagtctcaccagacccgacggaaccgttccaggtggatgaagggtgtgatcggagcggccttagtggagtctgtggaaactgggaaatagtgggccttaagctgggaatgtggattcaggccagaatgtggaaggaaactaaggcgcttggacttcatcctagtggaagaactncaatccagtgactaagcagntatgacagaatgtgtgtattttgggacgtgtttctac

SEQ ID NO: 7823 - DNA, 525 bp, Mus musculus
caatttgcaaccaagattcttccagattgaaatctttttttctcagttttgatgtgctagttgatcttactgaccacactggaaccctccattcctgcagtctctcaggaagtattgctgaggaaactttgggctgcacgataaatgagtttctcacaatgacaagtgaacagaaaacaaagctgaagtggcaacttcttttggaaagaagcaaaatttatttaaaattgattttatcacacagagcaaggggtggactgaaagtcaccatactctcctgtaagcttgcagatcctactgaggcaagcaggaacctggctagacaaggacatacttaaaaccagattttgctccaaattctgggaaaatatagacatttaactcttacgatggaatgttagcttgagaattatgtgtaaaattacattttgcctaaatgtggtaaaattatttcttagattgtcactgtttccttctagagttagctcagccccctggaataccatttctattaaccttaccctg

SEQ ID NO: 7824 - DNA, 545 bp, Mus musculus
  misc_feature (341)..(341): n is a, c, g, or t
  misc_feature (416)..(416): n is a, c, g, or t
  misc_feature (430)..(430): n is a, c, g, or t
  misc_feature (499)..(499): n is a, c, g, or t
acacgggatatcatttttaactcggaactattgtctgaccgagctgtatctgaacaacaatgcaatatttgagatagaaggcctgcataatttgccttcactgaatattctcctgttgcaccacaatgagctcacaaacatcgatgctactatgaaggagctgaaggggatgcagaatctgcggagcctaagtctgtaccaaaaccctttatcccaatataacctctaccgattgtatataatcttccaccttcccggactggagttgcttgatcggaaacaaattacagagaaagagagaagatacatgattaccatttttgaccataaaaaagctcatntgattcaatcagtagcatttggaaaacgagtggatgcctcctggaaccccaagttaccaataaagcaaaagcggntcaaaaaacctccntcagattttgcatttggggataatgttgacaagtaagtggttttttgtttgttttttacttctttcctnttattgacagactgttttataattgtctcatttctaaattacccct

SEQ ID NO: 7825 - DNA, 450 bp, Mus musculus
  misc_feature (362)..(362): n is a, c, g, or t
  misc_feature (373)..(373): n is a, c, g, or t
  misc_feature (388)..(388): n is a, c, g, or t
  misc_feature (393)..(393): n is a, c, g, or t
atttaggtctggtaccagcttccagctctgtagacatcagctacgttagaagatccaacagcatcccttcggtcaatggatttggtgataattcacagggattccaagttggccccacaagaatgagaaggaacggctccccctttctgaatcagcatggattgctgtttctaccttcccgcagtcgtacatctgccaaccggattttccaaatcaaacaggaagaagggatggatatggcaattagagaagcaatgcatgagagggacatgcatactgcaatgcagataagtcggggtacggaacaatgtctaaatctgaatgacaataacaccgtgaagtcatccactatgaggaacatnaatccaaatcnattttccccagtggnttctntccccaaaagacctaggaagaatccacaccacgaccatctgaccttttagctcaagt

SEQ ID NO: 7826 - DNA, 429 bp, Mus musculus
  misc_feature (370)..(370): n is a, c, g, or t
  misc_feature (397)..(397): n is a, c, g, or t
  misc_feature (404)..(404): n is a, c, g, or t
gagacgcctggcttggtctccgtgtcggtggcgatgttcttgtcagaggcaggcgcaaggccccgagcaggcgaagccagcgcctcagaacgcaggaaatgggtgaaagtatttaaagcatgcgatgaagacaacaaaggctacctaagccgagaggactttaaggttgcgattgtaatgctgtttgggtacaaaccctccaagatagaagcggatgctgtgatgtcttcagtaaatcccaacacttctggtgtttcacttgaggggtttttgagtgccgtaaagagaaagaaggaagcgcgactctatcggaatgagataaggcagatcttcacagctttcgacgtgcactatcgtggatttttaactntagaagatttcaagagggcgtttagtngagtggntcccaagctaccagcgaggacagtg

SEQ ID NO: 7827 - DNA, 405 bp, Mus musculus
gacagaaggatagcgttgctccctcttcaggggcaaagctgcagttccctgttagcgaagcagaacaccttcttcaagaaagaaacctgtccaaatgcctgaactcttctacgcctgttttgtttacggatatgctcaattatgtgacatccagcattcttgagctgactgtcaaggacagagacagccacaccagctgcaacaaactcattgccccagagcagaagtccaagccaactgataacatcgatgaactctgccagctcttcaaggatagccagtatatggctgatgagactccaggatgctacaagacaccaagatccaataagataacaggactctatgaggcaccaagacccggtcccaagtgatgatatttgcatcttggaggctgggcatcca

SEQ ID NO: 7828 - DNA, 45 bp, Mus musculus
tggcgctgacatccattgctcgtagtaaatgtgcgcaggcgtcag

SEQ ID NO: 7829 - DNA, 536 bp, Mus musculus
atacttatcctagactggctcttccaggaccagatctgagtctgactcacctctgtgttcccaaaattgagtaccggctggtccaagagtggtttcctacctatatctgaagagttgagtatatgtggggcccatctcattcactgtgttctaggccctagggtgtttttcatcctaacaggaaactgatctggcctagggtgttgtctgcaagtcacccatgggcaccattgccttcgccaggccgcggtttcttaatgtagtactggaagttcatgtatttttcccaaaagggtaggcaaagttttcaagagtttgtgggttgttttctgggagggaggatcagcaacagtctccatcagaattcagcggggttgtgagaagagaccggagaaagggtacggggaggagaatagttcccggaaacatttgcccagatccctgggtcacacacctgctgtcctcctccgtcctcctccggcatgggaggagccctgagctccaggggtgcatgtcactgtttggccctttgggaa

SEQ ID NO: 7830 - DNA, 230 bp, Mus musculus
tacaaaggatctatgctacgctggagggatcctgtgcctctcggcagcagtcctgtgtgtcatcgatgcattgctgtttactgagaagaggaggaacaaagcgaaaagttccctggcgagggaaactaagctctctgccacccaactgaggcagaagcagcactgacgtcacccagccctccgctgggtgacacaagatcatatctacatgtataatcactcccaccagg

SEQ ID NO: 7831 - DNA, 491 bp, Mus musculus
  misc_feature (214)..(214): n is a, c, g, or t
taactggctggcatgcaccagtgtccactccttcccgcagtcggagagtctgccacctatcagcaggaagcggtgccagggacccttccgagacatcaatgaagtcttggaacagcgttataagcctttggagcctaccctgagggtggcagaacccatcaaccaccttcgtctggccagagaggcattcaagcaagaggaacgcatgcgcaangtgcaagacaagatgtttttgccattttcttcctaccataaaaaggagaagtacatcccaatgatacactcgtcaagtgcgtataattctgactcttatggacagaagcactttcgcagtcaagactctaagaagtggatctctgacaaggatttccagactgttctgccttcatttcaactcttctcgaagtatggaaagttatattcgaaagctggagaaattgtataaaggacaatggaaaagaagacagggaacagcagcaggactcctcaaa

SEQ ID NO: 7832 - DNA, 454 bp, Mus musculus
ctacttgcccaagaacatcgaggagatcatcgcctctctgcagtccgaagcccagcaggcctcagaccagaccatcaaggagcttattcagagcatcctgggccagaactacgacatcgcaatggaagatatttctttgatggaacaaatgtacctcagaccatctcaggtgcaatttgaagtacccaaggaggtggaagagaaaaatttcccaccaagtattacggaacatccagttgtgccgagcatttatgaggagctcccggagactgtgtcaagcatcttccaggtggaacaggaggaagctatgaaatgggtagacagagacgaaaatatcgcagcttttaaatctcaggaaacgttagacattgtgccacctgaggacgacggtaaacctttggatagtgctcttcccacaactgatgcaaaactaaccagccagccaactttaaag

SEQ ID NO: 7833 - DNA, 552 bp, Mus musculus
ggatcttatgagagtgcttctatcacaagagagtcaggagacagagctggtcacagttgtgagaaagaaaacagttcagagggcccaactcagaaaagtcttcgtgaagccagggaagaagttggatataaatcaaagttgaagaatgagaaaaaggattcagaatttcctgtagatatgcaaccagatccaaacgtgacttcatgtacagaaaacgtttctgcagcaaaatttgactacaagctaaacaatattttcagacttcatgaactcccagtgagctgcatcgtcatgcatccctgcagagactatctcatctcctgtagtgaagatcgtctctggaagatggtgggcctcccacagggcaatgtacttcttacaggatctggccacactgattggttgtctggctgctgcttccatccgagcctgacctgatggagtcgatcagggaaggattgcactcgtcctgtttctcacggccagctgtggttgtgtctcttctgtagacaagacctggggtgaagaatgtcttagcattggcttccatcc

SEQ ID NO: 7834 - DNA, 370 bp, Mus musculus
  misc_feature (297)..(297): n is a, c, g, or t
  misc_feature (317)..(317): n is a, c, g, or t
  misc_feature (340)..(340): n is a, c, g, or t
atatagcactgccttgatgctctcagatctggacactgaatctctgagggcgctccaatgatgagagtctgacaaggccagcatcctgctttcctaagcatctgaaatgaaggctcttcgggtccaacacctgagtccttgagctgacaagacagaatttgagcttccatattcatctgctaactccttcctccgctgagaagtctgctttcgtgaggttgcatggctgacagtcatttggcttcttgggctgatccacaagaccagtagcattatgggaaggagctgggaaggagntgggaaggccaggaagatgntcctgagcaccagtttcaatgancagaggaacaacgggctttatggaccattt

SEQ ID NO: 7835 - DNA, 162 bp, Mus musculus
aaacaggaagagatagatacaaacaggaaactgcttcttgacaatatgcacaataaaaacatcatccgagctgtagaacaacagcagcaagaggaggaagacgaaaagattagaaagtttatcaaagccaaaaaacgtcttatacaaatgaggatggacaaa

SEQ ID NO: 7836 - DNA, 464 bp, Mus musculus
  misc_feature (135)..(135): n is a, c, g, or t
  misc_feature (426)..(426): n is a, c, g, or t
cggcgcagagaaagagtagctcttgccgaggatcatctgaaacaaattgaggaacacaaagaggaagaagaagcaagaaagaaaagtgaagaaaaagatgctgaggagatgaagcggcagaatttgctgtatganatcgagatgaagaaaaacctaagcaagaaacaggaagagatagatacaaacaggaaactgcttcttgacaatatgcacaataaaaacatcatccgagctgtagaacaacagcagcaagaggaggaagacgaaaagattagaaagtttatcaaagccaaaaaacgtcttatacaaatgaggatggacaaagatgctgaaacacataggctaatggaagaacggagagaaagaataaataatttcctaagtaaactaataaaagagaaacttgatactgaagatttgattatngctagagatatttctgaagctgatgctgaactggagaa

SEQ ID NO: 7837 - DNA, 190 bp, Mus musculus
agataatgtcccgacactgtggcttcgttggaggtttacattaaaacaggactttggtgagcatgtgatgtcaagacaccttctttctacctgagagacaatgacatgtgacactgaggaggaaagtgtgtagctcaagaccagcagacaaatgaaagcttgttatctcatgtagtgtgcagatggacag

SEQ ID NO: 7838 - DNA, 466 bp, Mus musculus
tgccaagtcctcgaagcagtacctgcggcaggtcatctcggaatatgaggcgctggatcgggagctcccgtgtatccgaaaattctcagaaccaccctctgcccagcccctctgcctttgcatggagacttcggaagactttacgcacgtggaggtgctgcaggctttggaggccgagctgcccggggccatggaaagcgggcgcgtgaacagcatccgctacgagaatatgaatgtcatctgcggtactgcgggccgcagggacaggtggctcatcaccgtcacagacttccagacgcggtcacgcctgtgcgctccgggctcaccctccgtggaaccgcgtacccactggtgcgccacgacgatttactgctgggggactaccgtttgcacctgcgccgctctctggtccgaaggcgcatgctcgaagccctcggggcggagcctgccgacgaagattgacgca

SEQ ID NO: 7839 - DNA, 514 bp, Mus musculus
  misc_feature (262)..(267): n is a, c, g, or t
  misc_feature (269)..(269): n is a, c, g, or t
  misc_feature (271)..(271): n is a, c, g, or t
  misc_feature (273)..(281): n is a, c, g, or t
tccgtcttcgtgacagaatccttgaggtgaatgctacgttggactgtgacacacctggggcttgcttccagcattcagcttccatcttggtggtcgatggtggtcaaccccaaatgaccagagaacttcacctcctggggcctttggactatgagcagcagaggttgtacaagatcaccattctgctgattgatcacagtcaagactgggacctcaacagtcaccgatcaggttcatgtaccataaccattgaggttgaggnnnnnncnanannnnnnnnnctgattgtgacagaattagaggctttctggaagccagagccctggtttgtggtagtgctgacagcaactggtgcagttctccttctggctctgggttggctcctcagcaggatcctccggggcaacattttgatggcagagcccaagatgtctgtatggggagagattacctgttcaacacactcacgggagcccggcgttggctgtgaggcggagtagctgctttactctgt

SEQ ID NO: 7840 - DNA, 444 bp, Mus musculus
aagagttcgtgctatggcgtacccatggacactgcctcccctgctatccggctctgctgtgcgtgctagagctggcatcatgcagggtatttgcgtacatatatgtctgtgtacctcgtgtgtttttggtgcctgtggaggccagaaaagggcattggatgccctgggactggaaatgcagatggttgtgaggcaccatatgggtgctggaaatcaaacccaggtcctctagaagatcactcctgttcctgggctcgcctgaccacttcttcctgtagttcatccaattcacttctagaggtgacctccccatctgagatagaagcaaagaagatcaattaccacacctccagaatcaaggcgaattatctgttaaccttatggtcacgatgccattttcccttggagctctcgctttccagtttgtttcagatcccttttcat

SEQ ID NO: 7841 - DNA, 537 bp, Mus musculus
  misc_feature (50)..(51): n is a, c, g, or t
cataagttaactgtgcacccgagcccaagcttagtaacttcaaaagtcannagggaacagcagtgcacacgcccatatgaagcggttttctctgagatgcaatggtggaccagcttcaaggaacatggaagtctgtttcttgtgacaattttgaaaactacatgaaggaattgggagtaggaagagccagcaggaaactgggctgtctggcaaagcccactgtgaccatcagcacagacggagatctgatcaccattaaaaccaaaagcatctttaaaaacaaggagatttccttcaagctgggagaggagtttgaggaaaccacaccaagtggccgcaaaagcaagagtacagtgatcttagataatgactccttggttcaagtccaggactgggatggcaaggaagccaccatctgcaggagactggtagatgggaaaatggtggtggaaagtgcagtgaataatgtcacctgtacccgaacataccagagagtttaagaactccatctcaaggtctccatgctctcaaattgtc

SEQ ID NO: 7842 - DNA, 431 bp, Mus musculus
tcaactggcccctttgcttaaaggaaactatacaaggtcccaaagggcttttgtttttatgtgggtcctgattaccaatacttaccttattagaaatgacaacctataagattcttcaatggccttctcatctctagtttgcacagggctcgcagtgtttggctttttttccagagctttatcagagcaacttcgcttaagactctaaactcgggtttcagagtgatgccgccatttaacgggcattgggacaaaacgccagagtaagccgtcactttagtgtcagcctaagcacggagagggtggtctcagcctgctcagttgctctggagtagattcttgcttctggagaactctagaacctcctgagtcagtctcagcatcttcaattaaagctaagtgcaaaggatggaaatcttgttccctcagcc

SEQ ID NO: 7843 - DNA, 316 bp, Mus musculus
ctccttccttccactactggaggaacgtacttgatgactggtgccagaggtccaaaggtctcctcagtgatgcagagcatgtccctggtgacattgctgagcagggtgggctcaaagaaatttcctccactttggtgtcgctttccgcccgtcacaaccgtggcccctttggcaactgcgtcattcacctgcttctctacctgagagatgagaagaagggcaccagggaaagctggatagggacattttccaaactgtacaatcccttaaaatgttaaacagcaaaaaaccagtcaagactcgattcctgggaatc

SEQ ID NO: 7844 - DNA, 336 bp, Mus musculus
tacagtggtaagagcctgctatcccaatacttgggaggttaagacaggaggattatagggaattccaggacagtctaggctgtacagtaagaaactattgtaataaataaattaattaataaattaattttaaaagaggagaaggaggaggacagaacagaaccaaggctcccagtgaactttgtatgtgatactcaagtagcttgtgtgtgcacgtgtgaggggacaaaggtcagcctcgggtgccattcctcaggagccacccacacccacatttttgagatagcatctctgactgggacatgagacttgtagtagctcacattagctcctcca

SEQ ID NO: 7845 - DNA, 446 bp, Mus musculus
agcgaaagcgagagcagagctgcatgaagcatcagatggaggcagccgccagccacaagaggaacaccatcctgaaccagctggtggaccagaggcgagatctgcagatgcttcagaggacacagagagagcacatggcagacagagctgctgagatggatcgagtgaacagactcaaccagtgcttgcaagaggactgggacaggagcctggccatgaagaagcagcgggacgtggaggaaaaggcctttgagcgggcttcggacaagctgtttctcttggatcagtgtgagaagtatcggcgctgcaggcagtgccagaggcgcacctgcaacacgggcgagagcaacttgtggcccatgaataagttcctgcagggctcacgattgctcgtgtagaactcaacgcttgaacctactatttcccgaggaacatttatttggagt

SEQ ID NO: 7846 - DNA, 508 bp, Mus musculus
aacaattacctaacggagctgcaagaaaactttgagagggagttggaaatcatcaataagaaagaacgagagaagagaaaggacaagaacagggtcgtctcctccacgtcgctgtttgaatcgtctggcaagaaatccaagggaaacaagcaaagagaaactgcctttctttcaaggaagaaaaagaaggaggtagaagagagaccaaaaggtttctattctcctttctcatttcaaaactctatggatgtggataacaattccctgggcctaaaaagcccctacagaatcaagtctccttccagtgagggcagcagcagtatctccacaatcaagcaggacatgctcttccagctctcaccctcctccatggaatgaacttgcccaagaacaggaggagactgcggaggtgaccctcctgtctttgatcagatgcggtagaaagcggattcagcaatggcaactgagagctctgatgcagccagtgatgcatggaacctctcccagt

SEQ ID NO: 7847 - DNA, 529 bp, Mus musculus
gcatccctgcatttgtggtcaatgggcacagtggccatcctttgcaatattgggtcagtcttacagagtagcctctttagaatctccctttcagttacctcacatgacaaaaggagaggaaatttcccgtgtttcagaagtaaaaggaaattaccctcagacacctccatcacacttgctgagactcacccggaagatgtaaggtactgttctcttgtccgtggacttgagggctacgaaggctatgctgtcatacagggaagtatggctcagtacacagggaccgaatatggcgttctctgggatgtcgcaggttgtatatacactggtaaaaatgtctgtcagacactgttggacagccttggcatctccatcccagatgcctctctggatgcctgaatcctccatcactggagacagatacccaggacgagaagagagttgttattgccttttctgctacgaacctcggcagagcgtttccgctaccagacatattttctttgcacttgccggcttttttacatag

SEQ ID NO: 7848 - DNA, 471 bp, Mus musculus
cattaaggtggaaagccgcattctaaatatgagcagcacccatccatggggcagagtcctggagccagtaaaaaggagacagccagtcaaatgcaaggattcatcactttctgcttcaacgtaatgagtgcaatggaaccaactgtctctagctcattccaccattacttatccactttctatcaacagaatccttcaaatgtgaaccaaaagaaagcatctcctccttatttcttgaagagccagaaaagagctgataaaacgatgtatgtagactttttgtctctgagtgaatcttaatatcaatttgcaacagaagagccaaactccatctactgtgagatggtttcaggtagggatgaaccggttcatgtccctgttactgcagggatcctgtcactgtgtccaacccacataagaagcagactgtttatcacaaacaatgggatactgcttatccagctgccaatt

SEQ ID NO: 7849 - DNA, 384 bp, Mus musculus
tctgctccaccagagagtgtctctatatgctgtccagccacgacatcgaacagtgccctgtctatcgagacctgccagccagcagggtgggggggagccctgaacctagccagggggctggagccccccaagaccctgggggaacagcccaggcctgtgaggagtacctcagccagatccacagttgccccacgttgcaggaccgaatggagaagatgaaggagattgtgggctggatgcccttgatggctgcccagaaagatttcttctgggaggcactggacatgttgcagagggctgctggaggggctggcccagacacctcgactcccgagagctgaacccctcttcttagcctttcctcctgaaggaagtcgagccgtg

SEQ ID NO: 7850 - DNA, 132 bp, Mus musculus
gaggtgttagctgagccagagattcagctcatagagaagttgcctgagaatccactgctcaaaatagaggacacaagcaaacaagacaggccagtgaaagagtctcctgtgctggacagtataagaaagcca

SEQ ID NO: 7851 - DNA, 412 bp, Mus musculus
tcattgctaagattgacataacggcaaatgacattcagctggcaaacccagaacagtacccattcttcaggcttttccctactgactcacaagaggctgtcatgtataaaggagaacacaccatgaagggcttttgtgacttcctggaaagccatgtcaaggttaggattgaggaagaagatgagctattgtacattgagcaaaatgaagaggaggaggtgttagctgagccagagattcagctcatagagaagttgcctgagaatccactgctcaaaatagaggacacaagcaaacaagacaggccagtgaaagagtctcctgtgctggacagtataagaaagccagaagagccggagagaaggaaggaaacagctgagagggaggcggcggcagctcagccgaaggaaca

SEQ ID NO: 7852 - DNA, 413 bp, Mus musculus
cccagagcacacttgcattgatcaagcctcatgtgacacacaaagaaagaatggagatcctgaagaccattaaaggggcaggatttgagctgaccctgatgaaggaaatgcacctgactccagagcatgcaaacaaaatttatttcaaaataacaggaaaagatttttataaaaatgtattggaagtcttatctttgggcatgtcgctagtcatggttttgaccaagtggaatgctgttgcagaatggaggcgaatggttggcccagtagacccagaagaagcaaaactgctctccccagaatccctccgagccaaatatggactagacattttgagaaatgctgtccatggggcgtctaacttttctgaagcatcagaaatcattagtaatgtgttcacagagggtaatcct

SEQ ID NO: 7853 - DNA, 354 bp, Mus musculus
gcattgtgggaggttctgttcctccttcccatagatacagatgaccctcgggggtggggggaggttgtcttactaaaacagctgaacagagtgtgggaactctgagatcttggagaagcatgtttagaaagtacctggcctctctcccagaagctcttcatccatcggttcaggtgggatacaataactgataagatttttgataagcttccagagcgacttgggaatcccaagacggtttcatcacctcagggagagcttgggtgtggagctgaagagttcatgtgagttttggaaagtgtgcccaccgaaggaataatgacatccttgttttcttttcctccagataagatg

SEQ ID NO: 7854 - DNA, 364 bp, Mus musculus
atgttttcaggacaagccagtatgttcttggagaaaacccaaatgccttcgagtcaagtcagtattctgtgggagcgacccaaaataattttggaccaaatcaacataacttcggagcaaatggaaacttttgtgggacagttggaagaggaggaagtactggaggacttaatttttctcaagtatatggcaattttctgaatgtctgcaatacacttccaggtttccaagactctaatggtgattatttcgtcctctatagttatggggcttatgacgtaagatatgcacctaattacaatgttcaaataagccagtcaactctccttggtaatgattaccagcgaatttattccgcgttttg

SEQ ID NO: 7855 - DNA, 561 bp, Mus musculus
ctgttggcccagtccatagagagacaaatcctatgtgaggaactggagctggagtactctgtgctctgaagagtgaggacgtgatcctcatcctaagcctggtgcagggctgtgggctggagctggagcagtctggctgccagctcacctgggaccctacagtcgtgcctcagctttctgcactctacgggtgcctcacagggctacagctactagctgacccatgtcctgggctttctaggacagtgtctgaagaggaaacaccgatttgtccctaaggtctcatccaatctgatgcctggcagcctaggatgtcactgaccctcactagtggtcacagctgatgacacggttccaccaggagaagccccacaccacactttaagactggtttcaaacatctgaaacacctattcagaacaatatcctgaatcagtgttatttctgagcagtgcaggctacctgtaaaacattttggctgtgtatcttaggtagcatagtcccttctgtgctcaggtaaaatcagccattgtaaaagatttgtggtaattcccagggcac

SEQ ID NO: 7856 - DNA, 286 bp, Mus musculus
aaaactcatgttgccaccaaagtatgatgtagataggagtggtggacacttcatgggcatccctagagcacaataaggagagtgctatgtgcagctgagctctcgctttcaagaaacatgatagcaggcatcagcttaatggcacagagtgcccagagctcctgtcccacgagtcaggaaatggatgcacccagcccacgtaggagggagtgtttcctccctgccctttgcagaatttctcctagtgttttcttcagggaagacatgcttgaaaggcacatccaaa

SEQ ID NO: 7857 - DNA, 547 bp, Mus musculus
tattagcatcaagcatctctccaaccttccgtccagccatccggtggtgcaccagcaaccagccaggagtgaggtgcccagaacaaaaatccctgtttccaaagtgctggtccgtagggtcagcaaccggggcttggctgggaccaccatcagggcagcagcatgccatgacagtgccaaaaagttgtgaggtccccaaggccaaggaggatggatgggccatatgttaaggaatacaactttcccctggaaaccactgaaggaagttcgctttctccaaagcaaatcatttaggacccacccttctccatatggcctagaagtctttgttggagacaggggcaggacaccctggaagggggatgttacacctggagttcagataagtttctgagaattcttttctagcgccttcccttttcttttaacctttacagaagatctgggcttccttctcctcctcttcctcctcttcctcctcctcctcctcctcctccttctcctccttcttccttaattcatggatcattcagaagtcacctttctt

SEQ ID NO: 7858 - DNA, 333 bp, Mus musculus
aaggaacctggatcgcagagctgccttgggatgggatgacctcgcggccgagttagagaggagacacgctctgtgtttgcaaaaaaccacagcagttagtttggaaagaaataagctgctgttcttcaagtaaagggtttttctttacataattaaattctccaggtatctctgtgaaatactctgacttgttagaacctgtgagttggaatccttctatagctttactaaaactcacacagcgcagcataggatatgtgtggaggtgcttagccaggcatgatttatatgttgatttcagtcacaaagttgatcagcagcatgtgaatccag

SEQ ID NO: 7859 - DNA, 429 bp, Mus musculus
aagccagcggaggagaaactttccagaaaacagtaattaccctattgcaatgaaacattaaggaactgtaaacaaccagtgagccgacaatttccagtctcatgcagcattaacaaatccaagtgttagccgagaatttgtgataatgaagactgtaactataagtccatttttgtgaaaaaggttgcagagtccgccctcttcgtattttgttgatatgattggttgttatactaccttttgttggtattttgaagggaaaatggttagtaaaacatttaaatgtatgtgtcccatgactctgaaaaatggttcagaatccatcctttgagatctgtacacaaattatgtgcatgtctgtctttaccttccttaacaatttgtttctaataagaaaaaatatggtagacgaactcaaatgccaaccag

SEQ ID NO: 7860 - DNA, 107 bp, Mus musculus
ctcactgttatcatggtgattgtacatacctctctttgcttatttaatttgccagtggcggacatggttgaagcagatttaccgaagtttaacaggcagcctccttt

SEQ ID NO: 7861 - DNA, 335 bp, Mus musculus
agccgcccttgtcatgttacttctgggacaggaacactattactgtttggctgtttatctcactgttatcatggtgattgtacatacctctctttgcttatttaatttgccagtggcggacatggttgaagcagatttaccgaagtttaacaggcagcctcctttttccttgatggttgctgtcatcagtgctttatttaccagacctgcccagtcgttagctcccatgttgatactgtctaagctaaaccagcatgagcatggagaggcgaacaacagacttttagatcttcaggacagcatgtttaattcggtctgtgtggtctccctgggca

SEQ ID NO: 7862 - DNA, 371 bp, Mus musculus
agctgatgctgaagtgacctcacctacggcaaatgagaaagtgattgaaatgcaagacccttttacaaccaatgaagcaagcgtggagaagacacaaacccgcagaccagcagaatctgaactagaggtgttctcattagaagaggaaatcagttacaaagagactataaataatctacagcagaacccaggacaacgaagtgcaaagacagatgctgccactgaaaatcgaagcccatagttatcatgactcctgaaagcatgaagttggctaccatgaacagctgaaagagaaaagatatagttatatgattagaaaatatctactttagccaggcctcaaagaacatgatcagggtcttagggacgat

SEQ ID NO: 7863 - DNA, 426 bp, Mus musculus
aaaatcttgcttctggccatgctatttattactagccaggagcatttcctagaagcatcatcctgcaccgacctgatttggggtgaacaaaatccagttctctgtgtcttaaagttgtctgatgactgtctgggatcaaagttcaggatttcacatttctactggctgggggcgaatctttctaacaactttgttggaaaaattgtaccgtttaaagttgggagactcttagttctgagggcagagacacaccaccattcaatgcttattgaatctacaaatgctttcttgagaaaggaagacattgggactctctatctggtttgatgatatagagatttatcaaggtctggaaatgtcaaaagcgatgtagcacccaggaggtcttcagcgaaacacatgcaagctgtcttctacatgatctag

SEQ ID NO: 7864 - DNA, 422 bp, Mus musculus
  misc_feature (101)..(101): n is a, c, g, or t
  misc_feature (154)..(154): n is a, c, g, or t
  misc_feature (371)..(372): n is a, c, g, or t
  misc_feature (384)..(384): n is a, c, g, or t
aagtgagtccagaaagccctcgctcagtcaccaaggagatgccagtttgcacacagaaacttcagttaccacctcacaactctccagacctcccagccctntgaatcaacctcttctccaagaaaggttccagcctttttctcagtccacgtgncagaagatccccgagggtgtacgaagccttctgacatcccaccgagctcacccaaaggacagctttatctctgaaacaaattctatccatgaaagaccaagctaccctctgaagaaacacttactgcgtgcacagagatatttttaactcctatctcacgggaacacggatgacggatgaagagttcactcagcaagacactgacattcgaacaccnntcccctgttatntgggttgacttcctggtgcctagcccttgttaattcaa

SEQ ID NO: 7865 - DNA, 488 bp, Mus musculus
gaacatgctcatgtcttcttagtagacatttaggtgtttgttgtctttcttcccaaactgacctcagggactgtcccttcacttctgccgagagaatgatgcaaacccttgaggacgatgtgttcctatggaatccatctgtgacacctctgtccctgtcaacaatatttttgacagacaaccattaattccaaatttgcttttctagcaccaactgttttgggagctcttctcggtcagttgagagcacagcagcaggactcgattgcagtgcagtgaagacaagtgtagccatatctgcttatacacacaccttactgttccccaccacgtgaacaaaaactgcctccatctcagggtagaaagccttcctccacctctctagggcgagttaagcactgcgtcttctgtgggtggcagcagacagcagggaagagctgccctgcttctctgcagcttgctagatgatgtcacgattgtcttgagca

SEQ ID NO: 7866 - DNA, 477 bp, Mus musculus
agaccccagctcacaggttcagtttccaacacacagggcagagccgccttgccagagtgtgcatcaagaattcaacagcggggatataaacgcccggagcctccaggatgcaggaaactctcagtcctcagccctgaaccagagaggcatcatgtccaagaaatctgtactctctggtgaccaggaagaacctgtgggtctcccagcccccgattcagagatactacaactacctggaacacaaggctgtccccgttgtccagagttacagaaggaaatagaggacctcaggaaacaattgtcagccctgcaggctgtcagtgagaagttccagacccatttaagttaaacccaacgtgtccacaagacaaccagctgctgtggttccgactcctcctccagattctccctgcctcttgctgctgctttctttgccccctgcccctttccgagttaacagtcgtttcgaactcaaat

SEQ ID NO: 7867 - DNA, 418 bp, Mus musculus
cagaaatgtcatcaagctcagagcacagccctgtccatgtgagcagtctccttcagcttccttctccatgcttatttctcaatttgaatgccaggcaagatcatcatggctgacaggagaggctccagcatggaatgatcctatactgaacaaatcctatgaagattcaaggaatagactccgtccagggagaagaaggaacaggccatgagacccaagcctcaactcttgcacaagaatgggtgtattttctcccagagaaagatgatccagaaacaatgcttggaaagaaggagaaggagtggaaatgacagaaaagaagcaaaaggaagaaataataattttgaaatcatcataggatccagctgtccacactcagcgttgtttctggcctctagccgtggctttggtgacgtga

SEQ ID NO: 7868 - DNA, 372 bp, Mus musculus
ttggagcactcctcgagctgttgaagataccctgacttaccgagaggacttcctgaaacctgccacagagacatctgtggatttttttgttttgttttgttaagagactcaagttttatgatcgtgtactactcaaatcagagcaagaaacaaatgtatttttctaagacatcaagataaattcttaaaattttgtctaaggacacccctcccacccccgtctaggcagtatgaggatttgctgtttatagggtattctcagggcagcgttattaacccctgaggtgctttggaatcccagcatcacccacttgggcatacgtggagctttctggactcccaccagcagctgactgcttgtcctgttgaaat

SEQ ID NO: 7869 - DNA, 504 bp, Mus musculus
ggctggaaaagcttcagtttaccttctgattttcatatgagctatccaatttatatattagtatctctcttgagttcaattttattaagttgattggaatgtcaaatcatgttttcacctcaacttctccaaactaggaacctgattcagtgaccggacactaaacaactagttgttcaggtccaaattgatcatcatatcctattaaaatatacaaagaattttcaactgaggaatatcaaatgactgagaagcacctaaagaattgttcaacatcacctagtcatcagggaaatgaaaattaaaacaacgctgagattgcacctcacaccagtcagaatggctaagatcacaaatatgctaatgaaagaattttaactgaatcatctctcatactactagtacactaatctcttggacttcttcagcagtataatcagcaatctaataattatctatggacctgctcttagctcccagttcatcctacattctctactttga

SEQ ID NO: 7870 - DNA, 488 bp, Mus musculus
gttcagatgtgaatgccaccactgccagatgtgtggggggaacacatctgggatctctgagggaactgggacagaagcagtctctccatcatcctcctggtaaaagctaacactagacctcagtaacttgacactcaaccttcataccacccaaccccatcttgtacaagacaccatatcaaaaggagagaacaaaattcagtggtcaaggaaaaacaaaaggatgtttcaaaaggttctatacaaatggacagaatgactgtgacactgtcatcctcatgagaaggaagatccaaacctacaggatcatgagtgtcaacatcttttggggagcatggtcaggaggagtaatgtccaaccgagtgataataatacagccagatcgtgattctaatctattccacaaatatagccatcttttccttggtagtttaggcatcttccctgaggcattttgagaagagatgctcctcagcaaggatgaccag

SEQ ID NO: 7871 - DNA, 560 bp, Mus musculus
agctaataaaccatacctcaccttaagagaaaagcttgactctgcagaggaaatgaacttgagagaggaatctgtttatatcgtagcatctgtcttaaaggaatttattaggaatattccaggaagcttactttgctctaatctgtatggaaaatggcttgctgtccttgatcaagaattccatgatcaaaagatttctgctatccaaagtcttttaatacagatgccattaccaaatgttctccttttgagacaccttctctctgtgctacacaagattaaaggtcgctcttctattactcacatgactgcttacgctttatcagttcgcatagctccaagtatgctttggaatccttctctctccaactcagggtttgggaatgatatctcacaaaagaaacgactgcagaaggagacttgacaagcagcaaccggattggccaaatagcttctggatggagaaatttttttctcagcaactgaatacttgaatccccaggactacattgaattccatttctccttcactttattgattattccactaagaccccttt

SEQ ID NO: 7872 - DNA, 437 bp, Mus musculus
atgttatacgtgttagactcggtacaatgcttggtacacatgacatcattttccttgacagaagcatcacttcagatatcctcctcattctagtgaactttacgactattatgccatctgcaagcattaagaaggtgttagtggactgaaacaaacctagaaattactgttaaacccagaataagtcgtgtaaaaaagtatgtggtctgacgacttactaagcttgtagagtaaggaaatacatatgtaaaagtcccaatggcccagcacgattgggggtccccctatgtattccattaattgcaaaaacaaaaaatagataaataaaaataaaaactcagtgaattctagatgtgcctgctgagcttggagacttcaaaatatgagtgaaagaaaagaaagtgtgttccttttgtctttcatattgagaggctcag

SEQ ID NO: 7873 - DNA, 483 bp, Mus musculus
cccttcccagtcaagtacagtggaccagactaagaggggtggaagaaaccaatgtcctcagcccaagtccttgcagcttttaaagccatccaacttgagttctttgacacctcctccagattctgactcctcaccaagtagaacttccacatgtaagaaggcaccaggaatcacaccatgccattcaaaacatcagccaacatcgaatcaaaacaatcctgcaaatcatttgaatctgaaaacgtctaaactccgtcccccttctggctctttcaagcaaaaacaaataagtaacccccaagtagagcctcagaacttccaggccaagacaagcatcccaaggccattagcacggccaaaagagctgcatgctccacacagcggtttgcattctggggattgtgtggcctctaatcgatattctcgtcttcctaaaccaaagatacattaagtgcatagccatcacctgccaatttgtttttt

SEQ ID NO: 7874 - DNA, 385 bp, Mus musculus
gagagggtattcaggccttcagcaaaggttatgttcccaacctgctgagcatcataccgtacgcaggcttagatctcaccatcttcgagcttctgaagaatcactggctagaacactatgcaggaaactcggtgaatcctggaatagcaattgtgctgggttgtagcacagtgtcacacacttgtggccagttagccagttttccactgattcttgttagaactcgcatgcaggctgtcatgctggaaaaggaaacagtgcgcatgatgcagctcattcaggaaatatacactaaagaagggaagaagggatttttcaggggcttcacccctaatgtcctcaagctgcttcctgcagtgggcattggcagtgtggctcacgaact

SEQ ID NO: 7875 - DNA, 358 bp, Mus musculus
atagctcagtcagtatggccatgaagacatgaattccttataacccagaagaaaatgccaggtgcatgcttagaatcccaccgccggggaggaggaaactgaagatccctgggatagctggctggtcagcctagcttcctcagtgagccccaggctcaatgcttcctgtggcaagctcccaggggccccacctcaagggtgcctcttccccatgaccacctgtgaccttcaaaatgacagctgccaaggatgctgaagatggtcagcctggctcatcaccaactctggaactcagcagctgcatcaatgtggatggggaaaaaaaagtctcggttacattgatctttgccagtgtctc

SEQ ID NO: 7876 - DNA, 533 bp, Mus musculus
tgacacatgaccctttgcatcaggaggtgtcctttggagtaccttacccaccatttatgcctcggagactcacaggacgtagtagataccgatcccagcagccaatgccccctcctccttaccatcccagcttactaccatacgtgctatcaatgcttccagtaccacctgcagtgggcccaaccttcagctttgaattagatgtagaagacggagaagttgaaaattatgaggtgtgtagtatgcatgtgtgattttgagtcaaggcagcttcttagagtcttaccttgtaaccacgagttccatgccaagtgtgttgataaatggcttaagggaaaccgtacctgcccaatttgccgagctgatgcttcagaagtgcatcgcgattcagagtgaccagcctaagagcacaaatttagtttgggtgttcctcatcacatgtatatatggactatccatcgaacttaacctgtgtgcttccagccctccctttaccaaaagggtcaatggacctttctttgcactgtgtgact

SEQ ID NO: 7877 - DNA, 481 bp, Mus musculus
ggaatcttcaaactccgatcgcggggagctgcggggcagcaggcgcaccggcaaagggagctccggtggcggcgagcgacagagggcaccggcgcggacgcggggggatgcccacaggcgagcggccgggagccggaggtccccgcggatcccacgccgccaccgggaccttgcaggctaacacgattggagccttgagcgtcggtggactttcctggaaaaataggaatattgccacccttagctggccctgagatttgcaggtgagctttttctggagctctgtgcaaggcgaccgcggcttgcagacactttggaactccaccctatcgatgtacacctttattcagcctctattctcctgacttttccttttcctagatgaatgaactcaggctccagatgaataacagttgccaagtcatggaaatgttaagcccactctaccagacttcaaaccctttggctggcactgacagag

SEQ ID NO: 7878 - DNA, 468 bp, Mus musculus
agcaatttccaggattctgtgacatgtaagagaatcaaatgtaaactacagttgttttgaaaagtttatttatcatttatttatttatttacaaaattaggcttgtgcattgggtaatcatagtcattttttctttgtatttttcaccctttcacttattgtaatatgaatttgtgtttctctttgttcatgcctgaaatttaattggaactttcaacttgatagccttatcaaagcagcaattggatgttcacagtagttaaagaagtcatgggtatgtttagattggtgctttgtagatttatctcaatattaaatttcacacatatcaaattcaggagaaaatgtatacttgaagactgaatgcctgacaagactgaaaggaacacttggcaaacacccaaaggcttaatcttacccaatatagaagtcacccagattatgggtctgaagaattcccaaggaaga

SEQ ID NO: 7879 - DNA, 538 bp, Mus musculus
atcagaaccgagaagcctgggcagcttttgaaaagcaccccttaggcagtgctgctcctgcccagaggcagcccacaaggggtcaggaccccaggactcctgccgtcctcatgctggtgtctaacagagatctaccgccaattcatgtgggttcaaccccacaaaaacccaggaccgtggtaaggcacttgaatatgcttcaactgtcatccttcaaagtcaaagatgtaaagaaacctccctcgggcaggccagtggaggaggtggaagtcatgaaggagtctgcaaggagccaaaaggcaaacaaaaagaacagaagccaatggaagaaacagactctagttatcaagccaagaatttgccgtttactggagaggtaacaaaataaataaataaataaaatggaattctctctcccaggtctgactaagatggagataaattgatgttaaaaaaaactgattattataacaactcctatcattgacactgttttcaacataatccaaaactgtcagaagggactttatctctcttt

SEQ ID NO: 7880 - DNA, 146 bp, Mus musculus
tgaaggcgcaaagtattctaggattgttttattcaatgaaagagcccaaagagttggaaaaggcatttttctggcattcggaagcttgtggcaacggaagtctggagtcccagggtgcacttggtctcatgtacttttacggacag

SEQ ID NO: 7881 - DNA, 555 bp, Mus musculus
tcaatcagatggtaaaacggccagtttgaacattgtacaaattgcaaaactggcacgtaaattcgaagattttaaaagtcgcctaaaaacgcgcaaggaggtcatgcagactaaaaatgaggataaagagataatggcagaaacattgaaacattatggacttatggaaaagcagattgaagagttcataacatcccattcagctttagaatctcaaactgaaactgaaagtcagtcaggaactccttcagtgactactcggatggccaggatgataaaaatatttgaaaatcagtcaactatgttagagaaagctttaaatgatcagcaaacaattgagtctaaatataaacagttggaaactgattttcaaatgttaataatggagaaaaccctgctggaagcagaaatacgaaggctgagagaaatagagagagtaaagtctgcagccaaagaagagcaaaccaagaaatctggaaaatcagaaaagaaaaaatttaaagagaaggaaaagtacgacatgaagatatgttatctttttattcctcaacttgt

SEQ ID NO: 7882 - DNA, 423 bp, Mus musculus
ctttgcaaaattcttgacgctcccccaagtgagacaagccatccacgtgggaaaccagaacttcagtgacggtgctgaggttgagaagcacctgcgagaggacacagtgaagtcggtgaagccctggctgtctgagatcatgaattactacaaggttctcatctacaatggccaactggacatcatcgtggcggctgccctgacagagcgctccttgatggccatggactggaagggatcccgagcatacagaagggcacgtcgaaaggtctggaagatcttcaaatcggataatgaagtggctggttatgtgaggcgtgtgggcaaattccatcaggtaatcgtccgaggtggaggacacattttgccctatgaccagccaatgagatcttttgatatgatcaatcgcttcatctatgacag

SEQ ID NO: 7883 - DNA, 508 bp, Mus musculus
aagagcctttaaatgaccccaagagcttgcctgaaattgaaggtaaaaatgtttgcaaaccagatgtacttgaaaatctctatggagcaattgcctttaaggatttcattgtacacaagggctatgatatgccaggaatactccagaagctttttatgaaaaagggatggaattacaactcagttaatactcctataccaagtgtattaaaatatcatgaaatgattcagaaaaaaatggatgatgaagatgatgaaaacagtggaaatgaactttactaaaaaagattttcttatcaccactacttgactgtgtcctcccctcatttttcatttgtattgagtggacaccctttggcaccacaaccacaaacaactcttaacattcagaaacatttctcaatgaagttatactctgccctcaagaatatttttgatatgctatacagtgtgagttcaacattagaatctaattccctcacatagtctttcattgacactgctacaaa

SEQ ID NO: 7884 - DNA, 398 bp, Mus musculus
ggaacaccatcgcatgaaaggctacatagtagagatgatctctacggcccaggggacctgtcctttgggctgctcccagagcaatggtaacacaagattccaggaatccatcctcaaatctagaaactcaatccaatgacacacacctgcagtgatgaccagtcccttcactgagtaagcagagggcacatagacagctatgggtggaagatgaaaccatcgcaaccgcatagacaacggtgtcaacactggaaccaatgccgggccaagcagggacctggcctaattctccagccaagtggaagcattgtgcaaatctgcaaccgcctctgcatcatgactgtctaatcctaattgtaatgtcatctgctccagtcaggtcttttgcacacagggct

SEQ ID NO: 7885 - DNA, 285 bp, Mus musculus
ggatgattctgacagctaactagctttctgtgacggtggagccggggaggaggcggtagctatcttctgtcatgctgaaaaactgggatggtgccttcttcaactacttggtttgcatcaagatccacagagacctttgaactcttccagaagctctttctgaagggtgcccctccacgtgttaggtcttcctcctgggcgcctgcctgagcgtgctcctgcatcaggtggggtgggacgctgaccgctggggatgacttcccactgactcgacttagaatctgt

SEQ ID NO: 7886 - DNA, 415 bp, Mus musculus
tggcacttccctcaatacgtttgggctagtgcatcaccaagtgtgctagtttatattgattgtcacagtgacaggatttaagatcaccttggaagtgaacctctggacatgcctgtgaagaattctctagtttaggtgagaagaattactctaaatgtaagcatgcaccattccacaggctggggtcttggtcagtagagcacctgaatttatctcctctgattcctaactgcagatgaaaagtgtccagcagcctcaagctgctattgtgacttctgagccatgggactctttatgttaaagttatgagctttagtataccctgcttcaagttgcttctgttccatattttgtcgtggcatcatgaaaagtaagcaatacatcccttaatttcagcgcttttttcagaacgcag

SEQ ID NO: 7887 - DNA, 527 bp, Mus musculus
gcatccactgttgtcttctaatatcgttcaagcatagtgagaggcttccctgccagccattgtgtgatggtgacagtaaaaaaccaagacctccaggggtgggagaggaaagcagctggttttctcataatatatgtgcccgggtaactctgagagatcatacgtgctaaacatcttctcgtttgtttgtgtttttaaaatatgtacgagggatttgtctacaagtatgtctgtgtaccatgtgcatgcctggtgccttcaacagccagagaagagcttagatcccctagaactggagtcacagattgttcggagctgcgatgtgggtggtgggactcggcccaggttctctggaagagcagccagtgctctcagccacggaggcatctactcatcgcctgcatctgtattgaagagaaaatgccatgaaactgcttggatgtgaccgtgtaactcacagaggcaaaccccctcaaggggctgatcatgggatatattcctgatgtcctttgtcgtcttcatgatct

SEQ ID NO: 7888 - DNA, 457 bp, Mus musculus
tagtggtccgctcgttcaaacaaagttgagctccggtcatccagacaacaaggctctgtgctcccctctaagttcagctcttgaaagcactgcagtcaggtatactctgctgcctcagcccctggaacctgtgctgaaaaaaggttgtattcttcctgataaacaaagcaaagccctgctaacaagtaccccatcttcagacatagctgagtttgtgattgatttgtctccagtgcaaaatgtgtcttttgaagaactatttccaaatgtcagcaattatgttaactcaagtgaagttgttcctgtgtcaagtttgcaagaaagttcatcaaatgagttttctccaaacacatcagagatctgttgtattattaggtcatcaccaggaaccagacagatgagaaggaaagaccctgctgtgaaaaacagatgttctcctcctaaagatgttcctcta

SEQ ID NO: 7889 - DNA, 330 bp, Mus musculus
atactttgtgacttcatcttacagaacaaaggaaataaattagctagctatcaaggctatcagaagacagtggccataagacttggaacattaatgccaagggtccctcatcaattacatctcaaaacttaggggcacatgaaaggaactgaagaagaaatctgaggacatccgtggctacctaaacaaacctattggctggtattgttctgctattgcagggaagccccatccttgaaactgtagaatttgcattaatactagcttctagatttactttgcagcttttgaggactgattttgccaaggtcccacaagacacgaggagca

SEQ ID NO: 7890 - DNA, 502 bp, Mus musculus
aaccctttcctgtctgacacctggagcatgggcgtcatcctctacactctagtggttgcacggctgccctttgatgacaccaatctcaagaagctgctgagagaaacccagaaggaggtcactttcccagctaacttgaccatctcccaggagtgcaagggctccagcataaaaccagggccccagcccctttcaccagagtagtgcgatgggccatcctgcttcttccttaggtccagctgctcagtgcctgtgctcacaaagtgggggcaagctcagccaagccctctctctcccctgccctagaacctgatcctccagctgctacgccaatctaccaagcgtgccaccatcctagatgtcctcagggacccctggatgctcaagttccagcctgagcaaccttcgaatgaaatcaggctgctcgaggccatgtaccaacccaccagctctgctaaacggcaccagtccttggaaatcacaacctgaaagtggctgaggc

SEQ ID NO: 7891 - DNA, 361 bp, Mus musculus
gtcttaaagccacgtctgtatgcagcagaaccagatcccagcttgtcactggctatgcagagccctgagcaaacatggaggtgtgtggccagagcaggaaagagcatcatatctatcatggcaacaagccagtcatgtctctatgtccatactgctgctagctggctgtgccacagtctctcttggcctcaaggtccttgtccatcaaacaggaagatgagacagaggctatgatttgtgtctctggataatgaaatccctgaggtctcttttatttccaagaccataagtttggtagttaaaattatttatttaggagaaggaataacaccttcagctatttgcctggagttcataattc

SEQ ID NO: 7892 - DNA, 520 bp, Mus musculus
atactgccagtcacttcccaagatacctctataagaagatgcgctggaacctggaaaccaccacagaggccagcagccaaggagcagactcccatgtggattactacttcttgtgttatcgagatacatgggaggatgcaggccagggaccagccaattcctgcccccagatccagaaactctggtccattggccgatggatgcccctaggaccagcagaggatgatcttgactcgtggattttgtgcccacagccacccggggactaccagcagctactaaccatcggcttcgaggagccgtcgcatgtgctggccaccgacctgctggtgcagatcctcctgggccaggcaggccccgcccggccccccagcgctgccgggcccgcggcttgggcagccccggcatcctgagtcccaggagaaggcgccagctcgagcctgacaaccccaaactccaggcaggaagaggtgcggctgcatagagtacggcccggcatgggccaccgaataccaagtgc

SEQ ID NO: 7893 - DNA, 364 bp, Mus musculus
taaggtttcggaggatgcccttcatcacaggtctcagagtctgagtggaaattactctccagctggtttggaacagcatccgtcttctgccagcttcctccaagatgaactttcttcactgtaccaaactatcggtagcttgactgttgaagttacctcaggctcctttgaagaagaaagctttgccaccccatctctagatgaagatataccttcacctattgaaacggatgaaataaggtcatctcagattttcctttctctgagaagggcagctcaaattggaaaatttcccaacaatcactctccaaagacgatagaaactagtattcagctctcttgagacccgttcttacgcagatct

SEQ ID NO: 7894 - DNA, 204 bp, Mus musculus
ccaaagatggatacgtggtttcatagttaggaaacacttaagcccctattttaaacataaaaagcattaccacggcaaaatgattagggtgcttgaaacaaaattgatctgcataggcagaagtgatgaagacaaatacttggaggatttcttctttatcaagcctgaatgcaacataaaagggaaggttgcacactggaaaca

SEQ ID NO: 7895 - DNA, 254 bp, Mus musculus
tatgggtcaattttcactgaagtgggctggatgtctgtactcacctttcatcaatacaaaggaatcacgcacttcactccctggacaacagcaatgagaactcgcctctgattggacgctagggatgtcagctgtacatagaagataagtgtgaggtggaagagagaacttcatctaatagtacatctaggacaaaatattttaacaaactgaatcttaatttaaaattgtcatgacattactcttcatctaag

SEQ ID NO: 7896 - DNA, 337 bp, Mus musculus
tcagctgcccacttagttttggagactgggtcgtcggtctcactatgaatactgtaatacgtgaaccaggctggtctcgaacttgaagtcacagtcatctgcatgcggcctgagtgcaggcataggtggtgtgtgttactgcccactttggctcctaaatctgtggtagataggcgaagagactgctcagcagtggagagcaccctcccacatgttcataactgcatgtagctccagcttgtggaaatccaactgctttagcaggcacctgcatcgctttcatacacataataataaaccttaagtctaccacaagccatattgattcctgacagaa

SEQ ID NO: 7897 - DNA, 352 bp, Mus musculus
tttaggattctagagctgccaaatgaatttgttgtgcttgccctggctgaactggcaaccagctatgtgtctcagagcatacccttcatgatgatgaccctgctcaccatgcagaccatgctcaggctggtagaggatgaaaatatgaggcaaaccttctgtatagcccttgaaaatttcagcaagtccatttacaagtatgtcaaccactggaaggattttccatatcccaaattagatgctaaccggctctctgacaagatcttcatgctgttccggtatataatggagaaatgggccccgcaggcctcacccatgcattcactgtgtatccattgtcccacttgaagtt

SEQ ID NO: 7898 - DNA, 204 bp, Mus musculus
aaatgcggcataatcagatgtattgtgagacaccacctactgtcactattcatgtaaaatcaggctcaaataggtcacatcaaaccagaaaacctattagtctgaaacgtcctattcttaaagatagttgggaagcatctgaaaacaatgctcagagtaacaaatctaagcggcccagagggccttgtctaatcatacagcgcc

SEQ ID NO: 7899 - DNA, 506 bp, Mus musculus
aagatggctcatgaacttgcatatatagacaaggaacttgaaaacaaggtgcttcaaaaaactttgattccagctccaactaataattatattcccaaacccttcattgcttgaattagttttgttttgttttgttttggctctggagacctcgggatcctttatcggtctcccaaacactgccttcctagatctctgttagttatttttccgttgctgtggtaaagcaccatgactaaggcaacttacagaagagtttattatgagttcacagttcggttccagagggtgagtccgtgatcgtcacggcagcaggcagcaacatctgaaactggagcaaaaaacgagagcttaaatattgacccataagcaggaagcaaaaaaagcccaattgggaatgacttgaacttttgaaacctcaaagcacaccccagcgacacatctcctccaacaagatcacacctcctgattattcccaaatgacataccacgaagcattgcaatat

SEQ ID NO: 7900 - DNA, 458 bp, Mus musculus
tgatggctggactgacctgcaggaagagctggacaagaggaagtttactgtgagccgggcgtttactatcctcttcatcttgcttgcatccttcatcttcctcaacatgtttgtgggtgtgatgatcatgcacacggaggattccatgaaaaagtttgagcgggatctgacgttggagaggaaccttgcgattatggaggagaagcaaataatcctgaaacgccagcaagaggaggtcaacaggctgatgaacacacagaaaagtggtagcatgaacttcattgatatggtggagggcttcaagaagaccctgcggcacacagaccccatggttctggatgacttcagcactagtctctccttcattgatatctacttggtcactctggacaaccaagatgttattgtcagcaagcttcaggagctctactgtgagattgtgaacgtgctgagcctga

SEQ ID NO: 7901 - DNA, 505 bp, Mus musculus
gggcttttgctagtttaatcctctcagtccgcagaaatttcttgcatcctgatagtaacacctctgccacgcatcccacagactcttgaaggcagtacccttcactcttagctccagaatagaaccatgtttggtttaggccaataagcacatgctcagttcaaatggatgactcaattctgaccaatgagagacaaggggatgattcctgactcagaaacccagcagcagacttctttttactcatcaccaaacaatcacgtgggacgagtaaagatccatgaggttcatgaatccttttggaaccctgaaggaatccaactttcagaatgagaaagataaagggctaaggacaaaaactggaaaggaatgggtttggatgatgaacgaaaccacttagtcaagcttagtgccagagcctggactgcatccgagcttgttcaggaggcgagagctgtgattctttctcttgatcaggatggtcgtcttgagatccagatttttt

SEQ ID NO: 7902 - DNA, 539 bp, Mus musculus
gggcctatccttgacctttgaagaagcctgggcctaataaagtgatgttggcctgggcttatcgccaacacttgaagaggccagagccaaaaacaagaagtgatgtgggcctgggcctattcctgaccctgaaagaggcctgggcccagtgcaagaagtggtgtgggcctgggcctatctcttaacccctgaagaagcccaggccaaatgtaagaagcaatatgggcacgggcctatccgtgaccattgaagaggcctgggccaaaagcaagaagtggtgtgggcctgggcctatccctttccctgaggagttttggcccaaaactagtatagatgttggcctaggccaagccctgaccttgaagatgtccagatccaaaataagaaatgtgggcagcctgtcccaacctctgccacttaagaggcttgggctgaatcaacaagaattggggcctggccttttccctaatcctctagaggcccaagccaaagtggaagatatgtggatctagggattgacctctaagaatcctggaccc

SEQ ID NO: 7903 - DNA, 451 bp, Mus musculus
gagctagttgcctgtatgtcactgcccagacagttgcttggggctcctgcgtctctatggcaccgagggcagaggcagcctttggccatcagccccagaagacgaagaggcttttcctgcagaggaggaacatgggagactggcctatccttgtctacagcaccgtgtggcgatcagttctgccctccatccacagctcaggccaggtcttggcagcagcaggcaagacatcaggacagttatgcccagtggttatcataccaccatccaggtggtgtcctctgccattgtgcccaccaattttcagagacctcggtgagtcgccggtgggatttgggagtctctgtccgtcacggtaagtttaaacatgttcaatgctacattccgtagacctctaacaggcttgatggatagccagtattgacctacctcgtaggtatctgagcgaaac

SEQ ID NO: 7904 - DNA, 385 bp, Mus musculus
agcagagactacatctacagcccaggctgtatctggaccggacaagaaaccctctacccaaactaacttggtatcccaagaggggcctgaacagtcagaccctacagcccagcaaacacctctagtccaaggagccaagtctaagcagggatctttgactgagtcagggtttctaacaaggctgcatgacctatccatacagcagacatctccagagtggaagtcattttttgactgtgttaccgtgtctgatatagagaaatgcttgagttcatcctcaaagtcaaattctccaaagccaagttacggaacagcgatcccggaaatggcactgctctccaaaaagaaacctgagtttgaaaagctgtcaggatatggcggtaaa

SEQ ID NO: 7905 - DNA, 296 bp, Mus musculus
agtctgtccagaagttgtctgctgtaaccagctttgtgaactcccatggggctctacaacagagtgattcctcaactactcagggcactgatgagtccccgtggccagattcctccacctcggttcctgtggctcagtttcgatcagacctcccttgaggtgccatacttcccataagagcaggttgcacgctcgggacacaggtggcaagccacgctcccgcggtaggtcctactccttgctgcctgagtcttggtagggatccttctctggaacttctacaatactctcagctg

SEQ ID NO: 7906 - DNA, 226 bp, Mus musculus
tgcagcagttgatccgataaggccagttgatgctggggttcctcctttaagcagattgccccaccttcagatggctcagttctcctgcaagagaggaacctgggagtttgactccatttcctgtgcagcagagagagcagcagcccttagaactaggatactaaaccagctgccttggagactctagagactcggaaacatgggaagaaggcccacaccacaacag

SEQ ID NO: 7907 - DNA, 395 bp, Mus musculus
ggcctgctcataacttctggaacgggctaggcactgtatcttatagtgcagagccttcgtacccaagcaaagttctaaggaactatcccagggtttattcagtcttagactccgacatcatacaactcagtctgagtgtgctaagacacaaccacagaagcaaacatgaaggaagacgctcaccacatccacagcatcgcacagccgctctcgggggatatgctcagtgatggacggacactgattctgcaggagcagcacagccttcaaaccctcggctgtgcagtcagcaacgatccagccacagtccagtgtgctgaaggagaaaccaccctacagagacagagtgcaacagtgccctccctacagagccgcacagtcagggcaaggcctag

SEQ ID NO: 7908 - DNA, 462 bp, Mus musculus
aagttacatctagcctgactccaagaggctccaacgaccccactactactgccgtctgggactggaaactcccccgtgtcctgccaccacctcctcacagcaaccccagctgccatgggtatttcctttcttgggtgggtcagctcgcctccgtggaagatgctgcctgtgctcggatgccagcatcaccctagggccccagcagaaccaaagggcatcgctgtgtgggacagtccattgtgtgtgagagtaggctgaagattactcaggcgccttcagggaactgctgtgggctcaggactacagtaatgactcaattccagccgtcctaatggtaccctgcagacacttgctatcccagagcggggaagtccacaatttcctggctgggaacagccctgggaagagactgcttctgtgcagaggatctggggttgggctgtcagctgtgatctctaggag

SEQ ID NO: 7909 - DNA, 499 bp, Mus musculus
gaagagtttgcaccactaaaagttatcttggaggagttcaaaaactctaacaaactcataactatatctgagaaagaacgactggacaaacacctcggaattccctgtaataactgtaaccaactgccaatcgaggggaggtgctacaagtgtactgagtgtgtggagtaccacttatgccaggagtgctttgacagctgctgtcactcttcccatgcctttgcgtcccgtgaggaaagaaaccaaagatggagatcagtagaaaaaaagatcagaagtcatgaaatatttaaatactgaaaatgagggtgaagcaaagccgggatgttttcaagaaaagcagggtcagttttacacaccgaagcatgttgtaaagtctctgcctctcctgatgattacaaagaagagcaagctgctggccccagggtaccagtgtcgactttgcttgaaatcattttcttttggtcaatatacaagactgctaccatgtactcacaag

SEQ ID NO: 7910 - DNA, 417 bp, Mus musculus
agtggtacctgcattgctgctgccggcatggacaacacggtgaaggtgtgggatgcgcggactcatcggctgttgcagcattatcagttacacagtgcagccgtgaatgccctctccttccacccatcgggaaactacctcatcacagcctccagtgactcaacgctgaagatcctggacctgatggagggccggctgctctatacgctccatgggcaccaggggcctgctaccaccgttgccttttcaagaacgggggagtatttcgcttctggaggctccgatgagcaggtgatggtctggaagagtaactttgacattgttgattatggagacatgaaggcacggaggcccccacccctaaccagctcttctggaactctgacagtgtccattctggaacagcgactgacacta

SEQ ID NO: 7911 - DNA, 457 bp, Mus musculus
gcccagaatgactcttcccaagtagtgaaaccgggatcaactctggtagagaccattcaaagtaacatggagaagaacatcattaagaaacagaagaggaagttttggcttaggcacttccggtaccttttcttcatggtcatgatcgtcatccggttactgggttacgtgttcttccacctgcaatatgtaaacccagactttctcgtggacaccctgcccatgctgatgagcagaagtagcttgaagtggctaagggacatattgtttcccttccttaccctagaagtggaagacgtgctgccacactagtgtgttaccacacctgccaggtgcacccaacggaggggccctggctgtggccctgcgttagtgatgtgggctgggcaggaactggaagccaaggactcagatcttctaggtgacagctgagctttctatttaattctctcctgga

SEQ ID NO: 7912 - DNA, 286 bp, Mus musculus
atgttagctagtatctgctacctgtttgtgtctggaacatttttcatcaactcaggatccagcagtataactcagggtatttcttcagtatttcagcatatgtttgcaattataacaaacatcataagtatcttcgtggctatatttggtttaattctacttggatatgaatttccaatttttgaatcaataggaactgaatacatttggtcaaatatggctggcatgatgcttctacaaatttctgtcatgtgtgccatcacagagctggttattgcaatcctag

SEQ ID NO: 7913 - DNA, 420 bp, Mus musculus
aaatctggccaaccgagtgccaaacaggacagatgaaaagaatagtcttgagtactggaatggccgacgacgacagcttcttctaccttggcaccacaaccggggatattctcaaaatgaaccccaagaccaaactgctggcagatactgggcctgtgaaggacaaattcagcttgggagtgtcggctctcaggtgcctgaagatgggtggtttgttggtcggctctggagctggcttgctgatcttctgtaaaagccccagctacaagcctatcaagaaagtccagctgcaaggtggtatcacctctatcacgctccggggagaaggacaccagttttttgtgggggcggaagaatcgcacatctaccgcgttaacttcaccgatttcaaagagactctcattgcaacttgtcactttg

SEQ ID NO: 7914 - DNA, 387 bp, Mus musculus
aattgaattcctttgggctccttaggagctcctgaggaggaacaaaggaactgaatgtagtaatgcattcaggccaaggaatcaatcagagactggctgagtatgcctaaccgaaagttgatgagagtgtgaaggaccctcgtccacacttggaatattttgctggttcatttatagcaaatctttggcaccagaccatacaatgtgtatctacagttcacaggtttaaatacgcttcagcagctaccgagcagcgtttttaaaaagcagaaaggaaacttgataattaaagattcataaaacaatctaggaaatcaacatggaaagaccatcagtggttctgaaaactgaacaccatgtataaatgctgtatctcggaaggtccca

SEQ ID NO: 7915 - DNA, 529 bp, Mus musculus
acagtggacaacagcctcgggaagaagaaatacgatattgatcccagaaatggaatccccaaattgacaccaggggataatccgtacatgttcccagaacagagtaaagagttcttcaaagcgggagcaactttgcctccggtgaacttctcactgggaccttacgagaaaaaattagacacatttatcccacttgagccacttccaaaaattcccaatctgcctttctgggagaaggaaaaagccaacaatttgaagaacgagataaaagaagtcgaggagcttgacaactggcaggtgccgatgcccttcctacatggtttcttctccactggtgcttccaacttttcaagacaacaatgagcagagacattgagcccccaggcattcgctgactgccctcccagccagcctctgccattgctgggtgtttttattctttgcttttgacattgtctctgtcctaaaccatttgtttgactcgaatgaggaatcactatgtttggccttgttgaacactcaactgtga

SEQ ID NO: 7916 - DNA, 167 bp, Mus musculus
acaaaaagaggcaataggcacctgtaatgaagttctgacaataaaagaagttgggcatctcatttccatcttgcatgccaaatctttcatcctctcctggaagatgaccccaacacatcaagcgcaagagaatgaagacacagaacattccactgcagtcatgtctg

SEQ ID NO: 7917 - DNA, 270 bp, Mus musculus
ctgcctgatccaaagagccagatggaatttgaagcccaagtattcaaagatccaaatgaatttaatgatatgtgaattcctaaatgtactgtgagtaagtacaaaaggagccacattaagttcatctgttcttctcagctcagaagatgccatgtggtgagatgcagttcacttgtatgtattttagttcaggacaccctcagatatgctgggtttggcaagagaggttaacattgttaaagatatttcaccacatttactctgttaaga

SEQ ID NO: 7918 - DNA, 236 bp, Mus musculus
gatgtgcagctgctagatttctcaatgtgctacccccaacattccagtttagagaaggccgtgggcttgtgtattcagagtcaaccacgggaagactgctgggtacagagagccagtcctgttctatgtctcctaatgaaccactgggaactagtgggcctcatacataagacttcaaagatatgtcaaaatcccgcagtcatcattagaacagctccttactttacctggataaa

SEQ ID NO: 7919 - DNA, 537 bp, Mus musculus
caaactgtgttttcgactgtgcaaaagaacgtaaattccaggaaccaaactcacgtcatcggtattggcaaccagttcatctgcgctgagcacacctgtaggcctcctgctctgagcctttagctggcgctgcatgatctggaacatggacacgtctgctttcccttcatatcttacaagttccacagtcaggacaagataaaatcaacatacaacctagaatttcagacaataattattttttgctacatgactagaattttttatattattaaataattcagaaatattatacttgaattaaagtaaaagcttgcatcgcatgagaaaaaatcttatatatggatggggcacatgacttggagcagcagagagagtgggcgtgacttctggacaccttgaagtggaggttttattacgtggaataaggctgaactgaaaaacaacaacatgtctgcctgagagtagtggagctgtcattgtctgaagttggcgagcaaggctagatctggggtaaggaaccttcttgctgttctc

SEQ ID NO: 7920 - DNA, 344 bp, Mus musculus
tcactggcctttctaagcccttggaccttttcatctgatgaagatcaaatggtcataaaggccttcaacagagttgcagagatgtaaccaggcagccgagggagtaccggccatcaattctgataagtatattgactggtgtctggtcacctacagagatacttctgtccccaagagtttgggacataaacttaccaggaatccactgtgatgacccacaaatttactcatgagatttaaatctgatcatgtcatcacttggtgtaatgaaacactataaaaaacataattaaatatgagtaggagccaggccatttccttagccctcaggatgaatactttgt

SEQ ID NO: 7921 - DNA, 432 bp, Mus musculus
aaagactttggtttctgtcctgtaggcagctgatgggatgctcattgcaggaaggattctggaactgagtttcagaatgagcattcacaggctatgtgaaatcacacactacaggctaggagtggtccagggggcaaaagcaacagatcagggagaggtcagaagcctgagccagggtagtggcaatgggctaggaaagaaaaggacgtgggcagcagaatggctacagtttgggagttatctggacaccagggtagcattctggtcagttttatgtcaacttggcacaatccagagtcatttagagtcagactctaaactgagaaatgcctccctaaggttgggcaataggcaagtgtgcgatctatttttaattaatgcttgatgtggatggaagtggcagtggggggttcgtctgggtagtataagcaa

SEQ ID NO: 7922 - DNA, 422 bp, Mus musculus
tggctttccccaaagagtggttctctgcaaacatcacacttgaatttgacattgaattcaaactgcccttcaattcgaatatcatcaaaacgcatgcctgcatgggcctcactgcagagtcctggctggagaaagatgagtttggccggagggagctggtgatgggcaggtgtcgaatggagcccagcagtgggggtgcatccatgtccactgaggaaacctcaccgaagatgaaacattttctccataacctcagagaaagcctagggaaagttatcccaaatctggtagaaagtcaggtctgtcctctgattggtgagatcctccggcagctggatgtgaagctgctgaaaggcctagtaggtgcctgctcataatttgggtcaaccctgaatcagtcagatctctgctgccagactcaa

SEQ ID NO: 7923 - DNA, 536 bp, Mus musculus
attttatatttacccacacgtgcagagtttttaatacttcagcgcttgtcacttacccagctgccccggaaggtagtggaggatgaagacctttttggacagtaggagacagggaaggaccctgacctaagtgaccagaccagagagagaacaaaagaaccatgccttggtcagcactgcttaattatgcatggccttgccccctgctgtggctcctctgttcaggtctaaagctcccctcatcctgaggaaggacttgggggtcactggatattgtggccacttggaataatttcatcatcacttgtgggatgtgagccacagactagcctgtgggggctcctaccagggaactgagggttagggaaagtcaagaaacaacacaaagactggaagctttctccacctcggcttcccaagacagatggagcaagttcagataggttttcagaggagactggaagcctttcgccatctgggcttcatgtaagaaaaatggtgtccacaagaaaagcacgggcatactcatctgcatc

SEQ ID NO: 7924 - DNA, 518 bp, Mus musculus
gccacatggcggtgaactgcagcaagacgagcgaagtcagctgctaccgctgtggagagtctggacatctggctcgggaatgccccattgaggctaccgcttagtaacccccttaaacgccatcctttactaagtacgctgtttctaacatttctttgctaatcaaaaacgtgatagatggaagctactcctataccattataattatcatcttaaagcaagaaaagactgggggggaaacatgtcaaaaatgttataatcaatatgctatttggttgccatgaggaagttcagatagggcacagccatttttgaattggacactagtggatcctttgagtacggttcgttttgacacactaaattagaaattgatagtgaaaaattacagcaagcttggaacatcgtctttgaatttactaacaaatactatatatgtatgtcagatagagataaactgctttgaagcgagagacaactgactaaaataagaagagaaactacttccttggtggtgg

SEQ ID NO: 7925 - DNA, 342 bp, Mus musculus
attattgctctttcgaatgtgcatatgggaagagtacggaggaatgccacctgcaatcctttcagactttcaggcatactgaacatcattgctagcagctttctttaccttgctgttttgttcaattacatagccatcatgagcaaatgggggattgccttcccaccatctttcaatttgcctttccagccagacactcggaagatgggaagtgccatggctttggcaattatagctgcagttttctttctactaagtggcacaatttgcctttcttcaaatttaaacatagacaagacgccccgttccaaaatgtaaatcgatacgttacatagccttgaa

SEQ ID NO: 7926 - DNA, 149 bp, Mus musculus
ccatccaacagaaggtgtgtcagatacatctttttcgaaaagtgcagacagcaactcttattgggtccacaattcttcagagatgaggcgatcaaggacaagaaggtcaaaatctaaacctatggatttttctgcaggctccaatcaaa

SEQ ID NO: 7927 - DNA, 530 bp, Mus musculus
atggccaaatatccctctggtgagaaaatacattatgaatgtcataaaccttttgaactatttgggaaagtggaagtgatgtgtcaaaatgggatgtggactgaaccaccaagatgcaaagatccaacagggaaatgtgggcctcctccacctattgacaatggagacatcacctccttgtcattaccagtatatgcatcattatcatcagttgaatatcagtgtcagaagtattatctccttaaaggaagtaagacaataacatgtagaaatggaacgtggtctgagccaccaacctgtttataggcagtgaagttgacagtgaagaatggtcatcacacttggctagtaggaagtaacaccagtatagaatgattcataaagaactaaacatccagaacacataaagatcatgaagatcatatggagtatggtaacccagacccataaagacaaacttcgcatgatctctcttattggaaactcctagctccaaatcttcccagatgagtctatatacaggagcaact

SEQ ID NO: 7928 - DNA, 504 bp, Mus musculus
gtcccaaaccagctaaaaagaacattccaagggattcacaaaaggacaagggaagagtatcttcagattctgaaggcgaaaaggctggtgtgaagaggggatccaagaaagttaaaaatacacctaagggtacagattcagcctcagaatctgagggtgaaaaggctggatccaagaaggaagccaagaccactaaaaaaggatccaaggataaagtttcactctcagaatctggaggtgaaaaggctggatcgaagaaggaagccaagaccactaaaaaaggatccaaggataaagtgtcagccacagaatctggaggtgaaaaggctggttcgaagaaggaagccaagaccactaaaaaagaatccaaggataaagtgtcagccacagaatctggaggtgaaaaggctggttcgaagaaggaagccagggatgataaaaaagatgcaacgagctcacaagaaacacttttaagtacagcagctgacaacgatggcaaaaaga

SEQ ID NO: 7929 - DNA, 359 bp, Mus musculus
tttcacccggatgaacgtgtgtcaagtaagaagataattgaagtatgatgacaacagagatgcaaaggctgtgtggtttaagtactcttcttacctgcaacaggaggttgcatagagtgtttccatgatttgtagaattccaggtctctccaccaccttgtctttctcagcttgctttttctctccttccctcgtttatacacaatatcctgaccttgctatagcttgtgcagcacgtggttgggacatgtggctggctgtagaacttcgtgctgattaatttagcctccctctgaagcagcctcctgatactagttttgtagcctcctgagtgtctagggccactttctttggtgaat

SEQ ID NO: 7930 - DNA, 396 bp, Mus musculus
aaagactacgaatctggccagctatatggactggaaaaattttgggcctatctggaatattctcaatctaagacccagcctgtcgacccgaaacttcaggaatacctcagccgttttaaaaagttagaagacttccgtgttgatctcccttctagtgaggaatttggaagacaaagacattcatctacttctggggaggagaggattcaccatacacttcctccaccaagtgctgctgagcctgcatctgcagggaactgcagtcccaaggacggtgtccaggggaaatccacaggagcccagtgacaactcacagtgacagtgccgccttggcctctagggttgaagtaccagggaagtagatacgtacacaaacgtcgtgtattcttgaaatca

SEQ ID NO: 7931 - DNA, 116 bp, Mus musculus
ccggtggcaccggaagaatgctatgaacatgaacttgcagaaagcgctggaagagaaatacggagagaagagcagatccaaggccaagtagttgaaaggacattgggaggaagctt

SEQ ID NO: 7932 - DNA, 378 bp, Mus musculus
gatccagctcgagagatgccagggagaccttccgagagggatgtgtcggggaggaaggccaagactccaggtccccagagcagaggacagtgcctctgagcaagaaggacagcgtcattcctgagaacatccgccacaaatttgggagcaagatggtggaccaactgatctctgaggatcaggctcgacaggccattggtgaaatgtttgagggccagaagaggccaagctcatggcctagcaggacccagagccccatgcaagcctcctccattttctcagactactatgacctgggctaccacatgcgatccaacttgtttcaaggcccaccccaggagacaaagagcctcatgaaggcttcctacacgcccgagg

SEQ ID NO: 7933 - DNA, 540 bp, Mus musculus
gaagtcctccttgatatattcctcaagtgtgaaggaggagacaccaagcgcatgccttgtaagatatcttttctaatgctgaggaagagtctctgagaagtggaaattggatgccatttattgggctgggcaaagcagggcacaaagagcagaggaccagggccaaagggccatagtacacataaaaactgtgggctgtgggcactcactgcagagaggatgaggcaggaggcagagtccccttgtgtctgtggattctttaaatataggtatcctggccataggagcctttactaggtctgtggacagcacaaaagtcggtagaggtatttgaagagtctggagactgttacttcaaatgtatttcccttacaatgatattaagtagccaggaaggaggaagtaaagagacttggcagttttcagttacaagtcatctaatagaggcaaggcatggcagcaaacacccttaattctagcactctggagtgaaattaagacccacctggtctttatagaccaggctagctgaggctacat

SEQ ID NO: 7934 - DNA, 429 bp, Mus musculus
ggacctgtgccaaggaaccagtctgaaatgctgacagcatcgcaaggctttccaactgcagggacacggaagcagctgcggttttcctcaccaacgcagatggcaaaaagggagtgtgtttgttggtactcaagagggtggttacaggatgggaaagccggaaagaacttctgcagatgtacccagccatgcagcagttagttccaaatactagttacttgcctctcacatctcccacctgctccttgtctgattgctcgttctcgaatccttcagttaccatctacccaatgatccatgctgtaaaactgcaaaatttggattttcctgtccactgtccatcagagtgagaaaacttcaactccatccttcacctctggctcacacctatactcccctgccctcacatttctctagatgcctgctgga

SEQ ID NO: 7935 - DNA, 511 bp, Mus musculus
gtgtttctactcaaatccaagctgcaagagccaaagatttaattagagaaacgtgcccaagcgtgggcagcttcctggcagctagtcaccagagaagagactccccagcaactgttaactatgtcctcagggagagaaggggtctccagagcctcaggaactcatgggcttcctgtgcccttgagctcggagagcctcgtaaccctgtttcctcctatgaagaagtgttcatgggcccactcctggaaggaagggcccagtgctcacagatgctctgacctgaacacggcaacagctgcatcatgacagaggacagagtgccaccgcatgccagagtgaccccgtgtctggagaagaatgcagacgtgagagtttctctgtgtagcgcttgctgtcctggaacatgacctgtatccgccagcggccacgggttcctgggttcctgaaaggaaagctggaggtggatgggaaggacggcgagagaaacaacgagccaagaccaagttctctg

SEQ ID NO: 7936 - DNA, 241 bp, Mus musculus
gaatattctacttcatggttggaacagcttttgccaatatcacatgtcagctaattgtttgccaaatgagcagcacgcggtgcccgactttgaactggttactgcttcctctcctcttggttgtggcagcggtgatcgtaggtgcagccacctcccgccttgagagcgccctcctttacacactcacggctgccttcactctggctcacatccattatggcgtacaagtggtgaagcagct

SEQ ID NO: 7937 - DNA, 501 bp, Mus musculus
atgttgaggagatctggccacctgtggaagaggtctggcccgatattgaagatatctggcctgcaattgaagcggtctggcctgatgttgaggaagactggtacatctggaacgatggccgggagaatgatgaagatcagaggcaagttggagaccaacaggattataataaggaaggagaggaggaaaacgatgatgatgatgacgacgacgacgaagaggatgacgatgattatgagtacgaagaggatgacgatgattatgagtacgaagaggatgacgatgattatgagtacgaagaggatgaggatgacaacgaaggggaagataatgaagatcagggggagattatcctgcgtgcctattgatggcaaaggaagctatggatgaagatagaatcaagaaattggttcatcgtgaataggagatcatctaacactcattaccatacggcaaattgatgaccgtcctattctaaaattcttcatccacatccatata

SEQ ID NO: 7938 - DNA, 228 bp, Mus musculus
gagagggagagtctatacgtggtaactgaggctgtggagaccctgcaagatgccatgcttcagagccacagccacatgctaggagctgggcagctgtccctcctacagttgggccatggtcaggtccagggacagaggaatgtggacacagagaaaatggtgagcatcccacagggcagtgtactggcctacagggttctgcagctgctggtggaagaagatggctgg

SEQ ID NO: 7939 - DNA, 260 bp, Mus musculus
gaggcaggccggacaaacaagagctagataaaaggatttcttatttcaaaacctacctggagacaaaaggggcagcgctgagccagactacggagtttctgcccttctatgccctccccttcgtgcccaatccgatggtccacccctcatttaaagaactcttccaggattcttggactccagaattaaagctgaagctggaaaagtttttagctttaacttttaaagccaataacacaccaaagcttttaaccatatat

SEQ ID NO: 7940 - DNA, 374 bp, Mus musculus
caacagtttttgaccataggaagcaacagttttgttggcatgtcaagctccagtttcctcagagtcaagcagagtacatagaaaaaagagtaccagatgataaaactattaatgaaattctaaagccttacatcgatcctgaagagtctgaccctgtgatccgtcagagattgaaagcttacgcacagtcacagactggggtccaaattttaatgagggtcgaaaatatgcagcaaaatatgataaggtatcatgaactggatccttacaaaagcctttcagacaacttgaaggacaaagtgatcattgagtacccgactttgcacgtggtgttgagaggatctagtaatgacaagcagctacttcaagtgaaa

SEQ ID NO: 7941 - DNA, 282 bp, Mus musculus
tgagcagcttgcatttgccacgaccgtcctcaactgttttgaagattccatcttataactaccagtgtgcacagactactactcaagtaacgtcgtgtcccagcgatgcaaagaactgaaatctcaagctggaaaagcctgcattatattcataatagcacagaagaattctagataggaaggacagacggaaacgaatgaagactttaaaagaaaaaaacaaacatccaagattgagaaaaactatcaggactaagaaggtaacacagaggaagctgtctt

SEQ ID NO: 7942 - DNA, 488 bp, Mus musculus
tactgccatcttctagagtctggtggttagtccgaagtcagaggcagaaagagtacacactaaagcttgtctatatgccacaactggtgcaagagtgatctccaccatggagtgaataatatcaacatctaataaggaaatatttcctatgggaaattttcacttgaagaatggatgctgaagtcactcttgggaataacggtctgcctgcttgcaggtcacactacaacatggacacacatcctggttaatggatgggatgtgtctgtacgttggtattaggcccatagacatccttctgtttatatagccacacatggattttcatggttggtgattgctcaatgtgtcctctgcatccctgttgccaagttctttatgtaacttcccattccacaacagtgctccaaggtaggacagataaactttttcctgcaaagtgccacagacgactatttcaggcagcaagagccatacggctgctttct

SEQ ID NO: 7943 - DNA, 547 bp, Mus musculus
gaacggaatactgagggacgccctgggcagtgccctgagagggaaggaggaggacttccgcatgtaccaccagaccctgggccaggtgaaaggggtcttcctgcaggcactacggcagcagaaagccaacaagcagtagaacacagctgttagctcaactcctggaggaccaacacttcaggttcaggcagcgctcactcggctcctcctagaagcggtttggtgtcgtagcagagcaggcaagctgaggatacctgagcaggggcggagccagccaggggcggagccagccaggggcggagccagccattcctgcctggtggctggtgcgtttccctgagcaggtgctgttgtccttccttgccctagggcctctctggggccctgggatgctactacgggctctccacacatagatgagcccctcggtgcttcctgatggctcatccacctggagccatctagccctcccctgtagcccctcactcggccctagcacccactggccatcctgctgtgcccagcctctctgtgtacttactgcaca

SEQ ID NO: 7944 - DNA, 171 bp, Mus musculus
aaagtgtttgtcgttctgtccattcagctgttcatcactgcagtgattatcggcatctttgttttctgcgaacctgtaagaaagtgggtcatcgccaagccctggttcctgtatgcactcctggatatccggcgccaagtgcccgcaaactacattctcctggcgttcttt

SEQ ID NO: 7945 - DNA, 265 bp, Mus musculus
gtttcccagtgagacatgagccagtgtgtgtcaggctgagtccgtgtgagcagggagtgaagatggaggttagtgctccattattcaatgatcctccatcccctctcggagaaccaggaaagcctttcagtgaactgtggaattatgaagttgtggaagcattttttttgaatgatacaactaagcagtatttagaagtcgaactttgtccccatcgtctagaatatttcaagcctttcagtttcaacacactgcttggagaaga

SEQ ID NO: 7946 - DNA, 414 bp, Mus musculus
tcccaaccatcttatgacaccaaaagtgtccagcggagtgacttccagaagccagcatgcccattggttttgccagtcaaacacagccggatgcaaaagccttcttgtggaatagttccacttaccagtctggatgtatcaggagaacatgagaacaattttgtagaatacatctcttttatacatcaatatgatgccaggagaactcccaatgaacccatcaaaggaaagaaacatggaaccttcgtgcagagagagataaaactaggggctatgccaatagttcctaaggcaccggaggtattattgaacactctagagtcaggttcatcagaacagccccaaaaaacagacaaaggaaattcatcaggagacaaagtgacctcaccaggcctatgccaacagaattcccaa

SEQ ID NO: 7947 - DNA, 409 bp, Mus musculus
aaactacaacaccacgctggagcagcaaacgtaaccatgtgagctatcacgcaccagctccttccttatttctgatcaccctggactcagttagcccggcttcccacagtaagactgtgtctagactgtggggacaacaggctgggagccaggaatggacctcaagcctacgagagcatccaagctgctttactaatacctttgaaccttccgatgactggaacagagttgaaatttatcagaaaatagaaaaacagctttggcacagcactaccagtcatcatgtacgtctctgaataacaaatgttcatctctaggtcatgcctccagatgtgtaattgaagatactaactggatgaatgaacaacttaaagttccaggggaacaaagcgctgttctggatgattcc

SEQ ID NO: 7948 - DNA, 324 bp, Mus musculus
cttcgttctctagcgtgatttttcttccagaaatccctctctactttgaatatcagcaacaataacattgatgacataaaagacttagagatcttggagaatcttaatcacctgattgcagttgacaaccagctgatgcacgtgaaggacttggagcttttactgaaaaaactgataaagctgtggaaaatggatctaaatggaaatcctgtttgtcttaaaccaaaatacagggacaaactgatactgacgtccaagtcactgggaatctgtccttgaaggaatctgaaagctcgctaacaaaaaacgatatccatgaacctc

SEQ ID NO: 7949 - DNA, 344 bp, Mus musculus
tgtgctgcactcgtactgtgaggttggccctggggcatctctgtgtctgtgaacctctcggtctgtctccagccaccttcagggacctgtttctatcctgcctgcacagcctgatgctggtagctttgctgctgctgctgctaacctggaagctgatgcagaaagcccatcactttagtctgggctggctgcccagtcagggctggggccggggctcaaacttggccgacttgagccatccttccagtccttaccaatgctcttgcctggccggaccctcctgcagaattctgtgttgctggaagccccggccctgctgagacgcctctacctgtgggtggaac

SEQ ID NO: 7950 - DNA, 395 bp, Mus musculus
tggtacacagccctataaactcgacctggacaatttcacctgaatttcaatatgcacggaacctgatattactggcaatgctgataaaacctgttgttgtgatttttagctcagcagcccttagggtcagcatactcaaagcctcaatctctgagattcagatagtgtgctacaagtgctctgtcttaattctgatcctcagcagcctttgtaccattatttctgtgacctggaaccatgtagtagatctctatggcaacaccacccttgacttcccaccaaactttccagttaagaaagacgccttgattaaaaaacacagcactcatgtgtttccaatggggcttatcacaaccactctgtcactctttggtgtgattatgttcctctatgag

SEQ ID NO: 7951 - DNA, 554 bp, Mus musculus
agaagatccagagcgcctacagcaagtgcaaggagtacagtgatgacaaggtgcagctggccatgcagacctacgagatggtggataaacacatccgaagacttgatgctgacctggcgcgctttgaggctgacctgaaggacaggatggatggaagtgactttgagagcactggagcacggagcttgaaaaaaggccggagtcagaaagaaaaaagaagctcccggggccgaggccggcggacgtcagaagaggataccccaaagaagaagaaacataaaagcgggtctgagtttactgacagtatcctatctgtgcacccctctgatgtgctggacatgcctgtggatccgaatgagcctacatactgcttgtgccaccaggtgtcctacggggagatgatcggctgtgacaatccagattgtcccattgagtggtttcactttgcctgcgtggatctcaccacaaagcccaaaggaaagtggttttgtccacgatgtgttcaggaaaagaggaagaagaagtaaagaagaggctgttgtgccagactgaag

SEQ ID NO: 7952 - DNA, 523 bp, Mus musculus
gaggtacttcttcatctgctggagcttccaaatcgtcctcttcacgtccatcatcaccatgatagccagctgcttcctcctgtactctgtgtatgcccagatatacgagggcctcatgagctacgtcatctggatcatcatctatgagtccaccagcctgaccgtccagaccctcaccgacgagttcagtgtggccctggtcagagccatgcgatggttcggctgggtgtcccgtgcctccctacactgcttctggctatattttgttgtcacacacgcccagatcatctaccagagcaaaaaacagggcaacatactcacttaccatagacgtatctctttgggaagcggagaccgtccacggcggaaatcaaagattatacactttgtccagcaccacagtgaataacggtggccattttccatccctggagattctcagggtagtcctggtcctccacaatgcatctctccttttggggggaaggattgctttgagtatgctatatcctctttagcctca

SEQ ID NO: 7953 - DNA, 452 bp, Mus musculus
gggtattccattcccagtcctggagtcatctttaggatggaaaaaggaaaggaggcacagacagcaaaggctgaattcccaggccagagatgtcaaggggagagaccttataaatgcagcagctgttggaaagccttttgtactaaggtccaactccaagaacatgagcgaattcacacaggagagagaccttatgtgtgcactcattgtgggaaagcctttagaagcagcatgtgtgataatattggaaccaacaattcggtcatatttttaaaagctatttgtgtgtgaatgctggtattgtgagccatggagttaagaagacaacttccaggagtccttgcatacagaatctgtcttttcagacactgcatttcatggtccaagatagttgtgtgagcgcttccagaagatactctctcttctccaccatctatccatcttgacgtagg

SEQ ID NO: 7954 - DNA, 530 bp, Mus musculus
cacctagaggaggtcctgcgcaaaaagcaagaggctgtgtcaattctcaagaagcatccccaagagagagacagtgacactccacagaagtgtacagtccagttctcaggattcagaccaaagaagctggggttgcttctaagtttgcagcttggatgctcaacaactggaggagaggctggcggatctggcaaggcaacacaaggacctctgggagttccatgtcctgcagcagcgactggcccaggagatcagcacgatggagcacaggaaagatcagcttcttgcagagaggactctgctgcgagccaggctggagaaggtggagcagcggctgcaggaggccagagagacctgggacagcccagggaactgtgggctgaagacagagctggaggaattggaggggcagtcccagcgcagcccagaagctcagaatgataaaggggaggctagccaagaggaacagcatcatttggagacatcagaagagttgccaaggacaggaacgctctgctaaaccacaagga

SEQ ID NO: 7955 - DNA, 541 bp, Mus musculus
ctgagcggcgagttcgaccagctgcgcgactttcccatctttgaaagcaacttcgtgcaggtgtggagccccggacctccgacccgttgatgtgacccggtttggagaagtcgccaacaaggtcaccatgggggtggcagcctctagtcctgccctggagctgccagacctgctgctgctggccggccctgacaaggagaatggacacctgcagctcctcgggctgtttcccttgcaatttgtgcagttgtttgtgcatgatgagagccgccagcagctcaaggtcaagttccgaactggccgcgccttctacttgcaactgcgctctcctccagagacccgcgactgcgagtttggccgctgggtgcggctgctttaccgcctgcgattccactcgcccacctgcgcagtgcccttcacgcacgaggacactgcgcctgagtaatagtagtagtattagtaggaggaggaggaggaggaagtcaaggaggggcagttgcaacccccggagggtatcatttaattgcccaagacgtctctg

SEQ ID NO: 7956 - DNA, 86 bp, Mus musculus
gcggcttcccacacatgagacaaacccataattgtggaggtggtgcacccttgttgttgtttgaatttacagtcttgtcaagaatt

SEQ ID NO: 7957 - DNA, 571 bp, Mus musculus
gttgtctgagaaatctttcctcttagagcttctgaaaacccatgaaaacgcattagagagacagctcagtgagattatcagcgagcgggacacactgctccaagcctgcgaggctataaagaataaaaccacagaggaagaggaaagatttattaaggaaattacagacttcaatgacaattatgaaataaccaagaaaagagatactttgatgaaagaaaatatcgagatggaaatggctgacttagacagccaggcagatgttttgagaagggacaggcttaaaagggagttagatctgtataaagcagaagacatggaaagtgtctacagagctctccaagcagaagtagacctcctggagttggcactggcaccaaaggatccccaggacagtaactccttgagtcatgagccaccccacacttgagcatcagagaaccacacatgagtggagcctgtagagctgatctctacgtgaacatgaggatcaggcagtgcagaggagtgatgactctattgcataatacattttatcttgttacctaagaggtccttgtacagtttctaa

SEQ ID NO: 7958 - DNA, 546 bp, Mus musculus
gctaacctagcctcataatgtgtgacactgagtcctaagccaataggggagccaggtgaggtcagcctgaggaagaaggacgcgtcagatctgactccaggacaatgaaaagaaatgaaggtcacaggaagaagcagagggggataggaaagacgcgagggaccgtcactcatcagcaagatggggccatcaagttgtcattccagggccaactcatctttcctgttgtctctcagcatagtaatgccaggaaaacccctccgtcccagccagaggcctctacctggaaacccaggcggccaagctcattcacccttttgcccctcattgtgcctgggccggaagaggaggcacagggagaggcggggacttgcccaaggtcacggaacagaagtgtccagtccccaggtgtcccagcatcctgagaaagggtctctccgtgctctgcccaattcaaagatgatacatcagcatgccaaccacagccctgctttccagcagcctagcagagccccgcccgggtgtcacatctatttctgggcttgc

SEQ ID NO: 7959 - DNA, 334 bp, Mus musculus
acattcagtacgtgcaagtgccggtgagcgatgctcctaattcttacctctatgactttttcgaccccatagctgatcacatccacggtgtggaaatgagaaatggccgcacgctgttgcactgtgccgcaggagtgagccgctcagcaactctctgccttgcctatctcatgaaataccacaatatgaccctgctggatgcacacacatggaccaagacctgccgccccatcatccgtcccaacaatggcttttgggaacaactgattcattacgagttcaagctgtttagtaggaataccgttcgcatgatctactctcctataggtctgat

SEQ ID NO: 7960 - DNA, 564 bp, Mus musculus
ccattgtttcccttccaggaggctcccggcaaagccgagcccgggaaccaggaagttccccggcgcgacacctccagccgccgccgctatggaaacggcccccgccttccccagggcggctctcccgggaccccgcctccgcgccgccggccccgcccgcctcaccggccgccaacagtcgccgttgcggccgcggccgccgccatcttggcgcgggcggacagcccctgccttcccggcggcacgtgcgctgttcccgcgctcccgccgggcgcgcgctcgatgggctgcgggcggaggccgacggcccgagcccctctgcatgaagagggggtccgccgacccggcggcgcccagcgatcgctccagagctactcacgggctgggaccagtgctgtgtctgacacctgagggcagccggcagagcacggcgcctttcgcggatgaggcccgtccgctcgccagccttcagacgttgcctactgcacttgggtttttcttggactcggtatcctcacccgtgaagtgagagggaaactgtacctgcttcgtggagttgttccc

SEQ ID NO: 7961 - DNA, 394 bp, Mus musculus
atgtgcagcacatctatgggccttccagaatggcgaatttggtatttcgaggaacccatggtttcctccccaaacatggcttttataggtatgtggagggccagtatctgcaaccacgttgacaactccagccacaagagtgtttgccagcactactcctaccatgatgccctcgttcctttggacattcggttagcgcaacatctgctcctggttgcaaacattattggtctgattgggacagtttgtgctgtctttgctctacagcagttatacacagagaaactggagacaaataatgacgacaatccatttcttctttcagctgttctcaacgctgttgctagcacctttatttttcttgctgttatgtgtaatttctactctgtgcccg

SEQ ID NO: 7962 - DNA, 261 bp, Mus musculus
gcaaaaaagattgtgtctggaccaggagggatgaagaactgggtagaatggaaattgcactgtttaggacgaccactctcctactggatgacgggatgccatctgggatgagccagggtgcagacctactggggagtcactccaggacccctgtactccttggacattcttcactatttcattgtcttgccttcacccgttacttttttctcttcccacttgcaagtaaaactgaccagagtcctggagggaaatatctta

SEQ ID NO: 7963 - DNA, 370 bp, Mus musculus
gaacgttgatggtagcttcgactatggcatcttccagatcaacagtcgttactggtgcaacgactaccagagtcattcggagaacttctgccatgtcgactgtcaagaactactgagtcccaacctcatttcaaccattcactgtgcaaaaaagattgtgtctggaccaggagggatgaagaactgggtagaatggaaattgcactgtttaggacgaccactctcctactggatgacgggatgccatctgggatgagccagggtgcagacctactggggagtcactccaggacccctgtactccttggacattcttcactatttcattgtcttgccttcacccgttacttttttctcttcccacttgcaa

SEQ ID NO: 7964 - DNA, 362 bp, Mus musculus
tttggccacgtgaacaatcctgtaccatcttttcacctcgagatccacaatttaatcctgtctggaaagaaagctgtttgctctcccaggctttggacaagccattgttccatttaccactgtcaccatttagggaagtcacacacttattgtaatactcttctctcgttggtgtcttgctgtgtcctccagagccccattgtcagacattcaatttaaaaagctccttactgtcagactcctaccctgcaggcatggagggagggaaggataatgaagccttggacagtcagcccaggaatcccagacaacagaactctttacagtttcatgaagcatcgaacaagtgctgtggtccacac

SEQ ID NO: 7965 - DNA, 425 bp, Mus musculus
gacgacgacgatattcctgtgatcccagacctggaagatgtgcaggaggaagactttgtgctacaggtggcgtctcctccaagtatccaggtaaaccgagtgatgacctaccgtgacctggacaatgacctcatgaagtactcggcctttcagactttggatggagaaattgacctgaaactcctcaccaaagtgctggccccagagcatgaagtgcgagaggatgatgtgggctgggactgggaccatctgtacaccgaggtgtcctcagagctcctcactgagtgggacctgctgcgggcagagaaggaggatcctgtgggaccatctaggtacatctgacccaggagcatcactgagcatttgaacaaatgcaagaagtctcaaaccaagagagcttgcaagcagcttacagtttttatacg

SEQ ID NO: 7966 - DNA, 551 bp, Mus musculus
tgtccctcgggcaagcactataaggaggccacactgaccatggaccaggtcagctcccttcctgctctgagggtcaaccctttcagagaccgcatctgcagggtattctcccacgacaacgtgttctcctttgaagacgtgctgggcatggcatctgtattcagtgagcaggcctgccccagcctgaagattgagtatgcctttcgtatctatgattttaacgagaatggtttcattgatgaggaggacctcgaggagattgtgctaagactactgaaaagtgacgacgcgtctgaggacctgctgatggacgtcatgcaccatgtcctgagtgagtcagatctggacaatgacagtatgctttccttctccgagttcgaacacgccatggccaaatctccagatttcatgaactcttttcggattcacttctggggctgctgatgtggaggtcatcggctggttcggcagcttcaatgaagactactggacaccccctgcatccaggcactgtagaatctgatttgaattatgactcagctctgtccatc

SEQ ID NO: 7967 - DNA, 526 bp, Mus musculus
ttaggaccactgagccagaaagctgagcaggtggcacctgctgcccaggcctggggccccaccttggcagtgcctgaagccaggggctgctctgggggtgttagctgggagactcctcggagaaaggaacacaaccgatactgtcccaaattgccccccatgaggccgctggagagcctgggctgggcagacccctgttccagaagcagagctccctatctgggtggccctagcaggccccggcccctgctgctgtgtgggctgtcacctggggttctgccaatatcctccgaggcaggggggaaggaggccgcctcccaacctgatatctgcatcctgaccctggccatgatgatcgctggcatacctaccgtgcctgtgccaggcctgcgggaagaggacctgatccgggcggctcaagctttcatgatggcccatccagagccagagggagctgtggagggggtgcagtgggagcaggcccacgcccatgcccacatggcttctggacagatgcctttagtga

SEQ ID NO: 7968 - DNA, 458 bp, Mus musculus
aagcgtcccgcgatgggcagtgccagccagggctcgctggtctcggcgcccaagggggccgtccggtggcagcttctgcgacaggttctgaagcagaaacagttggatgatcatctgagacatgtatctgtgagaagatttgaatcatttaatctgttctcagtcacagaagccacaaaaaagggaactgaaaaagaggctggtgtgtgggtccagtacacaagcatcttttatcccaaatacagcatctccgtaaggcataatagtggatccttgaatgtggaagacgtccttaccagctttgacaacacaggaaatgtttgtgacccccctccagccccccacacagggggagttgatggggatgtttttttgaccacttgatttacctgctcccattgacttcatgcttttgaagagtgactaagcttttgacaactctttctttgctaattcac

SEQ ID NO: 7969 - DNA, 497 bp, Mus musculus
aacctgctccagttatccatgacaacctccagtccttttcttggcaatgaccacagtcggtaagggccgcaaaatctcggtcggccatgatcacaagaccacggtcaccaagggccacaggatctcacttggcaatgaccacaggaccatagtcaccaacggcgtcaggactacggttggcaatgaccacaggaacaaggtcaccaagggccacatgacctcagtcggcaatgaccacaggaccattgtcaccgatggcctcaaggaccacagttggcatgtactacatggcctttgtcccccgatgactacaggaccacagttggcaatggctacaggatcacggtctacaataacaacagtcaacaatgaccacagaaccacagtcagcagtggaaacctgacgtccttttctgctatgtaaagaagcaagcatggattctagcgttgaggtaggacatctgtagtggccactgttcttctgaatgttcctgggt

SEQ ID NO: 7970 - DNA, 214 bp, Mus musculus
accgcgtcgtgttcagctgcaggaatggtgatggagtggagctgtataacgagattgaattctatgccaaggtgaactccaaggactcccaggataagcgttctggtcgctccattacttgctttgtgaggaaatggaaggagaaggtggcctggcctaggctcacaaaggaggatataaagcctgtgtggctctctgtggacttcgataactg

SEQ ID NO: 7971 - DNA, 568 bp, Mus musculus
ttttccagattacaacagatctcagatattcaagctgaaatctaccagaacaatctggaacttgaacttttgaagctagaaaaggatacagcagatcttattcatccttcccatttgattgagaaatgtgatgttctgcaaagcatgaataatcatctggaagcagtgctaaaagagaagcatgccatcaggcaaagactgctgagacccatgtgccaggagaacttgccattggaagctagttatcacagatatgtggtacatatgttggatctggctgtgactttcattgagaaatttgaaacccatcttgaaacagttaaaaatagccctcatttagacgcaaacctaaagcaaatgagcaaagctttagccaagatggatattttggtgaacaagacagaagaactggcagagaatatactcaagtggcgagaactacaaacagaaatttccttgtatatccccaaaatgctaactgaagaacgccatcttcatgaacttgacatagtgcctcctttacctttttttcctaaggctcacaccgaaacctccagggccaagtgat

SEQ ID NO: 7972 - DNA, 366 bp, Mus musculus
agcgccagaggcaggcaatgatacaggaaatgaggatgccattggagggaatgtgaacaaatacatagtgcttccaaatggatactctggacagcccaagaaaggacatcttacctttgatgcttgctttgaaagtggtaacctcggccgggttgagcaagtctctgattttgagtatgatctgttcattaggccggacacctgtaatccacgcttccgagtctggttcaactttactgttgaaaatgtgaaagaattgcaggtaacctcggccgggttgagcaagtctctgattttgagtatgatctgttcattaggccggacacctgtaatccacgcttccgagtctggttcaactttactgtt

SEQ ID NO: 7973 - DNA, 233 bp, Mus musculus
ttcctgtgaaggagccggaccggtaccccctacccaccgacctgcctcctctgagtgagaagagtaagtggaacctactaagattatcccctgactacaagaggacctaccagaccttcccatcagggaagagagtttcctctcaagagcgccaaaggcgggacctttacttcgagttcagagcctgaaaccaggtggttgaccccagggaaccttggcctgaccaggctggc

SEQ ID NO: 7974 - DNA, 531 bp, Mus musculus
aggttgtgactcacctagggctacacatcagtagtgagcagaggtggagggacatgtgtatccagggggtcagtttttcacccttcctcagcccccttgcgtggcccacaccccaggaagtcagaggcaaaggcagcagtctaaagagaggaggcacccatgttctagaagggccccggcacctggagagtgacatgtgaggagaatccagagggtggaaatgctggcatgtggggcgcctgaaggagagacactctggccgcactggctcagtgagaggaggctcgtgggtccgaggcccagcagcctgaggctctctctgcttgcacttgtcttcagccatgggagagccaccatctcactgagctacagcctcagctttcctccctcagaccagaccagcagcagaagcaacagcatacatgacacccagtacagctacacacacaccacttttcccgaaataaatcttcacgtacttcccatgtccgtgcacatacacctccaggtacctcgtgagaccacagacac

SEQ ID NO: 7975 - DNA, 499 bp, Mus musculus
agaccagttcttgctttcatcatgactatggtgactagaaattcactgaagcaaaacgcagctcaggtaacattgactccaatgactaaacggaggaagatgcggaagccgtttattccattgagatgtcaattatatttcaaggtacaaaggacaagaatcaagacagaacaatctctagggtgtacaaagaaaaaagttccaacatactatgtttatccaaaaagacgtaaaagagcaataagaccaacaatatatgtttgttatcatatgttaaataggaagtggaaagaaaggagggaaaaaagacaaaataaaagacggtatcagtccaagaaaaggagtcaacttaagagaagatgtcaaagtaagaaacaaaataaaagcaagagctatttttagctatcttcagattaagtaaagtcccagataagttcatcactttaaatgaagatcaacataacaaaaagataaatgaacttgcaaacatttgtagcat

SEQ ID NO: 7976 - DNA, 494 bp, Mus musculus
tgatgaaatctactgctctcctcagaagaaatgggtcttactgagtaagaaacagccatatattttgccaaaggtgttttacatgagcagcctactgaggacatcagaattctctgcccctgtgtctacccttctggaaatttccttatgtcaagaagccttctggaccccaagaagggaagacaggctaaccctgatgtccagaagtggttgctccaaaatcacaaagtttgaaacatatgatatgaagctggaagagtttgggaacaaaattattgttaaaggaccccgttcatgtcatcgtcacctgtaatgatggctctttggatgtatatgcatgggaggagagaagcctgctgctcaggaagtgttatcgactgaaaaacaggagacatctgtcaccgagaggcttcattaacaaaacgctatgtgatgatgtgagcataattcagttgatgatagatggtcatgacacctggtttctgatggcatat

SEQ ID NO: 7977 - DNA, 166 bp, Mus musculus
tgttgccatcacctctgtgatcctagtggggtctaaccttagacctccccactcccaaggaaagacatgcccggaactaacaagaataaaaagaaagaagtgtaatgccccaccagccaagcaggcagacagtatgagaccactgagggatacaggaccatcggtc

SEQ ID NO: 7978 - DNA, 330 bp, Mus musculus
caagacactgtttgatgacccagaagatgctgtgtttgtaagatccacgaagagatccctgatgacgttcaccagcatgaactggaacaccgttctaacacgaagtgaaaagtatgaccagaagaaaaagagctcggccgctgagatgctcatgatttccctgcggtaacgagcacttccggaaactcccggtgctgttcgctcactcgttagaacactccctcgatttagctccgtgtacatttgttgctacccgaatttttaaaatagaagagtcagtagtgaaaaatgtttcataatgtaaaaattgtatatgagttacccacgtat

SEQ ID NO: 7979 - DNA, 365 bp, Mus musculus
ttaatctcttgagcagcatcctcacagtactgtctactaccaccaactactggacccgacagcaaggggggcacagtggcctatggcaggagtgtacccatggcaaatgctccaacatcccctgccagaacaccgtggcagtgtccgcagcgtgcatggtgttggcagcaaccttcagtattgtagctttggggatcgggataaggattcagtgtcgagaggcagagtcacgacgtagccagaataccattgtcttacttttcctcagcgggttgctgctgctgattgccttggccgtatacacttcaaagaatgcctggaagccagaagtcttcttctcctggtcctactttttcggatggttg

SEQ ID NO: 7980 - DNA, 351 bp, Mus musculus
tcccgggcgcagtcaacaaatcagacacaaacagattcattatctccatcccctaatcctgtgtcacctgtgcctttgaataacccaacaagtggcccaagatacggaactgtgatccctaaccgcatctttgtaggaggaattgactttaagacaaacgaaaatgatttaagaaaatttttctcccaatatgggtctgtaaaagaagtgaagattgttaatgacagagctggagtgtccaaagggtatggtttcatcacttttgaaactcaagaagatgcacaaaaaatcttacaagaggctgaaaaactcaattataaggataagaaactcaacattggtccagcaata

SEQ ID NO: 7981 - DNA, 394 bp, Mus musculus
tgtgccctgcagatgagatgatttcaacaaggcccacttcacactcctaggggtccccaacaaacccctgcaatgcctggatttcacagcaaccggccagaagctctgtcacaagtatcgtggcggcaagatgattcccatcgcgccaggcatcaaccgggtcgactggccctgcttcacgcgtgccatcgaagattggtctaaattcgtgtccaggtccgaagagttcaagctgccttgtgccaacaaaagggtggagggtttcagtggctacgcggtgcggtacttgaagccggaggtgacccagaactggcggtactgcctcaaccagaaccccagcctggaccgctacggacagaagcccctgcctttcgactcgctgaacgcgttcagg

SEQ ID NO: 7982 - DNA, 432 bp, Mus musculus
tggccataggtctctttcagctcttggtgaatcccatgaacatttatgaggagcagaaggtggtggcgttatactgcttggcaagcttgggggccatcggctggggcacctcccctcacatccgctgtgccagtctcctgttggtacccaagatgctgggcaaagaaggcagactctttgtcatgggatatgctttggctgctatctacagtgggcagcaaagattcattgaataaagagattcagaacgtctctacctcctttgaagagatggatgaacaggtgaagagtgatgctggctactcatctgaggactgggacaagaacagagaaagcacagagatgttcggaacctcccgcgtccgaccctacctgtccacacagatggtgtatgagctgaggaccaggctacgctgcatccgtgaggagtat

SEQ ID NO: 7983 - DNA, 444 bp, Mus musculus
tgggatctcagctttgggccttctcctgctgatgcagggctcagtagatgcgaatggaatccagggatttttctacccatggagttgtgagggagatgtgtgggaccgagagagctgtgggggtcaggcagcaattgagaaccccaacctctgcctacgcctgcggtgctgctaccgggacggtgtgtgctatcatcagcggccagatgaaaatatgcggaggaagcatatgtgggcactgggctggacctgtggcagcctactcttcctgatcaccagtatctgtctcttctggtgggccaggcgccaagacatgctgcacctaccaaggtttctacatcggaaatgtagtaaactgtcaaagacagtctcctcactgtctaaggaccgacgatcggccaacaagtcaactaccgttctccaatccccaggaggcgaagtaga

SEQ ID NO: 7984 - DNA, 453 bp, Mus musculus
tcttggccgttctcaatgattcgcttggtggtcaccttacggccgttcaccatctcagtcgatgacatcactgacttgaaccctgagctgccagagccaccaaacgaagcagatgaaaaggtggagcggctgcccccaccatggcccagagtattgaaagatgacaaggcttccatgaaggctgggaactcaccaaagcccgaagggaagactctgtgtaaaccatggggccggcctcggccgctgaacggagtgtcccagaattcaaaggaaaaagggtccagtcccccaaagaactcgcggaaaatatcctcaggatttcggaagggatagccagcaccgaagggactgctatgggggacattggcaccgccacctgctctccatctgtcacagcctgcccggtcgtacacagaacgcttcttagagtctgacaagacttcgtaggcttcg

SEQ ID NO: 7985 - DNA, 460 bp, Mus musculus
tagtgccatcgctgttcctgttggtgatgcctgtccctagccaaggctggtctaggcccctctggtaccaagtagggctggacttgcagccctggggctgccagccaaacagcccagatatctggggctgccagccaaatagcctggatagctgcaagaacagtctgggttgccctggctactggttgggcctgggaggaaatcgcatctaccccgtggctggggtcacaatcaccaccaccatgttgctggttgtcagccgtgtgatagtgcaccgatggcgagctaaggttgctaagggtcagctcccagcagtgacctccagctccggcaaacactggaaagagcagcccactgtctcagaccgcacgctggtcctcagggtccttcacatgctggagccatcctgctccacattgagggccacctgcaggggctggcttcccaacaacaaattcaa

SEQ ID NO: 7986 - DNA, 295 bp, Mus musculus
tgatatgtctgtcccttttgctcatccctgcttcagctggaacctactgtgaatgcagccttggcctcagccgtgaggcccttattgccctcattgtggtgctggctggtgtcagtgccagctgcttctgtgccctcgttgttgtggcgattggtgtctttcgggccaagggtgacacgtgccctggacactcggaaaacaggttggtggggccctacggagtccaggaagatcgcatagacctgcacacggtacatgtggagtcccacctcatggaccctgatctggacgtatc

SEQ ID NO: 7987 - DNA, 416 bp, Mus musculus
ctcagagcaaaaacatggccatggcaggacgtgtggggcagatgaagaatcaggatgaagttcaccagaatcagatcttgcgggaactctttctcaaagagctacgggcacagaagctgtacacgcagtatcacgtgaatcccctgcgcaaggccaagttcctgaacctcattcaccatgctgcacagggtccaaaaaagaaatattcagagacacagaccgaagcccaagaaattggatgggacccaaatcccttgatcaacccagaccgtcaggaccataggctgaaccacttcagagtctaccacgacatcactctgtacaaggctaaactgtggagcttgggggaagacgatcaccagaagtgacattctcttggtggagtgaacctgcacactgaattccccagtgtatgt

SEQ ID NO: 7988 - DNA, 321 bp, Mus musculus
tcctagccctggagaattggcatcacctggagcttgctaggctcctcagatcaccacaaacattccacatcagaatctggatctttcctgcctccccagcagacagctgttcccggggagtacctgagctatgcctcgtccaagctgtcaggcgtcaacattcgtcaagcctttcggttcagctgtgccatagctcccaagtcagcagttctccgggccacctgttaccacaagctccatcaggacacttccagacaatcctttcctcagctctgtcctcccccttcacccctacttaaagcccacggcaattggaaacaa

SEQ ID NO: 7989 - DNA, 86 bp, Mus musculus
aagggcagcatcagtttggccctgaagctaactgaagacagagctgttggtctgataggtggagctgttagtctgatagtcaaaat

SEQ ID NO: 7990 - DNA, 544 bp, Mus musculus
  misc_feature (40)..(40): n is a, c, g, or t
  misc_feature (51)..(51): n is a, c, g, or t
  misc_feature (53)..(54): n is a, c, g, or t
  misc_feature (132)..(132): n is a, c, g, or t
  misc_feature (206)..(206): n is a, c, g, or t
  misc_feature (369)..(369): n is a, c, g, or t
  misc_feature (394)..(394): n is a, c, g, or t
  misc_feature (483)..(483): n is a, c, g, or t
accttcaccctggaggcctttgagtgcctggcggcgagcnaagcgggccgncnntggaaacaggtgaggcaattctgggtcgaccacttctcgcgccgcttctcgccgcggaggccaccgctgcgccatatntcatccatgtccaccttctatctgctggaccaccgcacgcgacaggccgaactggggctcaactacggcgagcngcgcacccgactgagcgacgaggccttcgttttccgcggcggccgctggaccccagaggggaagcgcgcaagcgcgcgcacgcctctgccctcctccaccatcccggcctggaagccacaagtgcagccgattaagagccaggtgctgctggaagagaataantacctgaagctgcagcaagaactgntcatggacatgctaacagagactacggcgcgcatgcaactgctggagaagaaggtggacgcggataacaaccctgcggccccggcgcgntcctggaagagaaagatgcccaagcaaaggggcgcgggagtacttataatccagccgcgcg

SEQ ID NO: 7991 - DNA, 350 bp, Mus musculus
gggaagccctcatcagaccaaggagtcatgacaaaaaggcgcgagacatcttgtgaggaatagcagaaataatatgactagagggcgaatgcagccctctttgtatcagtaaagaacgggcctgcaaggttgggctttgatcctaaaatccggtttctaaacctccaaagactccttagcaaagcagcctgccgagcaagcctttcttaactgagcttaacggatgggacacgtgacccaaggctagggctgtgagaaaggaatttgaggaatgttgagaggtggactcaaaactttgtgatcagctgaattcaaacgattttcctgtgattccctagttccagaacaga

SEQ ID NO: 7992 - DNA, 493 bp, Mus musculus
  misc_feature (48)..(48): n is a, c, g, or t
  misc_feature (336)..(336): n is a, c, g, or t
  misc_feature (340)..(340): n is a, c, g, or t
  misc_feature (348)..(348): n is a, c, g, or t
  misc_feature (359)..(359): n is a, c, g, or t
  misc_feature (364)..(364): n is a, c, g, or t
  misc_feature (436)..(436): n is a, c, g, or t
  misc_feature (449)..(449): n is a, c, g, or t
  misc_feature (451)..(451): n is a, c, g, or t
  misc_feature (461)..(461): n is a, c, g, or t
gagcgcggaagcacgccggctttcctcagacagcgagcgcgggctccnagaagccggccgactggagggaggggccgcttccgggagccccgccccgcggcgcgcagaggcgctgaccgcgccctctggcgcactgccgaccaatcataggccggtatgtcggctccgggatcaatgagggggcggagtcaccgtgccagctcgaaggcgattcaaactgagggagccggggattggctgaagctgggtaataggcaagcagaaagccttgtgtccaattcccattcagaagctctatttagactgcggaatgatgaggctgagaggagcgttgtntaangagagatngtagctaacantgganatgaaatgtatatgagggtaactgtggactgaagttagaaaacacagcaccattgaataaaatgaaaatttnacgggctgacgantngaaaccgagnacacgaatcaaaatcaggaggctaagctttag

SEQ ID NO: 7993 - DNA, 378 bp, Mus musculus
  misc_feature (257)..(257): n is a, c, g, or t
  misc_feature (269)..(269): n is a, c, g, or t
acatggtgattttcgtactggtactggtgtccagtcagtagtttggctgcagttctccatcctgtagaggtccagcagagtacggtggtgcagaatagcaccggtctgtggaactcattttcatttctcatattattttcaagcttttaaaaaatatgaaaacataacaaaaaaaccccaccacaccactattccctgcttcaatttaacagcatataactctgtcattagcgacgctagtgaagggcttctgcctnttcctgctgatntccctcctgatcttcaacaggaaatggcaccgtgatgagcattcctttcagaaatagttcaaaaaaggactataggattggaatttgacaatggccaaggtttgcaaat

SEQ ID NO: 7994 - DNA, 400 bp, Mus musculus
ctgtggagcgccgaccaatgaagtcggtagaggggaccctacgctcggcagcagccaatgggaggatgttctggtcgccacaacagccgtcgtcaaggaaacgaagctgtcagggaatacagagccttccgctgctacccttgagcagtatggcttctcctgcttcatcccaaaatgtagtttatacaaaaatgttcagaatcagaatgattcttaggggtaaggtactagcctatcgtaaagtcaatccctagcttaaatgaaatttaacactaacatctttcgataactgctcaagttcataggcaagaatctttcaccactaatgtattacgctatcacagttaaaaattatagttgtaggaaactacaacccaggtacccaggtctcagggatcaa

SEQ ID NO: 7995 - DNA, 282 bp, Mus musculus
atgatgctgagagcgacgcgacgccgccatcttcccactcccccgtactgtcactgcggcaacggcgccaccgcccgccctcacttccggattctggaccaatcgggatccaacatacccggaaatgattcctgccgaagtgggtggagtccgagagaagaagggaagtattggaagctcagagaacaaccagcctgggggcgtggcttagtagtggagcgacgggcttttgtgacgccctggcgggctggctgggcagatttgaaagttgtggtgagccac

SEQ ID NO: 7996 - DNA, 282 bp, Mus musculus
  misc_feature (58)..(58): n is a, c, g, or t
  misc_feature (60)..(60): n is a, c, g, or t
  misc_feature (71)..(71): n is a, c, g, or t
tgtggagagcgcgagccttgcttatccccgagttaattcccatttgtattaacacagntnttgaagggtgntctttctcattttcgcatcgttaagattagtgttcgacttaaagccgtggctgacttcatcatcccacttctgtagacttcgcattgtttgtaaacgtgcacgcgatgtcagagatccacagtgcaggtctgcagcaagaatgggcgtgaagcctttttcaaaaaaacaattgctgggctggagagatggttcagctgttaggaacaccga

SEQ ID NO: 7997 - DNA, 520 bp, Mus musculus
  misc_feature (473)..(473): n is a, c, g, or t
  misc_feature (487)..(487): n is a, c, g, or t
ttatgtggcaggaatagcaccgttcagattcattcagatgttttgcagggaggacacatacacacactcccttccaggacggaagaaatcgccaatgtaaaagaacactgtctttcacaaatagccattccatcatcggacagagcttcacattgtggattgaaagtcatctttgacccaatcattcaatctaaatagttcttgagattcacatttgactcataccagctttccatctcaacaatagaacaaaattttcctcccgtatctccaattccttcaactgtaataggatatctgtgaagatatcaagggaaaggggaaaaaagcatgtttcttatcactaaggatcaacctaaagatgttgctaaacctatacagagggagaccttctaagttgatgacaatctggaaattaaatagctgtgctgtataaaaaactaagtagaaccaacattatactcctctatgantggactaatcaatntctatacctgtctcctttcatttgtccaacaat

SEQ ID NO: 7998 - DNA, 518 bp, Mus musculus
  misc_feature (403)..(403): n is a, c, g, or t
  misc_feature (424)..(424): n is a, c, g, or t
tgagcactgcaacaccaatggctggcaaggacatggctgctgtgtagcgcttctctccgtggactcacacaggaaggaaaaccttggttgcaaatacctttaattgcagcgacttgagaggttagaaggatttctgagaattcaactcttgtctctagtataataaataataataataaataataacggaactgagtatggtgactcacgctgcaatatcagtacttggaagtcaaggccagcttcagcttcataacattgtgagtccaaattgggttacatgagactgctaaaaacaaacgctaaaaatgaaaaaaattaaataaccacagatgagaaaagagaaaaccccactcccaaacagggctcctcttctccatctgacctgcccacacatgcgtangcgcaaagctgtggctttatnagatgcctcctatttgtttaaattagccattcaaaaataagtggatggagagtacaccaccaaaaggctcaagccctccttttgaactggattt

SEQ ID NO: 7999 - DNA, 431 bp, Mus musculus
  misc_feature (211)..(211): n is a, c, g, or t
  misc_feature (355)..(355): n is a, c, g, or t
  misc_feature (385)..(385): n is a, c, g, or t
gaacaatatgctgccaatagagtttggaggtgggtattcagtttacagtgtataaatttaaaatatgcatcccttaacaacgctttgtgttagcatgctgcaaatcaaaatggcgcttaatattaaaacctggtgtagggaattttaatgaaaatcctgttcataaatgtaatgcatatgatgtgtacttttaagttctagtccccaaatntagtttatattcagctgttcagcataactaatgtgtaattttccttcacgctatattgtggctttgtgttttaagtaatattctcctttctgtttttgcaccagataagaatctgttacttgaaaacaaatttttttatctttnttaacttcagaatactaaatttggaaaatntactaaacttgtgtgttatgtggctgtaaatgatgtacacgctgta

SEQ ID NO: 8000 - DNA, 430 bp, Mus musculus
  misc_feature (311)..(311): n is a, c, g, or t
  misc_feature (345)..(345): n is a, c, g, or t
  misc_feature (350)..(350): n is a, c, g, or t
  misc_feature (404)..(404): n is a, c, g, or t
ggtgacctgtcattcaagagcctgagtccccagggtcatccctggaggactggaggggtgcatggttcctcccctcaggtctcctgtgctgtccattcccatgataagtcacaaacatggggacgctcagagaagtgtggtatatgatccttgctccaagagactgaggcaggagcattagactttaagacatccccagccacttaatgagttgaagatcagttgaagatcagcctgggctaccagagacggcggtttctccaaaaagaaaaacagaatcatgagccgaggaagcccacatgtaggacagnttcatcaagagaagactgaccacccagatcaggncgtanacatgtattcataaacgccaggtagaattcgtcaacgtggcttacaatggcatngactagctgccagtgatgtttcattg

SEQ ID NO: 8001 - DNA, 502 bp, Mus musculus
  misc_feature (308)..(308): n is a, c, g, or t
  misc_feature (314)..(314): n is a, c, g, or t
  misc_feature (326)..(326): n is a, c, g, or t
  misc_feature (331)..(331): n is a, c, g, or t
  misc_feature (334)..(334): n is a, c, g, or t
  misc_feature (337)..(337): n is a, c, g, or t
  misc_feature (377)..(377): n is a, c, g, or t
  misc_feature (411)..(411): n is a, c, g, or t
  misc_feature (458)..(458): n is a, c, g, or t
tctcttgcctacttgttttgaaccccgccctcactttctcccatgctcttacttgtttggtatatgaggagacagcaacctacagacagcggattataaaatacagttgggactgcacgtgtaaattgctatcagagaaaagaggaagcccgagccaaggacaaccgcatcttagatgttcactacctttgatatgaagatcaaaagatagcttcatagccctgggaaagcccgcaaaaaaaaaaaaaaaatcctgtcaagagcgtagaacctcaatatgaacacccggagccgattatccaagaaancacgtngcttttgtaagnttcanatnttnttcaaatggatgcatgtaaccggaacccatctgagttatntttggtatctgtgttatgggttccttaatgtttnttgtgacttatcatatttgaacagtttcttttgggttaatcgaattncaggtttaagtacccatcaatgctgcacgcaacttgagctagct

SEQ ID NO: 8002 - DNA, 390 bp, Mus musculus
  misc_feature (64)..(64): n is a, c, g, or t
  misc_feature (311)..(311): n is a, c, g, or t
tgtataccctgagctcttccaaagctgctggtgagaatggaccatcatcaccaccagcagcatnttaagagctgtgtccgactcttaccttgtactaggcaccgcgttgaccgctgatgtttgcaaattctggagcccagtctcctaggtcggaagtaactccgttctcccaaagacgctgtcagagaataaagaattaaatccatgagtatatttcaatatttaagaccatgcctggcatatctgtgcctcaatacagggggcctaataaatgtcaaataaacaacagcaaaaaaatatctccaatttanaagatagaaacctaaagccaacagccgtgcatttttcgagttttcaaagaagggaatgcttgctgggttgcagggtcct

SEQ ID NO: 8003 - DNA, 527 bp, Mus musculus
ttccctgtgtgtgccaaccaatataattaaaaatgcatcccaagtaaacctcagacaactgagccctccgctgcaacgtgggggggcgcgctcactgtcggagggtggtcaccccggtgggcgcaaacattgccccaggtgctctgcagctggctgcaaaggctcgtgaaattctatcctttcaagttcccagtgtgctggagagcaaccctgagaggccggctggcagccctgccccacctgtggaaactaatgataccagctcagcatattggcagaggaaggaaacttgcactgcaaacagacctaccgaaacactggaagtatgtctgaacagaagcacattgattcaagtcgctcaaagatcaaattactctcccagcccaggtgattttgtcctagaagccaggatacttgtatcgacaagaatattgatgaaaaaccactcgctgcatctcggcggaccatattaaggctgttaatctcggaagtgtcccataatttttatccgacatgcagactcttca

SEQ ID NO: 8004 - DNA, 519 bp, Mus musculus
gaaacttgcctgagatctgataaatgtgttatcaacaaggactagcttgaaaccatctccatccactgcaacgctctcaatcccagctgtcacaattatcactaataacacagtgttgttacacagacttgttgtgacacagccactgagagggtgtgacacaacccagttctggacacagtacagtgggatcttgcttcatctcctcaccatctgctgagccctgggagcttctcatatccaatgctggacagctactctttggaacctagcagtggaaatggtccctctgctctcactgtgtgaagacagactaggaagaagaaataactccaggtctttaagactgaaagaaaaagtagccccacttatttagaaggaatggtacccttggcatggtctgtggtataaaaggaaccgagaaagcctcacaggaaggacaatgaatgggatattttgggctaagtggaatgtgataaaaagcgtgacacattttcaggatggcccaacccaggtggt

SEQ ID NO: 8005 - DNA, 348 bp, Mus musculus
taggcactccattgccaaaggttgttgttatttcaaagtgacgacgatttggtgccctcatccctaggcacattttttttttgtgatctggttaagtaagaacttcacttgcaggtgaatgtgttgcctgtgtgtgccagaccccagggctttgagacaggttttatgggctcacaattctgctgaggaaggccccatcctggctttgatactcaaccacgacaatccggacttcttactacactggaagaagtctctgcattattgatcactggactctgaaaaacggtgttctacctgctataagacagcacaatgaagatgtgatgctacaaacacacttagtgt

SEQ ID NO: 8006 - DNA, 449 bp, Mus musculus
gatttgcacctaacggaatacccagctgatattcctctgaacacccggagactatacctgaacaataacaaaatcactagtttaccagctttgcagctgggattcctcagtgacctcgtttacttggactgtcagaacaaccggattcgagaggtgatggattataccttcatcgggatcttcagactcatctaccttgacctcagctccaacaacctaacttccatctcccctttcagcttctcagtgctcaccaacctggtgcggctgaacatttcacacaaccctcacctgttgtatcttgacaaatacgtctttgccaacaccacgtctttgaggtacctggacctcagaaacaccggattgcacatcatcgaccataatggcttccaccacctggtggtgctccagactctgtacctaagtgggaacccctggatatgcaactg

SEQ ID NO: 8007 - DNA, 565 bp, Mus musculus
atgtagctccctgaggaggccatgttgaagctcatggcccctgaagctgctcagagctctgagtgagttggtggtcctgataccacagccaagggctgtgttgatatttgtggtccttgttgccactaaagtggatacagatgttctgccacctgaagtcatgttaatatccatggatgctccagagccagctctactgcccctcactggagagttatgtgtgtgtatgtgtcccctggagctagccctgactccactggagagttggctccaccccttgctagccaacacttgtcagggcacaggagagttggcctcatgcctcttggctcataccatgatgatgatacatatatcacacacagcccccactcagaaggtctggccccacctcaactgacccacagaacacagaggcaagcagtggcttaggtgtggaatatctagtcctgcacctcgctggcagccatagggttctatcagttgaagacttctggtgtggacaaaagcaaagaaagacttttgggtggtgggagagtggggcggtctgaccactaagaatttg

SEQ ID NO: 8008 - DNA, 396 bp, Mus musculus
agaaatgatccgacgtggctacaggaaagtgagggtactgttcctttaaaccccttgaagccaaatttattcccccacgaggtcagagtcactggcccctgtttaaatgaaggagtgaatattaaagacctttatactaggaaaatagtttgggtcttaaaaagtaagctgacctgaaatagaccaaacctacaaaatttatttccactccatcagactccataccccgagggtgtgcgagcgtgaccagcaagctgtgttaggtcacgaatactcgagaagcaggcattgcgcgtgcagttcggaacccgtgcgataatcaatgtaagaacagtgctggatccggctccagtgaggggtagggctgatgcatacctttgggtcttctggcatttc

SEQ ID NO: 8009 - DNA, 564 bp, Mus musculus
atagatggagtcagggtcacagtgtggaaggagagcatgctacatttgagtccggactcggttgttattatcagctgtgtgaccaagagaattgttctatgaatctgatgtttcgtgccttcacttatggatgggaaaagtgagaaagacaactcactacagtgcagtactaacaaaggaaatgatgtattccatacaggactaaggaatgattgccaccacaattagtgtaataatggtggtggtggtgatggtgatgatggtggtggtggtgatgatgatgatgaagatgatggtgctgggactttgctatggcgtgaaatagaattcaaatctacccttttggagctggagaggttgccctgttaagactgctctcacagtttgctgcttatgcagaggacctgaacttagttcccagcactcttgccgggcagcccataccttcctgaaactccagttccagaggatctgctgccctcttctggcctgcgtggacaccaacaaacctgcagacacatggtgcataagttaaaatctgtaaacaacttcctttctgtgtat

SEQ ID NO: 8010 - DNA, 358 bp, Mus musculus
aaacttctggattctagaggatgactaacgagtaaatgagcgcttggagacagtctcttcctacagcagtggcttggagtgaaagttctggggccacatcttaggagaactggcaaccaaagaaggggttttagagacagaactagttctggatttgcccccagagttcaagtcataccagtcaatcagttaggtacctcctgtactggaaggtcctagtcattacgcaaatgcaagtgttagcagttagagaatcttagagatggattatctccgttttacagttttgaagacaaaaacgaaggaagagctagaaggattaagttcacaaataaactcaaatcctcgtctcaaggac

SEQ ID NO: 8011 - DNA, 481 bp, Mus musculus
gcccacctccgtatcattattataagcaagaaatataatatttaggcagttaaatcagacaataatagattttagacttagtgggacaagacctaaagttaataaactatagatacccataaagtcaaataaaaaccaaattattttgtttatattgatgatattaaaatatgattgtattatttgtaatacatttttcttttttctttttttcccatccttgcttcctgacttggcgttgcatgcatgattttgcatgtgtttgcatgaggagacccaacgttgataccaggagtggtcctcagttgctcaaacacctcactcatcaaggaaagacctcacaaacccagagcttgatggttatccatgctcactagctttctctgaagattccctgccccaggttcccagggatggagttgtatgaggatgccacatccatctgaccttcatcatggtttctgaagatccaagttcttac

SEQ ID NO: 8012 - DNA, 534 bp, Mus musculus
tgctcccctgtgtgatcagtcataccctgctcccattcccctgcatctgcacatgtaaacactttagatgaagggtggtgtgtgtgtgtgtgtgtgtgtgtgttagagagttgtgtcagcatcaagcaaaaacagattccttttacttggttctttaaatcgtatagcaaatatcaacataccatttgtattacagaagtgatatagagatgacttagagcatactgaaggatatgcatatgttataataaaagtactgtgtcactgtatgaaagggacttgagcaccaaaggtcttggtgttgccacatgtcctagggatggctatggagctctgagccttgtatgctatattttgcagtgacagactacactcaggcctagcttcctaggatacagagcactgcagcatctcaaagacaagatgccgtgcctttcaacaacttctttcatactcctctctcacaattctgtttccttggcattccatctaaatgaaatatgaatcaatggagaaaccagttacttcacttaa

SEQ ID NO: 8013 - DNA, 504 bp, Mus musculus
gggtggacctatctgtgctacagcctgccagtcttatgcggtggctgttacacatccatcctgtgtgtgtgtacgatttcagatcaccatttgttctttgtggcatctgtctgccacccgcatactctgccccctcctctgggaacacagaaactgaaggtgcagacccgtgagcttagccatgtcttttcaaatacctgtgtggcatatggcttctcgaaagggctgtcaagaactccccaacccgctagggtgttcttcaccctcctttaagatgaaacagaaaatgcagagacccagaaagtgacctcaaaaattcaaaagtcactgggaaagaactggctctggagacgcccatgaaggtcagaatgaaaagggttccaggagagaggaaatcttagccctgaaatatcccttatccaatgttgcaaacacaatcacacccacactgaaatggagtgtttatttaatgtctaatgtgtggctggtttccctaaacatttg

SEQ ID NO: 8014 - DNA, 364 bp, Mus musculus
agccctgtctcagtgacactcatattgttccccagagagaaccttctgcgccacctagaggacactttactgggttttttgagaagaaacgttgggatactgagaactgagggaagaaggctgttgagaaaggcgggccactgtccagaagtcaaaggtgatggatggcaacaaccactatgcctacctaagacgttcatcccgtccttgaactccaggcccttcttgataacgatcttagtttcttcaggggcctcgttcatggtttcattcaacatggagatgaccgccttggtggtattggcctcctcagatggaggtgccaccagaactttctttgtcactgtctgaatctaatggagca

SEQ ID NO: 8015 - DNA, 551 bp, Mus musculus
acccttatctagagcccttggtagactttgtatagctttctcattaacaagtgagacatccgaccggtgcccaggaaatgtcacgggaattttgggacttcctttgttttccctagccctttttaatttttgttaaaaactttacagtggatcaagagattgtagtgtggggactaccagttctgtctgtgatgtcaaggtttctattaggtttctgacagaaatgaagatattctaaagagacacttgtgccccctccctttggctaacagactattgaaacaatggttcccaaggaaatggaattttctctggagtctcctgctggtgaaagagaaaggctggaaggcagagattttatgcagctctggacgcttgtcagtcttgcagaagagactgaagcttgacagtgctgctgggggatcacatcttgagcagaatcttttagttctacctacctcttgccctctatttaaatgtaaacttcctctggcaggaccctgaagatgagcttggggtgacagtcactggacttcctttatgttcctctt

SEQ ID NO: 8016 - DNA, 471 bp, Mus musculus
aggcatgaacaatgggcttctttttaaacatttatcagtgggtgttaaaatgtgtggcagtcagaggctgagagtactggctgtctcctttactacatgggctctatggacagaatttgggcttcagagcaaatacttttatctcactggcctccaacaacagatttaggtttctgggggtgggaggggggatttaaattatgcttatgagtcttttgcctacatgtttatgtgccatatgcacacctcgtgccagtggaggccagaaggtcattagattctctatgagccaccaagtagatgcttaaattcagatcttctacaagaataaaggagtgttcataggatttctttaaacccaatgtgaaacattttcaaatttaaaatgactatatcatcattttagagtaaaaagctatttttcactctttcctaaaaatcgttttgaacaaccgcctaaaaacaaccatg

SEQ ID NO: 8017 - DNA, 516 bp, Mus musculus
gtacacatatgctatcataccagtatttatgtctcaaattgttcataataaagttttggtttgggggggacggattgtttgttttggtttgggttttcaactaactagtcccggacaagaaggtagtgaatgatggacggagtatttttaagttttcttctgcagagactttttttcatgtcagtgaatcacctggttgagaaacttggagaggttttattttaaaccttcaatgagaaaatagctttctaaaacagtttcccttaggagaagtgagtggtcagtcattggccttgcagctaatggagactcatctgagaaattagaaaactactaattgcttttagtgaaaagacaacctcttctgccagatttgcttttaaagactcctcaaatttcaagctccctccactgtagtcaatggatttttccaacaaagctaaaaaggaaaaataaaaacttctgactgagaggataagttaatagtagagtttttctccatcatgcccttggtta

SEQ ID NO: 8018 - DNA, 446 bp, Mus musculus
tgggtagaagtgtgggtctctccctgcacatgctccatgcaggaagacactagtgcactgatcatgctcagtatgtgacttcactacactcctaagcatgcaccccactcctgggcttattcattttatgttcatggagcacataccctaaaacataaatgacagacaaaagagaagacattaccttttagcagattccagaaggtgccttccttgcagggtggctaagaataccactgaccatggctaagaacaccacaatggacactgagacttgttgccagttcctgggcacagggcacacatggacccgtttgaagtttgaagctgtttcttataggcttcatgttcaagtaatgttgggattctatgtacaattcactcagtgtaagcaggagtcactgatcaaaacactatagcattacatagttccttgtccttttggc

SEQ ID NO: 8019 - DNA, 495 bp, Mus musculus
gcactctttgagtttctctattgggaaaggaaagctgatgtgttaatgtgtgagtgtctgtgaatgatagccatgctctcggcagctttttttgtttgtttagatagggtcttatacttgcacctcaagctgctccggacctcattgtgtagcccaagcaagctgatcttaaactccagatactctatctggctgatgcctcccggcatcagccaccatgcccttgaagcttctctgtactcatgagaggcagcctacagagtgaaactccgtgaatttctgagctgtgctttggacttgggcattgcacttggagggtagagcaggagggctcctcctcacttcagaaactctgggtgtgggtctgaagggcaccaaggggaaaggctctggagagcaaactgcttctgcccaggtgtgcagtttattcaaagggataagtggggctaccgtcatgcttgtgccatcactatgctccaggacaatccagggcgg

SEQ ID NO: 8020 - DNA, 506 bp, Mus musculus
agccaggtgctctgcacatgcgcagtccggaacgctcggcgggccgggcgccttcccgggccgcacgcgcgcgcgcggacgggccggccagcgcatgcgcctgaagcctccatgtgagccctgtggtctaaggcttcttttccccggcgctctgtaaaagggacgtccccatgggaacgcgcgcgtgttgtgtgaacctcgcggtcctctgcggcgctttaggtccttgcaggcaaaaggtcccccttcgggctccctttgggaacgcggaccccgcaggaggcgagtcccgccccccccctggcttccaccttgatgggtggggcgcctcccggactggggttctggttgcgtagtctgaatttcagggctgaccccgctggagtgtgttctgaagccttacagtgggcttactgagagaccttacacggtgggtcttacaaatccgtccagagtgcttggggatttctctttgaccaaaagctatgaccctcaaattgggcgtt

SEQ ID NO: 8021 - DNA, 465 bp, Mus musculus
gcatgtgcgtattgaagcagcttcaaaaagaacttttcattttttttgttatttttcatcatcaatactagaacaaagacatattttatatgcatatttaaagagttgaagtagacgcttacactgcaagaagcttaaattccagacttactcaaaagatgaggagtgttggatgtaagatatgaataccaaagattctggaacagtccaaggccctgctgacattttcttggtaaaggaggaagattgacagtgagcatagctcagttgtgagtgtgtgacactcagtcacacaggatcagctgagcagatacatcagggaggtgacaagacttgtaggattgtcaccacattttaggcatccattacatatcttggatattaactctttcttagatatgaggattgcaaatagcttctccctccccctcgagtttcttgccattctgtagatcattctggttg

SEQ ID NO: 8022 - DNA, 556 bp, Mus musculus
gcatttgcattctcttgatattcttttaaatcccgctacatttgtcattgcctcctctctctctctctctctctctctctctctctcacacacacacacacactatggcttctctgcctactttataaaagtcttagtctgtatcctctggcatttttaaatgaataattatagattgtttatagccatcacagaaaaccctcagaacagagccaatgctgtacggcaaggctgagtatctgataatacttcactaacctacaacaagtagatcaaagagagcttaagaaagactttttctttcaagatttttaattttatgttatgagtatgaatattttgcctgagtaaatgtctgtgcaccgtgtgcatgtaatggccaagaaggccagaagagggcatcggatccccagggactggaattatagacagctgtgaaccaccctatgggtgctggaaatcaaacctgagtcctcaggaaaagcaaccagtgctcttaaacacaaagctatctctccagctgcaaaacgagatgttgtgatctacgtgttctgcc

SEQ ID NO: 8023 - DNA, 399 bp, Mus musculus
gctctcaggacaatcgagtgattatttggacctgccatggtgcctcaggcaatatgtggtcatctaaactcctacacaagttcaatgatgtggtgtggcatgtgagctggcccatcacagtgaacatcctggctatgttaggtggaggcaataaagtgaccctgtggaaagaatctgtggatggacagtgggtgtgcatcagtgatgtcaacaaaggccagggttctgggtcagcctccatcacagaggcccaacagaatgagcagtgacaacataggcagccaggacttcctgttacctattctggaacaacctccaaacaactgggaagaagagtcccagtgctaccaagattccagacccaggagtgcccacacatgcaacactggctgtccagac

SEQ ID NO: 8024 - DNA, 443 bp, Mus musculus
aaggacaatcgtatgcgcgctgcaagatttaattaatattccaggcctccaggcactacatgccagtgttacctcattacaatatacattacagtcatatattgtaataataacaaagattgccccatatttccacctgtcccctgaaggaacaactttgcattaagtggtttacaatctagccgggaaatgcaccctcacggtggaggaccgatcagaggaggctgggagccactgaatgagtaaatgggagatggaggaagaggactcttaactgggccttacaaaatggccacacacagagatcctgactgagaaacggtgagacctcctggagtagagtagttgtagatatccagtgggattggtttccatatgctatttatgactttagctatactaaccacacccccgtacccatccatttatgaatctctgcaaag

SEQ ID NO: 8025 - DNA, 348 bp, Mus musculus
gagcagagcaatgacccaagctggtgtcatgaggctcatggctcagataggcaagactgtagcagaagaatagaactgaatagaattcaaagaaagcacacgtgttgctgctagtcatgaaaacagagattccccgattgcagctatagtggtgcaagagaacaccttacccacaacactcatttttgcccctttgttctaagagattcaaatacatttatgtctcctgtcatctactgcttttctttcttggtgctgtgaggaacatctgataagagtcaacttaagagaagaggggttgatttggacttatactttgaggaaatacggttgatcttggcagggaaa

SEQ ID NO: 8026 - DNA, 485 bp, Mus musculus
agatggacccagagtcgtgagagcaggagagctgtccctgtccctcaccttctgcagcacatgggtgaggggaccttgtaccttgcctgagccatagagtagagatgatcctgatggcatgagaacaggagcggtggctctgctcctttctgtctgtagcactggatgacctagcctgggcagggcaggagagcttgccttggcagtgtgagtgtgggagagctagtgagctccagggctttgaattggctcatcccaacatctaccccattgatgaactgctggagtgcatgcaggggccagtcctacagatccaaaacgacagcatctctatgacacaaggcaacaacgggatatccaaaagacagcccctgaggttcccatattgcaaatgtagcaggagacagaggccttgaaccagaccaatgactcagtgtaatgaacgtttgaaagcaaagaagtgtggtcaaaagtctctactttgg

SEQ ID NO: 8027 - DNA, 409 bp, Mus musculus
gtgaccagtatgtctgcctagtcatccagacagctcatgactacctcgcacagtgacatctgaggctgcacactggtggagctgctggttttcaagaagttaactcctctccatggaatgaagttcttaagcttcctctccctgtactagccaggtgaagacccactcctgcaggacattgtggtgtagcaaagatctgtacagccatcccgtctatgccagccagccctgaaggtggcttgctagcattctagcaccaccagtctttgtccatgtctggcaaggcagttctttcccctcaaaccatcttcccaccatatcattctgttttgtctgcccactgataggagatggggaaccagctctgacactagtttggcatggggaaggtccaattcttcaggtccct

SEQ ID NO: 8028 - DNA, 530 bp, Mus musculus
aaatctcctagtgcttgcgttttcaggtgaatggccttcgcacatgaagtgtcccagagtgcttacacagttaccatctctatctctgtctcatcccttgttattcatgttttcatcctatccttgtgttatctactgttttctggtcaaatttcttgtgggatttttcagaagaaatttgtgaatttggtgcagaatttgattattcctgagaaagtgctagaaggaacactgagagcctgggtttctgcacttgattattcctggcctagtgtttattgtttctaggaaatcaatatttcccttgtcaattctcattcattttctgacattccatggtactcaatcatctgctttttctcattgtcaatctatacttctgaggccggggcgttgaaagagatcattcatatacagcaactgtttatacatatttgtagcaagatatgtagcatcattccatgtcctcctcatgcactttcacacatatggaagtggacgcgatgaatttcaggtagtccatcccagaa

SEQ ID NO: 8029 - DNA, 480 bp, Mus musculus
gtaactgtgtaagcactctgggacacttcatgtgcgaaggccattcacctgaaaacgcaagcactaggagatttagttagcacagattagagtaaaatctaggagctttgtaatatctgcaataccaaagaaaccaggtaatgcaaattctctaccagaatgtttctctgtgaatattctaacaattgtaacatgcatgaaatgagtataatccctaatccatttactgacaacaggaatttctgtaaaacagaaattggatatgcagggaaaaatacattgctgtcataaatttacaatactcaaaacttgatgccctgggcatttgcagacagcatcaaatgtgtaataaaaatgggcataggaatacatgaattttcagggagaaatgaggacatttttcaaagtatgtcacttcatgactcttacttgtgacatacaggctgagtatcgttgtcatttctaccagcaacagagcat

SEQ ID NO: 8030 - DNA, 429 bp, Mus musculus
ggacatgctgggatacactgaggaccaggtagtcccttgtaacatcaaaagcatttcccactcttccacctttgctgctgtggctggcattgctctcagtgacaactttgtgaagctcatttcctggtattacaatgaatatggctaaagcaacatggtggtagacatcatggtctatgtggcatccaaggaataagaagccctggaccacccaacccagaaaggacattgagagaaagagagacgcctttgtctgctaaggagtcccagtcccaactcagcccctgacactgactatttcttgcacagtttctgttccagaatctctccataataggaggagcctagggagccctaatctcttgaataccaccactatgtttattgtgacattatttacagtagccccattgtggagttattgtagat

SEQ ID NO: 8031 - DNA, 551 bp, Mus musculus
gagttctgaatctacgctcgatccttctcagcagtgtgttttacgggaacctttattaaccgctccttccccgtgatgcagttctgaatcctccctgtagcagggggtctttgctcgtgcctgaagatgtttcttgtcccgggttttcgacacttcttgcgcgcgctcgactggccaggaagaacgacgctgcaacaggatccttctgcacacgtttattgggagagctcgattgtagaggcgaaaagaccctgagcccagaactggtgctgcttacataggcctaggagaggcgtgtctcacatctgattggttaacttgtcttggcaaaagaaccttcactgcctatgtatgtgtggtggccagcagtagccaactgccactctgcagctgccactctgcaacggcttcccacaaaaaagaccaggccatgaagctgggatgctgtggctcagagcagagcacatcctcaaatgctagaggccctgggtgattgtcagtacaccattacgtcaagtagggtcttgttgctcctaaggtttcttctaaag

SEQ ID NO: 8032 - DNA, 228 bp, Mus musculus
gaaagattaataccttagctgtgaactgatatcaaatgaagtcctgaaccagatgagatcattgaaagttcaaagattaaaaactgaaacagactcttgttcaagactcatagtctaatgagcaatgttaagcatctatgctcaaaaacctctgtaagaatatcttttttggacttagtgtgttcatccaccatggtggatacagaggtatctcatctaatagggctc

SEQ ID NO: 8033 - DNA, 407 bp, Mus musculus
cagaaaccctgtgcttcctttttgaccctgatttcacacacacgggctgcctcccacggacatcagatttacaaagtctgaggagagatagaaatgtgagtactgatcgctacccacgtgacatcaggcaaggagaaagaggaaatccgttgggagcctgcgataaatgaatctcttaccctgactaaactggagagcaagcatgctggccattccaaacaggctcactagaaatctcatttcacattaacgctcgatttgttttgtcttgctttgttttgtttgttttgggtgtagcttttagtcagctcagaactttgaagggtttctcaggagatcaaagctggaggagttgcgtgcctgggtcccactacagacctatgatgacatccgtcacagaaccagga

SEQ ID NO: 8034 - DNA, 432 bp, Mus musculus
cagtagtctccttccaactggaaagcggagaccccagtcctatgggatagctgcagaacttccaggccaaaggggggatacactttggaggcaacgttctgaaaaagagggccaccgaggctcaagagcgatcactgatccatttgcatccgatgatgtttaagtgagggcatctgtggcaccaacaggtacttcaactatcccaggaccaaaaccttcaaagtaccaccggcgcggtgccagcagtaggagagcagaatcggaagaaacacacttttctcggagaggaacacgaagtcaacactgagccaggatctttggctgcttggcaggcctcgaggcccctccagatgttggctccaagcacagaaggagaaaggacagagtgagacaccagaatagcttcagaggcctacttctgtcatatcatgg

SEQ ID NO: 8035 - DNA, 407 bp, Mus musculus
acgtgcgcaaaagtggccaggacccaccgcctgcccacagggtaccgggacgcgggtacatcttcctggaacctcaccccactgccttcatcaaatcccactgtctcagccccatatttccttgcacactgggacacaaactgccctcttgctgtgggacggaggcatgtggcacaacccactgctgcgaatctaaacatcagacccactgcgagcgggtatcatgctgaaaggtctcgatggacactatcctgggtgggaggagtgatcagaaggccagtgttgctttgggggaggcgtcgggacgcctggcagtttgattaaacgctacctggactgaggtggggcgccggaaggcggtgagaccaacaggcgggcgagatcagttttgaaaagccagccgccgc

SEQ ID NO: 8036 - DNA, 430 bp, Mus musculus
agggcaccgcagagctgcaccgctggtggcttcccgaatcgacggccccgagccagcccatggcggaggtgcggggcctgcggcgcggtggcgtgcagcacgagctgctagagaaggtggcgcgcctgcagcggggcgcgaggcacgcggagcccgaggcggcggcgcgcagaaccgcaggcgacggcggctctggctccggctcgggcttctggtgctggcggcggctgttcgcgcgcggagcccgcggggcgcgccggaggaagggcaagttctcgcggcccggcgccgcggccacgtcggagcgcagcgtgtgggcgcccccgggcctgcagaggctgttgcagaggttggcgacgtggcggcggcgttacctgcggcgaggggagcggcccgagggcctagaggagatcccgctgctcgtgctgga

SEQ ID NO: 8037 - DNA, 264 bp, Mus musculus
aggagcgaggagacttagccgccactgcgccgccgccacacagaattgctggctttgttctagctctctccctctgcccacctagctgctcccataatgctgtgggttttgcatccctaaacccctttggtcctcagtccgggggtccccgtatacccggagactacaggtgtgggtccaccgccctcctgaatcccgcaggtccaggacccgctgactccagctctttccaaaagacgatgtcacacacagcctctctagcag

SEQ ID NO: 8038 - DNA, 258 bp, Mus musculus
cagacagtcctgtggaacgacgagaaggtccccgacgtccagcaacgcccaggaagagccgcagcgaacgagcggcggccatgagcgaccagctgagtccagccccgagccgataggggcagctccagcagcccctgagctctcctcgaaacctcgggtgggcagtgtctgccgtgggtttcctttcctctattgtaacccaaagagtcttagctattagaggcccaaccccaaacgcgttcacgtagggaaactgag

SEQ ID NO: 8039 - DNA, 405 bp, Mus musculus
  misc_feature (88)..(88): n is a, c, g, or t
  misc_feature (308)..(308): n is a, c, g, or t
  misc_feature (334)..(334): n is a, c, g, or t
  misc_feature (345)..(346): n is a, c, g, or t
  misc_feature (358)..(358): n is a, c, g, or t
  misc_feature (371)..(371): n is a, c, g, or t
  misc_feature (378)..(378): n is a, c, g, or t
ttgtttggccccatttcttacagtctcagaaatttaatttagcagtgaactgtacaatgttgtttacccttgcaaaatatatttttgnttttagaaaaggtttaggattttttgttagggtgagaacagtctttctggtttcttttcaatgaaatgctttaaaaaatatcactaataccatgctatttaaagtttttctagattatttgcattttagtcaatgggggttattggttctcttatgtgtaaacactgtaccaagttttgcagattctttcaaatccacatttctgaagttttattttcanaagactgaacattttagaaaggaatntcttttccccnnaacgttttcttnatttgaacaattntgagggnccaattcaaacacacttagaagcgaga

SEQ ID NO: 8040 - DNA, 403 bp, Mus musculus
  misc_feature (251)..(251): n is a, c, g, or t
  misc_feature (262)..(262): n is a, c, g, or t
  misc_feature (266)..(266): n is a, c, g, or t
  misc_feature (275)..(275): n is a, c, g, or t
  misc_feature (282)..(282): n is a, c, g, or t
  misc_feature (288)..(288): n is a, c, g, or t
  misc_feature (294)..(294): n is a, c, g, or t
  misc_feature (298)..(298): n is a, c, g, or t
  misc_feature (302)..(302): n is a, c, g, or t
  misc_feature (304)..(304): n is a, c, g, or t
  misc_feature (315)..(315): n is a, c, g, or t
  misc_feature (320)..(320): n is a, c, g, or t
  misc_feature (323)..(323): n is a, c, g, or t
  misc_feature (331)..(331): n is a, c, g, or t
  misc_feature (341)..(341): n is a, c, g, or t
  misc_feature (343)..(343): n is a, c, g, or t
  misc_feature (347)..(347): n is a, c, g, or t
  misc_feature (353)..(353): n is a, c, g, or t
  misc_feature (360)..(360): n is a, c, g, or t
  misc_feature (362)..(362): n is a, c, g, or t
  misc_feature (378)..(378): n is a, c, g, or t
gcggaagccagatttgttcctgtgtgagcgactggatgtcaaagctgtgttccagtgtgccgtgctggccctcaagttccctgaggcacctactgtcaaggcctcctgtggcttctttactgagctgctgcctcgatgtggggaaatagagtctgtggggaaagtggtacaggaagatggccgtatgctgctcatagcagtgctggaggccatcgggggccaggcctcccgtagcctcatggactgttttnccgacatcctnttcnccctgaacnaacactncttcancctccntgancatntngatcaaggagnctctncanccacctgnttttccatcntncccntctcanccctgancnagaaggacacctttanccagcagatacttcgtgagcgagta

SEQ ID NO: 8041 - DNA, 516 bp, Mus musculus
  misc_feature (252)..(252): n is a, c, g, or t
  misc_feature (275)..(275): n is a, c, g, or t
  misc_feature (277)..(277): n is a, c, g, or t
  misc_feature (287)..(287): n is a, c, g, or t
  misc_feature (316)..(316): n is a, c, g, or t
  misc_feature (322)..(322): n is a, c, g, or t
  misc_feature (328)..(328): n is a, c, g, or t
  misc_feature (352)..(352): n is a, c, g, or t
  misc_feature (372)..(372): n is a, c, g, or t
  misc_feature (418)..(418): n is a, c, g, or t
aatgggcctgattgatgggatgcacacacctctgggggcccagggactctacatacagaccctgcttcccgggagccccgcggcatctgatgggcggctgtcactcggagaccaaatcctggaggtgaatggcagcagcctgaggggtgtcagctacatgagggcagtggatttgatccgacatggaggcaagaagatgcgatttttagttgccaagtctgacatggaaacggccaagaaaatccgcttccncaatcccccttcctaatagaccnanaggacccttntccccaccacctgtttcctgtatcctctncaggtnccaccnacagccaccacggcactcaccctncccctcacaccccagtccanccaatcctggtttttaaagttgactgagtgagtccctatgttgtgncctcacgttgaggacacctttgacagtgtgcatcttagtgtatatttatttatatgacagatgacactaagttgtgacatttcctacagagcttttat

SEQ ID NO: 8042 - DNA, 481 bp, Mus musculus
  misc_feature (145)..(145): n is a, c, g, or t
  misc_feature (175)..(175): n is a, c, g, or t
  misc_feature (185)..(185): n is a, c, g, or t
  misc_feature (194)..(194): n is a, c, g, or t
  misc_feature (206)..(206): n is a, c, g, or t
  misc_feature (217)..(217): n is a, c, g, or t
  misc_feature (269)..(269): n is a, c, g, or t
  misc_feature (275)..(275): n is a, c, g, or t
  misc_feature (288)..(288): n is a, c, g, or t
  misc_feature (293)..(293): n is a, c, g, or t
  misc_feature (301)..(301): n is a, c, g, or t
  misc_feature (326)..(326): n is a, c, g, or t
  misc_feature (328)..(328): n is a, c, g, or t
  misc_feature (350)..(350): n is a, c, g, or t
  misc_feature (365)..(365): n is a, c, g, or t
  misc_feature (386)..(386): n is a, c, g, or t
  misc_feature (393)..(393): n is a, c, g, or t
  misc_feature (405)..(406): n is a, c, g, or t
  misc_feature (408)..(408): n is a, c, g, or t
  misc_feature (434)..(434): n is a, c, g, or t
  misc_feature (452)..(452): n is a, c, g, or t
  misc_feature (454)..(454): n is a, c, g, or t
gtggaacggtacgaccctcgaagcaacaagtgggactatgtggcagctcttaccactcccaggggtggcgtagggatcgcaacagtgatgggcaaaatctttgcagttggcggtcacaatggcaacgcgtacctaaacaccgtgnaggcgtttgaccccgtgctgaacaagtggnagctggtcgnacctgtgtntcactgccgagnctggtgccggntgtggccgtgtgtgactgtttaactagccagatccgagacgtgggtcacggntccacnaatgtggttgacngtatntgatgaantcccagcaacaaggacacaatcccntntgatggacaggaagacagcagnccttttgactgtgantgcagcgactgtttttgaatntcagctnttgtgaatacanntntgtggactgacgggtgagagctgttntcataaagccaggtgagntntttcctgcttcagcaaacagtggagcg

SEQ ID NO: 8043 - DNA, 543 bp, Mus musculus
  misc_feature (322)..(322): n is a, c, g, or t
  misc_feature (330)..(330): n is a, c, g, or t
  misc_feature (332)..(332): n is a, c, g, or t
  misc_feature (341)..(342): n is a, c, g, or t
  misc_feature (372)..(372): n is a, c, g, or t
  misc_feature (422)..(422): n is a, c, g, or t
  misc_feature (434)..(434): n is a, c, g, or t
  misc_feature (457)..(457): n is a, c, g, or t
  misc_feature (464)..(464): n is a, c, g, or t
  misc_feature (466)..(466): n is a, c, g, or t
gggaacagtcttcaagagagccttgatgagctcatacagtctcaacagatcaccccccagcttgcgcttcaagttctacttcagtttgataaagctataaattcagcattggctcagagagtcaggaacagagtcaatttcaggggctctctaaatacatacagattctgcgataatgtttggacttttgtattgaatgatgttgaattcagagaggtgacagaacttattaaagtggataaagtgaaaattgtagcctgtgatggtaaaaatactggctcgaatactacggaatgagtagagaaatgcagctttttttatnccaccttntngttattttnntcgctttttgaagagaaacatggaagaganttttttttatttattctcacggtgcagaaatgacaacactgtgctatatntactacccaggntcccgcagagagaagcatgcgantctgttntngtaatgacctttagtacacagcataaagaaatgtaacttttttttaatgacaaatcaaaagtggttgccttcataag

SEQ ID NO: 8044 - DNA, 334 bp, Mus musculus
  misc_feature (218)..(218): n is a, c, g, or t
  misc_feature (224)..(224): n is a, c, g, or t
  misc_feature (233)..(233): n is a, c, g, or t
  misc_feature (253)..(253): n is a, c, g, or t
  misc_feature (261)..(261): n is a, c, g, or t
  misc_feature (283)..(283): n is a, c, g, or t
  misc_feature (288)..(288): n is a, c, g, or t
  misc_feature (303)..(303): n is a, c, g, or t
  misc_feature (305)..(305): n is a, c, g, or t
  misc_feature (309)..(309): n is a, c, g, or t
ggccccaagccagagactgtgaggtcagctagtagtgacaggatcccatcaggaattttggaaagtccggcatcagaagccaatcccgagggccacaaccactgggcaagttctgagcaggacgctggggtggataaagagggcagcccgggctcaggcagcagccccttccagctcatggcctcctcagaggaagacatcattgacttgaaatagantctatnccctattgnccatccttagttttcttacncaaatttntactgttcaagcagctccaacntccantctcaacacagcgcncncttnggccaggcagcgatccacggaccaa

SEQ ID NO: 8045 - DNA, 455 bp, Mus musculus
  misc_feature (309)..(310): n is a, c, g, or t
  misc_feature (320)..(320): n is a, c, g, or t
  misc_feature (337)..(337): n is a, c, g, or t
  misc_feature (369)..(369): n is a, c, g, or t
  misc_feature (377)..(377): n is a, c, g, or t
  misc_feature (380)..(380): n is a, c, g, or t
  misc_feature (389)..(389): n is a, c, g, or t
actcaatgctttcttgctgccaattaagactgtaggtgtacagggtgactgtcgttcttacagttatgtgtgtggaatctcaagtaaagatgaacctgactgggaatctcttattttccttgccagacttatacctcgaatgtgtcataacattaacagagttgtctatatctttggtccaccagttaaagagcctcctacagatgttactccaacttttttgacaacaggagtgctcagtactttacgccaagctgattttgaggcccataacattctcagggagtctgggtttgctgggaaaatcannccagatgccnagtgattttgacccctntacatttcgatagagatccacttcagaagcanccttcatnccnagaggtctngtggttattcgaacctttattactagtgacttcatgactggtgtacctgcaacacctggcaatgag

SEQ ID NO: 8046 - DNA, 504 bp, Mus musculus
agatttcctttgctacagtttttgttcagtatctactaagttttatagctgtattgggtacagtcctggtttacagaggcttttgtgcattttgaggtcattcatgtgttcaggtatcctgaaaaatatttttcaactatgatttattttgtcattgagctttaggagtttcagtcataaggaggctttgtctccacagtagctcttgtagatcacagcttagagaatgtgtctaaagactgtttcatgagcacatggtttcaacactacacatgaatgaatccaattctctagctctgacgtgctgtagccagtgcctgccgactgaatttattaactagatatttatttagcattcaaagtcatttgtgaatttgttttgtatttataaaatttatacttggaagaatgttctttaattttttaaacattttactatgtttctgttttatttcttgaccagtcttaatgatttaaaaataaaaatgccaccctctctaacag

SEQ ID NO: 8047 - DNA, 406 bp, Mus musculus
  misc_feature (305)..(305): n is a, c, g, or t
  misc_feature (347)..(347): n is a, c, g, or t
  misc_feature (353)..(354): n is a, c, g, or t
tgctccttcaccagttggatgggttgctttaacttctttttggaggagcagcagtgtggctgaatacttagcgccagcgggagggagaacgcttctttagtcctccgtcttggattcttcttcctctaaccctcagcatatctgccagggctcctttccctggatagcagcagcttctttctcagcagtaactgagggtgcatggaaatcgggctctggggaggagcgacaccagagggactgatcctggtaggagcacttggttagctgctgaccatgggtgccaacttgttattatgcccccnttgtaagctgctgagctgggcttcagtttttcccaggccatncacacnnttataatttatttgagagaaactaattgtattttcactgcagtatcttgtac

SEQ ID NO: 8048 - DNA, 286 bp, Mus musculus
  misc_feature (38)..(38): n is a, c, g, or t
gagcagctcaaaactcaaactagtttccaagatttctntagggcagagctggggatgtgactcaatagagtgtttatcgagcatgtgtggatggagccatggttagatccccagcattagattaaaccggccttggtggtacgtgtctgtaatccttgtatttgtgtagaggcaggaggtgcagaagtgtaaggacatgcttggctatatgagcccctgtttcaaggaaccaaaacttaggagttcaaagtcggagttgtcagattgtctctctcaccagtggcca

SEQ ID NO: 8049 - DNA, 283 bp, Mus musculus
agagctgttgtaactggcttcctttggacggttggagccatgtggtcaaactcctctgtaacagtctgaccagtgtcctggatgcagtcaggttgatgcagtcggtgggtccctgggcccaaggacaagaaggggatcttactcaggaaaccctgtttgtctatacccagatgttctgtcatgttctgcatatcatggccatgctccctcaggaggtctgtgaacccctctacgtgctggccttggaaatccttacctgctacgagactctaagcaaaagcaa

SEQ ID NO: 8050 - DNA, 521 bp, Mus musculus
  misc_feature (154)..(154): n is a, c, g, or t
  misc_feature (167)..(167): n is a, c, g, or t
  misc_feature (294)..(294): n is a, c, g, or t
  misc_feature (323)..(323): n is a, c, g, or t
  misc_feature (325)..(328): n is a, c, g, or t
  misc_feature (333)..(333): n is a, c, g, or t
  misc_feature (335)..(335): n is a, c, g, or t
  misc_feature (340)..(340): n is a, c, g, or t
  misc_feature (352)..(352): n is a, c, g, or t
  misc_feature (389)..(389): n is a, c, g, or t
gagaccgaccatacatagcatctaaatattcttggtttagggttcgatattttctctagaaattttcctcagataaatgggagtgtatgaaccaaaacataacactcatcagtcttgggaaattttaaatctgatcagctcaccttaaggacancagtccaattganaaatgcaattagtcaattcgcagataagatttaaggccttcaaaaagtaagggcttgctttgtttcttcaattgacttttgtcaaccattgaggttaatattcacatgaattttttatttgtatganttggatagtttaagaaattattccaactncnnnnccatngnccatnttttaaagggtnatatattttgttttgatataagctatgtacttggacnaaatacattggcatctaaaatttgaggtgtgttatgactgctttttgttttaaaaatgtggttacattcagatttttgaagtgttttatgcttcatatggctaagttgtagtttggcagagttaacagcata

SEQ ID NO: 8051 - DNA, 462 bp, Mus musculus
  misc_feature (89)..(89): n is a, c, g, or t
  misc_feature (297)..(297): n is a, c, g, or t
  misc_feature (302)..(302): n is a, c, g, or t
  misc_feature (316)..(316): n is a, c, g, or t
  misc_feature (318)..(318): n is a, c, g, or t
  misc_feature (375)..(375): n is a, c, g, or t
  misc_feature (385)..(385): n is a, c, g, or t
  misc_feature (406)..(406): n is a, c, g, or t
  misc_feature (424)..(424): n is a, c, g, or t
  misc_feature (430)..(430): n is a, c, g, or t
caagtgacatgcctgtcagtgtcaacagacggcagtgttctgctctctggctcccacgatgaatcagtgaggctgtgggacgtgaagangcaagcagtgcttgcgcacagtcaccctcaaaggcccagtgaccaatgcagccatcattctggccccacccagcatgctgaaccctgaattcaggcccagcctgcccctgccccacttcaacaagcacctgctgggggctgagcatggagatgaagcccagggtgggggcctgcgcctgcagctagggctccacctgcagggcaaagnagccntagctacctggagncntctggagcagctgcaggcagtgttgtccagctacctggagaagaacatgctaggcanccagatgctnccagcacgtgtgtttgatctnggaggatgaggtgcgtancctgcncaagatcaacagggacctgttcgacttctcca

SEQ ID NO: 8052 - DNA, 555 bp, Mus musculus
  misc_feature (67)..(69): n is a, c, g, or t
  misc_feature (349)..(349): n is a, c, g, or t
  misc_feature (355)..(356): n is a, c, g, or t
  misc_feature (372)..(372): n is a, c, g, or t
  misc_feature (384)..(384): n is a, c, g, or t
  misc_feature (467)..(467): n is a, c, g, or t
  misc_feature (469)..(469): n is a, c, g, or t
acgtgatgcgggagtcacttctagaagaccagctcagccctgtcctcacagaaccccacctcctggnnncctggaccgcagactccagatcatcctgaagaccgtggaggactgcatagaggcccacggcgagcgaagagtcatagccgaagggtcagcacaacgttcggctccagactccggccaggctaatctgacgagctaatggcaacaaacgtgggacctcagaacacacaactggagtcagcacctcatgctggtttgtaggcccctgttgccccattccatcctggggcactggaggccaaggcacaagctcagggaggaggcaggaacgctttgaaaaagncaaacnnggatccactgaacctnatctttatcctngggtggaggtcactgcttttacggtgcactggctggggctctctcttcccaacgagctctggctccatcaggactgcagattntnttctgagcacactgtgaaacctggatctggaccaggcttggaaggtttggaagctctgttcccaggagcggtttttattctaccat

SEQ ID NO: 8053 - DNA, 308 bp, Mus musculus
  misc_feature (263)..(263): n is a, c, g, or t
  misc_feature (276)..(281): n is a, c, g, or t
  misc_feature (283)..(283): n is a, c, g, or t
gactttctgactccagagtaccgatgtattctagaagaggcagatcatctacaagaggaatacaaaaagcagcctgcacatcttgaaagactctatggtatgattactgatctttttatagataaatttaagttcaaaggcactaatgtaaaaaccaaagtacccatgctcctggagattctcgacagctacgaccagaacacactgatttctttcttcgatgcagcatgaaagataaacaaggtaggccaacaggacagccngaagaagcaagcnnnnnncntgatcagacccgaggcacctcagat

SEQ ID NO: 8054 - DNA, 513 bp, Mus musculus
  misc_feature (266)..(266): n is a, c, g, or t
  misc_feature (289)..(289): n is a, c, g, or t
  misc_feature (299)..(299): n is a, c, g, or t
  misc_feature (327)..(327): n is a, c, g, or t
  misc_feature (343)..(343): n is a, c, g, or t
  misc_feature (350)..(350): n is a, c, g, or t
  misc_feature (389)..(389): n is a, c, g, or t
  misc_feature (391)..(391): n is a, c, g, or t
  misc_feature (442)..(442): n is a, c, g, or t
  misc_feature (463)..(463): n is a, c, g, or t
aaatagtttgtgactcagtgttaatggaatgttcttttattatgacaccatagaatctttttttacttaattcaattaattgattctttgtaagataatcttgataatacttaacagttgacaaataatttgagactatatttgtgaatttaatatttgatatgtaattccccagattttagatttgggttaacctcactctattaaaagctatgacattatgaaaaatctgaaactgaacaaaaaaatgagtgtagaaaatcccnaaacaattataacttaaagtatntactatagtnttccaaatttatctccagataggactgnacagagttgtgttttncagtttntactaagcaaatattaatatttgtaataagtagaaaacntnttcatcaagaacgagaattatgtaataaagcatacagaatgcatttacaancctgatgaaattagtgtatgntcaaagactacaaattaacattttacccaaagttgtttttgtagaacatg

SEQ ID NO: 8055 - DNA, 431 bp, Mus musculus
  misc_feature (184)..(185): n is a, c, g, or t
  misc_feature (355)..(355): n is a, c, g, or t
gcgcccacagctcgtttgtgtataaggaccagctgtacagctcggcttccgaggccctgcaggcctatattgatgattttgacctgagcagagaacatcctggtgcaaacgctgtcaaagtgaacactgacggtgagattggtaatgggctgcaattttccagctacgtacatatacccgacanngcttttgtcaatcttgatcccaagcagcactttaaccccttatactatagaagagagactgttaatgacatggacgccattagcctgacaactgatgatttgttaagacttccagcggatggatgcttttccttcccttgtgttccacctgatcaccgaccaaacaaganatacagtggaagacaggattcatcagacattaagaatagtccaagtttttatgtagacgctacttccaagagcaag

SEQ ID NO: 8056 - DNA, 548 bp, Mus musculus
  misc_feature (30)..(31): n is a, c, g, or t
  misc_feature (42)..(42): n is a, c, g, or t
  misc_feature (45)..(45): n is a, c, g, or t
  misc_feature (56)..(56): n is a, c, g, or t
  misc_feature (64)..(64): n is a, c, g, or t
  misc_feature (110)..(110): n is a, c, g, or t
  misc_feature (126)..(126): n is a, c, g, or t
  misc_feature (143)..(143): n is a, c, g, or t
  misc_feature (165)..(165): n is a, c, g, or t
  misc_feature (308)..(308): n is a, c, g, or t
  misc_feature (314)..(314): n is a, c, g, or t
  misc_feature (318)..(318): n is a, c, g, or t
  misc_feature (322)..(322): n is a, c, g, or t
  misc_feature (328)..(328): n is a, c, g, or t
  misc_feature (349)..(349): n is a, c, g, or t
  misc_feature (351)..(351): n is a, c, g, or t
  misc_feature (354)..(354): n is a, c, g, or t
  misc_feature (356)..(356): n is a, c, g, or t
  misc_feature (358)..(359): n is a, c, g, or t
  misc_feature (366)..(366): n is a, c, g, or t
  misc_feature (393)..(393): n is a, c, g, or t
  misc_feature (420)..(420): n is a, c, g, or t
  misc_feature (433)..(433): n is a, c, g, or t
  misc_feature (436)..(436): n is a, c, g, or t
  misc_feature (488)..(488): n is a, c, g, or t
  misc_feature (496)..(496): n is a, c, g, or t
  misc_feature (498)..(498): n is a, c, g, or t
tctgttcgctgcacaggagagctctcccannagagcaggaanaanagctttagtgntgctgagnactggtgctgttgctcctggtcacagactttgcagcctctcatganactctcgactcttccnattctcaaatcatgaanaggtcacagttccgaacaccanactgtggtcattttgacttcccagcatgccctaggaacctcaaccctgtgtgcggaacggatatgaacacttacagcaatgaatgtaccctgtgcatgaaaatcagggaggacggtagccatattaatatcatcaaagacganccatgnctgntggncagctngcagaagagcagacggagaantnctntncnnccggtgntccctgctcgaatcccaccccattttnttttccccccatttctttgcatgatanttgttcacagaanttntctgggtagaggctggaagacagtgatgtaaagcggtttataaacttaaaantcttgttntngggcttccggcctacaattcagtttagttcaacttatgacccaggcgact

SEQ ID NO: 8057 - DNA, 352 bp, Mus musculus
gggctttaacagttgctgctagtattttgatagtgttccaccagtatttagtttttacatcattctagtgtatagtttcaggtctcattagacaatcctaattccactacatttctgtttgactccaacattccacttagcttgactagcctaattttaacatgcttgttggaggtcaccaatattacttgtatgatgctgtcaccatgtgacatccataaagattttggtgtataccacattgcattcaaccagctgtgattatgcttagaaatactatagtaactagatgcagtgtgaaccttttccattaacagtaagtcagtggcttcaatgtgattatggtcctgca

SEQ ID NO: 8058 - DNA, 323 bp, Mus musculus
ccatgtggttaagaattcgctccttaacgttgaggctgatcagtggacttccaagtcttacccaccctgtggagcccaagaactcagagaagatgtcagagaacggtgtgtcctcccggatcgacatccttcgtttgctcctccaacagctagaggtggccgtggagacggggaagcggtttattgagaaggaaattcagtaccccttccttgggcctgttcccaccaggatgggcaggttcttcagttctggctgctgtcagtgccaagtccagtccttccatctggtcagcgacatgtatgagcttgacaccagtggctta

SEQ ID NO: 8059 - DNA, 453 bp, Mus musculus
agctttctcttgaatttgagccagtgagaaaagcagtcagaagaatgtgaaggatgtctgcgctgcagcctccagtgctgggtacgcttctctcgtggggaagggccgtgtccaggcatgtggatggcttgaagactactgatgctttcctctgaattgttctttgcactgaaggaggacttggactgacctccgacttacatagtttgttaagagctgtctttagcattctgctggaagaattttgggagcaacagactgggacagagcctgccagctgtggtggtgatctttggcagtgctaaggcaaaggagcggtgaagccactggggacagacaaggtggagacccagcagcagtaaatacctagcaattccaaggacttggtttcatcagttaccaggaagtgggggaaccatggagggagaacgctatattgggttcacagttaca

SEQ ID NO: 8060 - DNA, 136 bp, Mus musculus
  misc_feature (57)..(57): n is a, c, g, or t
tttaaaggacagttagggcttcaagaatgattttgtatgcaatgttgttttaaattntgactaattattagaactgtagtagtcttccttatatgaatacttgaaactccgttagttgatcttcaagaccacagag

SEQ ID NO: 8061 - DNA, 495 bp, Mus musculus
  misc_feature (54)..(54): n is a, c, g, or t
  misc_feature (139)..(139): n is a, c, g, or t
  misc_feature (145)..(145): n is a, c, g, or t
  misc_feature (148)..(148): n is a, c, g, or t
  misc_feature (349)..(350): n is a, c, g, or t
  misc_feature (353)..(353): n is a, c, g, or t
  misc_feature (377)..(377): n is a, c, g, or t
  misc_feature (383)..(383): n is a, c, g, or t
  misc_feature (397)..(397): n is a, c, g, or t
  misc_feature (423)..(423): n is a, c, g, or t
  misc_feature (455)..(455): n is a, c, g, or t
aaaggacagttagggcttcaagaatgattttgtatgcaatgttgttttaaattntgactaattattagaactgtagtagtcttccttatatgaatacttgaaactccgttagttgatcttcaagaccacagagagactnggctgnttngttcctttccacctctgctgtttttaagagtagggcctgttcttttggagtagtatctgagaatgtcatgggttccctcctgaatgcaggggataagaaaacatgccatacattttatattaaccagtatagtaaaaaaaataaaataaataaataaagctcacacacaaaaactaagttgcctttccttgaatgaatccnnccntgaaaaatgaaagaaaaataaaanataaanctaatggtatatantcttaatttgtaatgaatgagaatcnaaataatacacactgtggatatgtttttaagnccttatgtaattttaattgttctgcttgttctgtggttat

SEQ ID NO: 8062 - DNA, 483 bp, Mus musculus
  misc_feature (122)..(123): n is a, c, g, or t
  misc_feature (421)..(421): n is a, c, g, or t
  misc_feature (423)..(423): n is a, c, g, or t
  misc_feature (427)..(427): n is a, c, g, or t
gtctcagtctgtgtaaataaccagtgtagtggccctttgatttgttgttggtgttctttttgtttccggtctctgtgtgacccaccagtggcaggggttccagctccacctttttttttttnngcttgcagttgtccatctgtaggcttgtcagacaaagtacaagatgcccagttagagttgaatttcaggcacttttctagctcaagtatatttcatatttgacatatctgtgcaatttttaaaacgttcattaacttatctgaaattcagattttgactgaatatcctagatttttgttttctatgtagttttttaaacctgatagtcctagcaattgatcacaaaaggaggctcacagcatgtaaattctctggtctttatagcgttcacctggaatggacgacccttttttttttncntttnccttctacttatttctaaaagagggcatcaaggaacttaaccagcctacatggtgg

SEQ ID NO: 8063 - DNA, 490 bp, Mus musculus
ggattagactctggccaagggatcttccttctcagcaagcagacttgccttagaactgtctcacagcagaatgtagttgcattatattagatctgaaaccttatttattccagttggtaaaggtatttgcagaaagtgtttgctgtgtcaaggggcctttcctgacagtgctgtcagaaatggtcaaccctgacaagatgaaaaggtcactttgtccttgctgtggttaaaagaacatgccctgactactttcaaatgttatttcaaggtgaatatattatacctgtcttactttgcttctctcttgatttaccacagtttgtccagttatgttttcatgaattatcaggagtaaatttgaacaaaaacatgtgaataatctcctgtaaatgtgttttataacaagagtgtgctaaactattttctaaaaattacttgtgcattttgggaatctttctgtagctttgtgttttgtatgctctggattcat

SEQ ID NO: 8064 - DNA, 130 bp, Mus musculus
  misc_feature (46)..(46): n is a, c, g, or t
ccctctacagtgtcatgaagctcagggttagaatggcgcacctganatgcctgctgccttctttctagaaacatctctggcctatgggccagccccaaaccaaaggcaactgggcctgggttcgggcacc

SEQ ID NO: 8065 - DNA, 152 bp, Mus musculus
gacaaaggtggtaactagaccaattcaaactaaagaattaactctttgattctcagaattttaggaaacaagcaagactgaattagaacaaatgaaatttccctaactcatgcatttctgaattacagtctagtgtatccaaaactatttcc

SEQ ID NO: 8066 - DNA, 140 bp, Mus musculus
aactatttccatcattagcctcaccaactctgatgacaaaagccaagtgcaatttccttcaccatgaatgttcttcttgggaaaggaaatacggtgatggttaatgaaccggcttacccagtgctgaagtatccttttaa

SEQ ID NO: 8067 - DNA, 528 bp, Mus musculus
aagagacaaattctctcctgagttcatcataatatgggtttgtgtgtttggggactggccacaattttaaagatctaattatgcgtataaaaatgggaattattggaatttcacaataacagatttaaacagtcttaaattgtgtatctcctttattgtaatgtattgaaaattttagagaaaccttagttaacattttattaagtgccaatgtcagaatataacagattatagtttcttatgggtgacaggcctgcagttcttattttggaatgtttgatgaaggaaaacctctcctactggtcacttgtatatgtaagtcaagctgtgaaaataaggtggattacagacgatgtggaagaatgttttagcctgtagactcagtcattttctgtcagttacttaaccttctcatccagatgtgaattagacacagaccatcataaagtcaaagtcttgggttaggtattaggtgccagggaaacattttaaaataatttactgactaaatctatgtatgtgccgttt

SEQ ID NO: 8068 - DNA, 470 bp, Mus musculus
  misc_feature (74)..(74): n is a, c, g, or t
  misc_feature (78)..(78): n is a, c, g, or t
  misc_feature (109)..(109): n is a, c, g, or t
  misc_feature (216)..(216): n is a, c, g, or t
  misc_feature (230)..(230): n is a, c, g, or t
  misc_feature (239)..(239): n is a, c, g, or t
  misc_feature (251)..(251): n is a, c, g, or t
  misc_feature (259)..(259): n is a, c, g, or t
  misc_feature (274)..(274): n is a, c, g, or t
gatgacacacaacttcatgcggcggaaagtgacgaattttaagcttgtggaagtcagactctgagctttgctangtgntgacatgtccctgtccctccatacactgagntctcaactcttgagccgccattgccgtcattcgtcacctagaccatgagtgtgccactttcattggaccctgactgtacacagaatggaaggcagtgcgatacttanctgctaacaagacnggctctttnaccagtatgaangacaattngggggaggggtgagnaacttttcttttttctttaatctcttcagttggaaatctatcatggaaggaagagttatgttttatcttgaaggaaccattagatacggaaatggtgatgaaccagaatttcttggtcatttttccaaaattgttttttatttggttctattcctgataaacagagtaactggccttcatttctaggtcttcgaga

SEQ ID NO: 8069 - DNA, 554 bp, Mus musculus
  misc_feature (26)..(27): n is a, c, g, or t
  misc_feature (30)..(31): n is a, c, g, or t
  misc_feature (33)..(33): n is a, c, g, or t
  misc_feature (35)..(37): n is a, c, g, or t
  misc_feature (39)..(39): n is a, c, g, or t
  misc_feature (41)..(41): n is a, c, g, or t
  misc_feature (45)..(45): n is a, c, g, or t
  misc_feature (48)..(48): n is a, c, g, or t
  misc_feature (52)..(53): n is a, c, g, or t
  misc_feature (67)..(67): n is a, c, g, or t
  misc_feature (73)..(73): n is a, c, g, or t
  misc_feature (75)..(75): n is a, c, g, or t
  misc_feature (80)..(80): n is a, c, g, or t
  misc_feature (84)..(84): n is a, c, g, or t
  misc_feature (88)..(88): n is a, c, g, or t
  misc_feature (110)..(110): n is a, c, g, or t
  misc_feature (120)..(120): n is a, c, g, or t
  misc_feature (139)..(139): n is a, c, g, or t
  misc_feature (167)..(167): n is a, c, g, or t
  misc_feature (173)..(174): n is a, c, g, or t
  misc_feature (176)..(176): n is a, c, g, or t
  misc_feature (178)..(178): n is a, c, g, or t
  misc_feature (186)..(186): n is a, c, g, or t
  misc_feature (219)..(219): n is a, c, g, or t
  misc_feature (253)..(253): n is a, c, g, or t
  misc_feature (267)..(267): n is a, c, g, or t
  misc_feature (272)..(272): n is a, c, g, or t
  misc_feature (277)..(277): n is a, c, g, or t
  misc_feature (290)..(290): n is a, c, g, or t
  misc_feature (297)..(297): n is a, c, g, or t
  misc_feature (299)..(299): n is a, c, g, or t
  misc_feature (302)..(302): n is a, c, g, or t
  misc_feature (304)..(304): n is a, c, g, or t
  misc_feature (311)..(311): n is a, c, g, or t
  misc_feature (322)..(322): n is a, c, g, or t
  misc_feature (329)..(329): n is a, c, g, or t
  misc_feature (332)..(332): n is a, c, g, or t
  misc_feature (354)..(354): n is a, c, g, or t
  misc_feature (361)..(361): n is a, c, g, or t
  misc_feature (374)..(374): n is a, c, g, or t
  misc_feature (391)..(391): n is a, c, g, or t
  misc_feature (406)..(406): n is a, c, g, or t
  misc_feature (408)..(408): n is a, c, g, or t
  misc_feature (429)..(430): n is a, c, g, or t
gtctaagggtcagaggagcttgaatnnttnngngnnnantntttnagnatannatgtgtttggacangtaacntnaatangaanaaanttgatcaaagaagccagacagnaaggaaggantcagtctttctctctctanatgtagataacttatatttttaaaaagnttattnntntntgggaganagatatatgtgtgtgtgtatatatatgtatgtntgtgtataaaatttttagaaaggagatattttanagcaatgatgtatntctcntgttnagtgttttgtgantaatcantnatngnatagttngggggtatttnatttttnaanttgctagacttactttgtaaantcattgnaaggtttttctanttctagtttaaaagatncatatctcaaatgtntnagagaaaatccattgaaaacnnaaatctttaattgataaaagcacatgtgttccaactgaatttattttggataacctctaattaattgtatttgtgtttatatctattactgtttaagtagatatctcatggtcatattttttat

SEQ ID NO: 8070 - DNA, 526 bp, Mus musculus
  misc_feature (265)..(265): n is a, c, g, or t
  misc_feature (297)..(297): n is a, c, g, or t
  misc_feature (428)..(428): n is a, c, g, or t
  misc_feature (438)..(438): n is a, c, g, or t
  misc_feature (445)..(445): n is a, c, g, or t
gtgacattttgttagccagcctgactgtaattctaggctctaacagtgccaaaaatcctacatagttactgacaagtgtgtgatctctttgcagtcacaccacctgctgcctgaaaagcagactcttccaagtaatggcagaggcagaaagcggccatgcatgccatgtgtggccactgtccctacttcctcccgtccctttcacaacttgctctgttcagccttaatatttcaaaggcctacagtataataggagctgagcgtntggatcaagtgtatctcttctttcatcctttnggaagaatggaagtttcagcacaaccccgacatgtatataagctgaaggcaggaaaatgtggcctgacacttcacatccgtgcttgacttaattgaacgacagggaaacacagggctgcatctgtgttttnccctcgaccntcttatntcttaagtggagctatgaaatgtcaccctgatactcaggaattctcattgagagaaggtgtgggatacttttgttctaact

SEQ ID NO: 8071 - DNA, 550 bp, Mus musculus
  misc_feature (321)..(321): n is a, c, g, or t
  misc_feature (361)..(361): n is a, c, g, or t
  misc_feature (396)..(396): n is a, c, g, or t
gaagctgatcaacaaccgtgccaaactgctgtccctctgttcctatatcatcgagacctgcctgtttattctttggcgccatctggagtattatttgttacattgcacgccaatggattcccaagattcattgtttgcctctaggactttatttaaaagcagaagactacaagaacccaatctggacttcagaagtggactatctcaagtgaaccagcacgatatagaccagcttcagtctgatgctgtcaacgctttcggagagtcgctgcaaaagaaacttcttgacattgaagggttgtactcaaaagttcgatcccngctatagtttcatccaggctctcatcagacgtatccgtgncctgctgaggctgtccaggaactgagaactgactntcttccgtggaagagatgaactgaggagaaccacctcttttttatagatgactttatttctaaattatgaccaaaagatattttgctatttctttctttatatatggacatcttttctgtaaacctctctcatttctccctcacttgtgaacaa

SEQ ID NO: 8072 - DNA, 522 bp, Mus musculus
  misc_feature (76)..(76): n is a, c, g, or t
  misc_feature (125)..(125): n is a, c, g, or t
  misc_feature (330)..(330): n is a, c, g, or t
  misc_feature (341)..(342): n is a, c, g, or t
  misc_feature (395)..(395): n is a, c, g, or t
  misc_feature (435)..(435): n is a, c, g, or t
aagtgccaagcctcgatcaggtgcaggctgccctgacagagcgggatttatatatctacgcagggcacggagccgntgcccgcttccttgatgggcaggctgtcctgcggctgagctgccgggcnggtggccctgctgttcggctgcagcagtgcagcccttgccgtgcatggaaacctggagggagctggtatcgtgctcaagtacatcatggctggctgccccttgtttctaggtaatctctgggatgtgactgaccgtgacattgaccgttacacagaggctttgctgcagggctggctgggagcaggcccaggggctccctttctntactatgccannccaagcccgccaggcccctcgactcaagtacctcattggtgctgcacctgtancctacggcctacctatctctctgcagacaccctgaagctntcttgtctatggtagaagctgtgtgactacctccaaacttggttttgattatttagaatttttaaagtgattttccctggtgttttg

SEQ ID NO: 8073 - DNA, 557 bp, Mus musculus
  misc_feature (86)..(86): n is a, c, g, or t
gtgtagttcagttacctcttatttgactttagatggatttaatacatttggtaggggctggggggtttgttttgtttttgttttantcccttagcctcgtgtgtataaactctcatttccaacagttctgaacacatttatacagtggtccaggaaagatgctgtttttcagaagtttttaaatttgatacatttcctctttttactacctgggtttgtttaaactgttcttttataagaaatgttttgacttacagatcattttatattctttttctacctgactttcaaccattgaaaatgtgtagttctttcaaatggagtgaagatttatttaagttaatcctaagggtacacgtcgtgtttagaaatgtgagaaggcgtagatgagcagatcagttttgtttaaagagcaaactaacaacctagttttcagaacttgtgcactcctgttcctctctgcatcattgtttgtctgaatgggatgtaaaagggacagcacacacagtagccttccgtacgtgtgaattatgttatgcttttgtatgaccttgtta

SEQ ID NO: 8074 - DNA, 285 bp, Mus musculus
  misc_feature (118)..(118): n is a, c, g, or t
  misc_feature (171)..(171): n is a, c, g, or t
aggctgcctgtctggaaatgacaaagtcagcttgtgtggtagcctcagtagcaacaccttgggttgatttcaatggcttagaaagggtcagcccacagggacccagatgctcctatantggccacaatgtgatatcatgtgacagggctattcagttggggtacggttggnccattcacagagcctggggatccaacctcgctgatcactaggaagagataaactaaggcataaagcaactccttggggtttgggtgggatgggagttcagtctcctgaaacctc

SEQ ID NO: 8075 - DNA, 446 bp, Mus musculus
  misc_feature (104)..(105): n is a, c, g, or t
  misc_feature (274)..(277): n is a, c, g, or t
  misc_feature (280)..(281): n is a, c, g, or t
  misc_feature (283)..(284): n is a, c, g, or t
  misc_feature (286)..(288): n is a, c, g, or t
  misc_feature (294)..(294): n is a, c, g, or t
  misc_feature (299)..(299): n is a, c, g, or t
  misc_feature (307)..(307): n is a, c, g, or t
  misc_feature (321)..(321): n is a, c, g, or t
  misc_feature (323)..(323): n is a, c, g, or t
  misc_feature (343)..(343): n is a, c, g, or t
  misc_feature (384)..(384): n is a, c, g, or t
tctctcgtgggcaaaggcggcatcgatgatccatcctaaggaggtgccccctgaagccatcctgctggctgtctaccttgagctgcagaatggtaatacacagnntggccttgcagatgatcaagcggaaccagctgctccccgcagtaaaggcgcactctgatgtgaggaagaagacagtgttccagcccgtgcaccccatccagcccatccaaatgccagcgttcaccaccgtgcagaggaagtgagagcttgcctcgggaggccaggggannnnatnntnngnnnggaagnacggnaagtagtngctggagaggagantnggagagaaacactgggcctntccctgtgatgcacttctgccagcaaggccacgcctcccantccctgaagtgtcactccctgaagatgaagcattcaaatatgagtcgatgagagccattctt

SEQ ID NO: 8076 - DNA, 454 bp, Mus musculus
  misc_feature (90)..(90): n is a, c, g, or t
  misc_feature (94)..(94): n is a, c, g, or t
  misc_feature (98)..(98): n is a, c, g, or t
  misc_feature (158)..(158): n is a, c, g, or t
  misc_feature (189)..(189): n is a, c, g, or t
  misc_feature (196)..(197): n is a, c, g, or t
  misc_feature (208)..(208): n is a, c, g, or t
  misc_feature (213)..(214): n is a, c, g, or t
  misc_feature (221)..(221): n is a, c, g, or t
  misc_feature (228)..(228): n is a, c, g, or t
  misc_feature (231)..(231): n is a, c, g, or t
  misc_feature (284)..(284): n is a, c, g, or t
  misc_feature (293)..(293): n is a, c, g, or t
  misc_feature (296)..(296): n is a, c, g, or t
  misc_feature (310)..(310): n is a, c, g, or t
  misc_feature (323)..(323): n is a, c, g, or t
  misc_feature (405)..(405): n is a, c, g, or t
  misc_feature (425)..(425): n is a, c, g, or t
atggatgatccagaattcagaatagaagttggtgcaaaagaaggccctacttgctccacatctacctacagttgaccaaaaaagttaggnccancaanttaatagttagctttgctctttctagtgtgagaaactgcgggctggatcagtagttcagncagctacacaggcataaaaacagtcattgtncatgttnnaaacctttcantgatnnaacccantttctanttnttcattgtgacagtattactaaacaggtgaggaagggatattttgttacaccntgtatagtngantgtattgtaccgtntctgtgaaaaccntgctttaaattatattttcatatgttttgttggggacagagcacattaagtttgaaagcaacagaactatcagaattgaagncaatttactcaaactttctntcaagaaaagctgcttaataaatgtacat

SEQ ID NO: 8077 - DNA, 467 bp, Mus musculus
agctgggatattttgccacttttaaaatgactttagaaaaggtcctaggaaacttaagattagtgatgtgtgtgggtttatgtgtagaaattcaaggtacattctcatagtctgaatataagtaaaaggcacaaaggctacagcaggattcaaagatctaacaaatgccaatcccactttaactatgtttctgcatttgaatgtacacagcacttttcctatatagttctatacaaagaaaacagaactaggtataactgtgttgtaggattgaagaaatcattatttatgtctgtctttgtttcttgttatcctacaaagttgatgtgtaaacatcaagttgatttcattggtgcatgaggaaaagtggatgtgatctgtgaggaaccagagtcccatgggaagagtttaagatggcattcaatattcagtgctcaggtatgtagtaagtactgtagtcctatggg

SEQ ID NO: 8078 - DNA, 330 bp, Mus musculus
  misc_feature (282)..(282): n is a, c, g, or t
tgtaagtgtgcattggccatctccttcagtgctaggatgtgaatggctatctggctcaaccagagggcactcttgcgaccttctgagccttctcctcctctacctggttgggtggagcaaaaggatagtcacttttctgaggtctcccggaaatgaatgtatttctcccccaaaagagctgatatttaatgttttactagggatttttgagaaacaaataaccttatttataatctgggcgatccaatcatttttttactcccttttgatgccatacctagnaggaaaggcaagctttttggcgtgagacttttgcaacccacaatggga

SEQ ID NO: 8079 - DNA, 519 bp, Mus musculus
  misc_feature (331)..(331): n is a, c, g, or t
  misc_feature (355)..(355): n is a, c, g, or t
  misc_feature (418)..(418): n is a, c, g, or t
  misc_feature (442)..(442): n is a, c, g, or t
  misc_feature (455)..(455): n is a, c, g, or t
gcttttccttccttaatcgatacctcagcatccgtggaccttgccaggaatctttctacaatttgggccgtggccttcatcagctggggctgacacaccttgcaatccactattaccagaaggctctggcactccctccacttgtggtcgagggtatagaagttgaccagttagatttacgaagagatattgcctacaacatgtctctcatttatcagagcagtgggaacactgcaatggctcaaaagcttttgtatacctactgtgtcatataagcagtgtaatttataagacgatgtatggaccagtatcttctaacgggacctcattnttcttgatgataaaaatggtactntcatcactgcttgctaccattacaactgctttgaagcaggggatgtagctcagctgtagactncctgcttgcttcatatgtacaagnccccagattcaancctttggaaaattgaaacacagcttttactctggaatatatgcaaagttgctattcctatgaga

SEQ ID NO: 8080 - DNA, 437 bp, Mus musculus
  misc_feature (330)..(330): n is a, c, g, or t
  misc_feature (394)..(394): n is a, c, g, or t
atgaaggagtccttgctcttgcactcaattgtcatctgctaaagatcattgatttgggtggctgcttaggtattactgatgtgtccttacatgcattaggaaaaaactgcccatttctgcagtgtgttgacatttcaactacgcaggtatctgacaatggtgtggttgcacttgttagtggaccatgtgccaaacaattagaggagattaacatgagatactgtataaatctaactgataaggctgtagaagctgctctgactgcatgtcctcggatatgtatacttcttttccatggctgccccctgataacagatcgttcacaagaantcttggagcaattaataggatcaagaaaactaaagcaagtgacttggtctgtttattgatcttnaccgaggctgatctcaaaaccttgcacaggatttgcgctataa

SEQ ID NO: 8081 - DNA, 372 bp, Mus musculus
  misc_feature (26)..(28): n is a, c, g, or t
  misc_feature (30)..(38): n is a, c, g, or t
  misc_feature (218)..(219): n is a, c, g, or t
  misc_feature (221)..(222): n is a, c, g, or t
  misc_feature (224)..(226): n is a, c, g, or t
  misc_feature (228)..(228): n is a, c, g, or t
  misc_feature (230)..(236): n is a, c, g, or t
  misc_feature (238)..(241): n is a, c, g, or t
  misc_feature (245)..(245): n is a, c, g, or t
  misc_feature (257)..(257): n is a, c, g, or t
  misc_feature (270)..(270): n is a, c, g, or t
  misc_feature (274)..(275): n is a, c, g, or t
  misc_feature (277)..(277): n is a, c, g, or t
  misc_feature (279)..(279): n is a, c, g, or t
  misc_feature (281)..(281): n is a, c, g, or t
  misc_feature (286)..(286): n is a, c, g, or t
  misc_feature (288)..(288): n is a, c, g, or t
  misc_feature (296)..(296): n is a, c, g, or t
  misc_feature (298)..(298): n is a, c, g, or t
  misc_feature (305)..(305): n is a, c, g, or t
  misc_feature (323)..(323): n is a, c, g, or t
  misc_feature (327)..(327): n is a, c, g, or t
  misc_feature (335)..(335): n is a, c, g, or t
gggccccacaggtacctagatgctcnnntnnnnnnnnnagcccaggaaatgcttccaaacaaaagggaagcaagagagacacacaccccgaccctcacctgctgtgagctgctgcctgatatagaatggatcaggtccagggtaaggaggtgactcttcttgcagggtcccagatctgtcagctcactgcagtggcatgtgaaaggggggcagtgctnntnntnnnantnnnnnnntnnnnatancatccacactanccaccagatgtgncctnntnananaggtntntccttaancnaaatgtnccccgaagtgattccaancctnatcgagtntggggaaagtggattctgatggtgacgaatcggatcc

SEQ ID NO: 8082 - DNA, 250 bp, Mus musculus
taggcaagctgatgcggtgccgaccgggtgaccatggcggtgtttcacgacgaggtggagatcgaggactttcaatatgacgaggactcggagacatatttctacccttgcccctgtggggataactttgccatcaccaaggaagatttggaaaatggagaagatgtggccacgtgtcctagctgctcactcattataaaagtgatttatgacaaagatcagttcatgtgtggagaaacagtcccagcac

SEQ ID NO: 8083 - DNA, 542 bp, Mus musculus
ataaagacagcatccgcagtggcggaccagttgtggtgctagtgcaactggagcgagaggaggaagtcacgggcccagttattgcacctctcttcccacagaaacgtgaagagggctggtgggttgtgattggagacgccaagtccaacagcctcatctccatcaagaggctgaccctgcagcagaaagccaaggtgaagctagactttgtggccccagccacaggtggccacaactataccctgtacttcatgagtgacgcatacatgggctgtgaccaggagtataagttcagtgtggatgtgaaagaagctgagacagacagtgattcagattgagtctgaggcactgaacctgaaaacaggaatgtggactaggtctgtcaggctgaggtctggccattcaggccgctgctgtccccagtccacatccagttactgtcccactttggaccttagttcaaggtctgggtcttgtattttcaagtgtcatgtcaagcatgaactgtacaatatttggaggcatggttttctagttccttg

SEQ ID NO: 8084 - DNA, 445 bp, Mus musculus
  misc_feature (164)..(164): n is a, c, g, or t
  misc_feature (307)..(307): n is a, c, g, or t
gtggtctcaaagctctccagaagatagacgattttgccaccagggttaagtggtggtggagaggatctgctgggtgcacagaagccagaggcaataggatacttgagtaccggcggtgggggttaaactgagcatgcgcggtcctgcccctccgcagctccaantgtcaccctagcacccagtcatggagcctactcaatgtgcagctctgtcaacagccctaagccgcctcacccgagaggtaccttccagaggggaggcagatgtcctcattgtcacctgtgcctttcctggctcactcatatcnggctgtgtttccaggagtgcccggcaaccaagaaccagcctccagaagccaagacccaacctgagcctccttcagcttccccttcgcttccagggaaagatcacgggaaggccatgggcagaacatcagtggctcctt

SEQ ID NO: 8085 - DNA, 429 bp, Mus musculus
  misc_feature (264)..(266): n is a, c, g, or t
  misc_feature (287)..(287): n is a, c, g, or t
  misc_feature (302)..(302): n is a, c, g, or t
  misc_feature (331)..(331): n is a, c, g, or t
  misc_feature (386)..(386): n is a, c, g, or t
  misc_feature (391)..(391): n is a, c, g, or t
ggaaaccagatttaagtgttttcagtaaaatgtaaacaaagtttttatttgttagggatgactcatggaaatagtattggtttggtctgcatgtctaacgatgtgtgtgtattggtagctatgtcacttttgcaagtacacaggcaagccaaattttaggtgacaaaagtccataaataatgggaatttttgttgtcttttattaagttgaagttgataaccattaattgctaaaccatatatttatgctctgttttggtttannnatgtaataatacctcattttnaaagtaaaaactacnactgttacattttattttaatcagctagnaaattcatgtagctttttaaatatacaacctattaatgatttcttgagtttttcnatctnccatagtaaattaaagcattgcacagtatttattagta

SEQ ID NO: 8086 - DNA, 414 bp, Mus musculus
  misc_feature (327)..(327): n is a, c, g, or t
  misc_feature (371)..(371): n is a, c, g, or t
  misc_feature (381)..(381): n is a, c, g, or t
  misc_feature (386)..(386): n is a, c, g, or t
aaagtccttatgagtttcaccgataacttcagtctgcagtgaatcagatgtgtctgcttcacagccagcaggcaggaagctatgtgaaggaatcttctgatgtcataattctgggtgtcactggaacatttgatcaacattcctttggcaagtctagccttctatggaaagtcagtagacgcaattgatttattcacctctacaggaatcagacttggcctattttggatttcagtgaattatgccttttcggtttgggacccagccaaggaggtttccagtggaaggaggagactcttcaattgagctagaatcaggcctgagctntagtgcttcctgtaccgggaaagagacgtcacccaataggcaantccgaagatnccctngaagtcactgcctgacaataactgatgt

SEQ ID NO: 8087 - DNA, 368 bp, Mus musculus
  misc_feature (66)..(66): n is a, c, g, or t
  misc_feature (241)..(241): n is a, c, g, or t
  misc_feature (264)..(264): n is a, c, g, or t
  misc_feature (280)..(280): n is a, c, g, or t
  misc_feature (282)..(282): n is a, c, g, or t
  misc_feature (291)..(291): n is a, c, g, or t
  misc_feature (294)..(294): n is a, c, g, or t
tcagtggtagcatgcgttccaagcctgcgcaggtcctgggtccactgtcagtactggaaaaaaaangataatccatacatcacagtgcaaccaagagacagtttgattcttttcacataagatttacaggtgtgaactaatttttttgtagttcctgtctgttcatttaccatttatataacttatagtttgtggcaaattaccacagaactagttctctcttgccaaggttaccagttgngttagagaccccttgggaggtanctggggatggcagagngntaggagggnctnccttgaagcagagaacagacatgacctgggttcagggaggctcagcagcggcttaggacatgagctctgtttct

SEQ ID NO: 8088 - DNA, 540 bp, Mus musculus
  misc_feature (63)..(63): n is a, c, g, or t
  misc_feature (312)..(312): n is a, c, g, or t
  misc_feature (357)..(357): n is a, c, g, or t
  misc_feature (386)..(386): n is a, c, g, or t
gaagaaaccagctatagtcacacctacctgaaagtagaaattcaaagtcactgtccttgactnacatatgcagtccaaggccacgctgggctacacttctccaggcatgaaggtccgtgtttgtatcaaggggcaggaaaggagagtccaaggtcaaggccagccgaggctgcatagtgagttgaggctcttcagcaaaagaaaagcaaactaataggagtcgttgaaggtagccaccggccatttctctaaatatcattctgctgaaaagggggcttagtttagtttagaatgcattaatgtatgtagaanctgggctatttcagattatttgaaattgtagctattgttaattancacttaataactaactagcattatggtantctaaactattagagtttactacaaagaggttttgattgaattatattaaacatataatatggattttaaaaatttaagatgtttaagaaagctatataaagattaaacatttttgtggctgtatatttgtgtatataccttggttgttcttta

SEQ ID NO: 8089 - DNA, 83 bp, Mus musculus
acactgcagtatctcaacctcatcaattactacaagggccagtatatcctaactctgtcagaagacatcgtggatgggcatga

SEQ ID NO: 8090 - DNA, 449 bp, Mus musculus
  misc_feature (273)..(273): n is a, c, g, or t
tcaagcggctccttcggattgactccaagtgtctgcacttcactcccaaagactggagcaagagaggaaagtggtgacacacactacccattgccataccacgagagctggccgaaccatggctagcaccctgtcttgtcccatttgagcttcgaagaggcacgcaaagtgagacaggccgaagaacagacccaagaggagaagaggcctaggaggggcccactagtggccagtgccaaggcaagctcaggtctaggccaactccgaggatanctggcttactggcccaggtccgctctgaacacgtggaccaaagggatccaggcagctgtgtacattaagatgggtggggagcattctgtacaggaccggtgattgtaaaaatttcttttataaaggaggagctggagggtggggtgggcgctggttgcaaagttctggcccctctt

SEQ ID NO: 8091 - DNA, 316 bp, Mus musculus
  misc_feature (237)..(237): n is a, c, g, or t
  misc_feature (239)..(240): n is a, c, g, or t
  misc_feature (264)..(264): n is a, c, g, or t
  misc_feature (273)..(273): n is a, c, g, or t
  misc_feature (286)..(286): n is a, c, g, or t
  misc_feature (291)..(291): n is a, c, g, or t
gacttacttctagcttgatcttattttgaagcaatagataccattacaaaggttgtatatctgaacctgaaattcttaaaagattttttttagttgcacagaagaaaagcccctaatcaccttctctagaagtctatagtggctggccattgtgcttctttgaacacacagaacagtgactaggagggcccattggagtgccaggcagagtgagccactcagcgagtgggaggtccncnnctgagtatctcatctgagcaggantgagatccntgagggacacaanccccngatgacagtgtaattcaggtcactt

SEQ ID NO: 8092 - DNA, 438 bp, Mus musculus
  misc_feature (265)..(265): n is a, c, g, or t
  misc_feature (342)..(342): n is a, c, g, or t
  misc_feature (393)..(393): n is a, c, g, or t
  misc_feature (403)..(403): n is a, c, g, or t
  misc_feature (413)..(413): n is a, c, g, or t
acttgaggactttgggctcttctgaggaccaacgatgctgcgtggcctttgaaggctcttaggtcccggtggcaaggtcctcaggactcgggattgagaaacagaaaaggaatgtgcgtacaaataggcagtcacccgaaaagacttttcctggatccgtttgcctcagctatttgtgggaggcttggtgaaggaagggtaaggaacaaagggagagacacccaaggacgaatgtgagtctgttaccacagacgcctcgacatgntctcctggggtggtttctaaggtaccttcctgtttaatactacataacctcggaaaggacatcaagggactcatagntcttcagtctggagagttaaacatgtacacttgaaccggtagaatcccttntcattggtantcctcatttntcatttgcggtttttactgtgctga

SEQ ID NO: 8093 - DNA, 546 bp, Mus musculus
  misc_feature (336)..(336): n is a, c, g, or t
  misc_feature (355)..(356): n is a, c, g, or t
  misc_feature (395)..(395): n is a, c, g, or t
  misc_feature (464)..(464): n is a, c, g, or t
  misc_feature (509)..(509): n is a, c, g, or t
  misc_feature (521)..(521): n is a, c, g, or t
ggcagattagcaatctcccaggtcatgcagcatcttgaaacaaagtaagaattctgattcccaaaaataacaaatttaagtgtatactttagcaggtgtgtactaattaccagtaacttcaacacaagcaaagcaggttacatggtaatgttcattcagtatatttcttgtttgtgaaattgaaacctctataggcatcatatgcttcttgtctttaacaaagtctttgtcttctaagagcaaccccgcagtaaacaacagaggggttgctggacttgagggtgacgagacagatgatcatagcagggatttgaaatatgaattatggttacatgntcctgattttttttttttnnggtgacatgaatggaacagaagtattttgttttagaagntcctggcccagcgttggttcttcctcctgtatcctgtgaggcctggagcttttcaaacactagaggggnccttagagtaagtggaaaggacttctaaaatgtgtgtgtgctttnccttccagaaanccatctttgggctactgtaatatga

SEQ ID NO: 8094 - DNA, 446 bp, Mus musculus
  misc_feature (40)..(40): n is a, c, g, or t
  misc_feature (114)..(114): n is a, c, g, or t
  misc_feature (222)..(223): n is a, c, g, or t
  misc_feature (226)..(226): n is a, c, g, or t
  misc_feature (333)..(333): n is a, c, g, or t
  misc_feature (343)..(343): n is a, c, g, or t
  misc_feature (371)..(371): n is a, c, g, or t
  misc_feature (377)..(377): n is a, c, g, or t
  misc_feature (408)..(408): n is a, c, g, or t
  misc_feature (410)..(410): n is a, c, g, or t
ttcacgtctccatcaacttcgtcagaagtatataagatcnaatttatatttccaaatggagacacatacgatggcgactgcacaagaactacctctgggatctgtgagagaaangggacaggcacgcacaccacgccgaacgggattgtctacacaggaagctggaaagatgacaagatgaatggctttggaagacttgaacatttttcgggcgctgtgtannaanggacagtttaaggacaacatgtttcatggactggggacttacacattcccaactggggcaaagtacactggaaatttcaatgaaaatagggtagaaggtgagggagnatacactgancacccaaggcctgcagtggtgtggtaanttccanttcacagctgcccccggcctgaaactaaagntntacatgtagacctgctgccttaacgctgagatgtgg

SEQ ID NO: 8095 - DNA, 410 bp, Mus musculus
  misc_feature (123)..(123): n is a, c, g, or t
  misc_feature (247)..(247): n is a, c, g, or t
  misc_feature (269)..(269): n is a, c, g, or t
  misc_feature (272)..(272): n is a, c, g, or t
  misc_feature (274)..(274): n is a, c, g, or t
  misc_feature (276)..(276): n is a, c, g, or t
  misc_feature (289)..(289): n is a, c, g, or t
  misc_feature (291)..(291): n is a, c, g, or t
  misc_feature (295)..(295): n is a, c, g, or t
  misc_feature (299)..(299): n is a, c, g, or t
  misc_feature (302)..(304): n is a, c, g, or t
  misc_feature (315)..(315): n is a, c, g, or t
  misc_feature (324)..(324): n is a, c, g, or t
  misc_feature (356)..(356): n is a, c, g, or t
  misc_feature (385)..(385): n is a, c, g, or t
gtcatcatgggcgttttccagatattgatgaagaataaggaactcattcctttggcgttttttataagcgtggccgccaccggagccacatctttcgctttgtatgcgttgaaaaaaaccgangtggttattgatcggaaaagaaacccagagccttgggaaatggtggatcctactcaaccccaaaagcttataaccatcaaccagcaatggaagcccgttgaggagctgcaaaaagtccggaggncaaccagatgattgctcaccantcntntnttccaaagaacantntatnaatntannnggaaacatttntgcacaaantagatgttgatgccagtgtgcggaaatgcttntgctacatttgtagggtttgcctgcattntttggatcctgcattagcaagtgaa

SEQ ID NO: 8096 - DNA, 465 bp, Mus musculus
  misc_feature (310)..(310): n is a, c, g, or t
  misc_feature (360)..(360): n is a, c, g, or t
  misc_feature (379)..(379): n is a, c, g, or t
  misc_feature (408)..(408): n is a, c, g, or t
  misc_feature (425)..(425): n is a, c, g, or t
aactacctcatgtgaaattggctgtggacaatctgtgtttgatgagaaatgtgttcgcagaaatttattctgtttgataagttgaacagtgcagtgtctctatgaagaagaaacatgttataccagatgccaaaggctaaactagacatagatttctcagattcatttctatgttaatgtttattccagtctgtatcctcataaaggtttgtagttttgtagagccacatgctttgggtatctgtcacaatcacctcttgtcccctcagtattttgactgaacatcataatgctgataggaatcaagttnaactacgaaagtgtcaaacagcttgtggcttcttaatttaatggaccttnacttagaaatgtattgganccttctaggaccacttgttgagtgaaaantcttgtgtgcagatgtntctgcttctctgtccaagttgttgttcctgtatttcatga

SEQ ID NO: 8097 - DNA, 512 bp, Mus musculus
  misc_feature (281)..(281): n is a, c, g, or t
  misc_feature (297)..(297): n is a, c, g, or t
  misc_feature (373)..(373): n is a, c, g, or t
  misc_feature (375)..(375): n is a, c, g, or t
  misc_feature (392)..(392): n is a, c, g, or t
taggagtcaggacctcaacactggggtttgagtggacatagccacaactccagttaatcccatggtgctgttgctgttcctgcctcagatgaaccaatgcaaccttgaggcagccattcctttgaatgttgagctcagttgtctgctttcagggctgctgtcctctgccagggagaatcttcatccatggcctttaagttcagagcctgagagtctgggagttgttgttgctaggaaacctcaagcaaccaaacacgtggtcccacactgccctggcacanctggtgttggccaggnctcagtgtggctgtgactggacctgagagctgcaggcagccagtgggctgtaacggctctcagcagataggaggtntngggaaatgagttcaagncctctggtgctctctgtcctgattttcacatgaagaagcctctagtccagacccaatcaaagactcttaagactttggaacagagtttctttttctgctcagtgcatcacccagaaatag

SEQ ID NO: 8098 - DNA, 373 bp, Mus musculus
  misc_feature (76)..(76): n is a, c, g, or t
  misc_feature (82)..(82): n is a, c, g, or t
  misc_feature (214)..(214): n is a, c, g, or t
  misc_feature (254)..(254): n is a, c, g, or t
  misc_feature (258)..(258): n is a, c, g, or t
  misc_feature (271)..(271): n is a, c, g, or t
  misc_feature (274)..(274): n is a, c, g, or t
  misc_feature (289)..(289): n is a, c, g, or t
  misc_feature (321)..(321): n is a, c, g, or t
  misc_feature (327)..(327): n is a, c, g, or t
  misc_feature (330)..(330): n is a, c, g, or t
  misc_feature (333)..(333): n is a, c, g, or t
  misc_feature (342)..(342): n is a, c, g, or t
gctatttcaggattgccatgtgtgcaaacaatcatgccatgcagccaaggaatatatgtcgatgtttttttttttnaaaccnatggtttttatttttattttattttttagaattttcattaatactgtagttatacaccatatgcctcattttatcatagcttattgtgtatgaaatatgtttgtaaaatgaattgatgtttagtttgctttngccatttgaaaagatgccacaccaggaggtaaccaataanagcncagctccacattnttntccctggagaacccnttcctggaagagtgatggaaaccggagatacnaaatgnccnaancacacaccntcattcctctcgcacctgtgttgaccaaaga

SEQ ID NO: 8099 - DNA, 552 bp, Mus musculus
  misc_feature (60)..(60): n is a, c, g, or t
  misc_feature (165)..(165): n is a, c, g, or t
  misc_feature (179)..(179): n is a, c, g, or t
  misc_feature (301)..(301): n is a, c, g, or t
  misc_feature (303)..(303): n is a, c, g, or t
  misc_feature (312)..(313): n is a, c, g, or t
  misc_feature (325)..(325): n is a, c, g, or t
  misc_feature (327)..(327): n is a, c, g, or t
  misc_feature (329)..(329): n is a, c, g, or t
  misc_feature (344)..(344): n is a, c, g, or t
  misc_feature (354)..(354): n is a, c, g, or t
  misc_feature (385)..(385): n is a, c, g, or t
  misc_feature (393)..(393): n is a, c, g, or t
  misc_feature (397)..(397): n is a, c, g, or t
  misc_feature (400)..(400): n is a, c, g, or t
  misc_feature (452)..(452): n is a, c, g, or t
  misc_feature (470)..(470): n is a, c, g, or t
  misc_feature (481)..(481): n is a, c, g, or t
  misc_feature (503)..(503): n is a, c, g, or t
  misc_feature (509)..(509): n is a, c, g, or t
tgtgatcaacgtagagcttcctcctggtcaagaaggctgcatgcatcaacttctaccaanccctcagctcctccatacttcttccacccagcccacaagcacattgaattcctcccactatgctcaggataagcaaacagaaacagcccctgcttgaatggtttnctcattctaccagncaactgtgtatttacactgtaggtcacacaaatgctataaagcagaagtccctgggtatgatgacatcaagcaggctacctggcccgcaggtcatgtgtgcaagagtaggagtatcagggantnctctctgtnntgaagtgacatntnanctggaaagctcacanttaatggganccaaggaacaagtatttcaagaagagtggantcgacttnaacnctnctgatgtaactggataaggacaagtgaagggagggatggagaactccacctnccatcattgaatcgagtncctactgtttnccagacactttaccaaaggctnccaagntccttgctcttagggaactcgttttctagagagagggcatgca

SEQ ID NO: 8100 - DNA, 496 bp, Mus musculus
atttgttcccaagcattacacgctaagtcccattgctgggaaaacctgcctgatggaaggacggaagcggccactacaggttgtcctctaactgtatgtgcacacaaaataaagtgatgcacgagtcactcccgaccaacagcacttgaggtggccctctggctttcacacacacatgtgtgcacactgctacacatatagcatctacacaaatgttgtgtgttttctgacattcactctgtgactaaaattatacttggaggaacttttaaacattttgccctgatattaaggaaaatcctgcaaggtgcaactatgaacaagcagttgggttctgtgctgctttggggattttacgggtttgcccagtgctgtgttcacacttccgtaaaggaaggtttacaggcactgatggacacagtgagcactgagtttactgagtagttgtggaaagctctggaaagccctaaaataaccatcttatacattccagtct

SEQ ID NO: 8101 - DNA, 496 bp, Mus musculus
  misc_feature (130)..(130): n is a, c, g, or t
  misc_feature (327)..(327): n is a, c, g, or t
  misc_feature (353)..(353): n is a, c, g, or t
  misc_feature (394)..(394): n is a, c, g, or t
  misc_feature (396)..(396): n is a, c, g, or t
  misc_feature (427)..(427): n is a, c, g, or t
atccgaatggtctgtgaggctgcaaaggacgtgccacttgatgagcccgaggccattgttgtgctctgcaggaacgtggactcctcagcccagtgcttgactcgctcccgctgaacagagccccagcggnttccaggaagcttaagtgggttccgagacagacataaactgatacatgcaactattttccagcaagaaagctaagaggactttattcagctgaccaacaagtaagcccttatagtcagatctagtgactgaggcactgccaggccgtgaggaccatggaggtctcagatgtctgccgtcccctcccctgaaggcccntgacagaggagctaggtgctggttgntcatggattggtattaaaactgaaatgtgaaagctcttgtntnttcggttgtacatgacacatgtgtaaagttncctctctttgctgttttatttaagaatgttgagtccctaaggtagaaacctctactttgggaagacatc

SEQ ID NO: 8102 - DNA, 527 bp, Mus musculus
  misc_feature (396)..(396): n is a, c, g, or t
  misc_feature (398)..(398): n is a, c, g, or t
  misc_feature (405)..(405): n is a, c, g, or t
  misc_feature (430)..(430): n is a, c, g, or t
  misc_feature (465)..(465): n is a, c, g, or t
ctagtctgttttcccaattaacttgtaaatcagtgttcaactagttttataactgaaaagctgcacatttttgtcatagtaccaactagtttgtacctgtagtttgaatttctctgttaagataaaaccttatcaccccccaccctcaactccctttttagaggacatctactaaaagaaagtccagtgtggcattttcttgggtaatgactggttgtgtaatttctgcccttcacactgtagaaaacaccatggatgccattaccttctgattccaggttaaaaacctgcagagagctgccattttgtacagcttttctccccatgtaaatgagctatgtgatggcatttaaaacccgcatgttctttttaaactgaattttctatctaatcaantntcttcantcctgaaggagaatctgcattgttntctgtatagagagttgctgtgcatggttacgagcnccttttactaaatgctgttcaatgtggctttgttgttgtggcttaatactacctacatgagg

SEQ ID NO: 8103 - DNA, 482 bp, Mus musculus
  misc_feature (373)..(373): n is a, c, g, or t
  misc_feature (415)..(415): n is a, c, g, or t
ccacggccaacagattgtcttcaaggactgaccttggccttcccccgctgtcctcttgcttctgggacctagtccctctgtctctttgccccggctctgctggccaagtcgtgggtcttccctctgtcccctcgttgcatgctgttttcagtgagccctttccttccagtcatcaccactcactgctaaccacatggtacattccagcatttccctctggcggcgctcttcagaaagccagtgaccgcccctcctctacatccttgttctgccatctttctcttaccatctgattccctttctgttttgttaatacattgaacacacgtgtagaaaggacagtgctatcagccacactccaagctgctttccnccattgcaacagagtactttgcccctcctgccccaccatccnccacctccctaactttgtactaggctggcctggacctgtgccagctctgctatcgtgatctgtttca

SEQ ID NO: 8104 - DNA, 533 bp, Mus musculus
  misc_feature (315)..(315): n is a, c, g, or t
  misc_feature (319)..(319): n is a, c, g, or t
  misc_feature (338)..(338): n is a, c, g, or t
  misc_feature (382)..(382): n is a, c, g, or t
  misc_feature (407)..(407): n is a, c, g, or t
  misc_feature (409)..(409): n is a, c, g, or t
  misc_feature (424)..(424): n is a, c, g, or t
gagagttggaccttgttctttggtaaatttaagatagaagggctgtctgccatagaggtagagatcttcaaggcctttactcatgccctgtgtatcctttggacaccatactatcatgcgcagtggccccaagccaccgagaaccagtctgagaagctccagattcgctcaggcccttgatcatcagtcgtcgtcgtcttcgatttgccagaggagtttagatgaagaatgtcaaggatgttcctccctgccctcccatctagccaagaacatttccaagaagataaaactgtcactgagacaggtctggatgcncccntaggggcaaatagagaagncctttaccacattgctgctggctataggaagtcccaggtactancctgaaacagctgatatttggggcntntcacagacaatatgnccaccccttggtctttatgcatgaagattatgtaaaggtttttattaaaaaatatatatatatatataaatgatctagattattttcctctttctgaagtactttctta

SEQ ID NO: 8105 - DNA, 520 bp, Mus musculus
  misc_feature (317)..(317): n is a, c, g, or t
  misc_feature (336)..(336): n is a, c, g, or t
  misc_feature (342)..(342): n is a, c, g, or t
  misc_feature (360)..(360): n is a, c, g, or t
  misc_feature (395)..(395): n is a, c, g, or t
  misc_feature (436)..(436): n is a, c, g, or t
  misc_feature (438)..(438): n is a, c, g, or t
gaaaacattgttccaaaccctcttgccaaagaagagctgaatttcttggccaggctaatgggagggatggagatcaagaagccgagtggccctgaaccaggattccgactgaatctgtttacgaccgatgaggaagaggaacacgcagcactgtccaggccggaggagttgtcctatgaagtcatcagcatacaggctacacaggaccagcaacggaatgaggagttggcccggatcatgggtgagtttgagatcacagagcagctggagcagaacaccagtaagggagacgacttgctggccatgatggacaggtnatagatgcagatgggcacnccctanccctccctcaagagactnccttagaccaccctggacacggatggctggggatntcatgtgcccctgctggattccaaccaaggcctgcaccttntnagtccatttttaagtcagaaaaaaactgtgacgacctctcggagagcatccatttctgaagccacacacatttctgtatttt

SEQ ID NO: 8106 - DNA, 479 bp, Mus musculus
aaatatctcttgctgaatgtggacagtttacacacttaacacatattctttctaaaattactctgtacataataagccaggcatggttgtgcatgcctgtaattccagcagttgggaagtcggaggatcattcaaggccagcccgagatacatgagaatctgtgtcaaaaaagcaaagtgacaaacgttactctgtctaacaaaacatgatactctgaaagggtgtctttatttgctgtttgcgagcttggatatagataatttggcccacactggagtataccagcaacagtttaaaatacatgtgccatgctttggtttcgtattttaaaagtttgtatggttttatgttttggttttgattttaggtttttggttttctgaatttaccaggttctgtgttaaaaaatattttcatatctattcagttttattatttcttttgttactaaatatttgactcatttcttgatctcaga

SEQ ID NO: 8107 - DNA, 310 bp, Mus musculus
  misc_feature (186)..(186): n is a, c, g, or t
gggatggcttttcagaataatacttttagtgtctgatacaaaaagcacttagtaactgaaggtattttcatataaagtcacatgaacccagttcccagaaattttaagtgatggcagatctgtttggaaatgtttgctttcactgatacagagagcagtctttatgttttgaagacttacaggaangtcgttaataggagtggactgtactgaatgctgttggatctttcaaggtttccaccatggctttctttttttctccagaatactgtgattaagataactgagcacttctctttacattgactgt

SEQ ID NO: 8108 - DNA, 522 bp, Mus musculus
  misc_feature (85)..(85): n is a, c, g, or t
  misc_feature (87)..(87): n is a, c, g, or t
  misc_feature (345)..(345): n is a, c, g, or t
  misc_feature (430)..(430): n is a, c, g, or t
gaaggaattccatttgcaatcagcaaagaaagcctctgccctttcagatgcctctcgaaagtggtttttaaggcaggagacaagntncagctttggagcatgaagaaatgccttggttgcaaaggcagtacatggactcagcctatctgcctcaaacctcacgattacatgatgtttctgacatggacccctcaacacacattttttcaagaaattatccaacagaatggaaccacatggaacacgaccttctcaagaacgtgcgagatcttcgcaggagactcacagcccgggctcggaacagctgtcggcaccctcatcttttggtgacataaaagacagttnaccattaaacaatcagagataccttttttaatcaatggcattgattttttttcaactatttattctaattttttataaagatcanccttttgtatagagaaatatgtctataaaattatgttttctattgaattataatgctttggcttgtaaagggcttctggaatctttcacaat

SEQ ID NO: 8109 - DNA, 516 bp, Mus musculus
  misc_feature (278)..(278): n is a, c, g, or t
  misc_feature (299)..(299): n is a, c, g, or t
  misc_feature (327)..(327): n is a, c, g, or t
  misc_feature (371)..(371): n is a, c, g, or t
  misc_feature (378)..(378): n is a, c, g, or t
  misc_feature (387)..(387): n is a, c, g, or t
  misc_feature (461)..(461): n is a, c, g, or t
  misc_feature (465)..(465): n is a, c, g, or t
  misc_feature (474)..(474): n is a, c, g, or t
  misc_feature (476)..(476): n is a, c, g, or t
gcgtgccgctgagagagctgaattcagctataggaacaagcaaagaccccgagaaatggggcgatgtccacaaagaagtcattgccagtgcctataatattatcaaaatgaaaggttatacttcctgggccattggcctgtctgtaactgatattgcagagagtattctgaagaatctcaggaagacgcatccagttaccaccaaaatccaaggtctctacggaatcaaagaggaggtgttcctcagcgtgccttgtatcctgggagagagtggcatntctgatatcataaaggtaaanctgagccctacagaggaggcccagatgntaaagagcgcagagactatttggaaaatccagaaagatattaanttttaantcacccttntaaagataccgaagacagaaaacgcagtgcacggccaagtgtggggtgaagcgggggttccgaaagctggaggntttnttgtttagntntcctgttgtgtagcatccagaggctgggtgactttgcttt

SEQ ID NO: 8110 - DNA, 451 bp, Mus musculus
  misc_feature (196)..(196): n is a, c, g, or t
  misc_feature (206)..(206): n is a, c, g, or t
  misc_feature (306)..(306): n is a, c, g, or t
  misc_feature (341)..(341): n is a, c, g, or t
  misc_feature (351)..(351): n is a, c, g, or t
  misc_feature (356)..(356): n is a, c, g, or t
  misc_feature (363)..(363): n is a, c, g, or t
  misc_feature (376)..(376): n is a, c, g, or t
  misc_feature (385)..(385): n is a, c, g, or t
  misc_feature (391)..(391): n is a, c, g, or t
  misc_feature (397)..(397): n is a, c, g, or t
  misc_feature (404)..(404): n is a, c, g, or t
  misc_feature (417)..(417): n is a, c, g, or t
  misc_feature (426)..(426): n is a, c, g, or t
aatgcagcgatgtcaagttcttccagctggctgcccagtggtcttctcacgtgaagcacttccccatctgcatctttggacactccaaagccaccttctagccccacccacggaagggctgacactggacagtgactctgtgccagccattgatggagggacagctgtatttctgttaacacgtggttactacagnagacagactnttaaaaacacaaagaaacagtcttaagtatgaatgtgctcatagcccagctagctccctgtgggccactgagtaactttgctcggcttactaaccagaanatgtgggcaagtggaaaggctggtaagaaaggagntgaactctgntcccnatgaaancccagaccacaancaagaaatnttcttncctttntatcctnccctttgctgacntcaggattntgcttcctcagggagtagggagcac

SEQ ID NO: 8111 - DNA, 533 bp, Mus musculus
  misc_feature (54)..(54): n is a, c, g, or t
  misc_feature (75)..(75): n is a, c, g, or t
  misc_feature (313)..(313): n is a, c, g, or t
  misc_feature (325)..(325): n is a, c, g, or t
  misc_feature (328)..(328): n is a, c, g, or t
  misc_feature (335)..(335): n is a, c, g, or t
  misc_feature (347)..(347): n is a, c, g, or t
  misc_feature (350)..(350): n is a, c, g, or t
  misc_feature (387)..(387): n is a, c, g, or t
  misc_feature (420)..(420): n is a, c, g, or t
  misc_feature (427)..(427): n is a, c, g, or t
  misc_feature (430)..(430): n is a, c, g, or t
  misc_feature (445)..(445): n is a, c, g, or t
  misc_feature (447)..(447): n is a, c, g, or t
  misc_feature (450)..(450): n is a, c, g, or t
agggctgacacagagcacctcggaagtgagaaggcaggcttcccagtaccaganaggaatggacgtggcgtgcanaagcgggagggaataaaagccacctgggtagggaagtcctctgaccaacagcccatccttttgcagtgccctgttccagggtcatgtggccaccgctgctgctgctgtttctgctgcttcctgctgcccatggcgccccccacccggctgcggacctccaggaaaactttccaagcgtactcgaagaaatccaaactgaaggagacagaggcatgtggagagaagacaacccgttcgntggctcccgctntcntcctggntcatgaggtggnttntatgtggtccagaagctgggggcgaggacctgtagcntcatgaaggcctgccaggcacaggatccggagntccacantcntcccaaaatccctgntntcntccgggggcccttcagctgctgaaggggctggggtggacaccattatcctagcaggggacatatgtggaactcaccagaccca

SEQ ID NO: 8112 - DNA, 508 bp, Mus musculus
  misc_feature (294)..(294): n is a, c, g, or t
  misc_feature (364)..(364): n is a, c, g, or t
  misc_feature (404)..(404): n is a, c, g, or t
  misc_feature (460)..(460): n is a, c, g, or t
aggaacccaccggtagagatggtcggggaagtagagttcaagggtgcctgagggaacagagggccgagtagcctcccgcctcacgttttccatgtctggccctgcctgcccagaggctctagtcaccaaggccctggggccattgttgacagggacaaaggtatcccagcaacagggaagcgggcagccacagtctaagacctcagcttacttcctggtgcggggctgggacccaaagtgttccctcccccctccctgccccacagcgggaggtcatgccctctagagcgtggntctccaccccatctctgtcctcaagacacatccaagtaagggcacagtgacaaaggccacaaagtatggnccatgatctagagatccacagaaggaagtggatacctaantcttgggttggggagaatgctctgggatcactggtggcatcgctgaacatgcagancccagggcctgctcattctgctagtgcatcctgtgtatctcatgacaa

SEQ ID NO: 8113 - DNA, 467 bp, Mus musculus
ttgaaagttccctgattcttctgtttctctttatagaccagaaacgctgtatctaaaaatcaggctataaatttaaacctagcatatagcataaaattgccattttggtttttagctcctcgcatacatgtgcctccgtggtcacctgtgttaaaaaggagagagggccctttttcttttggcactgtgacaatttagtaactactgtggggaagtgtttgccttttattttcagtgtgaggatttaaccaggttattacaatgatggtcacatagtttcagttatgtgaacctatatatagaaacagttatagtttcagaatttgccaagtatacattgtgtcattctctacagtccaggtgttcctaataaaataaaagcagaaatgtgtgctttttggtaccaatcagcctgattggtgtaagctgtcatctgaaacatggaatctttccttgtagcactatta

SEQ ID NO: 8114 - DNA, 313 bp, Mus musculus
  misc_feature (27)..(27): n is a, c, g, or t
  misc_feature (95)..(95): n is a, c, g, or t
gtcctcagtcacatgggtctacaaaanctcagagcagaggtggacccatctctagaaccaggcaatgaccacagggcaagtgagaacctgcaagnttgcagcagacttgggagcacatggaggcttttcatgccccagcattcaggcaccggatgatgcacagctcctgcaaacagcagcttggtccgtcaagttatcttggtacaagtgtccgagaaatactacagagtatctgccaaagactgcactggtaactaactgttctgcatgcagttactgtcttctttcagctttagttaacctactccatggg

SEQ ID NO: 8115 - DNA, 527 bp, Mus musculus
acacttggctgagtttctacctgggttgccaggttatcatcggagccttcttgtgtcctcaaagggccacggggcctagaaagaggatcagaatgctactgaactaattgggcagccatctcaaagctgctgtaggcaaagggctgctgtagcacttttcttttagcaaattaatgactctctggcaaaggagtgtttaagtgaaggcattaataagggctctggcaggtattcccatgattctcagagttccatttgcattgaattaatcttaaagaaacttgcaagataaacagctggaattcggacaaacatggcagattcagtgagtgaagtcctctcatccataaaatgaacacgagatacttgttttaaaattttttccctgtgggtaaaaatagaaaaatcagaatgcttataacaaaacataatttggtacaaaattcttcaaaatacttgtatccaactataaatatattcttcttgagataagtcacttacgattcttgctctgtttgttggtgtaa

SEQ ID NO: 8116 - DNA, 373 bp, Mus musculus
  misc_feature (126)..(126): n is a, c, g, or t
  misc_feature (135)..(135): n is a, c, g, or t
  misc_feature (233)..(233): n is a, c, g, or t
  misc_feature (259)..(259): n is a, c, g, or t
  misc_feature (283)..(283): n is a, c, g, or t
  misc_feature (340)..(340): n is a, c, g, or t
ttatgtggtacgtgtgtgtgcatgtgtgtatatggtaggaggctagccccaggggctgcttttatcagagtggaccagaccagaagccagccagccctacagcaggctcaaaataggagtcagccnttgctttantgatggggacctgtgtgtatcggtgtgatcacagtgccccctgctggcagactcacatcaggggactggaacggttcatgtagtagaagcctagccgncctgcctggctcactaacccaccttnccttgacaacccctagaaaccctncctgagacctcttggggtgccaagaggggtacattggtttttaagtttatggttttntcttgttttatcatgattctttttatgaagcaa

SEQ ID NO: 8117 - DNA, 158 bp, Mus musculus
actgaggccagggttttgttcattgtctgatccttaccacatactgcagagtgcagccagacaggcagcaagcaggcacagctctgctctgccctttgtcctcctagttgaaactcctgtctataaagagcttgttcttcatgttttgagcactttat

SEQ ID NO: 8118 - DNA, 452 bp, Mus musculus
  misc_feature (212)..(212): n is a, c, g, or t
  misc_feature (270)..(270): n is a, c, g, or t
  misc_feature (292)..(292): n is a, c, g, or t
tcttctttccctttcaactaactatgtgacatctacctttattttctcattcagaaagatgtttagtatgtatcttctgaaatattatgctttcactctgtttttaaagcttatagaatggctttaaatgtgagccaagccccagactatcaatgtcaatcttgctgggctattaatcacatcctaagaccattaaaaaaaaagcttcctgncaagccacaacctccttaccccatggtagaaatctttttcagacctcagtgggtattnatcatgcagatggtccagattnaggtgtacgttcaatctaacaaatgacctgggctttgaaacctacccatcatctcagatagaactgtgtgtgcttctttgtgctagtacatgagaaaaaaagatttttattgttttgacagtcccagcatattgtgtgtaaactcttgttgtgctcgaat

SEQ ID NO: 8119 - DNA, 550 bp, Mus musculus
  misc_feature (145)..(145): n is a, c, g, or t
ggactaatgcttgcactgggcagctcccagaaacacctaagtgtgtctgtttccctgcatctgggcctgcagtcacttggctttggacctgcagagggtccccagcacccgcatactggtagcactcagctggcttgtccacatnctcacctcagccacctcatgatctggtggaacctcctctttcttgtttctggctggtgcagacacccgtgtgtcctaatacccatctgtacactgcagtgtgtggtgcattcctcttaaacagctgcagccatggcttgttgtattgtagacgctgtccccagtctggtgtttctgtttgacatttgtgaatgcttacgtccgtgtaatacccttggtgctgtgtcagtgttgtgcacattggactagacattctgctttgttgtgcacttggtggcttccttcctatgtgactcctctgctccatggacagtggcactgatgctccacgttgccttccagttgctgccatggtgctgtgagcagatgctgttggtgctgctcccggacatctattttctcataa

SEQ ID NO: 8120 - DNA, 236 bp, Mus musculus
  misc_feature (204)..(204): n is a, c, g, or t
  misc_feature (210)..(210): n is a, c, g, or t
ccaggtagcccttgaaattctcaaaggcaaagactggaagttgaaaggcagaaatgccctaaccccaaggcaccttcaggcatggctcaaggacatacatcctgaaccagcaatgcctatggggcttcgaattgtacctcctctcatggagaggcacatcttcaggactcggaaggtgaaccacccaaagatagtagcttggcnttgganccggaagattgaaaagctctaccaca

SEQ ID NO: 8121 - DNA, 378 bp, Mus musculus
ggtgatcaatcctctaatagaagaactgggttgcgataagttcatccacagagagtgaagagtcggactgcggggagggcacggcaccaagacctccgcatccaagtgaaaccccatcctgcaacttggttttaagaaatcaaacggatcttgagaggcagcgcttcctcagagggaggaaaagcgtcagaaaattgggggtggggagggaaagcatcgtagactcctaccgtttcttgagtttatgatcagttgaaatttcttgtgttatggaaaaggtccatcctcgtggcttcgttaataagtaaaggacggttttgtaaaactgtaaagacttaaaattgccagtagtagagcccacgacgaagaagactcgaa

SEQ ID NO: 8122 - DNA, 509 bp, Mus musculus
  misc_feature (32)..(32): n is a, c, g, or t
  misc_feature (318)..(318): n is a, c, g, or t
  misc_feature (320)..(320): n is a, c, g, or t
  misc_feature (348)..(348): n is a, c, g, or t
  misc_feature (351)..(351): n is a, c, g, or t
  misc_feature (357)..(357): n is a, c, g, or t
  misc_feature (365)..(365): n is a, c, g, or t
  misc_feature (402)..(402): n is a, c, g, or t
  misc_feature (415)..(415): n is a, c, g, or t
  misc_feature (417)..(417): n is a, c, g, or t
  misc_feature (434)..(434): n is a, c, g, or t
  misc_feature (438)..(438): n is a, c, g, or t
  misc_feature (440)..(440): n is a, c, g, or t
  misc_feature (473)..(473): n is a, c, g, or t
ggataactcagcactcatgatcagctgtcaanctataacggagtgttgaggcagtccctgaaaccacagcgccattttgtaggaactaagaagccaacctcaaggaatcactcgccccaagaagactttgttctgatctgatgtgtttctagcctggtggagcctcagctatccaaaggaagagctgttaagatgattggaattttggtttttccgattcactcttttttctctccagccatctgccttagacagcaggagaaaaggaaacttagcctcagaggtggggtccttcggaaggactgacagtgggctagntntcctgctgctgggagcctgagtgccttnggntccttntccagacntcagctttaccacggaggttacctgcttaccatcaanatcgaaacttgcntnttcccctgggtgtattntccntnttttgtgtacagtttgattcctccaaactgctntccctgtgaagaaagccgatggaattcagggagcct

SEQ ID NO: 8123 - DNA, 432 bp, Mus musculus
  misc_feature (324)..(324): n is a, c, g, or t
  misc_feature (351)..(351): n is a, c, g, or t
cactggaatgttgggtctgggttctgaaacctgacattgtgagacaaagaaaaaacttgaagcaagaagaagctagttgaacacttcaacggtagtgtttgtatttatcgcgccagtgtacgttctgaacctttcaggggtaggagctactgggagagacgggggagtgagatggggtagacgaaagctttaatttaggaagaaaaagttcaagtaaaggaaattattttgatgaaatatattttatttgatctgggtatttttggaccacattattaaattgttgagctgcagctgagttgctgaggggagagctttgctaanccttgcacaggtgcgtgtgactcatcnccaggtgtactttatggagcttattttatgatttcaaatactgtactgtacataggaggtatgttaccttctccttatttg

SEQ ID NO: 8124 - DNA, 417 bp, Mus musculus
actcgctagtccttataggattcctgagtttgtaatacttttatcatcatattctttacttactcaaagcccaaggaatgagctgctacttcactacagtgtggctgtgataaatgtgaaaagagttttggcctgtttaaaataatttttcaactacttaatggtacagacaaatatgtgctgcataataaaaatacctgtttattgttacaggaaattaaaaagggatcttttatattataggattaaaactaattttctgtatatgttaactaattgatttaattttaagtatcttgcatttattaatatgtcttaattttgaatttgaaaacatgaagtgcaataaacatactactacagatttcattttgttgcaattggcacgcagtgcagatgatcactaacagtttgcat

SEQ ID NO: 8125 - DNA, 481 bp, Mus musculus
  misc_feature (28)..(28): n is a, c, g, or t
  misc_feature (156)..(156): n is a, c, g, or t
  misc_feature (161)..(161): n is a, c, g, or t
  misc_feature (167)..(167): n is a, c, g, or t
aagccaatctttttgaggctcaaggttntagattccctaaggatactactttttaccatttgttttctaagaataagctaattcttatcaatatttacatattaatttaataaataaaaattaagattaaaaagtgcaccaaagcaatggcaaaantactntatttnttaaatatgctcaggtggccacaaacttcagtatcgaccattataaacccatatgagcagaatatttcctaacaatcctcaatttacactagtagaagtaatatctttaaaaactgttctttctttaagtgttcctttctttcaaatgttgattgcttttcaaagctttccccttatctgtcattgtctttgtatatagtgcagattgttgcttgtaagaaaggctaataaggaaccaaactcttgtaagtaatgtaaataaaaaggtgggtagatcatgttttcaatatactctactacctcagtttacttga

SEQ ID NO: 8126 - DNA, 445 bp, Mus musculus
  misc_feature (180)..(180): n is a, c, g, or t
  misc_feature (182)..(182): n is a, c, g, or t
  misc_feature (184)..(184): n is a, c, g, or t
  misc_feature (190)..(190): n is a, c, g, or t
  misc_feature (374)..(374): n is a, c, g, or t
  misc_feature (399)..(399): n is a, c, g, or t
gtttctaacttactatgtacttccttaacgttaagcactgtgattggatggctatctttaatttgtttaataatcctcaaatgtgtcatttaatgtaaaactgcactactgaatggtcatacagaagggcaaggctttagttttcacaggattaactgaagtagacagagaagggttttncntnttaagnactcattgagttcttcacctctccctctgactgttcaattgttacatgttaaagtggatgttgatcagatggacactaaaccatcatcacctctgcagacagtgttaagtaccacagatgctaaggagtggaaatgatcgagttgaccctcacacaggtatttctgtttagtacttcagagtgntcctttctttcatctgtttaaaatngtatatgctaaattttttatggtaaacatgcattctacttgatcgt

SEQ ID NO: 8127 - DNA, 495 bp, Mus musculus
  misc_feature (30)..(32): n is a, c, g, or t
  misc_feature (358)..(358): n is a, c, g, or t
  misc_feature (415)..(416): n is a, c, g, or t
  misc_feature (436)..(436): n is a, c, g, or t
  misc_feature (439)..(439): n is a, c, g, or t
  misc_feature (441)..(441): n is a, c, g, or t
  misc_feature (443)..(443): n is a, c, g, or t
  misc_feature (445)..(445): n is a, c, g, or t
  misc_feature (447)..(447): n is a, c, g, or t
  misc_feature (449)..(455): n is a, c, g, or t
tccacagccactagcaggcggtaatgaagnnngtccaagcactcagctttcttccttaaggaaacctgaagaggatgatatggcatactttgaaagacagtaccaggagaggataaagctggaaaaggctgctaagcagaaaggaaaagtgccaccgctgccgagcacaaagccatcgtgaagtctggtgaacagatcgagccgtcatccagatgcatcttctatttatttattttctcccaatatatatactttctaattgtgtaaatatgtccttttgaattggcttagcttattgaaacaagtgaagtgaatttttgttttttgtcagaactcatgacttaaagcactttctatnccttttaaagatgtctattgggtagcacagcctggcgttgggatcacggtattcttnnccttaccgtgtgtatgctcnctntntntntntnnnnnnntagcaagttttatgttatttttatgtgattcaaaccccaa

SEQ ID NO: 8128 - DNA, 196 bp, Mus musculus
tcttgataaagggaagaggacctctactcagtaggctgtggtaatgaagcctcattttaactgactgtgggaagatagaagtctccactggaaacacaaaccttgtattaagaacctagttaaagagggcttccctaactaccactaccaccactccttttagattaagttgagacctagatggaatgaatccagc

SEQ ID NO: 8129 - DNA, 311 bp, Mus musculus
gctatatttgcccaaagagactctaaaacaagtccttatctccattcttaagagaggtcagagtttagagccagatcatgtcagtttaagtagtagagtcaagggctggtctggaatcggcaccaagaacttaaaggggaaaagtgggtaggtgactgaggacatagctcagtattagagcacttgcttagcatacacaggccctgggtttaatccccagtactgctgaaaaagaacagcttttttagataaggaattttagccaagacaatcaatgatgaatgctgacaaacgctctcacaacccattag

SEQ ID NO: 8130 - DNA, 527 bp, Mus musculus
  misc_feature (79)..(84): n is a, c, g, or t
  misc_feature (185)..(185): n is a, c, g, or t
  misc_feature (329)..(329): n is a, c, g, or t
  misc_feature (342)..(342): n is a, c, g, or t
  misc_feature (354)..(354): n is a, c, g, or t
  misc_feature (405)..(405): n is a, c, g, or t
  misc_feature (408)..(408): n is a, c, g, or t
  misc_feature (419)..(419): n is a, c, g, or t
  misc_feature (421)..(421): n is a, c, g, or t
  misc_feature (428)..(428): n is a, c, g, or t
acccctggagatacttttcttgaatagtttccttaataagagaaaatatttatgatttttttcaaagtattcttttttnnnnnntgtttttggttttttttgagacagggtttttctgtgtagccttggctgtcctgaacctcactttgtagaccaggctggtctcgaactcagaaatctgcctncctctgcctccccagtgctgagattaaaggccaaagtatcttaaaaaacatttatttggggtcaaggagatgtggagatgtgggtcatcacatgcatatggaaggcagaagactgtgtctctgggattaagcccaggtcatcgnccttggtgggaanccatctgtctgntcccgtagtttgtgagacctgggttggttctgtattccctatgtagcctgnccntaccctcaaantncttcctncctgagtttctgaggctgggactaaggcatgcatcagcatgctgggttaaagatacttagttggactacaagtagatcctgggtttgtgttcaatttga

SEQ ID NO: 8131 - DNA, 445 bp, Mus musculus
  misc_feature (249)..(249): n is a, c, g, or t
  misc_feature (394)..(394): n is a, c, g, or t
aacggcttgagcgtttggaagctgcaacacacgggaaagtgatggtcgacgagaaggcctggaacaaccttctaagtcgtgtcactcttctagaaacggagatgctgttgtccaaaaagagtgaatctgtagagcgtaatgtggcaagtcaagactgtgagtcaattagtgatgtggactttgtaccctatgataaaaactacagtgtggggggagcagcaggcaactaccgctcgtctggctgtagtncagtctcatcagaaacagcacccgggagctccattgttaattactgtgtcttgagagagttctcagaggaaacaactatccagaaaatggaaaggatgaaaaaaatgtttgaagagacagcagagttactgaaatgctcaagtcnctaactgtagaatgttctgcataatcgctcctaggactttggctacttata

SEQ ID NO: 8132 - DNA, 315 bp, Mus musculus
  misc_feature (95)..(95): n is a, c, g, or t
  misc_feature (114)..(115): n is a, c, g, or t
  misc_feature (129)..(129): n is a, c, g, or t
  misc_feature (134)..(134): n is a, c, g, or t
  misc_feature (136)..(136): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (148)..(150): n is a, c, g, or t
  misc_feature (152)..(155): n is a, c, g, or t
  misc_feature (157)..(158): n is a, c, g, or t
  misc_feature (160)..(161): n is a, c, g, or t
  misc_feature (163)..(163): n is a, c, g, or t
  misc_feature (167)..(167): n is a, c, g, or t
  misc_feature (171)..(171): n is a, c, g, or t
  misc_feature (173)..(173): n is a, c, g, or t
  misc_feature (178)..(178): n is a, c, g, or t
  misc_feature (182)..(182): n is a, c, g, or t
  misc_feature (197)..(197): n is a, c, g, or t
  misc_feature (204)..(204): n is a, c, g, or t
  misc_feature (206)..(206): n is a, c, g, or t
  misc_feature (210)..(210): n is a, c, g, or t
  misc_feature (213)..(213): n is a, c, g, or t
  misc_feature (217)..(217): n is a, c, g, or t
  misc_feature (232)..(232): n is a, c, g, or t
ggcatcaccagtggaacggttcggggtgcagccaggtgcgcggcgccgctgaccgctactcgctgcagggcggcctgggctccttctgccatggnccccgcgctcaggtccttnnctgtcgccacggantttantnctgntgntgntnnncnnnncnntnntnggcncccncnccgancccnccaccgggagcgctntccccgntnaganccncccntgcgtggattgccangcatttgaattcatgcagcgcgcccttcaggacctacggaaaaccgcctacagcctggacgcacggacggagaccctcctgct

SEQ ID NO: 8133 - DNA, 447 bp, Mus musculus
  misc_feature (119)..(119): n is a, c, g, or t
  misc_feature (121)..(121): n is a, c, g, or t
  misc_feature (407)..(407): n is a, c, g, or t
gtagaactcattttgctggctgaaagagtatggaataatatatctcatatgtcatttttgtagaagagaaactatttggatttcctttttgttggtttggttttccctaacacgtgtcngntgtacgcattcgtcacgtgcaagctcagcttgtgcagggttttttgtatttgtaaattggtttaaatacatggaattttatacaggttttctcctgtgttatatatgcattatgtgcaggtatgatattttcttcactactttttctatcttaatatagtgtggaattttattgtattattcttccattcttaatactgtaccacattcctgctcagaaactgctcacttccttaaattgtcttttcccccaagcgtgaaatgtatccacttataactgcctattncctgttctattagcatccaaaaatgtggaaggcctcccaa

SEQ ID NO: 8134 - DNA, 406 bp, Mus musculus
  misc_feature (365)..(365): n is a, c, g, or t
actgtttgcttgtcctcaaggtacctttttccttccaaagcaggaaattaccatggtggttagcctttagtagcagaaacgacaggcttaagaaagtggcttccatagtcaccatcctgtcacctcactgaattgcatcctgtagatgtagatttttgtgttaaaatgtataaatgtgtctttagtgcttttaagcaatggtctcagcagaattttctaaatgtatctgacctgacgaaaccaatttctagctccccttaggcttcccctccggcagctttacctgactaatggataagacttggtgggtaacgcggttgaagtgctcttgcagtccagggcctgcagaaccctcgcagtcacgnaaaggtgctccttgctagacagaaacttgctgacttccagt

SEQ ID NO: 8135 - DNA, 278 bp, Mus musculus
  misc_feature (93)..(93): n is a, c, g, or t
  misc_feature (114)..(114): n is a, c, g, or t
  misc_feature (140)..(141): n is a, c, g, or t
  misc_feature (155)..(155): n is a, c, g, or t
  misc_feature (161)..(161): n is a, c, g, or t
  misc_feature (170)..(170): n is a, c, g, or t
  misc_feature (175)..(176): n is a, c, g, or t
  misc_feature (180)..(180): n is a, c, g, or t
  misc_feature (188)..(188): n is a, c, g, or t
  misc_feature (194)..(194): n is a, c, g, or t
  misc_feature (214)..(214): n is a, c, g, or t
  misc_feature (216)..(216): n is a, c, g, or t
  misc_feature (218)..(218): n is a, c, g, or t
  misc_feature (234)..(234): n is a, c, g, or t
  misc_feature (236)..(236): n is a, c, g, or t
ttccatgtcgattcaaactgaccccaacttctgagtgctaaacttagcgttgacaatgtcaagcaaagaacctcttctacaactcagtccatntcagttctggtgctacctgantcggacacgatgtatggttcctggtnnccgggacggctggncctgtntcacagatncagannccantccctcantctagncctagaactgtggtgcactncntncagctcttggacaccntntcctcggattctgcacacaggttggactctcaatgtgaaccc

SEQ ID NO: 8136 - DNA, 491 bp, Mus musculus
  misc_feature (240)..(240): n is a, c, g, or t
  misc_feature (253)..(253): n is a, c, g, or t
  misc_feature (273)..(273): n is a, c, g, or t
  misc_feature (316)..(316): n is a, c, g, or t
  misc_feature (327)..(327): n is a, c, g, or t
  misc_feature (330)..(330): n is a, c, g, or t
  misc_feature (333)..(338): n is a, c, g, or t
  misc_feature (354)..(354): n is a, c, g, or t
atgtgtgctgtgacaaccttctaaagaaagaaaagttgggacctggctcctaatatgctctgatcatcccctggcaaaggcacccgattccacagctgtagttaaatctgcattcagacctctgacagattattttagtagagtttggtttgtactataataccgtactttgccctttgtacttaagtctttgataaattttcccttaactgtatgattttggacaagacatttcatagnaaatatttttttncaactcttaagttagaagtnatatccaatttactccaagtgacttacgttcaaaagtaatgtntcgtgtttgtntcnccnnnnnntgagacttaaatattncagtttctgttcacactgtggattgtgttctgtgagaaaggttacgtatgcttcaagtgaaaatatgttctgagtggacaagtgctgataaaagaattctctaggtgtaggagaaccgtattttatatctcagagga

SEQ ID NO: 8137 - DNA, 530 bp, Mus musculus
  misc_feature (322)..(322): n is a, c, g, or t
  misc_feature (337)..(337): n is a, c, g, or t
  misc_feature (390)..(390): n is a, c, g, or t
  misc_feature (392)..(392): n is a, c, g, or t
  misc_feature (397)..(397): n is a, c, g, or t
  misc_feature (442)..(442): n is a, c, g, or t
  misc_feature (492)..(492): n is a, c, g, or t
acaatttcatctatagtgtcacaatacaaaatgtcacaaaatattagagctgttacatacatagctataaaaagtatcggcttaagagctgaaggcatctttaagagaggagacagagaggaggcaatggaacactgacttagcggccagaacaattttatacattctcaagactgtcatgaaaacaaattgataattttttctgttacattacagtttgggctccagccatgcagttgatttagcagggaaatgcaggtttctcagcaactccaaatcagtaaacagatttagacgtagacaggaacacgaggaagggctntttttaaacatccantctcccagcatatgcacataaaaaggtgaatgaagcaacgtgaaacgtacttntnttcantcaagtgaaaaaggctaaacatttgttagctggtaaaatattgtntcaagtaagccggaagattccaaaattaaacagtggttgatatgttaacntcctcaaatatttgagtgcacacttcctttgagatctg

SEQ ID NO: 8138 - DNA, 520 bp, Mus musculus
  misc_feature (131)..(131): n is a, c, g, or t
  misc_feature (300)..(300): n is a, c, g, or t
  misc_feature (314)..(315): n is a, c, g, or t
  misc_feature (341)..(341): n is a, c, g, or t
  misc_feature (348)..(348): n is a, c, g, or t
  misc_feature (416)..(416): n is a, c, g, or t
  misc_feature (432)..(432): n is a, c, g, or t
  misc_feature (467)..(467): n is a, c, g, or t
  misc_feature (472)..(472): n is a, c, g, or t
  misc_feature (474)..(474): n is a, c, g, or t
  misc_feature (481)..(481): n is a, c, g, or t
  misc_feature (494)..(494): n is a, c, g, or t
aacttccctgccgaatattgtatcaatatttaatcctggctcaaggtcaattttatgatcttaagcaacttttcatgtctgcaaataatagtcctcctccctctaacgacgagtctccagaagacagaagntgtggagcagagcttgttggagaaggtgggactggctgggaatgacggggacccagtggaggagagcagcagggactgcgtggtgtgccagaatgggggcgtgaactgggtgctcctgccctgccggcacgcctgcctgtgcgacagctgtgtgcgctacttcaagcantgtcccatgtgccnngcagtttgtgcaggaatcctttgcantttgtgntcagaaagagccagacaaggacctactagaaacttcctgaagatatcacagccggaaagtgtactttntacacagggtgcaganccttgtgtccttagaggcaatcctaacacagaatntacantnttaactntcggagagagttntattttcacttcgcacttgtacaata

SEQ ID NO: 8139 - DNA, 51 bp, Mus musculus
ggctagtttgtagtccacatgtatgtaagactctatttttcagggcttcta

SEQ ID NO: 8140 - DNA, 434 bp, Mus musculus
  misc_feature (318)..(318): n is a, c, g, or t
  misc_feature (323)..(323): n is a, c, g, or t
  misc_feature (328)..(328): n is a, c, g, or t
  misc_feature (394)..(394): n is a, c, g, or t
ggacttcatgcattcctggatcaacgatggcatcccgcctgtcttctggatcagtggcttcttcttccctcaggctttcctgacaggcactctacagaactttgcccgaaagttcgtcatctctatcgacaccatcacctttgatttcaaggtgttgcccgaggcgtcatcagaaattaaggaaaggccccagacagggtgctatatccatggactgttcctggaaggtgctcgctgggactccatgaatttccagctggctgagtcacggcccaaagagctgtataccgagatggctgttatctggctcttgccagnagctnaccgnaaggtccagaaccaggacttctacctgtgccccatctacaagactctgacccgtgctggaacattntcaactacaggccactcaaccaactacgtcattgctgtgg

SEQ ID NO: 8141 - DNA, 490 bp, Mus musculus
  misc_feature (27)..(27): n is a, c, g, or t
  misc_feature (262)..(262): n is a, c, g, or t
  misc_feature (311)..(311): n is a, c, g, or t
  misc_feature (412)..(412): n is a, c, g, or t
  misc_feature (460)..(460): n is a, c, g, or t
gtagatctgcttccttgtcagaacttngctgtgttccctgtgattgctgccaccccttaaagcctcagacaccacccactaagacacaagacggcggctacaggtggccctcatgtgcctgtacctttcccggggccaggagtgtccatgtgccactgctctgtcccctcccttatttaactgcagccatctgtgcattgagtgttccgagtgagcaaacagtcagggtggggtgttttcacccccttcacctggggggggntgctccacctcaggaaggggttatgcaagatggcactctagctgcaggnccaacctgtgcacccagcctggccagtgggcaatgaggtctgatcagcccccgcacttgggttttctaagaacctgcctctgaaacacaggaaagctgtanccttcccatcctttggtgtagcagctcatctattaaaggcaaagcctntcttgaagctgccccagtaaatgagggtga

SEQ ID NO: 8142 - DNA, 442 bp, Mus musculus
ctttacgctcagtcaagggaggctattaaagtggtggtaactcacatggaacaaatcaaaagaaatcagatcctcaaacagcaggtgaaatgagcaattaaaaccctgcgcgctctcctgggtgcaggtctctctcaagccgcatccttgcaggcctatgcaccggctttcaacggcagggagcgaagactgggaaagggatggcagtagcagctaaagctgaaataataaaagatttgcatcctacaactatgtgcattctatttcttctcacatctaaccttgggagtcttacctaaaaagccttttgtgggccacgaatacttcctcttgaggctgcaatgcttcccatgctcgtcagtgctgccaggctcatcactttcaagggacagacataagtgttacggaaggatgtatgaaatattacaatctaccacctcaa

SEQ ID NO: 8143 - DNA, 335 bp, Mus musculus
  misc_feature (77)..(77): n is a, c, g, or t
  misc_feature (98)..(98): n is a, c, g, or t
acccctctgggcaacgtggaggaatgctaccgctactttaccagcgttctcttttgtcatggaatcaggcggccccntttcagcattgacctctttanagaggaacagctgctggcactggcagactatgtggtcaacacctacttccgccacttcaagctctacaaatatgtcttcaccccacaggtgcgactggacctatctttgacttacacggggttacagccactcacgctctggccagaggagaaagaaaacgaggagatgatggtggtagagcaagtagctactccacaggaggaagagccggaaactgtgacggagccagagcaaca

SEQ ID NO: 8144 - DNA, 426 bp, Mus musculus
  misc_feature (64)..(64): n is a, c, g, or t
  misc_feature (202)..(202): n is a, c, g, or t
  misc_feature (252)..(252): n is a, c, g, or t
  misc_feature (317)..(317): n is a, c, g, or t
  misc_feature (319)..(319): n is a, c, g, or t
  misc_feature (341)..(341): n is a, c, g, or t
  misc_feature (343)..(343): n is a, c, g, or t
gatgagccggcatagtgactgtgactactatacttggcaggtagaggcaggaggatcaaggggnttcaaggtcagccttgactacatatgaagttaaaggccaacctggactatgtgagactctgttttgaaacataacagtgagtcagaggagaagggcggtggggtagttacaggtttggatttacaaacctgacactantttctgcccagattgatatagattgtttggttggttttttaattattttnttccttttttaactagtgcttcaatttgtatctaacaagagatgtttccctctttataggatctntncttgtggacagaaggaccatgntnttctaactcaatgatgttctagaactgggaattactggtaacaattggttagtcatctgaaaatagagtgcaagacccaaatt

SEQ ID NO: 8145 - DNA, 398 bp, Mus musculus
cttggagactatgggagcctctgcacccagggaaaatgttaccctttacaggggggaagggtaaaccagtagggaatacagtacaatcccaaccctactgggaggggcgggagggaggtgttgccgtcactgtactaagtcgatgttgggaaatgttttaacatctggagcctttgtgggtggaaatctgtctccaattacaactctgcactggatgtgaagaagcaaaaactattccgtctactcacagaacagtactttctggaatattatgggggattgtaccaaaacaagaaccacttaaacaatgcctagggaatgataaggaggaggaaaatcccaggtccacagcaaaggacacctaagagtgggaggctgcagcagtaaggtggcttttt

SEQ ID NO: 8146 - DNA, 436 bp, Mus musculus
  misc_feature (224)..(224): n is a, c, g, or t
  misc_feature (243)..(243): n is a, c, g, or t
  misc_feature (279)..(279): n is a, c, g, or t
  misc_feature (326)..(326): n is a, c, g, or t
  misc_feature (411)..(411): n is a, c, g, or t
aaggcagttgtcatacttgctaaagagttcatgtttaacatttcactgaaatcactccaagcctgcactaaataccaatcgagtgttattctgcctatttctgtgttgtgctctttgagcaacaaactacggggaaattctgtgaaaacaaaaaattcttttcctttttttaaaaaatgaatgactgctgtattaaatatacgaatatacaagctttttttttnaatttaaatacacttctgncaaggttatagatgattaacctctgttcatagactnatatatggaagtagagttttttgtttactttgaaactgtttcaagtncaattgtttcttataaaacatggtcgattaccactaaattctcattttagctggttatctgcaaatatatagtatgtatccactntctcttcttgtgatatttagtttgc

SEQ ID NO: 8147 - DNA, 288 bp, Mus musculus
agggacatagcctctatcctgcaatcacagaggcccggagaccctgcctgatgctgcactcagaggtcttgaaatcaggtgtgtttactttctctgaggaggacaaagtacaccctggtgagagccaagactgaaggccctgggtggccttctctgctaacgccctgtgaaccgaacccaatggactactgtggttaggaagcattggactttgttgttcaacgtatagagtctgagagagatgatacgtcagtgcaagctctgggaactctctgctgtagctcaatg

SEQ ID NO: 8148 - DNA, 478 bp, Mus musculus
  misc_feature (106)..(106): n is a, c, g, or t
  misc_feature (311)..(311): n is a, c, g, or t
  misc_feature (320)..(320): n is a, c, g, or t
  misc_feature (324)..(324): n is a, c, g, or t
  misc_feature (341)..(341): n is a, c, g, or t
  misc_feature (345)..(345): n is a, c, g, or t
  misc_feature (355)..(355): n is a, c, g, or t
  misc_feature (359)..(359): n is a, c, g, or t
  misc_feature (402)..(402): n is a, c, g, or t
caaggtatgtttgtgcagcccaggagtgcaaggccttgaggaatttaagaattctacctgttcccagcaagagaaaccaaggtgactggtattttgtttgtttttntttttgagagtagcccaggctgacttcaaactccctgtgcagccaaggatgatcaggagttcatgatcctctggtttcccttcccagaggacaaagaacaaggggattgcagggactgcccagcagccttgaactttttgttttgtgatgttatattgagacagggtctctctgtatagtgctggctgtcccggaactcgctatntagaccagnttgnccttgaactcacagagntctncctgcttctncctnaccagtgctaggattaaaggggtgcactgctatgcccagctgntcttaaactatgaatcctcctgtctccacctccatgtttctgggattattggcatatgtcaccacatacccatctt

SEQ ID NO: 8149 - DNA, 190 bp, Mus musculus
  misc_feature (97)..(98): n is a, c, g, or t
  misc_feature (100)..(103): n is a, c, g, or t
tcagcttggctctgctgagaacagacctgagcaaagccttcctcagcagagactccagctctcctctgcctttcagcagcagcagcagcagcagcannannnncaacaacaacaacagcaactacaacagttgcgattcttgcagcaccaaatggctatggcagcagcagccgcacaaacagcccagcta

SEQ ID NO: 8150 - DNA, 479 bp, Mus musculus
  misc_feature (121)..(121): n is a, c, g, or t
  misc_feature (127)..(127): n is a, c, g, or t
  misc_feature (140)..(140): n is a, c, g, or t
  misc_feature (147)..(147): n is a, c, g, or t
  misc_feature (157)..(157): n is a, c, g, or t
  misc_feature (164)..(164): n is a, c, g, or t
  misc_feature (173)..(173): n is a, c, g, or t
  misc_feature (199)..(199): n is a, c, g, or t
  misc_feature (215)..(215): n is a, c, g, or t
  misc_feature (243)..(243): n is a, c, g, or t
  misc_feature (275)..(275): n is a, c, g, or t
  misc_feature (314)..(314): n is a, c, g, or t
  misc_feature (375)..(375): n is a, c, g, or t
  misc_feature (421)..(421): n is a, c, g, or t
  misc_feature (423)..(423): n is a, c, g, or t
aaaatggctgctactctgttcggagaaataccatattcaacggttcatgaagctttgcacaacttccttaagactgaagaactgcaacctggttattccatgtccaactatatgtatacanccaagntgttatgttgaancttgggnaacctcaggnaggcttntaaattctntaacttggcattgctactgcctgttntcaccaaagaggacanggatgcccataaagaggtgaagaaaatnatcagttctttgaagaggaaattccatacaanttcttctgtgtgaatactaatttcctgcggttgcttcantcaccattcaagatacctgaccttggaaaaaacagatcatggtcagcatgcaggtgttgantccagactaacaggaccccttccacgtaaagatgaaggacacagantntgacttttcaggagacttcgtgtacaatgctggaccaagggagttctaatccagaa

SEQ ID NO: 8151 - DNA, 339 bp, Mus musculus
  misc_feature (277)..(277): n is a, c, g, or t
gatgaatccgcttcaggctgggagatctgagagcaggatgcactgtgtgttcagagccttctaccaaggtacatttccttggcattatgacttgataaaactgagagcatttgctacaactttagcttttttagtataaaagctcaagccaaggtaaatgaggaggcccttgggaacacagtgacccttgtaccaggctaggaggttacaagcccctgagactgagtgtccagaatatcagcatgcaggttctatgtttaactgcaggtggagtgangtgggtgttaacttttattttgatcaccttgtagtcttttaaacccttggtctctgaggcca

SEQ ID NO: 8152 - DNA, 515 bp, Mus musculus
tggaatcacctcttaccaacttgaagagccccaccccaccccaggtatagggctggtgctgccatcggccttcacagcgaagctggtggcagcatcctgtctacagagagcaaataccccaaatggaaagctgagaaactgacatgtgtcctagtcagtaagcccactgggaaatgatgggttttgttttatttgattgatttgcttggcgtagcaaaggtgcctttcccaccctcctccctttaaactttgttttgtaagacttgtttgaaacccaaacaagtccaaaagactcgcactgactgttacctttgtccaggctatcccaaacttctctatgctctcattttattaaaagcaggtgctccctggaatctctgggacctttctgaggcattcaaagcagaatataaagagtggtctcatctccttccttaatcctggtggttgggatgtcccacttgtatcatagttgtttttattattactgatgtgctccgctgtttttaaatgtg

SEQ ID NO: 8153 - DNA, 495 bp, Mus musculus
  misc_feature (310)..(310): n is a, c, g, or t
  misc_feature (352)..(352): n is a, c, g, or t
  misc_feature (403)..(403): n is a, c, g, or t
gtgctggatagccatggtagcctttggcgtgccccttttgaagcatgaactcttgtgttcagtctttctaactgattagacaaacctctagattctggtttaacagatttctgctgcctctgtctccatcctaaccatacttttgaagtttatacagaaagctttaagagtttagtttgtgcccttggtttttatttttacaactgctaaaatacctctgtaagccttatcctttatcctttcatagttgtataaaattgtatagaattcattcaccaactgaaatgttggatatctgtaaatgagaccnaaatgtgggttgctttttttcataaaataatttctattgggncgttgctgtgacatgaacagcagccagcctattaactgtgaatgccttgtntcgtcagtatttgcattacattcataaaagtgtgcaagtcctgtgactcccagcttaactaaatactgttatgccacttaacgagcacagca

SEQ ID NO: 8154 - DNA, 472 bp, Mus musculus
  misc_feature (233)..(235): n is a, c, g, or t
  misc_feature (254)..(255): n is a, c, g, or t
  misc_feature (258)..(258): n is a, c, g, or t
  misc_feature (261)..(272): n is a, c, g, or t
  misc_feature (298)..(298): n is a, c, g, or t
  misc_feature (318)..(318): n is a, c, g, or t
  misc_feature (320)..(320): n is a, c, g, or t
  misc_feature (326)..(326): n is a, c, g, or t
  misc_feature (331)..(331): n is a, c, g, or t
  misc_feature (333)..(333): n is a, c, g, or t
tgttctctagctgtctttctagaacacgcacatatatttatttttattgaatatccattgcctttagtcaatgtttcctttccctcagtgtcaccaaagccaaatgtcattgctaacaatgtttttgagacgcctgtagggaataaaaatactggctaaagggaagggtttctcttcatgaatcctaactaatctccctggggcagggggcttcggagtaataccttctgttnnnctgttctgttctgttctgnnctnttnnnnnnnnnnnngttttgttctgttctgttctgttctnttttgtttgtgataagaacnanaggaantctcngnctgtgagtttgagtgactggattagaaacttcagattgttaaatttagaaaaatgttaactgtcaaagtgaatgcttttgtggtttctcttaaagcacttcaccatatacctcaaagattaccaacgtcactttgtaga

SEQ ID NO: 8155 - DNA, 504 bp, Mus musculus
  misc_feature (134)..(134): n is a, c, g, or t
  misc_feature (317)..(317): n is a, c, g, or t
  misc_feature (467)..(467): n is a, c, g, or t
tgcgattccatccaagggcttttgaagaatgtgacccaacctcaggaaacttgtgtttctcctaagccttatgggagtggttgtccctgtcgctctggaatgagagcaggtacagagctggagggccgtggccnaggccgcttgtggcctgctgggcagcaagggccttgttgccagcagaggcccaggtgtgcaggaggcagggccaaccctggcatcagctgcttatttctaagcttgtcctttaggggaaagtgaaaccacgacctgaatctggcagacggggcgcagaaagaagatggtttgggttttccgtntcctctgcccaaagctgagagctgcttcagggatgggcagagaaccttttcccaccacctccttaggatgcacggggctatggcagccaccctggacacgtggatgaaaacttcgagattctaagagtcagatccctaatgctactgaantcctaggtgaacaataaatgttcctccacatccctat

SEQ ID NO: 8156 - DNA, 470 bp, Mus musculus
  misc_feature (283)..(283): n is a, c, g, or t
  misc_feature (326)..(326): n is a, c, g, or t
  misc_feature (337)..(337): n is a, c, g, or t
  misc_feature (350)..(350): n is a, c, g, or t
  misc_feature (358)..(358): n is a, c, g, or t
  misc_feature (370)..(370): n is a, c, g, or t
  misc_feature (376)..(376): n is a, c, g, or t
  misc_feature (390)..(390): n is a, c, g, or t
gaaatattcggctgccacgaaacaacaaaggacaaccccctgctatggccgaatgtcgagtatcaggtcttaggtggccagacaaacaacaagattatttttggccaaagaaatgggatctataccttccatctgtctgtggtagatccatactacagctactgcaacctgaacaccatattcagcgtgtacgtgcacggggccttaccggtgacgaagttccaaccattgctcaccatcctcctgatggtcaccacaacgctgctgactgcgtggctggccntatgctatccccaaacagctgaggagtgagaaaggccagcganttctgggtttntgctaccagatantccagctntgcctaggggtntgcttntgcacctggctgcntggcaaactgagacagtggctgcgccccagaagggtgaaagaccagaacagaggcaaggtgcgagttgcccagaaacatc

SEQ ID NO: 8157 - DNA, 441 bp, Mus musculus
  misc_feature (83)..(83): n is a, c, g, or t
  misc_feature (317)..(317): n is a, c, g, or t
  misc_feature (378)..(378): n is a, c, g, or t
aagcttgggcccttttctagcttctctgacaccggaagccctgtaccctgttcacacaagatcctggtttagagaattgtttnatacctttcaaggaaaggccagtggagctaatacagacacgactggggctaaacagaggtaaagcaaggtgctttgagataatacagtcattttagtatttaatgcagtgtcaatggatatggaaccctagctgctttgaaaatttatggagactggcgtttaccagaaaaaagtgtttgactgtcccattagttagactcgaatgtaaccagtttacctgaaaggtcgttggncagacacattagaatctaactgcatgtgtattaggaagcttgactgagataagcttccagntccccgatttctccatccagtaaaaggagaggctcctcttggtaccgctcagcgatcagtgct

SEQ ID NO: 8158 - DNA, 504 bp, Mus musculus
  misc_feature (56)..(56): n is a, c, g, or t
  misc_feature (340)..(340): n is a, c, g, or t
  misc_feature (345)..(345): n is a, c, g, or t
  misc_feature (418)..(418): n is a, c, g, or t
  misc_feature (454)..(454): n is a, c, g, or t
  misc_feature (456)..(456): n is a, c, g, or t
agagtgacatcgtcagcaccgcggaccactactacgcggccttctgagcagagccncggagcaaagcgggaggctctaccctaggttctgctcacaggcccagtaaagacttacacatcccatagtaagctctgataagtcacaggaaaataggactgagacagatggctctgatgtcagccatgacacacacaagccctccttgtcagctccctggctggacttcccatcactcagaacagaatgggagaaaacggtgttgctggtttaatcactgtgtctgaattcaggggccccgtctcgatagaggggcatcccagggcgaaggctcctccacatntgaanctggagcagaaatagcagactacaccgtctgaaaacgtcacactccaagctaccacatacatccccaccaggntcccctgatgtgtcaagagctcgtataggcgcatcntntcctacagtaattgacgtttgcctcagtttcctgggacttcagcagta

SEQ ID NO: 8159 - DNA, 514 bp, Mus musculus
  misc_feature (234)..(234): n is a, c, g, or t
  misc_feature (265)..(265): n is a, c, g, or t
  misc_feature (267)..(267): n is a, c, g, or t
  misc_feature (340)..(340): n is a, c, g, or t
  misc_feature (364)..(364): n is a, c, g, or t
  misc_feature (381)..(381): n is a, c, g, or t
  misc_feature (406)..(406): n is a, c, g, or t
  misc_feature (413)..(413): n is a, c, g, or t
  misc_feature (415)..(415): n is a, c, g, or t
  misc_feature (417)..(417): n is a, c, g, or t
  misc_feature (419)..(419): n is a, c, g, or t
  misc_feature (422)..(422): n is a, c, g, or t
  misc_feature (476)..(476): n is a, c, g, or t
atcttccgaggctgtcctagacatacactcttcggtctgagtcagcattaccagcttatccaagagaagtcctatcatattcatcaacaacgtcgaaagtagcctactttaagagaaaatatgcagaagaagaagatctacatcaagattcccatgggtattttccaaaacacctgatattaccggaagacaggacttgtatcctcaaactttccctagagaagctcaggtttnttgaagacccagaaacctacctaagaaggtntntgttaattaacaatttgctgaggaagatacacctagagacggagaaagagagctatgaatacttcaaggaagntccctgctataagactgcttattntgatacgagaaaacggntgaagtttatggtacaggagtgctnttcccantntntntantatgaagagctgcactcctaccacattgtgccttacacttcggagagtaccatntatgggatgggctacactggtgaccacttggagcaaaa

SEQ ID NO: 8160 - DNA, 574 bp, Mus musculus
gaagactacttcaatgactttgccaaaattaaaaagccatataaaaagagaatgacagctgaggcacacagacgtgtggtggtggaatacctgcgggctgtcatgcagaagcgtatttcctttcggagtgctgaagagcgcaaggagggcgccgagaagatggtcagagaggctgaacagctccgcttcctgttccggaagctggcgtctggatttggtgaggatgcagatggacactgtgatacaattgttgcagtggcagaggtcattaagctcacagacccttctctgctctatctagaagtctcaactctggtcagcaaatatccagacatcagagatgaccacattggtgcactgctggcactgcgaggagatgccagccgggacatgaaacagaccatcatggagacgctggagcagggccccatgcaagcaagccccaactatgtacccatcttcaaggagattgttgtgcccagtctgaacgtggcaaagctccttaagtagccctgtcctccctgctgccctatgtgtctttactgtgtggcttccctgttgtcaccatattaaa

SEQ ID NO: 8161 - DNA, 367 bp, Mus musculus
  misc_feature (341)..(341): n is a, c, g, or t
gtgtgtttactagggactggccgtaatagttcccttaattttgacaatttagaggaagctcttgggtttgtattaaatggagcattggcctttgggagagagacattttactgccaccatccccattcttaatttttctatcctctactaagatgaacttccaatttacaattgtcccaatcatttacatttcagagggtctacaggataggtaggttatggagcgaatagtgaaggtagtagaagctaaatagggaggtccgtaggccaacccctgcaccaataccatccactcttgtctcctacctgaagacaacggccttggttttcttttgtggggnagtgtagcatactgagtttttccttt

SEQ ID NO: 8162 - DNA, 464 bp, Mus musculus
  misc_feature (109)..(109): n is a, c, g, or t
gatggctcagatcagcaccaatattgaacagctgatgaaggcaccaagtctgaaggaggcagaaggaaaggaacccgagcaattcctaagtagatctaggcctgtggcnagccaaggccaagcaggcccatcttaccaccctgaagcacatacaagcaccctggtggaagaagcttggagaagaaccaggggatgaggttgatgttccaaaggatgagcttagtatagatttaggaatgttatttatcggtggaaccaaacctccctagagagtactgtgaaagctggcaatcttaccttttaagagattgttagttttgcctctggcatgcaggaagactagggctatgccagtggctttccagagcatcatcttcatgcaacacttggaagcaaaaagcaaagcattgcctacctcactctcaattctttcccctgtctctatgccctgtctgtgagcttta

SEQ ID NO: 8163 - DNA, 539 bp, Mus musculus
tctcagcgagaccttcgagggcttcctctgcaatgtctgatatagaaactaatttgttcacattttagttgtattcaagatttgaagatgtattttatagacaagttctgtttttgaactttgtggaactattccaatcaatttaccagttatgatgagtatttgcattatgaatgtataatccagacattatttgtaaagcctacagtatgttttttttacctaacactttttatactgtgtctcgtctcgacaatatgatattgaagtctgagtcgtcagcttgatcccttcaagtttctagttacagacaaaaatcatactgtgattttatttttaatatggatatgctataaaactgtgacacttataattcactggtcctgcatcaggagacgggagtggggagaagactgtatttaatacagtgtgtatctgaatactctgtatggtttatacagtttgtgttgttcagagatgtctaaagttgatctttgtttttttaagattaaaaaagcacttgccccactgtatatata

SEQ ID NO: 8164 - DNA, 516 bp, Mus musculus
  misc_feature (49)..(49): n is a, c, g, or t
  misc_feature (184)..(184): n is a, c, g, or t
  misc_feature (190)..(190): n is a, c, g, or t
  misc_feature (222)..(222): n is a, c, g, or t
  misc_feature (314)..(314): n is a, c, g, or t
  misc_feature (317)..(317): n is a, c, g, or t
  misc_feature (338)..(338): n is a, c, g, or t
  misc_feature (343)..(343): n is a, c, g, or t
  misc_feature (378)..(378): n is a, c, g, or t
  misc_feature (399)..(399): n is a, c, g, or t
  misc_feature (426)..(426): n is a, c, g, or t
  misc_feature (428)..(428): n is a, c, g, or t
  misc_feature (441)..(441): n is a, c, g, or t
  misc_feature (486)..(486): n is a, c, g, or t
gaaggctgtcattatgatttccatttcatgtttcagttagtcatgcatnagctatgtttttggatgaagggttattattataatgaaaattttcaaatgtgactcctcacagctcatgccttgcccatgttccgtgagccccgccagcgaagtacgaggaaacagctggagaaggacagactgnaccccntgaagtcccacaaaccagagcctcctgtagcnggcccaggtcgtggtggccgagttggaacccacgggggcaccctgtcctcctacattgtgaagaacatcgctttggacaagaccgacgacancantccccgggaagccattttgcnccatnccaaagcagcagaagataacccatattgggtttcnccagcatattccaaaactcanccaaaaaccatgtttgcccaagtggantntgatgatgaagantcaaagaatgaaccagaatggaaaaaacgtaaaatttgaagaatntcgttgaagagctatttgcatggagcaaca

SEQ ID NO: 8165 - DNA, 433 bp, Mus musculus
  misc_feature (238)..(238): n is a, c, g, or t
  misc_feature (254)..(254): n is a, c, g, or t
  misc_feature (256)..(256): n is a, c, g, or t
  misc_feature (367)..(367): n is a, c, g, or t
  misc_feature (370)..(370): n is a, c, g, or t
  misc_feature (372)..(372): n is a, c, g, or t
gcaaagaagaccactacagcagactcattgaggagaatgacaagtaccggagacacgtaggcagcctgataaataaggtaacgtcatatgaagaaattatcaaatgtgctgaccaaagacttgagatatcacattctcagattgcacagaattctgcacagtgcctgcttctaatagttactcctctttccctgagagctatctttaagcctttgatgaaggctgcctctttagtcgnaagtcctcgagaggangncttggaagagaggaatagacatttagaagatttaattagaatgcccagagagaaagccaaaaggccaagaccaagattagataatcacccaaagtccttgaccttgataantcntnttgagggccaccataaagaatgttctatttccttgtgaactgacagtaatacatgattaaa

SEQ ID NO: 8166 - DNA, 289 bp, Mus musculus
tgaaaaggcacttcaagcccacactattgagattacaaagctgggagggcttctggagagcaaagaagaccactacagcagactcattgaggagaatgacaagtaccggagacacgtaggcagcctgataaataaggtaacgtcatatgaagaaattatcaaatgtgctgaccaaagacttgagatatcacattctcagattgcacagaattctgcacagtgcctgcttctaatagttactcctctttccctgagagctatctttaagcctttgatgaaggctgcctct

SEQ ID NO: 8167 - DNA, 542 bp, Mus musculus
  misc_feature (336)..(337): n is a, c, g, or t
  misc_feature (339)..(339): n is a, c, g, or t
  misc_feature (361)..(361): n is a, c, g, or t
  misc_feature (386)..(386): n is a, c, g, or t
  misc_feature (388)..(388): n is a, c, g, or t
  misc_feature (395)..(395): n is a, c, g, or t
  misc_feature (402)..(402): n is a, c, g, or t
  misc_feature (407)..(407): n is a, c, g, or t
  misc_feature (418)..(418): n is a, c, g, or t
  misc_feature (450)..(450): n is a, c, g, or t
  misc_feature (452)..(452): n is a, c, g, or t
  misc_feature (506)..(506): n is a, c, g, or t
acgccttgtcatctttaataccagacattggcagtaattcgctcagctgcacggcttcattaaattggcatggaccctgaaatctctgaacaagatgaggaaaagaagaaatatacttccgtctgtgttggcagagaagaggacattagaaaatcagaaagaatgacagctgttgtccatgacagagaagtggtcattttctaccacaaaggggaatatcatgctatggacattcgctgttaccattctggagggcccttacacttgggagaaattgaggatttcaatggacaatcatgtatagtttgcccctggcataaatataaaatcactttnncnaacaggagaaggattataccantctataaatcctaaagacccatcancnaaacccnagtggtnttccnaaggagtaaancaaaggattcacaccgtgaaggtggataacgncnatatttatgtgacactttctaaggaaccatttaaatgtgactctgactattatnccactggagaattcaaagtgattcagagttcctcct

SEQ ID NO: 8168 - DNA, 482 bp, Mus musculus
ggaacattgctagctgctttacctttgcttcaggtgcttggtaatgctgaagctatccttagacaaagaaaagacatgaaagaagtccttgaagatataccaagaacattcatcagtatcattcattcgtgtttggatttttatgatcacccgatttcttcatcatgcattctgcgtttgctaaatgacagttactacatcaatctgcagctatcaaaaatgagggaaaaggttcaggctgttaacaatcccatgcagtatttaaatacacttacttggcagagtctatacctgcccctgtttccttgctgtatttcaggcaaggtttaaagagggcaatttgtgctgctgttagtgcaactgctgtgtatgttgagccactgttgtcatgccagtcaggtgcaaaggcagcttagctactgaggtattgaatgttctgaggacattctagacaacagcttagatcctttttcaggctcatt

SEQ ID NO: 8169 - DNA, 540 bp, Mus musculus
  misc_feature (114)..(114): n is a, c, g, or t
  misc_feature (337)..(337): n is a, c, g, or t
  misc_feature (356)..(356): n is a, c, g, or t
  misc_feature (363)..(363): n is a, c, g, or t
  misc_feature (369)..(369): n is a, c, g, or t
  misc_feature (388)..(388): n is a, c, g, or t
  misc_feature (421)..(421): n is a, c, g, or t
  misc_feature (455)..(455): n is a, c, g, or t
  misc_feature (462)..(462): n is a, c, g, or t
tagagctatttgtctttccctgtccttggtcttagtatttgacagttgggttttttccctcccatccaaagtgtgctcattagaggggctctaactgttgggcagcagcttaanccccagtgttcttccaggtgctctgcctaacagctcaaggggaaagtgaacactcagtttacccaaacccacttcttttcaagctagctggagaagtctctccatttattttgactccacaggcctctggtaggctgagataccagatagttatggttgtggtatcatctgttccccaaacaggagaggcctgccggagccaatgtgaccagcacgatagttnctgctagacaccactcctntcaagancctttntcctttttttttttttttnccccacgtttgtgtattttccctgtgacactgncaatggggtactttttcatccagagaaaaacttntcagtgntcccaagaatgaatttccaggggattgcgggaggggaaagagcaggggctgtggcagcgagttttcgtgttgcacttt

SEQ ID NO: 8170 - DNA, 367 bp, Mus musculus
agcacttgatgttttatctttttggttgggctggggcttgaacctggagcttccttcctttatgcatgctaggcaaagcctctaccactaaaccttattcccagcccctcacctctttccaaatatagaaaagctgaagatttttgttcagcaaggatgagcatatatactgtctgcacagaaagcaatgttcagacatgaagtgaaaacacagtatttgaaggtggtcaaagacaccctaacacaagggcgagacaaaagggacaggtttgattccacctgcataataatatataaagtgtggtgtgaattcacaaaggtaagagcaaattgatgcttgccagaccatgagtacacagaagctgtt

SEQ ID NO: 8171 - DNA, 458 bp, Mus musculus
  misc_feature (358)..(358): n is a, c, g, or t
  misc_feature (367)..(367): n is a, c, g, or t
  misc_feature (379)..(379): n is a, c, g, or t
  misc_feature (389)..(389): n is a, c, g, or t
  misc_feature (391)..(391): n is a, c, g, or t
  misc_feature (421)..(421): n is a, c, g, or t
gttctggcttgtctaaatgctgctgttggcatgcctgactgtctgcttttcccaggcgaagtccatcacgaggtagccaattccggaggctcttccctgctcccacagttttactttgtagttagctctgtgaaaacaacctggcaagattttatatgccactgttccagaaagcagacaagtcaaggtggcttgtccgtatcttaaccccctccagtcaggaggctgagttccctcccccatgccagtggcccaaggagaatgagacagggttagaagtcagagtggtctgtgctgtccggaaaggcagtggctgcactaactgatgtggagctgggaagctttggggaccgggcanccatactancagtgggtgaancaagagacantnccctggtgcaacacaggaaatgctggaatnccttttgcgtattgttatagctgttgcaacctgggtc

SEQ ID NO: 8172 - DNA, 549 bp, Mus musculus
  misc_feature (122)..(122): n is a, c, g, or t
  misc_feature (372)..(372): n is a, c, g, or t
  misc_feature (389)..(389): n is a, c, g, or t
  misc_feature (399)..(399): n is a, c, g, or t
  misc_feature (425)..(425): n is a, c, g, or t
  misc_feature (438)..(438): n is a, c, g, or t
ttgctgatggcatacacaccaaccctgcagctctgcgcattgctcaccgggcccatccccaggggctggtgctggtcactgatgctgtccctgccctgggcttgggcaatggccgccatacnctgggacagcaggaggtggaggtagatgggctaatagcgtacattgcaggcaccaagacactgggtggcagcatagcccccatggatgtgtgcgtccggcatttcctgcaggctacaggctgtagtgtggagtcggccctggaagctgcctccctccaccctgcccagatgctggggctggagaagaccaaggggagcctggactttggtgctgatgcagactttgtggtgctcgacgacactctccatntccaggccacttacatntctggtgaantggtgtggcaggcagaggaagctggnccgtgactgaggntcttggctggaaaggacacttggagaggccaggcagtccacggagctggtctccagggagcaagctgagagccctgccctatgtctaaaacagaacctcagtcatcactcc

SEQ ID NO: 8173 - DNA, 444 bp, Mus musculus
  misc_feature (55)..(55): n is a, c, g, or t
  misc_feature (275)..(275): n is a, c, g, or t
  misc_feature (280)..(280): n is a, c, g, or t
  misc_feature (283)..(283): n is a, c, g, or t
  misc_feature (289)..(289): n is a, c, g, or t
  misc_feature (293)..(293): n is a, c, g, or t
  misc_feature (298)..(298): n is a, c, g, or t
  misc_feature (315)..(315): n is a, c, g, or t
  misc_feature (336)..(336): n is a, c, g, or t
  misc_feature (350)..(350): n is a, c, g, or t
  misc_feature (376)..(376): n is a, c, g, or t
  misc_feature (381)..(381): n is a, c, g, or t
  misc_feature (386)..(386): n is a, c, g, or t
  misc_feature (392)..(392): n is a, c, g, or t
  misc_feature (397)..(397): n is a, c, g, or t
  misc_feature (406)..(406): n is a, c, g, or t
gatggtggcactcagaaatctaacaaggcagctaagtgctttctgtttgctttgnatttcctgcccaatatgtactgaatgcggtgtttattaacatttggaatgacttgccgaaatcatgtggtttttctcatgcctctatgttaattctcacgcatcagattaaaaggggctggtggttttctgtcttcaagatgcatgctttcattggacagcgtccccggggaagccacaccgtagcttacagaaacactggcccttggatttgttccccnttgtnccnagcacncacnccttncctttcattcctttttnctctcagagcttaccttcagnacaacttaaatcantgtggttagaagagaagcgagctccngaagngccanctgtanccctntcacatctncaatggcatcagtatggaaacgtgatccctgatagctt

SEQ ID NO: 8174 - DNA, 309 bp, Mus musculus
  misc_feature (73)..(73): n is a, c, g, or t
  misc_feature (107)..(107): n is a, c, g, or t
  misc_feature (120)..(120): n is a, c, g, or t
  misc_feature (123)..(124): n is a, c, g, or t
  misc_feature (133)..(133): n is a, c, g, or t
  misc_feature (151)..(151): n is a, c, g, or t
  misc_feature (170)..(170): n is a, c, g, or t
  misc_feature (172)..(172): n is a, c, g, or t
  misc_feature (209)..(209): n is a, c, g, or t
  misc_feature (211)..(211): n is a, c, g, or t
cagggtgcagccagagggtttaaaagcaccaagaaaaaaaacaaacaccactgatggatcctggcaaggaaanccagacagactattcagggagtggtgtgccaggncctttttctcacnttnnggatcaatnccctgtgctggacccttntcacctccttatttccatntntggtcacttgaagcaaccagtgtatagaaactcagantnttcagattccagaaataaccaggacacactgaaggacagagatggagaggccacctacctgctctgcagcggctactctaagaatgtcactattaaac

SEQ ID NO: 8175 - DNA, 506 bp, Mus musculus
  misc_feature (127)..(127): n is a, c, g, or t
  misc_feature (295)..(296): n is a, c, g, or t
  misc_feature (298)..(298): n is a, c, g, or t
  misc_feature (317)..(317): n is a, c, g, or t
  misc_feature (331)..(331): n is a, c, g, or t
  misc_feature (350)..(350): n is a, c, g, or t
  misc_feature (366)..(366): n is a, c, g, or t
  misc_feature (391)..(391): n is a, c, g, or t
  misc_feature (396)..(396): n is a, c, g, or t
  misc_feature (403)..(403): n is a, c, g, or t
  misc_feature (421)..(421): n is a, c, g, or t
  misc_feature (441)..(441): n is a, c, g, or t
  misc_feature (481)..(481): n is a, c, g, or t
cagctccttcagaacgtgggagcaaaggtgagctttgcacttgcttttcccataattcattgtgactttttaaagccttcaattttttaaaaattgtttttatatttgggttttggttttttttttntttttttttgcttgttttaagattatttttaaaaaaccagaggtagaagtagacggctttaaaaccgtgaggatttaccacttgttttaacagtgaactcctggtttgcagtgttcagaaacatgtatgtgaggcagaaacttgggtagggaaggtgcagatccattnncntgtaacatgttcagtgttncagtgacctgaaangccaggcagagctggagcntctgggtaaatgagtntctaaggagggaagagtgagcatgnccgantctgggntcacctgtgaggccactntctggcagcttcctgggcantccccacaaaaatgctgggaaggagtgagtgggtgttgcntcgcctggttttctacaagtactgt

SEQ ID NO: 8176 - DNA, 297 bp, Mus musculus
gtgagggtccagatctaaaccagcaggactgtcccagagtttgcagagaatctggcttcctaagatgaaggttttgagtgaccttagtcctggtagcctgatgtcagactccctgtcaaaaagctggctttactaggcagccagtgctgaaagctgtgtggaggtagggcagtgaggagatggaggataaataataacctgagtgctttgtcaccatggaaactggagttcctgaggccacagcccatgctgaagagcttttgagcatgcccctgacatgcttggtccagaggctat

SEQ ID NO: 8177 - DNA, 427 bp, Mus musculus
  misc_feature (380)..(380): n is a, c, g, or t
  misc_feature (383)..(383): n is a, c, g, or t
agaagtgtcgcgctctgaagctgcagcgggaagaggcagctgaagtggctgccctggatgttgccaacatcatcagcagtacaggccggccacgaagacgaaatgcctggaacccttcaggggaagggacctccccaggagagacttatcgccgaaccctggactcagaagaggagcagccgcgccaagcacctccagactggtcccatatgcgtgatatcatcagcagtgacggtgacagcagctgaactcccgtgtccatggtggaccttaccctgttatacaagagcctggtcagtggaagcaacttccaaagacagactacagtggcaggatccaagttattggcacactactcaatttcatgttctctaagatgnccnttggggttcatgtgcaagcatcctctccaggcatttgagtggac

SEQ ID NO: 8178 - DNA, 459 bp, Mus musculus
  misc_feature (265)..(265): n is a, c, g, or t
gatgctgtccttggaggtatttaatatgcaataggtagcacctttactaattaatctgcatatgaagggtttcctgatgtatttaataagatgtgtagaagctcttcaagcattaaactaaagttgacgttttatttcattgacttttcactgtcaaagaatatcaaccacttacaatggaattgaagtctgttacctaatggtatttgggccttttaatttctgaagcttctagattgtttgtattgtgaggtacaaaaaaaantgctgcagatctaggaatgtatgttcttagcaagtgtttgaatgatgtaagcattatttaccattgaagagtacgacccctatgttcttaagtaaatgcttagtaacccatatacatttttgcaggtacaaaagtatataaacattgtataatgtgacagttgtataatttatgtactctgatgcatgagtcag

SEQ ID NO: 8179 - DNA, 338 bp, Mus musculus
  misc_feature (99)..(99): n is a, c, g, or t
gaaatcctggcatatctggcatacgaaaccgtggcccagctggtggatctggctcttctagtgaggcaagatatggtgtccaaggcaggggaccccttncagccatgccatttctgcaaccttcattcagtaccacaactctgctgaggggtcctcatgtttgaagtccagcccagactctcctgagaacacacctcctcctacaccaacagctccctcttctggatcacagcattcaggtagagctgcatctggttctttggggaatgggaacacaggacaagacactgccaaaaccaagcagcggaagaggaaaaagagcactgcggcctgtggtg

SEQ ID NO: 8180 - DNA, 524 bp, Mus musculus
  misc_feature (367)..(367): n is a, c, g, or t
  misc_feature (380)..(380): n is a, c, g, or t
  misc_feature (392)..(392): n is a, c, g, or t
  misc_feature (416)..(416): n is a, c, g, or t
  misc_feature (418)..(418): n is a, c, g, or t
  misc_feature (427)..(427): n is a, c, g, or t
  misc_feature (443)..(443): n is a, c, g, or t
  misc_feature (445)..(445): n is a, c, g, or t
  misc_feature (448)..(448): n is a, c, g, or t
  misc_feature (462)..(462): n is a, c, g, or t
  misc_feature (481)..(481): n is a, c, g, or t
ggaggacctttttgggaagatgccaggggggcaagaggatgatgaagaggaagaggaagatgaggaggaggcagaagaggaagaggaggagatagaagaggagatgagcaaggacgaggaggacatagacaaggatgcaaagatgacctggtcagggattaaggtcacagagacctcccagcactctctgcagtggcaatggcagcaggatctgaagaccataataaaggaggagacagaaagtgacgagaaggaggccattgggaggctaccagcttttgccaacctgcaggaagcaatactggagaacatgattcagaacatcctggtagaggcaagccgtggagaggtagtgctcacttcgagnccccgcatcattnccctaccaccantcagcatgcacaggacagacaacntnttgcagatntcacaaggggacgtgntntgntctgggatgcagcntcctgactgtttgctggtntcagcatccagcccctctaacatgactacctaaattgcccctg

SEQ ID NO: 8181 - DNA, 380 bp, Mus musculus
  misc_feature (225)..(225): n is a, c, g, or t
  misc_feature (258)..(258): n is a, c, g, or t
  misc_feature (293)..(293): n is a, c, g, or t
  misc_feature (318)..(318): n is a, c, g, or t
gttgcttaagttctggagacatttttgttgctgttgtttactgagcatgtgaagggaggtctttctgccttgcctgttttattttcaggaagcagggttgggaatgaaccctggcgctgagacagccatcctgaagctagaacaagccggaagaacaaataaaccccagtttcttgtatcctggctgatgtatttagtgaatggcctagggggctgaacaacctncattaaagcttgctgcagatacatgagacagantcaactgagcttggggcagctctccaagacggatnctgtgcccaatttaaaaagacaaantcaaataggatgaggtttgggtttgaacttttgttttttttttcagatgacctcagtatgta

SEQ ID NO: 8182 - DNA, 530 bp, Mus musculus
gaattctccaaagtctcctaaagtgactcggacagattctaaaaggagacagaacacaacttctcagtgcagggcacaaaatctccaggatcctgtgccaaaagattccccaaaatcatggttttttgataaccggtcaaagtctcttccagcacctcacccgatccgctattttgacaactccagtctagggctgtgcccagaaccagatgacgtagagaatgtggagcctaagacagacctctgccaagcctccttggaaaaagatgtgtcccagtgcaagacgcagtagatgcccctgtcccgtcagagcagagcgcccttggatggatgcccccgtcagccgagcgctcttggatgcctttcctcgtgtgtccacactgacaaagatgatgcaatccaacttagtttcagtctaatttccactttagaagatggaggaacaagaaacggattgattgcagtgacttagaacgctggtggcagttctttctgcttgcatctgtgacattccacacgctgaactgtta

SEQ ID NO: 8183 - DNA, 512 bp, Mus musculus
  misc_feature (275)..(275): n is a, c, g, or t
  misc_feature (313)..(313): n is a, c, g, or t
  misc_feature (417)..(417): n is a, c, g, or t
  misc_feature (426)..(426): n is a, c, g, or t
  misc_feature (441)..(441): n is a, c, g, or t
tgttgcagcctcaagattcttttcttttaacctttcaatgttttggtgaatttccactcagtcggaaaaaaaagtccttctgaactgctctgtatttgcatggatatctgggcacagtttcttgcaaccatgtggttaaaggtgacaactgaagtattcgcgtatgatttaaagtctagtcaactggacaggatttataaatccaactttcaattgaagaggccagcaggcagactgcaattttgtgattaaaactgagaactcattagtaaacntgctgttgcttttatactaaaatcatgttgattcaatncgcatacaaacgtatcttgcaaataaagggtaacttttcgattaaaggagtaacagattggaatttatgtttgttttgtgggcctatgcatgttcaaatgcatncctgtttgnccttgacactctgtnccttaagcatttttgctactgtgctatccatagagaattaaaatgtcaggaggtgctctagaatttcttgt

SEQ ID NO: 8184 - DNA, 240 bp, Mus musculus
tttttccatccttgctcagaggcagccttttgtatacattccctgaccccaccccaattatatctctcatatgatatctgttgcgtagtgtgactttgtggcatgacttggttgtcagatcatttgcacaagaacaaacgaataaacaacaacaaagcccaccatcattaccaccggcacttaatgctagtctttctgctagggatactgacagtctatttgcttcccatggtcataggg

SEQ ID NO: 8185 - DNA, 504 bp, Mus musculus
  misc_feature (118)..(118): n is a, c, g, or t
  misc_feature (136)..(136): n is a, c, g, or t
  misc_feature (151)..(151): n is a, c, g, or t
  misc_feature (279)..(279): n is a, c, g, or t
  misc_feature (293)..(293): n is a, c, g, or t
  misc_feature (337)..(337): n is a, c, g, or t
  misc_feature (375)..(375): n is a, c, g, or t
  misc_feature (433)..(433): n is a, c, g, or t
  misc_feature (435)..(435): n is a, c, g, or t
agttcagcgggcaaagcagatcgaagacatgagcagcagacaagtgaacagagacccacagcaagcttttcggttatggcttaagaaaaagcatgaggagcagatgaaagaaaggaanacagaagaactcagaaancaagaggagtgtttnttcttcctgaggggaacagagggccgcgagagagcctttcgacaatggctcagaaggaaacagatcgagaagatagccgagcagcaggctgtcaaagagagagccaggcagctccggctcgaagcccnccgctccaaacagntacagagcagcctgtacagcatacccgaagccaaggctttccgnttcaccgaccactacaactgaagccacccgggaaagantacatgtgaagccgctggcaccaggatgttgtgtgttgttccccaggggccccatgtntnggcgtcactacagattgtgggagtaggatttgccttttggtgatgctggatttatgttgttttcgcaca

SEQ ID NO: 8186 - DNA, 404 bp, Mus musculus
  misc_feature (234)..(234): n is a, c, g, or t
  misc_feature (236)..(236): n is a, c, g, or t
  misc_feature (242)..(242): n is a, c, g, or t
  misc_feature (252)..(252): n is a, c, g, or t
  misc_feature (377)..(377): n is a, c, g, or t
  misc_feature (379)..(379): n is a, c, g, or t
gaggctgtggagactaactttgaaaaggcactaggattttgacttgtgtacctgtgtactcgactgaatagtaatttccttaagacagaattctatttagtttctgtcaacttgacaaaaactagagtcacttgtggagaggaaacctcaactgagaaattgcctttctccaccggtctccaggcatttctgagggagcatttacttccttaatgattgaggcgggagggtttntnccactnccatccttantcaggtagtctcaggctgtgtaacatggcaagctcagcaagatatggaaagcaagccagtaagtcacatttccccatgcgttctgtttagtccttgcccaaaagtttctgccttcacttcctgtntntgcatccctctatgacctacaataa

SEQ ID NO: 8187 - DNA, 416 bp, Mus musculus
  misc_feature (94)..(94): n is a, c, g, or t
  misc_feature (115)..(115): n is a, c, g, or t
  misc_feature (121)..(121): n is a, c, g, or t
  misc_feature (241)..(241): n is a, c, g, or t
  misc_feature (272)..(272): n is a, c, g, or t
  misc_feature (299)..(299): n is a, c, g, or t
  misc_feature (307)..(307): n is a, c, g, or t
  misc_feature (311)..(311): n is a, c, g, or t
  misc_feature (322)..(322): n is a, c, g, or t
  misc_feature (342)..(342): n is a, c, g, or t
  misc_feature (355)..(356): n is a, c, g, or t
  misc_feature (373)..(373): n is a, c, g, or t
gtgtgcgacatccttcaaggacaacgacacgaagcatcactgccgggcctgtggggagggcttctgtgacagctgttcatccaagacccggccngtgcctgagcggggctggggncctgcncctgtccgcgtgtgtgacagctgctacgatgccaggaatgtccagttagatgtgactgaggcgcaggcagatgatgaaggtggaacgctgattgcccggaaggtgggcgaggccgtgcanaacaccttgggagccgtggtgacagctattnacataccactaggcctggtaaaagatnccgccagnccgncctactgggtncctgaccatgagatcctgcnactgccacaactnnccgcaaggagttcagcntcaagctctccaaacaccactgccgagcttgcggacagggctt

SEQ ID NO: 8188 - DNA, 364 bp, Mus musculus
tgcagatggctgtgtctgttctcatcgtgctgggtgagagagtgcgaaaggacatcgatgagcagacccaggagcactggtacacatcctacatagatctgctgcagcgcttctgcctctggaatgtgtccaatgaggtggtgaagctgagcaccagcagggcagttagctgcctcaaccaagcctccaccacgctgcatgtcaactgtagtcactgcaagcggcccatgagcagccgcggctgggtctgtgacaggtgccaccgctgtgccagcatgtgtgctgtctgccatcatgtggttaaaggcctgttcgtgtggtgtcagggttgcagtcatggtggccatcttcagcacatcatgaa

SEQ ID NO: 8189 - DNA, 479 bp, Mus musculus
  misc_feature (288)..(288): n is a, c, g, or t
  misc_feature (362)..(362): n is a, c, g, or t
  misc_feature (449)..(449): n is a, c, g, or t
gagcacagtcctgatccagaggtaactgtggacataactgctggcctgaagggagccttggaaccggcagacaagatgagcgataaaccagacttgtcagaagttgaaacgtttgacaaatcaaagttgaagaaaactaatactgaagtaaaaaatactcttccgtcgaatgaaaacaagatgagcgataaaccagacttgtcagaagttgaaacatttgacaaagcaaagttgaagaaaactaatactgaagtaaaaaatactcttccgtcgaaggaaactatccancaagagaaagaacacaatgaaagaacataaaatgagactctcctttcaagagcaacaacaacattgcctaacantcatggctctaggcttgtttctgtaaccctatgcaatatatagacatgttaggcagctcctggtagatccatttactaccctggctncaaaggtcagcatttgctatgaatcattaa

SEQ ID NO: 8190 - DNA, 215 bp, Mus musculus
gtttgacttttatacccagccagaagttacaaaatgatgacccactctgggtataagcttgatttcctttgttgagacttacccttcattgaagagaaaaagaagacagtcaaaaaaggtccaggttacaaagttctcctcataggtggaaaggtttactgcagtgttatcctctaagtgtgataaactgtgctttaccgctccgaacactcagg

SEQ ID NO: 8191 - DNA, 473 bp, Mus musculus
  misc_feature (224)..(224): n is a, c, g, or t
  misc_feature (256)..(256): n is a, c, g, or t
  misc_feature (264)..(264): n is a, c, g, or t
  misc_feature (297)..(297): n is a, c, g, or t
  misc_feature (304)..(304): n is a, c, g, or t
  misc_feature (332)..(334): n is a, c, g, or t
  misc_feature (349)..(349): n is a, c, g, or t
  misc_feature (369)..(369): n is a, c, g, or t
  misc_feature (413)..(413): n is a, c, g, or t
  misc_feature (428)..(428): n is a, c, g, or t
  misc_feature (437)..(437): n is a, c, g, or t
  misc_feature (446)..(446): n is a, c, g, or t
aaaagacagcctctcctgaggctttcttctctggacaagcatccaacctgagcatccacccctcctgagggtggcgcttctgctccccgccccgaggaccagtgctggccgcgcttcctgcctcagtccattgtcagtgccgcctccctgggctgaggatgacggctcctcttttagttatttattttaaaaatatctttgaactgtgtcttgaaaaatcgccnatgaagttggtgccactttatttatttactcnactgactngatgttgttgtgttggcatatttagtatgttgnatctgtncccttactcttgttgacatttgagaggnnnaaaataaccctttcnaaacagttatttttttgacnaaactctttgtggagtttttaccaaatagatcattttagtagtnaaacttcactatgtntccttcccnagacatgtntcccctccctcagaaatatgacctaag

SEQ ID NO: 8192 - DNA, 466 bp, Mus musculus
  misc_feature (199)..(199): n is a, c, g, or t
  misc_feature (263)..(263): n is a, c, g, or t
  misc_feature (311)..(311): n is a, c, g, or t
  misc_feature (322)..(322): n is a, c, g, or t
  misc_feature (330)..(330): n is a, c, g, or t
  misc_feature (340)..(340): n is a, c, g, or t
  misc_feature (351)..(351): n is a, c, g, or t
  misc_feature (354)..(354): n is a, c, g, or t
  misc_feature (391)..(391): n is a, c, g, or t
  misc_feature (413)..(413): n is a, c, g, or t
gattattcttaagttggcatttcatgtaccattgtaaaaagaagggcttgctaataagtttagcaccaattcttaatgggaataaatcttgcaacagatggatgtgttagagcttgagaccccaaaatgtatttgtgatctacccctgccgctaagagcttttggtttacagactttcataacattctgatcttttatnacttactctcccttttctcttacttgatgaacacttatttgagcttatgttttttgataagagnatctgtcctgttttacacaccaatattattttggtttttatgaagttnctgaacaaatnccttagcnatttaaaaancctaccatagnctntagtactaacactaacaagaaggatggaaacttcctnatagagacatgtttgagtagtnctttacttttgctgagtataaacacctttcaagtgttctcacggttagggttt

SEQ ID NO: 8193 - DNA, 401 bp, Mus musculus
  misc_feature (59)..(59): n is a, c, g, or t
  misc_feature (340)..(340): n is a, c, g, or t
  misc_feature (366)..(366): n is a, c, g, or t
aagtatgtagtgttcttgcaggttctgtgtacattgtccaccccttggcttaaaggatntgccatgcatctcaacattcagtggggccctggaaccaacccaacacaaagggacaactaattattactcttgttaatcacacaaaatgttttgtgcccatctccccctcccccgctcccaccccggtgttcatgggtctgagtggactctgtctgcatgaatttcatgggacagctgctggcgtatgggaccaagaggaagaggaataagaatgccctcccaccggtgcttgtgaaggggagaccggactccccacctctgtccatgctggctggaacanccgctgcactaggggatttttttttncttttggagcttcagttctatctacagcaagggct

SEQ ID NO: 8194 - DNA, 228 bp, Mus musculus
  misc_feature (26)..(26): n is a, c, g, or t
  misc_feature (29)..(29): n is a, c, g, or t
  misc_feature (44)..(44): n is a, c, g, or t
  misc_feature (144)..(144): n is a, c, g, or t
  misc_feature (153)..(153): n is a, c, g, or t
  misc_feature (155)..(155): n is a, c, g, or t
  misc_feature (181)..(181): n is a, c, g, or t
  misc_feature (188)..(188): n is a, c, g, or t
  misc_feature (200)..(200): n is a, c, g, or t
  misc_feature (203)..(203): n is a, c, g, or t
accaacgcactcaccgtggcgtgagnccntactcctgcccactntgcggcaagagcttcagccgccgctccaacctgcaccggcacgagaagatccacaccactggacccaaggctctggccatgctcatgctgggggcggcanctgcggggncnctcacggcaccaccacctgcttccanttagaancctgagagagancantgagaacacccagggaagctgggac

SEQ ID NO: 8195 - DNA, 423 bp, Mus musculus
agggtagtcctaattatctcttattcgcctgctggaagttttcttctgctttccatactgttaggaacaagagataggtttcaatggcatcagcttcagtaagggaccacaatctggttttccattttatccacaagaatagacttttgggctgctggagtttaagtagaagtttctactatattttttatcttattatcttattttctgtatatgaatgtttaacctgcatatatgtctgtgtaccacgtgtgtggctggtacccatggagaccagaaaatgatattagatgccctagactcagaattgcaaatagttgtgagctgccatgtgggtggtagaaactgaacctagggactctagaggagcagccagtgagtgctcttacctccatctctccaacccctccattatatttttgt

SEQ ID NO: 8196 - DNA, 436 bp, Mus musculus
  misc_feature (187)..(187): n is a, c, g, or t
  misc_feature (261)..(261): n is a, c, g, or t
  misc_feature (325)..(325): n is a, c, g, or t
ttcttcctctcagaccattgtggaggaggccctgacagcaggagtggtcaagaaaatgattaaattcctgaggatgggaggccagactgcatcacgttacgccataaagatactggctatctgcacgaacagctgtcatgcagctcgggaagaagtagtgagacttgataaaaagtttgaccttttnatgctgctgcttgcctctgaggatgaaattctggcgggcaatgctgccctctgccttggcaactgcatggaagntgcccagtgcagccccttccttgctgaagacggacatcgtgagggtgctcttgaagctggcagncagcgactcaaaggagacaggcgtacagctgaatgcaggcatcgctctggggaagctgtgcactgctgagcccaggtttgctgcccaactgcgagagcttcacgggataca

SEQ ID NO: 8197 - DNA, 575 bp, Mus musculus
  misc_feature (270)..(276): n is a, c, g, or t
  misc_feature (278)..(278): n is a, c, g, or t
  misc_feature (282)..(283): n is a, c, g, or t
  misc_feature (285)..(285): n is a, c, g, or t
  misc_feature (287)..(288): n is a, c, g, or t
  misc_feature (290)..(290): n is a, c, g, or t
  misc_feature (292)..(297): n is a, c, g, or t
  misc_feature (300)..(303): n is a, c, g, or t
  misc_feature (305)..(306): n is a, c, g, or t
  misc_feature (308)..(310): n is a, c, g, or t
  misc_feature (315)..(316): n is a, c, g, or t
  misc_feature (326)..(326): n is a, c, g, or t
  misc_feature (330)..(330): n is a, c, g, or t
  misc_feature (332)..(332): n is a, c, g, or t
  misc_feature (339)..(339): n is a, c, g, or t
  misc_feature (353)..(353): n is a, c, g, or t
  misc_feature (358)..(358): n is a, c, g, or t
  misc_feature (361)..(361): n is a, c, g, or t
  misc_feature (372)..(372): n is a, c, g, or t
  misc_feature (379)..(379): n is a, c, g, or t
  misc_feature (391)..(391): n is a, c, g, or t
  misc_feature (398)..(398): n is a, c, g, or t
  misc_feature (412)..(412): n is a, c, g, or t
  misc_feature (418)..(418): n is a, c, g, or t
  misc_feature (440)..(440): n is a, c, g, or t
  misc_feature (458)..(458): n is a, c, g, or t
  misc_feature (469)..(469): n is a, c, g, or t
  misc_feature (483)..(483): n is a, c, g, or t
  misc_feature (498)..(498): n is a, c, g, or t
  misc_feature (519)..(519): n is a, c, g, or t
  misc_feature (539)..(539): n is a, c, g, or t
acccagccttccatcaggtgaaggaccagctttgggagaaggggcagagctaccactggctgtccagcctcctcggtcttgctccagctctgctctgactgagcaggtggtggacactcttgaccagcatatgggacaaaggcctcctgtccctgagccttcccaacaggactccacatccacggaccccaaaggtttggcccaactttgatctcatcctcactaagctacagacctggatctgggagggcagagacagcttctgctgcnnnnnnncnctanngnanntntnnnnnnttnnnnanncnnntccanntgactggganacananacctgtncaagaagataggcntcttnctntgggccaggcntacattnttcctctccctnaggcttntggggagaagtggntccctnccatttcctttcccaacagaantcctcataggatcccctntcctttccctncccaccttttgtantctcacacagcactntgggaccccaaattagagctntcttccggttgtattttaancccccctttagaagtcacacagcgtgctgagtccaa

SEQ ID NO: 8198 - DNA, 517 bp, Mus musculus
  misc_feature (357)..(357): n is a, c, g, or t
  misc_feature (372)..(372): n is a, c, g, or t
  misc_feature (378)..(378): n is a, c, g, or t
cttgctccaggcaggacatcagactgtctggggagttggccctgggcttctgtgttgtgtgcagagactgcacagtaaaacagtcacttttgccaacaagaatgtgtggcgccccacatctccctaccttgcactctagggccagaccactctctgtatggaccagaccatcttcccaaacccatggtgctttccccccgaccccactcaacctacattctgaggaggggagggatggatcagaggccatagtggccccctggataatcctgacatggggtagagtcgggtgaggcagagggagcagcacccaacacctgcactgggccacaagcgggaaagaacacgggttggttngcagttgagttgttngtctgnccgtctgtatttggatctttaactgtactttgcctggcgctgtgcgcaaggtctgaaaccttattgctagtacctagaaacacacaaggctatccagccaaatcttaatgtaaagtagctagagccatggaagtccagt

SEQ ID NO: 8199 - DNA, 45 bp, Mus musculus
tattcatgtacaggcaataagcatccctaaggtttgtgtctggtc

SEQ ID NO: 8200 - DNA, 556 bp, Mus musculus
  misc_feature (333)..(333): n is a, c, g, or t
gattttacactgcttaaaccctgaaccctgtggtaaagactgtttactgtagcagggcctgaagcgggaggagcgctctttatacacagcacacaaggatacttgtatctatatgacagtgcccaccctacactggaaaatgtgtctggctttggcactaaaatcatgtagttctaccagacagcaataataactgagcagagagctaatgagctagtgttcaaacagctcaatggtgagggtgggcagctgtatatagatatgcatgtatgtgtatgtatatataattttataactttcccacataaattaatacatgccatgtatacacanatgtggaatatatttgtatatattcatgtacaggcaataagcatccctaaggtttgtgtctggtcctacacccagacatcaacttaaaaccatcagacctcaattgtacaataacaagggttttgtttaaaataattaaaaactccacagcacttagatacgacgtttgtcacacttgagtagccttgacaaccatcctgtaatcctgaacctagcattccac

SEQ ID NO: 8201 - DNA, 493 bp, Mus musculus
  misc_feature (205)..(205): n is a, c, g, or t
  misc_feature (207)..(208): n is a, c, g, or t
  misc_feature (213)..(213): n is a, c, g, or t
  misc_feature (219)..(219): n is a, c, g, or t
  misc_feature (224)..(224): n is a, c, g, or t
  misc_feature (232)..(232): n is a, c, g, or t
  misc_feature (236)..(236): n is a, c, g, or t
  misc_feature (262)..(262): n is a, c, g, or t
  misc_feature (313)..(313): n is a, c, g, or t
  misc_feature (360)..(360): n is a, c, g, or t
  misc_feature (468)..(468): n is a, c, g, or t
actactgctcagtaaagttgtttaaaccatttctgatagctgatgacaattttatattaaactgtatactgactttagtgaaactgatttcttttttagttgtttacagtgcagatacttgtgggttttttttttaattgcagtatttccattgtcgcagtaatttagtaaaactctgtggctgccttgattttgacagattttntnnatatnaactgnttgtnaggcaatnagtnatatttatgcataaatcaattgcacnataattcatgaattatttattacaatattttctaatgaattcatgtatctntcttgtgttgtacatgtactgtaattttgttcctactttgtgttgtnatatatctaaatctgattgtatgaattttaattgttcagttaacgtgtttctaggttgtaatttgtagtaaagcacttcaatgcttttgcacttaaatttacaacacngtcggtgtgtggttaatttactcat

SEQ ID NO: 8202 - DNA, 400 bp, Mus musculus
  misc_feature (75)..(75): n is a, c, g, or t
  misc_feature (80)..(80): n is a, c, g, or t
tgtgcagcagacacacctgattgatgtccacaattatccggattacgtttcctctggaggtggatttgggcctgnccatngaccatgggtatggtatctcctacatcttcatgggggaaaacgcaatcaccttccatatctccagcaagaaatcaagcacagaaacagactctcaccggctggggcagcacatcgaaaatgccctgttggatgtagcctccctgttccgggttggacagcatttcaagcgccagttcaggggggagaattcggattatagatacaactttctctcctgtaagactgtggaccccaatacccctacatcctccaccaacttgtgagcccctcagcagggagctggtctccctcaggatggaaggtgttgctcccagggctt

SEQ ID NO: 8203 - DNA, 488 bp, Mus musculus
  misc_feature (28)..(28): n is a, c, g, or t
  misc_feature (32)..(32): n is a, c, g, or t
  misc_feature (42)..(42): n is a, c, g, or t
  misc_feature (227)..(241): n is a, c, g, or t
  misc_feature (272)..(272): n is a, c, g, or t
  misc_feature (290)..(290): n is a, c, g, or t
  misc_feature (292)..(292): n is a, c, g, or t
  misc_feature (302)..(302): n is a, c, g, or t
  misc_feature (321)..(321): n is a, c, g, or t
  misc_feature (334)..(334): n is a, c, g, or t
  misc_feature (364)..(364): n is a, c, g, or t
  misc_feature (384)..(385): n is a, c, g, or t
agccatggtaatgcccgctcatctaaanatgnaaaagattanttgatcacctcagttaagtgtggccttatttaatttaattcagaagggggagatgtcagagaccatcccgtgagaaagtgagcccttcacaatctccctagcaggccaaatggccttgtactgagagctggttgtcacccccctttcctccctattcctttcctggcacctgaggctgtaaaagnnnnnnnnnnnnnnnctcttccctatctcttcctgagttcccatgncatccaaggacatgagtnangcctgagccnagcctgacccccaaggctntcaaggaggatcnatgttccagagataagatccagagtgcccnctgcctggcgcctgacttcnncccccatgtcagcagatgcccacttctttgttctttgtataattctccctcgacccctcccatattccccgcgatgtatgctttaaaaagaaggcacctcagc

SEQ ID NO: 8204 - DNA, 488 bp, Mus musculus; identical to SEQ ID NO: 8203
  misc_feature (28)..(28): n is a, c, g, or t
  misc_feature (32)..(32): n is a, c, g, or t
  misc_feature (42)..(42): n is a, c, g, or t
  misc_feature (227)..(241): n is a, c, g, or t
  misc_feature (272)..(272): n is a, c, g, or t
  misc_feature (290)..(290): n is a, c, g, or t
  misc_feature (292)..(292): n is a, c, g, or t
  misc_feature (302)..(302): n is a, c, g, or t
  misc_feature (321)..(321): n is a, c, g, or t
  misc_feature (334)..(334): n is a, c, g, or t
  misc_feature (364)..(364): n is a, c, g, or t
  misc_feature (384)..(385): n is a, c, g, or t

SEQ ID NO: 8205 - DNA, 425 bp, Mus musculus
  misc_feature (165)..(165): n is a, c, g, or t
  misc_feature (314)..(314): n is a, c, g, or t
  misc_feature (355)..(355): n is a, c, g, or t
  misc_feature (369)..(369): n is a, c, g, or t
tgaactggtcttgtttcttagttttcaaatcacaagaaatgaaaatagccccagaaatcaaacaaatcgggagacctttaggttggtagcgccaccatctgctacagaaacgggccttctaagtgaactctgcagactggaatgccaaagctgaggcgtcaaggntcagacaggaagatgagcagagacccctgccctgcctctgagaacgacgctaacaaacagtttcagcagatctgagagaggatggtattcggatctcttttcttgctctggtcctcgggagatattcttggtgtccattgtcttaacanttcctgaaggtgagaaagctcatcctgaagggcagagactntgagagctgaggancccatctggggaggggcaaagcgcacagaggaagactgttacagggcttgcttcct

SEQ ID NO: 8206 - DNA, 400 bp, Mus musculus
  misc_feature (179)..(179): n is a, c, g, or t
  misc_feature (182)..(182): n is a, c, g, or t
  misc_feature (235)..(235): n is a, c, g, or t
  misc_feature (249)..(249): n is a, c, g, or t
  misc_feature (280)..(280): n is a, c, g, or t
  misc_feature (341)..(341): n is a, c, g, or t
tcacctatgggccagtcgaaaagcaaacccagagagaagaaagaggaggagaagagcactaccactttagttacaaagtctaaggagaaagtaatggagaaggaggccaagcagtctgacaaggagtcgcagcctgccgaaagcctgttgttcgcgacatccaagcactcaaggccgtngtnttcgtctgaagacaaacctgagacaaagcaaaggtcaagcaagaagagaagtntcatcccgcagatnatcatcacccgggcctccaacgagacgctantcagctacggcatccccgacaacgatgaacagagaaccattcgggagcatgccgactgggntccttaccaccgacacaggagccccagcacaatagcagcctatgatgtacacaacacag

SEQ ID NO: 8207 - DNA, 496 bp, Mus musculus
  misc_feature (357)..(357): n is a, c, g, or t
  misc_feature (456)..(456): n is a, c, g, or t
ggaacaagctcagatcagcaacctaatcagtctcccagtagttggtaatttctggttccaaatattaatctgttattttcctggctcggggcccagtggggcggtgccatggtgccgaactcagtacattctgatactaccaagaaacacaagcgcttttaagcagcaacacccagcagctgtacagatgttttaattcggagccagctgacatgcagataggattgcttctctgatgagaatccatcatctctgtagcctctagggccccctccccacccctggcttctccaatcccagatgagccgcacacctcccaggagagccatcaaaccaactctgcggaggaagccaggncctctgctctaacaggagtccagcttctcctgggggtggggcggggggggggagcgcaggtagatttttctggagcacccaagactgaccttgatgtgntcctccaaatacttggtcggtgtttataagcatatgctcc

SEQ ID NO: 8208 - DNA, 327 bp, Mus musculus
  misc_feature (96)..(96): n is a, c, g, or t
gaaaattcctgaccattatgactgtacctaatgtggtcctttctttcctctcttctggctgtgaactgcgtagaattgggtctataattgaatccngtgtgagtaattctgctctttaagttaaatcaagttgcacagagacactttccagctgctacactgtgccgtcctgttgggaattctagtggtgctggggaacagccagggcccagcagggtggtgtgcacttgtctggtagggaagtcctctagcacaggagacaggactcctgcttgttcccacttcagtttgagaagctgattacaaatcttttcctactcagttcaa

SEQ ID NO: 8209 - DNA, 461 bp, Mus musculus
  misc_feature (369)..(369): n is a, c, g, or t
  misc_feature (411)..(411): n is a, c, g, or t
gaatcttaccaatggctggccgtgaccctgagtgccagcgcacagagatgattaagaaagaagaagaacgcctgagggcctccatcaggagggagtctcagcagcgccggatgcgagagaaacagcaccagcgggggctgagcgccagctacctggagcctgatcgctacgacgaggaggaggaaggcgaggagtccgtcagcctggctgccattaaaaaccgctacaaagggggcatccgcgaggaacgagccagaatctactcctcggacagtgatgagggctccgaagaagacaaagctcaaaggttactcaaagcaaagaagctcaacagtgatgaggaaggtgaatcttctggaaagaggaaancggaagacgatgacaaagcgaataaaaagcataagaagtatntgatcagtgatgaagaagaagaagaagatgactgagctacaaactgtgaa

SEQ ID NO: 8210 - DNA, 498 bp, Mus musculus
  misc_feature (300)..(300): n is a, c, g, or t
  misc_feature (346)..(346): n is a, c, g, or t
  misc_feature (416)..(416): n is a, c, g, or t
  misc_feature (433)..(433): n is a, c, g, or t
gtatgagtacacgagtcagctcttaaaacgacgagtggtgtcagtaccattaaaaattgagcatctctctgaggagctggatgcatggagagcttgcacacaatcgaccaaacaatcatcagaagattctccatatacacccccttctgactcacaaagaacagtttatgaaactttattaaagagactgaaagaagagccactcaaaggaattactggactagattacgtgactggatcaaatcttccaagccattcagacattcacatctcttgtcttactggactaaaaatccaggntcctgtgtatttcctagaagatggaaaatcaactatttctttgaangacgctctgatgtgggcaaaggtgaatccattctcacctttaggaactggaatacgactcaatccatttngactgaatttttttctncacacttcctagttttgtaaaaaggaaatttggggtatttataaccttcattttggtggtctaag

SEQ ID NO: 8211 - DNA, 413 bp, Mus musculus
  misc_feature (200)..(201): n is a, c, g, or t
  misc_feature (203)..(204): n is a, c, g, or t
  misc_feature (296)..(296): n is a, c, g, or t
  misc_feature (320)..(320): n is a, c, g, or t
  misc_feature (346)..(346): n is a, c, g, or t
  misc_feature (350)..(350): n is a, c, g, or t
  misc_feature (360)..(360): n is a, c, g, or t
aaacctgctatagttctgtgaatcattcttatgaaacttattttgctttaaatacttggaagcaaaagagtgggatgcagatcaactcctgggagctgttgacatcttcagtgacacactgttcagttccagcttcctgaaagacactcattcacagtcatggacttcccagtgagacattgtgagtttactacttagtnntnnctgacattttccttgagagaagacggtctgtccccaacagcagaattttagattactgttaaaagtttttaatctacaggattgagacaganacatgaaggcttgttaaagagaancacattcaattctgttaggagggatnattntttctgattntcttgacagggcatcaagttcgtactgtgttctctcacagatgacagcctgga

SEQ ID NO: 8212 - DNA, 469 bp, Mus musculus
  misc_feature (377)..(377): n is a, c, g, or t
acaggatcaagcacgtggcaggttccacgcagacacggcacatcccggaggacactcctgatggttttcacctacaaagtgtgtccaagctgctgctggttatcagctgtgttctggtgctgctggttgtccttaacatgatgctcttctacaagctgtggatgctggaatacaccacccagaccctcactgcctggcagggtctcaggctccaggaaaggttaccccagtctcagacagaatgggcccagctattagaatcccaacagaagtaccacgacaccgagctccagaagtggagggaaatcatcaaatcctcagtgttgctcctggaccagatgaaggactcgcttatcaatcttcagaatggtatcagntcccgagactacacagctgagagcgacgagaagaggaaccgctatcattgacaaggcaggaccaggggtggctacaagaggcctgtgcaata

SEQ ID NO: 8213 - DNA, 437 bp, Mus musculus
  misc_feature (39)..(40): n is a, c, g, or t
  misc_feature (42)..(42): n is a, c, g, or t
  misc_feature (44)..(45): n is a, c, g, or t
  misc_feature (47)..(47): n is a, c, g, or t
  misc_feature (53)..(54): n is a, c, g, or t
  misc_feature (59)..(59): n is a, c, g, or t
  misc_feature (382)..(382): n is a, c, g, or t
  misc_feature (410)..(410): n is a, c, g, or t
gaaagccactgagagggacgtcctccccttgaggctggnntntnntntttttnnggaanatgctaccctgcacccttgaaactagaaaacctggttggagtctgcaaaccgcgatgcaggatgtgggcaccgagaaaaagcaagagatcccagtcaggacttcgttggcccaaaccacggtctgcatgtcagcaaagacttggttataatctctgcatacctaagattgcttagttgagccatcttttggcagcccttcgacgaccttcactaaatcctggtttcttaggagcgccctcatttaacaccaaggccctttagttgcctatacaaagggagggcttacagttaatgacctttgtgcccacacagtagtacaagntcagctaacttaatgtgcccagtgaatntcgatcgggttattgggaacttcctga

SEQ ID NO: 8214 - DNA, 546 bp, Mus musculus
  misc_feature (30)..(30): n is a, c, g, or t
  misc_feature (511)..(511): n is a, c, g, or t
aaggctgtggtttccttgcgccagatccancacaaagccactcaggaaaaggagcgcaaccaggagctcaggcgcctgcaggatgaagcccggaaggaagagggtcagcggctgacgaggcgtgtgcaggagctggagagggacaagaacctgatgctgcagcgcctgttagcagtgcttccctcgggagtgaataagaagtgcagcccccggtctgtggagtcctcatcctctgagtctccggcagctgcttcgtgcaaggaatctgtgaaaggctccctgaccgtcctgcttgataacctgcaaggcctgagcgaggccatttccagagatgaagatatttgtgtggaagataaccagaacaccaagaaaaccaagaaccctccttcagatccactgctgagctagagctgccagggggaagaatgaagccagcctgaagctggacccccaggagggttgggtcggaggaaatggggtgggggccagcctagccctgccccccagcaanccttggaaccccagcttctaccaaattcaaactct

SEQ ID NO: 8215 - DNA, 334 bp, Mus musculus
  misc_feature (164)..(164): n is a, c, g, or t
  misc_feature (173)..(173): n is a, c, g, or t
atcacgaaggatgctggctggcttcaccctcaccctcgtgtaaccctctgcaatttcactttgggtcagtgaaaacaaaaaaccaaggacttactatgtagcacaagatggcttcaaatgtgtgatccccatgctgagttctgggactacaagtgtgtaccatnacacccganctaactttgggagggcagctttaatgtagaagatagactatctccatgaaatcggtcttagggtgccacactccgaatccctttctgttagaggcggagtcccaggtttactctccccctccacaagaattgcctgttttcatcgttgtcggtgccacaga

SEQ ID NO: 8216 - DNA, 296 bp, Mus musculus
  misc_feature (41)..(41): n is a, c, g, or t
  misc_feature (70)..(70): n is a, c, g, or t
  misc_feature (76)..(76): n is a, c, g, or t
  misc_feature (83)..(83): n is a, c, g, or t
  misc_feature (97)..(97): n is a, c, g, or t
  misc_feature (105)..(105): n is a, c, g, or t
  misc_feature (113)..(113): n is a, c, g, or t
  misc_feature (118)..(118): n is a, c, g, or t
  misc_feature (127)..(127): n is a, c, g, or t
  misc_feature (133)..(133): n is a, c, g, or t
  misc_feature (135)..(135): n is a, c, g, or t
  misc_feature (210)..(210): n is a, c, g, or t
  misc_feature (212)..(212): n is a, c, g, or t
  misc_feature (246)..(246): n is a, c, g, or t
aaggacctggaaaagctattggaagagatggaaaaaatctnagtgcaggcaacctggatggcctatgatntggtgntcatgcntacgaaccccacantagcagantccatgcnccggntagaagacnccttcntnaactgcaaagaggagatggagaagaactggcaagagctgctcactgagaccaagcgcaagcagtgagctaccatntntcagcagcctgtgggccgaagccagggacatggntccagaagcccagacgtgtagccatgtgcatggtacttgtttttcaataa

SEQ ID NO: 8217 - DNA, 519 bp, Mus musculus
  misc_feature (242)..(243): n is a, c, g, or t
tgataccccgagaccgagaacttgctgctcgacctgcgttgttagcttgtgtgcgtgtagtctgtgagtgagacttctttgattgtagctctgtgctgtcggaatggaacagtagttcccgccaattcctccaccaccacggcctcagaggcctgggccgtggccagagacgagtttgcatcatccacgtggctctgtcacctctgcatctcgacctgtcctgtcatctgtccccgccaggnngtcagtcatccctcagctcccatgtgccctgtgtcccacccaaggcgggctgggcgggcaggcctcctttgtcctctttcacaatctactgtttctgagtgtacacgttgcgctgtttgtgtttgaccccctgacttgtagccagcttgtgtaagaccccttgcagaatgagaacgttaaaaacaagaaacccacccagtactcacaccatcaagtctgttctagagcgtacaaccgtattaacacggaggcctgcctggctacttttttaacata

SEQ ID NO: 8218 - DNA, 571 bp, Mus musculus
  misc_feature (391)..(391): n is a, c, g, or t
  misc_feature (395)..(395): n is a, c, g, or t
  misc_feature (415)..(415): n is a, c, g, or t
  misc_feature (441)..(441): n is a, c, g, or t
  misc_feature (490)..(490): n is a, c, g, or t
tgtctgcagtgaccctgactgtgaagggcaccgctgcgagaatggggtctatgacccgcagcaggatgatggggatgagagtgcagatgaggacagctgctccgagcacagctccagcacctcaacttccaccaaccagaaggagggcaagtactgtgactgctgctactgtgagttctttggacatggcgggcctccagctgcaccaacaagtagaaattatgcagaaatgagggaaaaacttcgtttacgcctgactaagaggaaggaagaacaacccaagaaaatggagcagatctcagaacgggagggtgtggttgaccatcggagagtggaggatttgttacagtttataaacagctctgaggccaagccagttagtagtagtcgngcanccaaacgagcaaggcacaancagaggaagctggaagagaaggcacncctagaagctgaggccagggcacgggagcatctgcatcatcaggaggancaaaagcagcgggaagaagaggaggacgaagaagaggaggacgaggaacagcatttcaaggaggaatttcagcggcttcag

SEQ ID NO: 8219 - DNA, 314 bp, Mus musculus
  misc_feature (113)..(113): n is a, c, g, or t
  misc_feature (214)..(214): n is a, c, g, or t
  misc_feature (218)..(218): n is a, c, g, or t
  misc_feature (275)..(275): n is a, c, g, or t
tggcagttaagcacatcagtacatttcacctcgaccaaaaggaggcttagatttcacgtcttctcgggggagcttgacggcataaatcagaagcaagcacagtttgtcaggtnctgaagcccctatgatggtaggtgtcaaatcagttgtagctaatctgtccagggagagtaccagcttcattacacttgtatagtcgagttcctccagcatnaccnctgtttaatagaacgtgattagtcatcaccgggaagaaggcatattagccgaggagntagttacacggcacgctccggtgattgccacgatatgat

SEQ ID NO: 8220 - DNA, 429 bp, Mus musculus
  misc_feature (65)..(65): n is a, c, g, or t
  misc_feature (272)..(272): n is a, c, g, or t
caggttcttgaagcacatccaacttaccccaaaatcagaaaggatatacttgataaggcgcgtgnatctttaagaccttgaaaatgatttttactgaagtgttgggcaagagatgacagtggtccctcagctttcacagtctttgcagttgacacaggctccagctgacagtgtgacagaagtgtgtcctgccttctccagcagaggctgctgctgtccgtggacaacactggtctgtggcatccttggtggagtggctgggtgagagctcntctttctcccttccattaggcacaatggtagttctgtgataaagcttaactcgtttctacagaggatatttttgttaaagtctgggtgatatatcttttctgaagagtattagattttccaacaattctatttaaagtctactgtcatctgttaatt

SEQ ID NO: 8221 - DNA, 495 bp, Mus musculus
  misc_feature (312)..(312): n is a, c, g, or t
  misc_feature (316)..(316): n is a, c, g, or t
tgaggccaggattgacttttagtctcagccaggtgtgtctgtaacaagctggatccctgctcacatctgtaatcccagttcccagtggggagaggcagggtcggtagatccttcctgggaggagcaggaagagtgatggagaacaacttccctctcccatgtctgctcataagcgcatccaccacattcctgtgcacacacagtaagttcttatagaagatggaaaatgcaaaagtacagaatgttaagctatggtggcactgctttacctgagtgtctgaatccaagctaaggtaccagaagccccagctntctntcacctgtgtgcgcacgggtaacagaactgttacattgagcttatgagaagaatacagataagtgagaaacagcacttggtgtaactagtgagtcggcaaaattaaagccggtaatgtttttgtgaaatttcaattttggaacctgaaagaaatgttgcattgttctgtttagcccata

SEQ ID NO: 8222 - DNA, 397 bp, Mus musculus
  misc_feature (276)..(276): n is a, c, g, or t
  misc_feature (346)..(346): n is a, c, g, or t
  misc_feature (372)..(372): n is a, c, g, or t
tagtaccaccttgagtagctgaagagttctatgaacgtgtgtgtgctgtaatgaggttattgtacggcactcaagcagcgtgttcagtgacccactaacatgcttcccttcacccaccattagtggactgtatggaactgagtagggaccacacttcctaagtctacatgtacagccatccaccaacatctcagttcctaccatgtaagtttggcgtgcaatcaaacacttacaaagcaggtgaggagatttagattccacactctacttcagctnacatggctacatatgacctagtacacttgaagtcagacagacatttcagttgcttacctccaatactganccttgctttggaaaactaagagattnagaccaagtcactgccagtttttgc

SEQ ID NO: 8223 - DNA, 531 bp, Mus musculus
  misc_feature (73)..(73): n is a, c, g, or t
  misc_feature (143)..(143): n is a, c, g, or t
  misc_feature (179)..(179): n is a, c, g, or t
  misc_feature (183)..(183): n is a, c, g, or t
  misc_feature (188)..(188): n is a, c, g, or t
  misc_feature (323)..(323): n is a, c, g, or t
  misc_feature (335)..(335): n is a, c, g, or t
  misc_feature (354)..(354): n is a, c, g, or t
  misc_feature (358)..(358): n is a, c, g, or t
  misc_feature (366)..(366): n is a, c, g, or t
  misc_feature (368)..(368): n is a, c, g, or t
  misc_feature (395)..(395): n is a, c, g, or t
  misc_feature (399)..(399): n is a, c, g, or t
  misc_feature (405)..(405): n is a, c, g, or t
  misc_feature (409)..(409): n is a, c, g, or t
  misc_feature (421)..(421): n is a, c, g, or t
  misc_feature (430)..(430): n is a, c, g, or t
  misc_feature (456)..(456): n is a, c, g, or t
  misc_feature (471)..(471): n is a, c, g, or t
gttttatttatccaaccacctgcgacgccacatgatcatccattcaggcgtccgcgagttcacctgtgagacntgcggcaagtctttcaagaggaagaaccatctggaggtgcaccggcgcacgcacactggggagacgcccntgcagtgcgagatatgcgggtaccagtgtcggcagngtgnttcgntcaattggcacatgaagaagcacacagccgaggtgcagtacaacttcacgtgcgatcgctgcgggaagcgcttcgagaagctggacagtgtcaagttccacacgctcaaaagccacccggaccacaaacctaccngacgtgcccatncccatggacctcagcctcnattnatttgtantnttggacattatgtccagacgatcagancccnagatanccanccacaggggctnccccaaccncaggccggaaggaggcattcccactnttccctgggcaggtnccccaccctgccccatcacatcccacccatggagctggcacatgggattgcactgctgaa

SEQ ID NO: 8224 - DNA, 474 bp, Mus musculus
  misc_feature (57)..(57): n is a, c, g, or t
  misc_feature (67)..(67): n is a, c, g, or t
  misc_feature (306)..(306): n is a, c, g, or t
  misc_feature (320)..(320): n is a, c, g, or t
  misc_feature (347)..(347): n is a, c, g, or t
  misc_feature (371)..(371): n is a, c, g, or t
gaggtgttcatatttatatcagactgaagaaaagttcatcaaataaacttccccctnttggaagggnttctgtcatgtccttagtgatttaggaagtagccatgcttgcttggtccaattacttgtgtgttggatccaagatgtattttaaacaaatattggcatagatagtaaggagtttctgttgtcagtcaaatgaggatataaaacatagaaaaaaaaatcttatgctacacttgagcctcatataaagatagcctgtgttttgttgttgttgttgttggttttgtttttaattactatttntgcatttaaattanacactgttttcctttgtattattaacnatgtatgtcagaactggagttttntcccctcccccatctgaacataatataaaatctgaaaagtattgtgacaagcactttaacatatcagacaaactgacatgggttttcaggttttggagtacat

SEQ ID NO: 8225 - DNA, 522 bp, Mus musculus
  misc_feature (61)..(61): n is a, c, g, or t
  misc_feature (125)..(125): n is a, c, g, or t
  misc_feature (142)..(142): n is a, c, g, or t
  misc_feature (192)..(192): n is a, c, g, or t
  misc_feature (373)..(373): n is a, c, g, or t
  misc_feature (384)..(384): n is a, c, g, or t
  misc_feature (419)..(419): n is a, c, g, or t
  misc_feature (428)..(428): n is a, c, g, or t
  misc_feature (459)..(459): n is a, c, g, or t
  misc_feature (469)..(469): n is a, c, g, or t
  misc_feature (491)..(491): n is a, c, g, or t
ggtggctggacctccacttgaaggagaacgtccctccttctcttttgctcctgtcgcgcancttctacctgatagatgtgaagccaaagcctattgaacttccaccgaatatagagactccaaanccaaaccttggaatacngacacctccaccccccgagtcaaaggagaacctcacagactctgcacctnagctgaagggaacgaaggatgaagaatttatacaactgcccccagtaccgtcatcactcatagcaccagcagcaactatttccaaagaagcaatcctccaggccaagtcccaggagacctcacagaacagcaaggctgattccaaaggagcctaaggatcccttgaaggtggcgctccctntcttcagtcantccgctcagcagtggcgtccacaaaggaattccanctaagactntctggcttgagataaaggatcagccattaantcgttggagnccttgtgaccatcccagagatncaagcagtgacaccaagttcaggccatttag

SEQ ID NO: 8226 - DNA, 412 bp, Mus musculus
  misc_feature (258)..(258): n is a, c, g, or t
  misc_feature (262)..(262): n is a, c, g, or t
  misc_feature (312)..(312): n is a, c, g, or t
gcatgattttccttgggatgcaaatctgaaacagtcctttaacatgaacaatctgcagcacactgaagggcattctgaattgaagcttggagaactgcactaaacccactaaacagatgcaaaaacctgaccaggcccaacacccaccctgcctggctcctctcctcatccagactaactctactgtgaagtcccaccacattccaggttggaattttagattcagggtggattttccctgccgtggaagaacacagncatntccctagctttctcacgctaaccctgaagtatgatcacttctgaacctgntcctttcttaactgccaggattggaagcaagagcatcaagcccataggatgactgcgcaatcctgttcagtattgtgaagtagcccttaatcctaacttt

SEQ ID NO: 8227 - DNA, 373 bp, Mus musculus
taaggtatttctcagtttgtgcaaaagtggagctttactttgtttatttgaaaagcaggaaaaattatagcaatctgtcattttaccttaaatggacaagcctgggcatcacaagtacttccaggcttccctgggatataccaagacatggagttcaattttgcttttctgtggttgtgagtatagatgctggaattggggtttgacggtgtgatggctgctgacaagaagccagaactcccattcctgagggacttgagactgaggaccacgtttcatctcccttcatgccgtgttctgtctcctctgtccaagttgactaaggatgttcttggttgtttggtttcagttggtgctctgaagctgaatctca

SEQ ID NO: 8228 - DNA, 327 bp, Mus musculus
ggagaactactaccgcttagcagaggacctctccaacgaggcgcgcgagcttcgggtcctgattgacgattcgcagagcattatcttcatcaacctagacagccatcgcaatgtgatgatgaggttaaatctccagctgaccatgggaaccttctccctttcactctttggtctgatgggagttgcttttggcatgaatttggaatcttcccttgaagaggaccatcgcgtgttttggctggttacggggattatgtttatgggaagtggtctcatctggaggaggttgctctcattccttggaagacagctggaagctcctgtgcc

SEQ ID NO: 8229 - DNA, 544 bp, Mus musculus
  misc_feature (121)..(121): n is a, c, g, or t
  misc_feature (317)..(317): n is a, c, g, or t
gttcttctagatactcatctgccatccattctagttttaggggagactgcctgttgccctaccttttcctcatcctttttaaggattgagctcagctaagttaagatgtgatttttttttnaaatatttttttttaaagcaagttccctttgggaaagagaagagtggtaagaagcaaccttgtatatggggtttcttcaggtgaacgggtgcagagtgatctattttttaactacttagcaataactacatgtgggtttgagtgcacctgagaaggggtggaggagcccagatgtttggctagactgtttgaaacnaataccaaaaacctctatagagcactatcctctgctgctgtgtttctgtagaaagcaacctattttactaattttttaaagaaagacaggaccctgacagagaacatttaaaagttactgactcctgcccctacctaagtgggtttctccttcctgtcacttctggagagtgaacttaacaccctggcttcttttgttaagccgtggctgaccttaatctgtggtta

SEQ ID NO: 8230 - DNA, 480 bp, Mus musculus
  misc_feature (216)..(217): n is a, c, g, or t
  misc_feature (223)..(224): n is a, c, g, or t
  misc_feature (233)..(233): n is a, c, g, or t
  misc_feature (375)..(375): n is a, c, g, or t
  misc_feature (396)..(396): n is a, c, g, or t
aaaaactattactacatgtgcgagtagttaaatagcctttgatattggtattggtgattggtatgcagaaaaaatgaaaaactgttatgtcagttactgtgaaatatttttagttatttccttatcgtgtgcttgttcctaaaaacattggttgtatgttattttcaagctgttctgcctctaagacgttgaagaaaaagctgtggtgtttgggcnnaccttnnttgtgatgnccttcttatcctcctaataatattgccaagtagggtagattccacacgattgctcttaacccttggtattagcaaatcatataggtgctaataacgaatattggatacagtcaatacaggaatataaaatggaatgtaaaancctgttgctatgaatggttanccatctacatgttgtacaaggaatgttgatgttatgaagtgtggaaacttggtattgaagatgtgaactcaaagctttgtggat

SEQ ID NO: 8231 - DNA, 449 bp, Mus musculus
gctcatgccccactctgaaaaaagacaccagcagatcaagaattttctgaattcctgtgatgctcggatcattttacagcagatagaagaacatatgaacactggccagctagcagggttttcacatcagattggaagtctggttctgaatcatgttgtaaataagaaggaatttgggattttggcaaagacaaagtattttcagttgttgaaatgccacgtgataaacaccggcaacgtcactgaattggtaaactatttggcaaatgacttcagtgtagatgaagcatcagcgttgataaatgagtattcaaagcattgtgggaagcctgtgccagcagatgcagctccctgtgagatcctgcagacatttcttggtggatcatagtaaaacaaacaagttttcaaaacaagaggaagtctggagtctgccgctaattaatcttatt

SEQ ID NO: 8232 - DNA, 529 bp, Mus musculus
atgtttacaaccaagggccacctctcgctgatgttttaaccctcaccttcaccaggctacctgttagtttgagtttcacctctgtctgctccctccctgattagggtccacttgagtacacaaaccctgattttaccttccctccatctaaggcagtgtgtgatgactgtgtgggaatgaaatctcttgtacatacttagcacagcacttggggtatgaacccacacccctgttctgtaacattagcgcttactgtaaaacatcgggagaagtatagtattgtatttgtaacaatatcattctttgtatacacgaaactcaatgatctctatatataaatataaatatatataaataaaatatatctacacgtgagcctggaatgttgatactgcacacccactgaatgtatttcctctgacagtctggtcaccggtcctggcccaccctccccttctttgtgccgtggcggcagttgtctggtttggggttgtgatgtatttaatgtgctatctccttatttaactga

SEQ ID NO: 8233 - DNA, 549 bp, Mus musculus
  misc_feature (176)..(176): n is a, c, g, or t
  misc_feature (270)..(270): n is a, c, g, or t
  misc_feature (272)..(275): n is a, c, g, or t
  misc_feature (277)..(283): n is a, c, g, or t
  misc_feature (327)..(327): n is a, c, g, or t
  misc_feature (329)..(329): n is a, c, g, or t
  misc_feature (333)..(333): n is a, c, g, or t
  misc_feature (336)..(337): n is a, c, g, or t
  misc_feature (339)..(342): n is a, c, g, or t
  misc_feature (344)..(344): n is a, c, g, or t
  misc_feature (352)..(352): n is a, c, g, or t
  misc_feature (355)..(356): n is a, c, g, or t
  misc_feature (359)..(359): n is a, c, g, or t
  misc_feature (361)..(361): n is a, c, g, or t
  misc_feature (368)..(368): n is a, c, g, or t
  misc_feature (370)..(370): n is a, c, g, or t
  misc_feature (392)..(392): n is a, c, g, or t
  misc_feature (401)..(401): n is a, c, g, or t
  misc_feature (404)..(404): n is a, c, g, or t
  misc_feature (417)..(417): n is a, c, g, or t
  misc_feature (421)..(421): n is a, c, g, or t
  misc_feature (423)..(423): n is a, c, g, or t
  misc_feature (436)..(436): n is a, c, g, or t
  misc_feature (445)..(445): n is a, c, g, or t
  misc_feature (463)..(463): n is a, c, g, or t
  misc_feature (495)..(495): n is a, c, g, or t
gtagatcctgaaaactgcagctctgacctccatcccagtctaagcttactgcaaggcctatgaaccccaacggctgttctgagttgactgtatcccaatactccgatcttattctacaagtcatatcttggaccctcacccagtatcctgaggaactaggcctccattagcacaanctgtcggtgaagccatgttcccgtcgtgccacaggctctgtgggcggtgcaggaaagcatcggtgcctagcagcactcctgcctccaaaccttncnnnntnnnnnnnaagcacgtgtgctttatttatagctctgtagactcctagccccntnctantcnntnnnntnagaggaanatnnatntntgtagananacacaagacatgctggaggaantaagggccnagntcaggtgtttaanaaantntggggctgggganttcctgttnccacagaactggggtgcnccctcaccactaagcttcccaagtgtgctgtnccttagagatgccaactgggcacaagaaagcgaacacagttcctaatggcatat

SEQ ID NO: 8234 - DNA, 499 bp, Mus musculus
  misc_feature (95)..(96): n is a, c, g, or t
  misc_feature (98)..(98): n is a, c, g, or t
tccctgcgttgaagccgagccctgaccccggagcgctgacccagtcgcgagcagtttagttgagaagccatggtggggcggcgggccggggacgnngnccacaatgtgcaataacgtggtgtcgcggggccggacttgggcacggacctgggtggcatgggggggtgtcgttttctagccagctacctcggtaactccaattcattcaggttaacttccccatggggcagccggccgcgggcttgggctctgtcgccctgctcttgtgtggcccgcggcgtgtgaggctccccggctgcctccttaccttcgggagcctcgctcttccaacgccccgctgccaggcagaccctggggcatcctgctgccctccccacccgactctgtcaggaagcaatacccggtccagtctggagctgggctgcctggcggtgtcaccgcatgaactcgccgggaggccggggccctggccagccacacggcactcttttctaatatt

SEQ ID NO: 8235 - DNA, 431 bp, Mus musculus
  misc_feature (57)..(57): n is a, c, g, or t
  misc_feature (82)..(82): n is a, c, g, or t
  misc_feature (134)..(134): n is a, c, g, or t
  misc_feature (155)..(155): n is a, c, g, or t
  misc_feature (183)..(183): n is a, c, g, or t
  misc_feature (222)..(222): n is a, c, g, or t
  misc_feature (251)..(251): n is a, c, g, or t
  misc_feature (253)..(253): n is a, c, g, or t
  misc_feature (267)..(267): n is a, c, g, or t
tgacagaatccacctttacgaaccttctgtcaatggaagcctctgggcagcagaagntgaggaaccgattctcgtgccatgnatcatagtgaatctggtggtggctctcctggttggattatcctggctctttntgtcttacagaccaggcatgnatcttagtgaagagttaatgttcttttntgatgtggacgagcaccctgagacaggaaccaaagcctntccatagccgctccttccctgcagtggcncntgcgctccccactngtgtttttaagtgtatttttataagatacatgtatttacaattgagcttttgttacataatgctgaaatgctactggagattatgaaaaatgtttcaattttatctggtccttataccaaactaacatctttattattatcaccttagtgatacaggagataat

SEQ ID NO: 8236 - DNA, 264 bp, Mus musculus
  misc_feature (146)..(146): n is a, c, g, or t
  misc_feature (237)..(237): n is a, c, g, or t
acaaatgcactttgggtgtgttttggtatttttctgggcatagaggggtgggtgttgggatgtccctgtagattagttccagagtggggtgtctgtaaatactgtactaataggcatgtgtgactcttgtaaagggacattagtanctgctgcaggtcctgtttggaaactgtgtgtataattcccggttttttgtaagtgtcagcgcgggagacatttgactcttgtgtttgtatntcctttttatgattgctgtaccgaccc

SEQ ID NO: 8237 - DNA, 455 bp, Mus musculus
  misc_feature (28)..(28): n is a, c, g, or t
  misc_feature (96)..(96): n is a, c, g, or t
  misc_feature (109)..(109): n is a, c, g, or t
  misc_feature (123)..(123): n is a, c, g, or t
  misc_feature (130)..(130): n is a, c, g, or t
  misc_feature (139)..(139): n is a, c, g, or t
  misc_feature (147)..(147): n is a, c, g, or t
  misc_feature (332)..(332): n is a, c, g, or t
  misc_feature (343)..(343): n is a, c, g, or t
gatttatactgttctgatgttgcaattnggtttgaaacaacatagaagcacacatttctgttagtagtggacatacatatatatagtctttagacntaacaagccagangattcttccttatnggataantaaactgcnttaggagntatgggaccagaggaagtgcatatatttttaccctatgggttgatcattctagcctcaggaaccctgtagaattaactcctgtcataggggctagctcagtgaaactggtagtataataaaacagtgagggagtttctagagtcttaataggttctagcatgaggactatcccttaatattggtntctctcataanaaggcacataacctccgggagtaatctcattgaatttatattacttggcctagatttaatcttattttcatgtattagtttgctaaggtggtcctacactctgcatttcttt

SEQ ID NO: 8238 - DNA, 535 bp, Mus musculus
  misc_feature (181)..(182): n is a, c, g, or t
  misc_feature (308)..(308): n is a, c, g, or t
  misc_feature (311)..(311): n is a, c, g, or t
  misc_feature (333)..(333): n is a, c, g, or t
tgccccatcttgatatttctcttctttaactcgagtgtgtctatgagccctatttccatctgtccttctatctgggccgcccctagcccagtccaactagcaactctgtccagagctcagtggatggaactgattccagcctggcaccagcagggaccatcttgggtcaggtgcttctggnntagtgcttctggctcaagcctcctcggcccaacttcccctcagcgggctctgcaggagctgcaggtgatgctctcagcatctgtctccttgtttaaacaaaatgccctcatttttcttgtcttganaanctgcgggctgcctctacccccncagcccacagggtctcaccgatttattgttcgtttctttgctgtggaataaacctcgagcagccagttggctttttaccctttagatattttttagtcatcggctgaccacacacagataaagtccgttttgttacttcttccactctgtgtgccttgagaaccgctcatgtggtacaaccaattctggtgacaatcctgtg

SEQ ID NO: 8239 - DNA, 516 bp, Mus musculus
  misc_feature (115)..(115): n is a, c, g, or t
  misc_feature (241)..(241): n is a, c, g, or t
  misc_feature (258)..(258): n is a, c, g, or t
  misc_feature (306)..(306): n is a, c, g, or t
  misc_feature (322)..(322): n is a, c, g, or t
  misc_feature (337)..(337): n is a, c, g, or t
  misc_feature (343)..(343): n is a, c, g, or t
  misc_feature (358)..(358): n is a, c, g, or t
  misc_feature (375)..(375): n is a, c, g, or t
  misc_feature (387)..(387): n is a, c, g, or t
  misc_feature (413)..(413): n is a, c, g, or t
  misc_feature (422)..(422): n is a, c, g, or t
ttcttcccaatttcatggtctcatcctgacctacagcagataagtaaggatgattccatttctgtattctctcgagcccatccccctctccctgccgtagagtcgggagtacccnttttttttttttcttctcaagacagggtttctctgtatcaccctggctgtcctggaactcactctaaagtaccctcttaattaaccatgcttagagaggaataaaaggacaagaccagagtttcanctaccttggattctgcnccgactcaggatcacagtcagtttgtgtgaggtcaccagtttataccnaacaggtttcaagggnccacggacagaactntcttgntcagaatcagctgantcttgcagacatgattntactccagaccnttttgtctctagaagagaaacttgcnaacattctnccttccttttcttttctttgggaaagtaaatgctgtgttagaagtttggaccagaattctcggacttcaccatctatggatgcttcgcttttga

SEQ ID NO: 8240 - DNA, 539 bp, Mus musculus
  misc_feature (278)..(278): n is a, c, g, or t
  misc_feature (311)..(311): n is a, c, g, or t
  misc_feature (313)..(313): n is a, c, g, or t
  misc_feature (395)..(395): n is a, c, g, or t
  misc_feature (455)..(455): n is a, c, g, or t
  misc_feature (475)..(475): n is a, c, g, or t
  misc_feature (497)..(497): n is a, c, g, or t
  misc_feature (513)..(513): n is a, c, g, or t
gttcacacataattcttgccatctattctggccttttcataggtacgtgataacaggtttacttcagaatccttaagagcaaaagctgtttcttagttcaagtcatgtcttcatatgtggagtggcttgcaaagatcacagaatatgccgacttcagactgggtttcagcccgttagtgagttgtgaggtccagtcagtggatggccactgagattacagaacagcgaagtggaataaaagtagatcagaatgcatcctgtagtaaaggcaaatactnttctgtgaaccttctcagcggagcgtctgagancntgctaccacatcaaatgtatttgttaaggggtacaaacatacaggttgaagaaacgatccgagctgagagaaccaaatgtgncctacataggtgatcttgtggttttgctttgaacttcagattacaacattgtttctattncctgaacacaaatgtaattnccctgcagatacaaaaaggatntctttttctgtcagtntctgagtaggcagtttgtgtaacccc

SEQ ID NO: 8241 - DNA, 370 bp, Mus musculus
  misc_feature (240)..(240): n is a, c, g, or t
  misc_feature (258)..(258): n is a, c, g, or t
  misc_feature (267)..(267): n is a, c, g, or t
  misc_feature (269)..(270): n is a, c, g, or t
  misc_feature (275)..(275): n is a, c, g, or t
  misc_feature (284)..(284): n is a, c, g, or t
  misc_feature (343)..(343): n is a, c, g, or t
cggaatgtggagtcacctcaggtgacgctgaaacacacgagccagagctgcggtcccatgggcatgggcagcgtggttctccaggtgctgggcttcctggtggacaccgccacaggcaataagcttgtccaggtattgctggaggacaaaaccactgagagcgctgtgaagctcagccttcccgtgggacaagaggccctcataaccctaagcaatggacagaggtttgtgatccacatntcagatgtgccccaaagntcagaaaananntattncaggaaaancaacgcgaacgtgcaaggtggtttgctggagtagggtgtgaggaagcaggcttgagttntccaaacatgtgtggaaccctaaagtt

SEQ ID NO: 8242 - DNA, 439 bp, Mus musculus
gacaaacccagcaggctaactgagaaggaacttgctgaggctgaaagcaagtgggctaatgaaacactagagaagtcagacgaaagtaacttggctgaaatgaatgagtttgaggcgggatccacggcacccttatttattgaccagacagaagaacccgagtcaaacacagtagatggtacagaactgtatgaagacagccagctcagcaaccgctctaaagccattgcctcgaaaaccaaagagattgagcaggtttaccgacaagactgcgagactttcgggatggtggtgaaaatgctgattgaaaaagatccctcattagaaaagtctgtccagtttgcactgaggcagaacttacacgagataggtgagcgctgcgtggaagagctcaagcgtttcattactgagtatgacaactctgctcaggactttggag

SEQ ID NO: 8243 - DNA, 428 bp, Mus musculus
  misc_feature (217)..(217): n is a, c, g, or t
  misc_feature (236)..(236): n is a, c, g, or t
  misc_feature (245)..(245): n is a, c, g, or t
  misc_feature (254)..(254): n is a, c, g, or t
  misc_feature (264)..(264): n is a, c, g, or t
  misc_feature (279)..(279): n is a, c, g, or t
  misc_feature (282)..(283): n is a, c, g, or t
  misc_feature (289)..(289): n is a, c, g, or t
  misc_feature (313)..(313): n is a, c, g, or t
  misc_feature (323)..(324): n is a, c, g, or t
  misc_feature (396)..(396): n is a, c, g, or t
  misc_feature (398)..(398): n is a, c, g, or t
tgtatccctgggaggacaacgactccgtaaagcgtaaggaggggcgaagagctctggttcttgaggtccagtgggttattacatcgtttcccaagatgtcccatgtgatgctttattattttcataaatgtatgtgaggctcacatattaaccactgttcaaaaataccagtaaggcagaattatgcagaacttttgtgaggtttaatgcacacgtnaagcatatcgcttacattnttacatatnttaaccagntccttttaanacagacatttacatnatnncacaanttatagcaacatcaagggcttttntccccgcttnncaatgaattgttttcttctgtaaggatgttgcggaccagcaggtatcagacttgccaacatggtcggtagantnttcccagcatacacctgagcactgaaagag

SEQ ID NO: 8244 - DNA, 458 bp, Mus musculus
  misc_feature (64)..(64): n is a, c, g, or t
  misc_feature (84)..(84): n is a, c, g, or t
  misc_feature (201)..(201): n is a, c, g, or t
  misc_feature (431)..(431): n is a, c, g, or t
atcactggcatgtgtgctgcttgaccacccccccttctgttcacctgccccccttctgtttggnctttggctttttgttggggntgagagccctagctcccagctcccctcactatcttttgacactaagatggaaggttactaagttgcaggaacaggatgaaaattctttattaccctcttcaacttttaggacgagcnacttgggagtgtgaggccttcctggctgcttctatgtagtcctaccacctgcacagaggggctggcagggcagaagtgtgacctcagttatatatacatcccagctctgcccagtatccctcacttaccaagaggagaatggagggataatggactcaccctagcctagggcttcgacattgcatgctgggatccagctcctacccttcctgcactcccttccccagttntgctcagctcagctgtgggaggtaaac

SEQ ID NO: 8245 - DNA, 328 bp, Mus musculus
agaccaactcggtgtcaatgccttttgtgtaggaccaatcggcaagtatacattccctgagaagtttgttcccacaccttcagaacacctaggctaaaatgctgcttctataattcctggacctaacctaagagaatttctctgagggcccatttagtcatccagacttctgtctacttacgagtagctttcgcagaagggcactgtcatataaagtagtctgtcatgcactttacaaattataagcttgtacagccttatgacagtttattctaagcatgaaaactggttcatgagtttattaaatgtagctctgtcagcctgtggc

SEQ ID NO: 8246 - DNA, 401 bp, Mus musculus
  misc_feature (72)..(72): n is a, c, g, or t
  misc_feature (140)..(140): n is a, c, g, or t
  misc_feature (350)..(350): n is a, c, g, or t
  misc_feature (368)..(368): n is a, c, g, or t
gggtgatgtgttcaagcctctcccacaacctttatgggtgcatttcttttctgtgtattctctaatgagaancactgggccacctctgcatggtttttcttgccaatttctcttgtagccctctctcccagcagacaacnacattcagcacacccctcacttgtgcactgccatggccgtccgttccttgtgaccagccagatgacttagataataggggagtttgaaatgaatgagctgatactatctgtaggttaggattctgaccaaaaggtcttcagggctctaggggaagggattaattgaaataccttcccgagcatagggcttttctccagtgtgaattctcngacgttgaatgagtttcntgaatcttgaaagccatcacgtggtcactgttg

SEQ ID NO: 8247 - DNA, 566 bp, Mus musculus
  misc_feature (164)..(164): n is a, c, g, or t
  misc_feature (380)..(380): n is a, c, g, or t
  misc_feature (423)..(423): n is a, c, g, or t
  misc_feature (460)..(460): n is a, c, g, or t
  misc_feature (462)..(462): n is a, c, g, or t
  misc_feature (467)..(467): n is a, c, g, or t
  misc_feature (473)..(473): n is a, c, g, or t
  misc_feature (499)..(499): n is a, c, g, or t
  misc_feature (501)..(501): n is a, c, g, or t
  misc_feature (508)..(508): n is a, c, g, or t
  misc_feature (541)..(541): n is a, c, g, or t
gtacagccagagttcttgtgcgactggaggtttgagcggctttttgacctgtattaatatgacggcttggccaaccagcaggaggagatacgtctgactgttgataccaccaagaccgccccagcggacagctgcagtgaccttgtccctcctcttgagctctntatcagaaccaagtggaagggggcatctgtaaactggaacggctcagaccccatcctgtgacccttggatacatggagttctatggcttcagcactcatcactgggatgaccccgggaccccaggtcttagggtcaagtctcttagaggagtcaccctgcctgagtttgcatgtccacagaggcatgctcagtcttccagttccttccatgaaggnccatggcagggtcctgttgagattccctcctggcctagatgtncctgccaaagacaggaaggagggaggccaccagagantntactncctttngtttgcatccttcctgaataaccctntntccaagncctctggtgtcactggctttggggaccctggantcttgttactgcagcttccataaag

SEQ ID NO: 8248 - DNA, 482 bp, Mus musculus
tatccgttacagctgttctgagatgttcgtccaccccctccctcagttcctcacaatcagggctcctccatcctcattctcgaggaacgatccagcctggctcgccatgtgtcacgagatccttgctggctgtggagtatgcctcactctttcgaaataggaagcagatgccactccatgtgtgggtctgggaatgactttctgaaacacagcaaggatgctgagacacgttgttttgagacaggatctcactgcgtagcccaggctggtcttggacttgcagccctcccctgcctccagtgttggggttattgcccaacactggatttaaaacgctccaatcctaagagttagggtcttgatatgcagccttggctggcctggactttgtataccaggcaatgctcctgcctttgtctccagaatgcctgggtggtgagaatatgctaccacacaccgctgagacttcaacttctcctaaa

SEQ ID NO: 8249 - DNA, 483 bp, Mus musculus
  misc_feature (153)..(153): n is a, c, g, or t
  misc_feature (159)..(159): n is a, c, g, or t
  misc_feature (167)..(167): n is a, c, g, or t
  misc_feature (376)..(376): n is a, c, g, or t
tggcttttcggaacccaggaatccaagacgagcccccaaagattcggggtgaaaactacttttggtggaaggtattagaggaagatttacaaaaactgcttctgtacagactccaggaatcttctgtgatccccctgagcagatagagagatnccagcnagggaccnaaaagctgagctgccccctccctctgaggcagagaaaaggctggcagtcagggatctcattgcacattttgagggggcagggaccacacattgagcccaaagggagggtgtcttgaatccacttttcaagggctcagttctgagggcacacagtacttgtcttttaagttggtgaggaactttttgaaccctaaatggcaccatctttntccactttggaaaaggctgcatgtcaatccttccaaccccataggaatgtagagagggatgggacatgggggacgcatccctcagggcagagtcctcattgctgagt

SEQ ID NO: 8250 - DNA, 490 bp, Mus musculus
  misc_feature (253)..(253): n is a, c, g, or t
  misc_feature (375)..(375): n is a, c, g, or t
tatgatttacagtgcaccctaggatcttttttcttactatataaactgtgactaatactaaaaagaaaatgtgagattatcaaaggtactatctctatctttgtatgtgtaagacaccagctggttccaaggttacatgccataaatggaaaagtagtatttgagagcatgcctacactgctgtaagcaatcattaaatgtgataatctgaacataggaaaatagaattctcacttctggatttccttttttnaacaacaagtggagacttaggaataatagattaaatttgggataatatcttcaaatgaatatctgaataagttaggtactaatttggggggattccagttttttagcttttttctttttctnttttcttttttttccttttttttgcttggtggctagtgtgggctgtcagtgtactgcacagtgctaagatggtcctagatattaacacctgcatcccgatagctcaaaaggtgta

SEQ ID NO: 8251 - DNA, 555 bp, Mus musculus
  misc_feature (49)..(49): n is a, c, g, or t
  misc_feature (326)..(326): n is a, c, g, or t
  misc_feature (328)..(328): n is a, c, g, or t
  misc_feature (385)..(385): n is a, c, g, or t
  misc_feature (405)..(405): n is a, c, g, or t
  misc_feature (423)..(423): n is a, c, g, or t
  misc_feature (463)..(463): n is a, c, g, or t
ctaacagatttcctcagcaggcctgggaagaagcccggcaatttttctngaaaaaagaaaaaaaataaatgttttttagctaattctgtatttgagtccctttgttagtgttttccattgttccttgaggagcctctgatctgtttatactctcctactgtagatacccctctgtgcattgtttataaagactgttcatactggccttcctagctttgcaaattgagtttgtttcctttgtgcataatattttggaattgtttattacttccatgctatgtaacttgtaattgtaatatggtaaagttagacaaatatcattcttntnatgaagtaacacagttttcagtgttgacttttcacattaagcagtacaaatttgagnaagtgttaagaatttataanccctgctttaagtttttntttggagttagagacctgtgtaactaacactttcagtaancctttgtactatttgaaattacagcacctaaccactggtcgggaacttcactggcagaaagcactgtgaactattcgtgttgctgagctaaa

SEQ ID NO: 8252 - DNA, 393 bp, Mus musculus
acctaagattcgaggctctgggtctaacattgcacatcctagactttgagcagagccggttacttggtaactggcaattgtgggggaagggcctccattgagatgtaagtgttccagtggagccatctgaaggcgtgacagtgtagagccacaccccttgcatgcacctgatctcagaaccaagccaggtcaggcacctcagtccttacagagagcgggattatttaagtggcacaactgaaactaagaccacagtagagctaggcaaggtggcatatgccttttaatcccggtacaacaaaccaacgaaagagaacttgcaggaaagcaaactctttgtcagatgcctatgctgagttttgcccaccaacccagccttgtatcttcttcaga

SEQ ID NO: 8253 - DNA, 150 bp, Mus musculus
  misc_feature (86)..(86): n is a, c, g, or t
  misc_feature (97)..(97): n is a, c, g, or t
  misc_feature (111)..(111): n is a, c, g, or t
tcagacagtctgtatcttgaccagaggcatccctctggtaagaggcagtgaggactgagaaccggagcctggactgtactgagagncccttcacagnactcttggcacagntcttagtcttgccttcaggatgcactcaaggtggcccag

SEQ ID NO: 8254 - DNA, 516 bp, Mus musculus
  misc_feature (341)..(341): n is a, c, g, or t
  misc_feature (343)..(343): n is a, c, g, or t
  misc_feature (348)..(348): n is a, c, g, or t
  misc_feature (355)..(355): n is a, c, g, or t
  misc_feature (357)..(357): n is a, c, g, or t
  misc_feature (362)..(362): n is a, c, g, or t
  misc_feature (391)..(391): n is a, c, g, or t
  misc_feature (404)..(404): n is a, c, g, or t
  misc_feature (417)..(417): n is a, c, g, or t
  misc_feature (444)..(444): n is a, c, g, or t
  misc_feature (446)..(446): n is a, c, g, or t
  misc_feature (467)..(467): n is a, c, g, or t
tgtgtaggtccccatgctttgtactcaagtatgggtgctaggtaaggggataggaacaggatgcccacctttggggtagacccctcagattctactacagtatgattttggagccctctggtgtttaagaaaccagacagtccgtggacacccaagcatgggaaaagccccaagtcctccctgcactcaggctggggtgcctaagctaagtgggtcctgacagagaacagagccagctcttggggaccctggaggtttgctagtgtgtgaatgtgtacccccaaaagttcatgtcttggaaacttggtccccggcacagcagccctgagagaggagcgctntnccagngcctttntnaacangtttaatcctttcgaggattaataagttntcttgagtatagntttgttataaagncaagttcccttgggcatgcttgttcantntgcatgtgatacctccacgtntcatgacatagcacaaagccatcagacacagcaaacaccaggcattagg

SEQ ID NO: 8255 - DNA, 495 bp, Mus musculus
  misc_feature (67)..(67): n is a, c, g, or t
  misc_feature (129)..(129): n is a, c, g, or t
  misc_feature (142)..(142): n is a, c, g, or t
  misc_feature (154)..(154): n is a, c, g, or t
  misc_feature (175)..(175): n is a, c, g, or t
  misc_feature (367)..(367): n is a, c, g, or t
  misc_feature (377)..(377): n is a, c, g, or t
  misc_feature (386)..(386): n is a, c, g, or t
  misc_feature (432)..(432): n is a, c, g, or t
aaagcgagtcttgtcactaacagttggcaacaaagaaaaggaaaaggacaaaggaaagaaggggaanaggggcaaaaagaagaagtaatgtcttcctcagcagctaccccgagcatctttgagatgatntcggccccagctngtcagggagagnctcacccctgctcacctgggnaagcccacagagaagctaagcggagagcagccactccaaggcactgtaccctgaccactgtgttctgttatccttcaggaggctgcacaccaagcaagatgtcccttacagccataaccattacttgccattatcccttaactcatgcaaagtctgtcaatatcaagttggcttcccttgtgctccacactntacccagctntcacacttnccagtattagttagcaccaagattacaacataaagggaggtctctntcatggcaagagcaccgtagttctattgttggtacactcgctctttattaacccatacgcatt

SEQ ID NO: 8256 - DNA, 315 bp, Mus musculus
  misc_feature (59)..(59): n is a, c, g, or t
  misc_feature (76)..(76): n is a, c, g, or t
  misc_feature (88)..(88): n is a, c, g, or t
  misc_feature (93)..(93): n is a, c, g, or t
  misc_feature (117)..(117): n is a, c, g, or t
  misc_feature (123)..(123): n is a, c, g, or t
  misc_feature (247)..(247): n is a, c, g, or t
ataccagctcccaagacacatctgtcagccacttcgagggaagcgtgaagccatgctgnagatgctcctgcgacancagatctgtaangaggngcaggcagagcaggaacctgcaanggaagntctttgagaccgagtcggtaacacaccatgactacagagtggagctggtacgagcagcgcctcctgcctcaacaaagcctcatgattaccgccaggagcagcctgaaaccttctggattcagcnggcagcacggctaccgggtgtcagtgacatcaggacactggacacaccattccggaagaactgcagct

SEQ ID NO: 8257 - DNA, 583 bp, Mus musculus
  misc_feature (91)..(91): n is a, c, g, or t
  misc_feature (175)..(175): n is a, c, g, or t
  misc_feature (199)..(199): n is a, c, g, or t
  misc_feature (262)..(262): n is a, c, g, or t
  misc_feature (286)..(286): n is a, c, g, or t
  misc_feature (334)..(334): n is a, c, g, or t
  misc_feature (339)..(339): n is a, c, g, or t
  misc_feature (427)..(427): n is a, c, g, or t
  misc_feature (444)..(444): n is a, c, g, or t
  misc_feature (447)..(448): n is a, c, g, or t
  misc_feature (464)..(464): n is a, c, g, or t
  misc_feature (468)..(468): n is a, c, g, or t
  misc_feature (478)..(478): n is a, c, g, or t
  misc_feature (487)..(487): n is a, c, g, or t
  misc_feature (501)..(501): n is a, c, g, or t
  misc_feature (510)..(510): n is a, c, g, or t
  misc_feature (514)..(514): n is a, c, g, or t
  misc_feature (529)..(529): n is a, c, g, or t
  misc_feature (544)..(544): n is a, c, g, or t
  misc_feature (556)..(556): n is a, c, g, or t
ggagctgttgaaacgacactcggaggggcctctgattgtggacactgtctctgccgagtccctctcagtgctggtaaaggtcgtgcggcanctgtgcaaacaggcccctagcatatccgtgctgctgctcagcccccagcccactggcagtgtcctgtgtgcctgccaggtggcncaggatgccacgcccaccttcacngctgaagcctgggcactggctgtgtgcagccacatgggaggcaaggcgtggggctccagagtngtagctcaggggactggacacacnggctgacctggaggccgccctcgggacagcccgagcttacgcactcanccagnctctgacgaggaccacccaggacacagaggaacaagaggcaggcaagcatctggagccctcatgaaaccacagagctttcctggaggnctgaggcagaggaccancannccggaggccaggtatntganccaaagaagntcacccggnccaccaggagactntaagaaacnaaanccaactgagaggcancaacctcaacagatntgaagacccggnctgctggagctgggagcagctaataaa

SEQ ID NO: 8258 - DNA, 410 bp, Mus musculus
atcgccgcctgtgaggagatgctgcggcagctgggccgccggcgcccagaaccggctggtggcgggaacggttcagccaagtctggagcgccgccccagccatctgtatcggccagaggtggccttccaaaggatgctggcgatggagcctcggagtcttgatcataccctagccgggcaccctgacttctgtccctttccagggccagtggctggactgtgaccaactcccttcactaaaaggggccagtcttcacgggcagttgctggtacttggccctcagcctgggatggcaactctactagcagctgggttcactcccacgtcgtcctggctgaaggcagtactgtgctttgaaatggagccaacaaacatccagtcttgagtactcggattcaggaagccagca

SEQ ID NO: 8259 - DNA, 510 bp, Mus musculus
  misc_feature (35)..(35): n is a, c, g, or t
  misc_feature (58)..(58): n is a, c, g, or t
  misc_feature (68)..(68): n is a, c, g, or t
  misc_feature (70)..(70): n is a, c, g, or t
  misc_feature (72)..(73): n is a, c, g, or t
  misc_feature (76)..(76): n is a, c, g, or t
  misc_feature (137)..(140): n is a, c, g, or t
  misc_feature (144)..(148): n is a, c, g, or t
  misc_feature (150)..(156): n is a, c, g, or t
  misc_feature (158)..(162): n is a, c, g, or t
  misc_feature (463)..(464): n is a, c, g, or t
  misc_feature (475)..(475): n is a, c, g, or t
gaatcatcttgcagcatgccatctattctgaatgncaataatggaataaaggaagcanaacccgctcngngnntcnaacagtgttcttacaagggaacaagaagtttcaagtggctgtggagatgagagcaaggaannnngcannnnngnnnnnnnannnnnaggacacagagaggcggatctagtaccctcagaactgtttcagttcagcttgggagcagccatgaaagaaacaaaagcctaccagttactgaagaagtctacccttcaggacaattcaaatcaagctgaagagagatttgaaagtcagttttcaggtctggatattggtggcagcatgttcacaacaaagacagcccacaaaatcgcctcggaagctagtttttcatctagtgaaggaagtcctttgtcaaggcacgaaagcaaaagggacccagtgaccaccataaagtcaaatgccttnntggggggagtntgatgacagtaactctgaaatcgaagctgccctac

SEQ ID NO: 8260 - DNA, 460 bp, Mus musculus
  misc_feature (53)..(53): n is a, c, g, or t
  misc_feature (74)..(77): n is a, c, g, or t
  misc_feature (137)..(137): n is a, c, g, or t
  misc_feature (219)..(219): n is a, c, g, or t
  misc_feature (224)..(224): n is a, c, g, or t
  misc_feature (232)..(232): n is a, c, g, or t
  misc_feature (234)..(234): n is a, c, g, or t
  misc_feature (359)..(359): n is a, c, g, or t
aaggcggaacatgcatgtccactctttttaggaagattgggtttattacatancccggagatctgggactcagnnnncgattcttggccagcctaaggcgcataaattctgccagcaaggctgctggccggcacaantgcacggaagaggtactgatcagcaagacggaaggccagcagacacaacgacagtacaaggattcaagcttggcctcgtgantcatntctggtgntntcttgctcagctgaactgaaagcatctaagtggcctgcctttgtgtgcccctgcgcctgtatagaagtctgtatttttttgttattgttgagatttattattttttgttacacaatgaccgtttntcttaatcttgttctaaaaataactgcatgttcaatctggctgctcaggtctaattctaacagtattctgttgggactataaagggtctgtattcccagtc

SEQ ID NO: 8261 - DNA, 339 bp, Mus musculus
  misc_feature (126)..(126): n is a, c, g, or t
  misc_feature (139)..(139): n is a, c, g, or t
  misc_feature (189)..(189): n is a, c, g, or t
  misc_feature (253)..(253): n is a, c, g, or t
  misc_feature (314)..(314): n is a, c, g, or t
tgctgcagagcgaggcatcctgcctgcattgaaacagagcctgaagaacaactttgctgagcggcagaaaaggctgcaagtagtacagagccgccgcctgcaccgctctgtgctgctgagccggcnccctggagcccgnccatcctctctcgatagtggctcacaccaaccctattttgcagccacacncaattccaaaacagacagaacccacgacagataaaagcacttgctctcagaaatgaggagattntctattttctcgattttattattcctgcatttatgcaaaggcacataatagaatgttactntcctacctgtagactgaaaataaaa

SEQ ID NO: 8262 - DNA, 493 bp, Mus musculus
  misc_feature (57)..(59): n is a, c, g, or t
  misc_feature (61)..(65): n is a, c, g, or t
  misc_feature (241)..(241): n is a, c, g, or t
  misc_feature (373)..(373): n is a, c, g, or t
  misc_feature (386)..(386): n is a, c, g, or t
  misc_feature (436)..(436): n is a, c, g, or t
ctccacgaggagatcgagcacctgaagcgggagaataaggatctccactacaagctnnncnnnnntgagaagcctcagaaaaaaggcagcatctccacatggagccttcactctggcaagtccgcctccaattccacgatgtccgctacggcacctcaagtcactcctggaagggaaccaaaggcccaaagctgcagctgaggaggctgggctgggttctccaaacttaattctgagcccnaatgcctgctgcagagcgaggcatcctgcctgcattgaaacagagcctgaagaacaactttgctgagcggcagaaaaggctgcaagtagtacagagccgccgcctgcaccgctctgtgctgctgagccggcnccctggagcccgnccatcctctctcgatagtggctcacaccaaccctattttgcagccacacncaattccaaaacagacagaacccacgacagataaaagcacttgctctcagaaatgag

SEQ ID NO: 8263 - DNA, 213 bp, Mus musculus
  misc_feature (151)..(151): n is a, c, g, or t
ggtcacctccaagggccttagtaagaagtggtgagtcccaggcacagggagtgggtgccccgcagcttggtgccacaagagacaggaggcaaggatttccagaaaaaaaggcaggccctgctcccagcccagccattggtgcagggcaccnttgaggcagctggcagacactctcttgttctccaccctagcttaattctgagcccaatgcct

SEQ ID NO: 8264 - DNA, 440 bp, Mus musculus
  misc_feature (151)..(151): n is a, c, g, or t
  misc_feature (268)..(269): n is a, c, g, or t
  misc_feature (279)..(279): n is a, c, g, or t
  misc_feature (283)..(284): n is a, c, g, or t
  misc_feature (312)..(312): n is a, c, g, or t
  misc_feature (323)..(323): n is a, c, g, or t
  misc_feature (333)..(333): n is a, c, g, or t
  misc_feature (340)..(340): n is a, c, g, or t
  misc_feature (342)..(342): n is a, c, g, or t
  misc_feature (359)..(359): n is a, c, g, or t
  misc_feature (363)..(363): n is a, c, g, or t
  misc_feature (365)..(365): n is a, c, g, or t
  misc_feature (367)..(367): n is a, c, g, or t
  misc_feature (369)..(369): n is a, c, g, or t
  misc_feature (374)..(374): n is a, c, g, or t
  misc_feature (376)..(376): n is a, c, g, or t
  misc_feature (378)..(378): n is a, c, g, or t
  misc_feature (382)..(382): n is a, c, g, or t
  misc_feature (386)..(386): n is a, c, g, or t
  misc_feature (396)..(397): n is a, c, g, or t
  misc_feature (400)..(400): n is a, c, g, or t
ggtcacctccaagggccttagtaagaagtggtgagtcccaggcacagggagtgggtgccccgcagcttggtgccacaagagacaggaggcaaggatttccagaaaaaaaggcaggccctgctcccagcccagccattggtgcagggcaccnttgaggcagctggcagacactctcttgttctccaccctagcttaattctgagcccaatgcctgctgcagagcgaggcatcctgcctgcattgaaacagagcctgaagaacaactttnngctgagcggncagnnaaaaggctgcaagtagtacagagccgcngcctgcaccgntctgtgctgntgagccngncgccctggagcccggcnatcntntntngatantngntcanaccnaccctatttnncanccacacgcaattccaaaacagacagaacccacgacagata

SEQ ID NO: 8265 - DNA, 485 bp, Mus musculus
  misc_feature (196)..(196): n is a, c, g, or t
  misc_feature (262)..(262): n is a, c, g, or t
  misc_feature (266)..(266): n is a, c, g, or t
  misc_feature (270)..(270): n is a, c, g, or t
  misc_feature (289)..(289): n is a, c, g, or t
  misc_feature (300)..(301): n is a, c, g, or t
  misc_feature (320)..(320): n is a, c, g, or t
  misc_feature (360)..(360): n is a, c, g, or t
  misc_feature (447)..(447): n is a, c, g, or t
  misc_feature (449)..(449): n is a, c, g, or t
agggagacaggcatctgccctgtgcgcagggaactctactcccagtgttttgacgaactgatccgggaggtcaccatcaactgcgcagagagagggctgctgttgctgcgtgtccgggacgagatccacatgaccatcgctgcctaccagactctgtatgagagcagcgtggcatttggcatgaggaaggcactgnaggccgaacaggggaagtcagacatggagaggaaaattacagaattggagacagaaaagagggacntggngagncaagtgaatgaacagaagncgaaatgcgannccaccgagaagcgggagantgagaggcgacaggtggaggagaagaagcacaacgagganatccagttcctgaaacggaccaaccagcaactgaaggcccaactggaaggcattatcgcaccgaagaagtgatcatttccacatggntntcagcaggccccttgccccataagcccattgtaata

SEQ ID NO: 8266 - DNA, 128 bp, Mus musculus
cattgtcattttggttggaagcctccagagtgcaaagaagagggactaagtgggagcatagacagtgggtcccctccagttcaaaggcacccaataaaacaaaaacaagagccagtggtgtatttaag

SEQ ID NO: 8267 - DNA, 249 bp, Mus musculus
tttgggttatgactgcaccccagaaaaatgcagttttagaggagtgtgtaacaatcatcggaattgccattgtcattttggttggaagcctccagagtgcaaagaagagggactaagtgggagcatagacagtgggtcccctccagttcaaaggcacccaataaaacaaaaacaagagccagtggtgtatttaagaatactctttggtcgtatttacttcctctttgttgcactgctctttggcattgc

SEQ ID NO: 8268 - DNA, 515 bp, Mus musculus
gaactctaacaaaagcctctctggtgaacttagagaggtcaaaaaagaccttggtcaattacaagaaaacctggaggtttcagaaaacatgaatttgcaatttgaaaaccaattgaataaaacactcagaaacttatctacagttatggatgatatccacactgtcctcaaaaaggataatgtaaagagtgaagacagagatgagaaatccaaggagaacggctcaggtgtatgacacagtgcacttggggatgagtgtgttaatagtgtactataaacaaaataatcatgagatgggaatgtttcacggcagtgcatgcttgactttagtagtataaacatatatgttagttcaaatgatgtataaagttttatgaatgtgagtctgcttttgaaaattgcctgtaatttctagcattcaaattattaaatactcactgagtgaagaattttgcattgcaaaaccttttaggatgaactttgttatagtttccccaataaagttcatcagtgtc

SEQ ID NO: 8269 - DNA, 543 bp, Mus musculus
  misc_feature (417)..(417): n is a, c, g, or t
ataccaatgtagtcagtgttcgtgttgtgatagctgagatcagtaaccgcctagttctcggcacagttggagcagttgtcttaaacaactgcctaggttgacccccttcccagaagagtgagtatacttgcaaggaaggagtggcctaaaggagtgatgcatatgtcatagattcaaggttttcagtgtatgaagtcatccagccctgcctggacaagttccatgagaaagtagattttcagtaatttccttacagatgttttagttgaacaggtagcacaatctactaatgttgtttgatctgtgtttgttatattggttgtaattaattttttaattcaagaactagcagaaaatttattaaattaactattaacgacattcaccttgtaaatttctgtataaaacttgttgacnatgcactgactttaggaagacattaatgtacatagagtgtaaataagatagtgttgatgtactgaaatatgaactgtataaaagtattggtcattgtatatggcgtgtacctgtttatctgtaact

SEQ ID NO: 8270 - DNA, 391 bp, Mus musculus
  misc_feature (117)..(117): n is a, c, g, or t
  misc_feature (121)..(121): n is a, c, g, or t
  misc_feature (311)..(311): n is a, c, g, or t
gacttagagggccaaaccaaccctgggtccttggcaaaatgcaaaagtcagggtctctacagatctacctctggctcagcgcttgccctgccctaaaaaaacagaagtgccaagggnagancatttcatgcagaaccagggtgcactttatgttcctgcacaggcagatgatggtgcctcctggaggctttgggatcttcctgtccctatggtggttctgaagggagagctgttcccctgttgggtgaaacccaggtcccttgccctggagacctggtttcccaggtcaccccacatacctgactgcagcncctcctaaactttgggttccttggtttggttataatgcagttctcattacacaagtgcatttctggctatcacttgtaac

SEQ ID NO: 8271 - DNA, 477 bp, Mus musculus
  misc_feature (76)..(76): n is a, c, g, or t
  misc_feature (175)..(178): n is a, c, g, or t
  misc_feature (185)..(185): n is a, c, g, or t
ggatggatccttgtaagagccaacttggagacgtctcctggtcgtcttcctgacgacactgtcccccttcggcccngagaccgttggcacgaaggcgctttcaccttccatgcactttccatttccccagtggggtgagtcgccctgcccacactcgagcaaccgcagagctggnnnnggcgggncggggcggggcggggcggttgtttcatggttattttgtctgggtttggttaatagcccaggctagctagcgtcaagctcgggggatgtctcctgcctcagcctcccgaggactgaggttacagtgtgcgccatcatgcagtcttctgcacttaatccactcgtttccaagacgtatatagaattgttggacttcaccctttcgttttctgcaagaatcgcttgtttaatattatctgttttgcctgtactgtgccttgtgcaactccagttgggtccaagttgcatcctttg

SEQ ID NO: 8272 - DNA, 519 bp, Mus musculus
  misc_feature (31)..(31): n is a, c, g, or t
  misc_feature (117)..(117): n is a, c, g, or t
  misc_feature (171)..(171): n is a, c, g, or t
aaagcacacgcgtcaatgtactacccctacntgtgtgaaattatgcagtttgacctgatccctgagctccgagcagttctgcgaaagttcttcctgcggataggcctggtgtataanatatggattccagaagagccgtcgcaagtgccagcagcactgtcatcgacctgngtagcactggctgcatggccactgctgtggttctgtagaacatccgccatgccgtcccagctggcggagggggagctgcccacctagctgggtttggacctggagtgcagtggcgtgaaccctggtcagcacagtccccagcggaggctcatggtgtctcattaaaccatcacataccagtaactcggtgggcagggagtctgttcccccgtccttgcattccgctggctgacctgttagacctgtccttgtgaatgccaccgtttcctctaagactggccattaatgtttcgtcggcggaagtcgctctcctgggaggcaatgagcattgccgtataggttcctgtt

SEQ ID NO: 8273 - DNA, 511 bp, Mus musculus
  misc_feature (55)..(58): n is a, c, g, or t
  misc_feature (62)..(62): n is a, c, g, or t
  misc_feature (64)..(64): n is a, c, g, or t
gagaagtgcctggaaccactgttcctggtgtcactttaaagctttttgcttcatnnnnctancntttaaaacctgtttgcagccacaaatgtgattaacagaagtttacaaagcaacactgtaccttatgcattatcttaaaatctgtggacattcatctattgttcaagcaatgatgacaaccagtgagataaaaagagagtagatagttcagcatggcaccattggctgttgttagactagtttcattggtgtatgctgtcctttgtaatgtcaggactaaaatatctagcaagccacataaacggtggcaagtgtgtatattgtttggtttccatttgtttgttaaacagccattttacttttccatggtcatgagttgaagggaaattaagataacgctccctccccaccaacactattcaactacctctctatgcctgatttctttaaaagggttcccttcttctaaatctgcacaaaaatagttccagctcatctacgttgtaat

SEQ ID NO: 8274 - DNA, 501 bp, Mus musculus
  misc_feature (63)..(63): n is a, c, g, or t
  misc_feature (69)..(69): n is a, c, g, or t
  misc_feature (72)..(72): n is a, c, g, or t
  misc_feature (77)..(78): n is a, c, g, or t
  misc_feature (122)..(122): n is a, c, g, or t
  misc_feature (126)..(126): n is a, c, g, or t
  misc_feature (160)..(160): n is a, c, g, or t
  misc_feature (292)..(292): n is a, c, g, or t
  misc_feature (303)..(303): n is a, c, g, or t
  misc_feature (413)..(413): n is a, c, g, or t
  misc_feature (474)..(474): n is a, c, g, or t
atcattaaaaccttatctcctcccaaagcctcaagacacctcccacctctggggacgcctttngtaatnctncgagnnttccctgtgccgcccacggaggaccaggagtgatcactcttccntganctgtgtcatctgcacctctgatccgcttcggaangatggctcgcttcctgttagtagttgcccacgacagggtttacaggccagaacctgggcagggtgacctgacagctggggtaggaagagcaggccctaacccagggtggcagtctctctggaccttgctttntcagtcagccntacggtaaggacggaagcagcatgatacctgagcagaagtggagcaaaatcctgcagtttggctttagggccatgctctaagagtgtgtgactctcatggtttcaataancaaacggtacactgggcctctcccctttccagactagcctcatggacagccagggggggantcgtgacggcactgacgtacctagatg

SEQ ID NO: 8275 - DNA, 500 bp, Mus musculus
  misc_feature (186)..(187): n is a, c, g, or t
  misc_feature (266)..(266): n is a, c, g, or t
  misc_feature (305)..(305): n is a, c, g, or t
  misc_feature (327)..(327): n is a, c, g, or t
  misc_feature (356)..(356): n is a, c, g, or t
gctctccagtaaaacgccaggtgtgtcttcataccaaggaacctgacctctctgacaattgcattttgaacattgttgtccccaaagagctgaatcttcaggtcgtctcttgtgactgtgagcggagacttgtccggactcctgtcagtaggcagctagctagcatcctccttctggcgtccctgnnttcactgtttcctccttcccttattgctgcttcccgctgccagatcacacccatcagctccagttcgcctggctccacncaccttgagctcagggccggatcatgctcgcccgctcangggcatacccttgtttttaganccaacccatgaggggagtttggacaactntcacacatgatgtgttctactgtcaagcaagtgcccttttgtaaagggaagggcacaaatcagggaccggacattcactcagtgagtattctccagttgtaattgctttgaaccaagcacctcggatcctgactactttaaaca

SEQ ID NO: 8276 - DNA, 412 bp, Mus musculus
  misc_feature (326)..(326): n is a, c, g, or t
  misc_feature (343)..(343): n is a, c, g, or t
  misc_feature (354)..(354): n is a, c, g, or t
ttcaaaggcgtctaagtcaggcagaagagagagctgcttcagcgtcccagcagctcagtgtgattacagtgcagagaagaaaagcagcttccatgatgaatctggaaaatatttaaacatattcatagttcactgacagaactgtagagttgggaaagctgttgtaccaaacgtattgacatggagaagcctgctgagaatggggaaggcttgtgtcattttgcataagcattttccattctgttttgagggttattggaaaacagaacagtgacagcttcttgtaagtagaaaactataatcctatatttgagattcagtagagnataaagccagctgaganagaactcactnccttcatcaatgtctatttttaattcctttttccccctccttggaagaacataatatt

SEQ ID NO: 8277 - DNA, 431 bp, Mus musculus
  misc_feature (122)..(127): n is a, c, g, or t
  misc_feature (130)..(135): n is a, c, g, or t
  misc_feature (286)..(286): n is a, c, g, or t
  misc_feature (291)..(291): n is a, c, g, or t
  misc_feature (293)..(293): n is a, c, g, or t
  misc_feature (314)..(314): n is a, c, g, or t
  misc_feature (320)..(320): n is a, c, g, or t
  misc_feature (325)..(325): n is a, c, g, or t
  misc_feature (348)..(348): n is a, c, g, or t
  misc_feature (379)..(379): n is a, c, g, or t
  misc_feature (382)..(383): n is a, c, g, or t
  misc_feature (398)..(398): n is a, c, g, or t
  misc_feature (404)..(404): n is a, c, g, or t
  misc_feature (406)..(406): n is a, c, g, or t
atgtcccgccatactgaagggcttaggagcacagaatagaaaccaaggttaaaaccttcccaaagccagaagcaatgatgatctctagaccagcgttggcaaggcagagggaggagggtcannnnnncannnnnngctacatagtgggctggaggctagcctgggctatagacttcatctcaaaacaaacaaaaagtccactaaacaaaaagtcacctttagaactgggaatatgcctctgttgatagagaatccatctatctgatatgcatggattcagtccccnccacntnatccaggactggtggaaccgncttganttagnaactacaggaggaggcagaaggntcaaccttggccacctgatgaaacgaggagnccnntctagactacacgantccctntnccccacctctgtttacatgtaacaa

SEQ ID NO: 8278 - DNA, 410 bp, Mus musculus
  misc_feature (42)..(42): n is a, c, g, or t
  misc_feature (52)..(55): n is a, c, g, or t
  misc_feature (277)..(277): n is a, c, g, or t
  misc_feature (280)..(280): n is a, c, g, or t
  misc_feature (288)..(288): n is a, c, g, or t
  misc_feature (292)..(292): n is a, c, g, or t
  misc_feature (307)..(307): n is a, c, g, or t
  misc_feature (312)..(312): n is a, c, g, or t
  misc_feature (319)..(319): n is a, c, g, or t
  misc_feature (328)..(328): n is a, c, g, or t
  misc_feature (338)..(338): n is a, c, g, or t
  misc_feature (343)..(343): n is a, c, g, or t
  misc_feature (355)..(355): n is a, c, g, or t
  misc_feature (358)..(358): n is a, c, g, or t
  misc_feature (366)..(366): n is a, c, g, or t
tatccaagaaataagctccagcatccagtgagcactgataangttgggcagnnnntatataatgtagtttgttcagataattgttatacaagcgagaaatcactgtgactttttgatatggaagacaatcacaattcttagttccctacccagtatttgagcaagaaaagctgtccgcagcttggaagtgtacctccatctggattagtttaactcacaggtactgtctacttggtaccatgcagaaactttcatgcagaatgcaaagagccacttngantacacacngacnaggtttgggggaccntcctntctcttnaaacttccngacttagttnacagncctcagtggttnttntctttcanggctgattgagggtagggtgttgaggatgtttgttctttctgtg

SEQ ID NO: 8279 - DNA, 298 bp, Mus musculus
  misc_feature (130)..(130): n is a, c, g, or t
  misc_feature (159)..(159): n is a, c, g, or t
  misc_feature (163)..(163): n is a, c, g, or t
  misc_feature (166)..(166): n is a, c, g, or t
  misc_feature (168)..(168): n is a, c, g, or t
agaactccattctaaaaccatgcaatgtaatgagaacagagatctttcctttttaatgaaaacattagcatgttaataccccgtatgaataatgcctgacattcaacaattgtggaaatatgttggtatnttgctgaacatacatacacctccgaaatnccanttntncattctacacatatgctttctggcagcgagtttattgccagattttaaacagggagttatgtggtgcttgtggcgctttcagaacccaaagatttgtagtctggaatcatgtagtctcatatgctgcact

SEQ ID NO: 8280 - DNA, 209 bp, Mus musculus
acgtggactttcagcagctgaaaatcgagaacgctcagtttttggagacgattgaagcaaggaacaaagaactgatccagctgaagctggcctctgggaacacgctgcaggttctcaacacctacaaaaacaagcttcatcgggcaatggagatctacgtcaatctggacaaggagatcttgctgagaaacgagctacttgggaaaatt

SEQ ID NO: 8281 - DNA, 414 bp, Mus musculus
  misc_feature (36)..(36): n is a, c, g, or t
  misc_feature (43)..(46): n is a, c, g, or t
  misc_feature (142)..(142): n is a, c, g, or t
  misc_feature (170)..(170): n is a, c, g, or t
  misc_feature (184)..(184): n is a, c, g, or t
  misc_feature (186)..(186): n is a, c, g, or t
  misc_feature (198)..(199): n is a, c, g, or t
  misc_feature (204)..(204): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (215)..(215): n is a, c, g, or t
  misc_feature (228)..(228): n is a, c, g, or t
  misc_feature (254)..(254): n is a, c, g, or t
  misc_feature (262)..(262): n is a, c, g, or t
  misc_feature (317)..(317): n is a, c, g, or t
  misc_feature (326)..(326): n is a, c, g, or t
  misc_feature (328)..(328): n is a, c, g, or t
  misc_feature (385)..(385): n is a, c, g, or t
  misc_feature (387)..(387): n is a, c, g, or t
agattcaaacgtcctccctccatgttcacagggcantcaatcnnnncgggagatgaagccaagcagcctcctactgttcacaacaaccatcctcctttgcctcagcatggcgcagcctagagcaactaggaaaggagttacnccgaaacaggggtactgtccggagtttnttcttgactgcccntnttgtcctgttanncccgntatncnanccngtgataaagggtngcaagggcaccaaaaaatgctgcttntactactntcagatgcggtgtgtggaaccctggacaaccttgacttgaaatgaaaaacctttnttaaccaantnttggaaaataacgacggcattggctccaacttggatggctgacctcgagttcttctntntcatagacccctcttattagtgaatta

SEQ ID NO: 8282 - DNA, 195 bp, Mus musculus
  misc_feature (27)..(27): n is a, c, g, or t
  misc_feature (67)..(67): n is a, c, g, or t
  misc_feature (72)..(72): n is a, c, g, or t
  misc_feature (99)..(99): n is a, c, g, or t
  misc_feature (101)..(101): n is a, c, g, or t
  misc_feature (103)..(103): n is a, c, g, or t
  misc_feature (114)..(114): n is a, c, g, or t
  misc_feature (118)..(118): n is a, c, g, or t
  misc_feature (129)..(129): n is a, c, g, or t
  misc_feature (131)..(131): n is a, c, g, or t
  misc_feature (133)..(133): n is a, c, g, or t
  misc_feature (140)..(140): n is a, c, g, or t
  misc_feature (152)..(152): n is a, c, g, or t
  misc_feature (160)..(160): n is a, c, g, or t
  misc_feature (164)..(164): n is a, c, g, or t
  misc_feature (166)..(166): n is a, c, g, or t
acagccttaagtcagactttagatggnaccctagattctgcttattatgggttatccaatgagtagntaccnaggcctttttccagaagcttccagagntnanctgagctcacntctnccccacagggncntntggagcncctgcacagggncaagcttntctntntctctttgtccatctgtaaaaccttccca

SEQ ID NO: 8283 - DNA, 443 bp, Mus musculus
aaagaaatgcaccagtgtctctccctgaactaaccagaaggctcacagaggcaaatgagaggatagcagagtttccagagagtgtaaaggcctggccctttccagatgtgctggagtgctgtctcgtcttgcttcacattgggtcccagtgtcctgacgctgtggaccctgagatgcagcaacaggcccaggagctccttcacaagtatgggcacactcgagcttacagaagacactgccagagtcggcacacgtgaacttccagaggccataaagctgtgccacaccacccacgacagcttcacctcggtcgtggctcaccaggccttcaccctgaccttcaacggaaggatgctgtgatccaactgacagatgagggtgaagtttgaatccattcacaatggagcttgcctggtacctctcaagtggcttcctgtagtgga

SEQ ID NO: 8284 - DNA, 219 bp, Mus musculus
  misc_feature (36)..(37): n is a, c, g, or t
  misc_feature (82)..(82): n is a, c, g, or t
  misc_feature (107)..(107): n is a, c, g, or t
  misc_feature (124)..(124): n is a, c, g, or t
  misc_feature (128)..(128): n is a, c, g, or t
  misc_feature (136)..(136): n is a, c, g, or t
  misc_feature (146)..(146): n is a, c, g, or t
gacccagggtttatgctcagagaaactgaaaatgcnncaatgaaggaaatctttcattaaaagtttttacttgttcactttnaaatatgtcatgatggagaagctanaagaatatggagttgtntaanctttcctngagactgaantgatctatttcaaagagaagctgtgaaatacatgcctcaaaatagctaatgaaactgacagcattctgtatgt

SEQ ID NO: 8285 - DNA, 506 bp, Mus musculus
  misc_feature (116)..(116): n is a, c, g, or t
  misc_feature (303)..(303): n is a, c, g, or t
  misc_feature (336)..(336): n is a, c, g, or t
  misc_feature (401)..(401): n is a, c, g, or t
  misc_feature (403)..(403): n is a, c, g, or t
  misc_feature (457)..(457): n is a, c, g, or t
agaaaagcacctatggatcccactccttcccatcgcttacctgttccccagctccccgttgacccaccctggtagattagccagctgtcagactcacttttatttcaatccttacncttcataaacttttgtctccacgttgttaccatatttggagacagaaacaggagtttctccaaatccaatgaaaacatggaaaattcaaggattgtttaaaggtctgtgatcatcacatacaagatgtaactctggttatttcagtcatatctgtgactctatcatgtacagtttcctgaattgtcnctgtgcatccaaacgtaatgagtctaacagacnctgatttcatgtgcactcccctctgcttacaatgtgcattttttggaggtcattcaaattttccntnttctgtgattgctgtagtttctttcatagaaagtagctgatctgatgtaatctntttaccttttaaacaaccaggatagagaacctattggagtttgcattgt

SEQ ID NO: 8286 - DNA, 448 bp, Mus musculus
  misc_feature (264)..(264): n is a, c, g, or t
  misc_feature (406)..(406): n is a, c, g, or t
gagcaccagtcgaatcctcaatgggcaggtttttggctcccgatcctacttctttgaccgggctggccactgtgaggatgagggctgctcctgggagcatagccggagtgagagcaccagcatgtccggcagcctgggctctggcagttggtatggtgccatcggacgtgagccaggctggggaggggccagccagacgaggaccactcctctgctcttctcccaggtgccaggacctggtagtcaccaccacagcctctattntacaccacagacgtgatctgcttttactccccttagaatacccaggccccagctcccctgatccctggcccctgtgccaagtacgtctgctgcttcttgcccaggttgccaggagactgtggctgcttctctcctctggccnggctccttgccgctcctattgtagtgagcttgtgccatcccc

SEQ ID NO: 8287 - DNA, 471 bp, Mus musculus
gtattcttggctggctgttcagatggaagcatcaggctgcaccagctgacgtctgagaggcccatcatgcagtgggacaacagcaccagtggccatgctgttactagtctgcagtggtccccaacaaggcctgcagtgttcctggtccaggacgatgcgtctaggatctatgtctgggatcttcttgagaatgacctgggtcctgtggcccagcagcccatctctccagataagcttgtggctatgactatcgtgggggaaccggagaagaccagtggtagttttgtggccctggtgttggccaggacctctggcacagtcgacgtccagaacctgaagaggcggtggaccaccccagcagtagacgagcatagccagctgcgcctgcttcttcagaaatgaagacttggtgtcgggagaatgatgggtacatgagacttgattacagatggatcccttaactctgtgttc

SEQ ID NO: 8288 - DNA, 530 bp, Mus musculus
  misc_feature (114)..(115): n is a, c, g, or t
  misc_feature (117)..(120): n is a, c, g, or t
  misc_feature (122)..(122): n is a, c, g, or t
  misc_feature (124)..(125): n is a, c, g, or t
  misc_feature (127)..(127): n is a, c, g, or t
  misc_feature (130)..(135): n is a, c, g, or t
  misc_feature (137)..(138): n is a, c, g, or t
  misc_feature (141)..(143): n is a, c, g, or t
  misc_feature (145)..(148): n is a, c, g, or t
  misc_feature (150)..(150): n is a, c, g, or t
  misc_feature (212)..(212): n is a, c, g, or t
  misc_feature (255)..(255): n is a, c, g, or t
  misc_feature (307)..(307): n is a, c, g, or t
  misc_feature (323)..(323): n is a, c, g, or t
  misc_feature (344)..(344): n is a, c, g, or t
  misc_feature (346)..(346): n is a, c, g, or t
  misc_feature (371)..(371): n is a, c, g, or t
  misc_feature (387)..(388): n is a, c, g, or t
  misc_feature (393)..(393): n is a, c, g, or t
  misc_feature (405)..(405): n is a, c, g, or t
  misc_feature (430)..(430): n is a, c, g, or t
  misc_feature (454)..(454): n is a, c, g, or t
  misc_feature (461)..(461): n is a, c, g, or t
  misc_feature (471)..(471): n is a, c, g, or t
ctgctgtctcgagatgcacctagaggatgccactcgattctgtccaaaggaagaaagagagagtgaacagacttctttcagcgatcaaaatcccaggcaagaccagaaaggggnntnnnncngnncnttnnnnnngnnctnnnannnnangtccagtggatcagaatacagggaaaaaactaatgagaacccctcaatggatccttcacccnccaaacaagatttcttcagaaaccgacttgctcttgcaaatgnccttgaccaaggaacagctgtgtaaatacatttacagttgtattgtcgagtngtaagaggagggtaanagcttgtatatatctctgcangnatatatatatatatatatatcaatntataaatccctaaggnnaactnatataaacattnacatatgaaattaaatcaacatacnagatactgaagagatgaagattantctatgnttaagacttncctttatgaacctcaggattgggaaaagggacatgaagactttccacatcattacagga

SEQ ID NO: 8289 - DNA, 560 bp, Mus musculus
attcacccatttttctggtccaaagttccagagttccacatttaaaaaaaaatgccctcatggtcacatttttttcacagcaacactctcacttgttggtagcttctgtattagttgcctatctgttgctgggataaaacaacgtgaccaaaagcttacggcctcagggagctagatgctcatggcagcaggcacaagaagctgcaagaccacacatcagcacaccctgggagcacacagtgaagtagaccttggctgtaaacacaaagcctgcccccaatggcatgcctcctccagcaactctgtatcttaaaagttcataacatcccccaacaacagcgccaccagctagggaccaagtgttcagttacttgagaccaaggcacttttcctccagtctacagcagaaggcaagccctacactgacggagccttttctccagcctcactcttcctctcttgctgctctaacaagtggcaaataaggaatgcttttctgatgagaaaacacaaagctcctgagaaagattgtggttttacagttctgtcaccagggagta

SEQ ID NO: 8290 - DNA, 529 bp, Mus musculus
  misc_feature (341)..(341): n is a, c, g, or t
  misc_feature (352)..(352): n is a, c, g, or t
  misc_feature (375)..(375): n is a, c, g, or t
  misc_feature (420)..(420): n is a, c, g, or t
tttgcaggcgcctttaccagcagggcctgaagaagagctgggaaagctgtttcgacctactgctgagcctgcgagatctgcacaggactctctgtaatgaaagaccagggattgaacccttgttttctccttatgctgaggccctgtacaggatcctgggctccagtccccagggaagccatgtcccaggtcctctcgatgatggggctggtaaccctccactttctgtgtaccctcaaactcccaggaaccagccttgggattatggcgtcgctgttccttctgcacagcttcaagggaacgcactgccaatgatgtcacaggaggattccctgtttccnagaggggagcnactggaaccccaaccattcaatntcagctccaaacttacttcctgactttgccccaggagaccctagnttccagcaaccgtggcccaccgcggaataacaccctgatactcaatgaagacaggtggcctttctttgtttattttctgaaaaacctgggactgtgaaaccttgtgggt

SEQ ID NO: 8291 - DNA, 514 bp, Mus musculus
  misc_feature (133)..(133): n is a, c, g, or t
  misc_feature (244)..(244): n is a, c, g, or t
  misc_feature (347)..(347): n is a, c, g, or t
  misc_feature (364)..(364): n is a, c, g, or t
  misc_feature (372)..(372): n is a, c, g, or t
  misc_feature (393)..(393): n is a, c, g, or t
  misc_feature (398)..(398): n is a, c, g, or t
  misc_feature (421)..(421): n is a, c, g, or t
cgaaccttttctgctctataggccagctccaccatcctatgggaggggaggggaggtccgaggatccttgtacagaaatggaggacatagaggagagggggctggtccccctcctccttaccccacacccagntggtccttacattcagaaggacagaccagaagttactgctgagataggaccaggaaaggactctccctgcattggatcttggcccaagtcaatcccttgttttgtattttnttgagctcaccaccccaccccaggtttctaactttgtaacttgctctgatgtgggtccctaaccccaaaatcattgtgtccctattatgggttgcaggatatnaccacccccctccctcntgggactnttgcacaattgagggggggcnaaggntgacagcctgtccctactccctntaggagtctccagcctgtacacagacggtggggagacagttcttgcccaccttcctcgtgcaccccacccactaaagccacctgacaacatta

SEQ ID NO: 8292 - DNA, 428 bp, Mus musculus
  misc_feature (26)..(26): n is a, c, g, or t
  misc_feature (48)..(48): n is a, c, g, or t
  misc_feature (51)..(51): n is a, c, g, or t
  misc_feature (64)..(64): n is a, c, g, or t
  misc_feature (79)..(79): n is a, c, g, or t
  misc_feature (110)..(110): n is a, c, g, or t
  misc_feature (119)..(119): n is a, c, g, or t
  misc_feature (130)..(130): n is a, c, g, or t
  misc_feature (135)..(135): n is a, c, g, or t
  misc_feature (140)..(140): n is a, c, g, or t
  misc_feature (178)..(178): n is a, c, g, or t
  misc_feature (215)..(215): n is a, c, g, or t
  misc_feature (230)..(230): n is a, c, g, or t
  misc_feature (238)..(238): n is a, c, g, or t
  misc_feature (246)..(246): n is a, c, g, or t
  misc_feature (248)..(248): n is a, c, g, or t
  misc_feature (266)..(266): n is a, c, g, or t
  misc_feature (268)..(268): n is a, c, g, or t
  misc_feature (286)..(286): n is a, c, g, or t
  misc_feature (288)..(288): n is a, c, g, or t
  misc_feature (301)..(301): n is a, c, g, or t
  misc_feature (309)..(309): n is a, c, g, or t
  misc_feature (315)..(315): n is a, c, g, or t
  misc_feature (317)..(317): n is a, c, g, or t
  misc_feature (390)..(390): n is a, c, g, or t
  misc_feature (395)..(395): n is a, c, g, or t
caggacaaagatcctgctactccagngtgtagcgtgctggtgctaccnaanccccgacagccanaggaaagtcagacanctcgagattattccgactttaattgatttcntggaggagnctttccaatcnagcancaagnctgaaataaacacccaccgcctctgccaattttgggtntgctatgccctcacagtcataacctgtaacaacttanctatcatgagggagntgagatcntaccgatntntaaaattccacctacagntngtggctacggagaactgntnctgggtggcctgnaaattttnccgagntnttatatttcctaataggttttcacaggaactaattttaatttttttttttagttcagttacaagattcaactntcctngtgccattgcattacctcagaaacctgaagtaa

SEQ ID NO: 8293 - DNA, 413 bp, Mus musculus
  misc_feature (130)..(130): n is a, c, g, or t
  misc_feature (140)..(140): n is a, c, g, or t
  misc_feature (157)..(157): n is a, c, g, or t
  misc_feature (307)..(307): n is a, c, g, or t
  misc_feature (356)..(356): n is a, c, g, or t
acaaggcgggccagtcatgtgcaagccattttttttcttctgaagccgatggaactgctgtcagcaaacactcggttgtttgttgttctcacctctcaggtgattggtggcgtcctggctcctggttccntagcccgctntagatgacacaagattntgggagaactcttccctaccccatcccatccattcacttcaaccaacaaatgctaaaggcactttatgttctgggaacaccatcctggcttctgaactgcctgccactctagcttctttccctgcccacctggacagatcctgggtagantcctaaacagtgaggccaggtatgtccctccagtgtcctgatgctcagnccacctttataccaagtgccttatggacctgtggtctaggccatgtgatgcccagta

SEQ ID NO: 8294 - DNA, 488 bp, Mus musculus
  misc_feature (236)..(236): n is a, c, g, or t
ttttctttgacatgctcttatctccccaaggtattgtttagatagggcaccactctgtagcccaggctgtcctggaattcaatttatttattacccaggcttgcctacaactcacaatagccatgtctcagcctcctgagtgctgggattacaggcttgagccacccagcccagcttcctttttgcactcttggtgttaacttaaaaatgtcgagttcatttgcttagaacttgtngggcagcactgccatggcagatcgtccccagcgtgagccttgagccagttacaacctgagctggccactctccatgtctgtgggactgttcctgaaataacagggctaagaaactactagataagttatagcctgtgggtaatgccttagtgttatttagataaaatatgtgtcattgatacttaatacatggtaaggaatgttcagaaagaacaaagttttcagggatgtctgtttgctgtgagtcttcca

SEQ ID NO: 8295 - DNA, 528 bp, Mus musculus
  misc_feature (165)..(165): n is a, c, g, or t
  misc_feature (178)..(178): n is a, c, g, or t
gaattctgccttctctatttattattttctatagcttcccagtggttctggtactgtgtgcctttgtaaccagattccaacagtgctttggaccatggactgttgtgggtgactcagcaggaagtgaatggtgctcagtggaggtggataggctggtcctcaacnttaaatgatgaantctactcccaaatatccacccaaccttcctgccgcctatgggccaacccctccagctagtcttgtgcacaatgtaaaactcatagtccagccaacacaccctgtctcagcagcagcaatttccctcccaggatggaagtttgttcaggggttggaaggacaactctccaggtgggtggatacaggcatgggctctccctatccactcctattgccaccaactggggagctgcaacaacctcccctccccaggatatctgccaaccttcatgccaaggctgctctcaccagctgctgcagaagacaagcaaggtctatatgtacaaaactctacagcgttctttttaccag

SEQ ID NO: 8296 - DNA, 557 bp, Mus musculus
  misc_feature (136)..(136): n is a, c, g, or t
  misc_feature (205)..(205): n is a, c, g, or t
  misc_feature (312)..(312): n is a, c, g, or t
  misc_feature (316)..(316): n is a, c, g, or t
  misc_feature (360)..(360): n is a, c, g, or t
  misc_feature (362)..(362): n is a, c, g, or t
  misc_feature (434)..(434): n is a, c, g, or t
  misc_feature (485)..(485): n is a, c, g, or t
  misc_feature (499)..(499): n is a, c, g, or t
agatcctctctctgctggtggaaatgctagccctgccggagttggccctagaggagatcactaactactatcagaagaagctgaaggaagggtcctccaaggcccgagagatggaatcggctatgggcgggctgcnacagaggaagaagattccttacaaccctcagcaagtagaaaacttagaagtcccagaacggagggtccncaggatcctgagccggctgaagcagcagaactatgctgccaatctgcagagcccctatgcccaggtaccctgcatcccactctgcccgaggctggacaagaaggcantccntcgaaagctggctagccataaccattcggtgctggatcagtgtntntccacaagcctgggccctgactttcatggcctcttcttccagccaggacagcaaggaagcagggaacatagntctgacagcagaaagtggcttagctccatgccagctcgaacccactgaccntccggaaccatggntccagttcaaggcctgcagatagttgggcagggcctggatttgggagtttgctttcat

SEQ ID NO: 8297 - DNA, 458 bp, Mus musculus
  misc_feature (35)..(35): n is a, c, g, or t
  misc_feature (45)..(45): n is a, c, g, or t
  misc_feature (52)..(52): n is a, c, g, or t
  misc_feature (54)..(54): n is a, c, g, or t
  misc_feature (63)..(67): n is a, c, g, or t
  misc_feature (77)..(77): n is a, c, g, or t
  misc_feature (83)..(84): n is a, c, g, or t
  misc_feature (99)..(100): n is a, c, g, or t
  misc_feature (102)..(102): n is a, c, g, or t
  misc_feature (151)..(151): n is a, c, g, or t
  misc_feature (367)..(367): n is a, c, g, or t
gtaaaccacagcaatttaggcactgtcacttttgnagaggggtgnaataggnanagggcttcnnnnncagccctgangcacgnncagcacagctccctnntnagctcctcccccagcctggggttccgcttttagccactaggtggcaccncgtcccagtgtccaagacagacactcccaactgttatgatgacagcactacccaaacctggacactcagcaaagatgaccctgttctggggacaccagaataacagcagcagcagcaacaacaacagcaacaaactatggcaggcaagcaggaagcagctgctaggaaaacctggccccaaccagaggcgaccccgcatgtgtgcagctgcctctntcatcgacagtagccaggggtttccctttttgccccacccgagaccccgcagcagcctcatgcccagcctggcattccgtgggaaccataa

SEQ ID NO: 8298 - DNA, 37 bp, Mus musculus
gcagagtacggccttggcatttacatcactggtgtgg

SEQ ID NO: 8299 - DNA, 351 bp, Mus musculus
  misc_feature (80)..(80): n is a, c, g, or t
  misc_feature (88)..(88): n is a, c, g, or t
  misc_feature (119)..(119): n is a, c, g, or t
  misc_feature (132)..(132): n is a, c, g, or t
  misc_feature (134)..(134): n is a, c, g, or t
  misc_feature (139)..(140): n is a, c, g, or t
  misc_feature (142)..(142): n is a, c, g, or t
  misc_feature (182)..(182): n is a, c, g, or t
  misc_feature (198)..(198): n is a, c, g, or t
  misc_feature (202)..(202): n is a, c, g, or t
  misc_feature (207)..(207): n is a, c, g, or t
  misc_feature (220)..(220): n is a, c, g, or t
  misc_feature (231)..(231): n is a, c, g, or t
  misc_feature (233)..(233): n is a, c, g, or t
  misc_feature (249)..(249): n is a, c, g, or t
  misc_feature (251)..(251): n is a, c, g, or t
  misc_feature (287)..(287): n is a, c, g, or t
gcagagtacggccttggcatttacatcactggtgtggacccaggctctgaagcagagagcagcggcctcaagtgaccttncaaggagnccccagaaagccaacagaataagaagatgcnatctgtgacccancnagaanntntcacacgcacagaacccactggtgttttgcttttgagttncccagctctagaactntcancaatnacctgtacataanccatcatcctntntgtggaacttcatctntnaacattacattatggagaagggatcacaagactccnccccacccctccccaaggatttataggcagctaatgttttgatgcaactactgtctaaattgta

SEQ ID NO: 8300 - DNA, 475 bp, Mus musculus
  misc_feature (213)..(213): n is a, c, g, or t
  misc_feature (243)..(243): n is a, c, g, or t
  misc_feature (245)..(245): n is a, c, g, or t
  misc_feature (255)..(255): n is a, c, g, or t
  misc_feature (306)..(306): n is a, c, g, or t
  misc_feature (321)..(321): n is a, c, g, or t
  misc_feature (323)..(323): n is a, c, g, or t
  misc_feature (335)..(335): n is a, c, g, or t
  misc_feature (377)..(377): n is a, c, g, or t
  misc_feature (382)..(382): n is a, c, g, or t
gaacaagtctaaggctaggcaatccaaatcagtccccagacttagcggctgcaggacccaggtgacggcctgcagggagcgtggcttctccgtgaacagcgagcagctgctgatcttcttcctggctatctggttcttctatttcttctacctccaggactaactcgatagagtctcctttccaccagctcagggattggctgagggtcaganccttggccccatcaggcagctgaccaggcntnacctgttaanttagggggggatgaagacccagagcccggagctgccacccaccttctgttntcacaagaccatggntnttcagttttgtnccttcattgagtatgtgaccccattaacaggcagaggacatntcatntctggaaggcaaagttgaagctgcatattcttggtagatggtgttgagcatggaaactattttgtgcctggcctcaggcccagtttctaatga

SEQ ID NO: 8301 - DNA, 468 bp, Mus musculus
  misc_feature (99)..(99): n is a, c, g, or t
cagcccacggtctagaccaaaggacgaccttgatcaggaaagatccagcaaagcaagaaacacggagaaggacaaaggggaacaagggaagccctctcnttctgaaacatcactagcaacaaaacacagactggcagaggaaaggccagagaagggcagtgagcaagagaggccccctgaggctgtgagcaagtttgcaaaacggagcaatgaggaaactgtgatgtcagctagagacaggtatttggccagacagatggcgcggataaacgcaaagacttatattgagaaagaagatgactaaggactgcccatatctggagtcccttgcaagcgtagagcattgtaactcttgaacttggtttaagaaagcatacaactgttcatagaacagcgactggagagtattttttaaaatatattttcaaaatttgttaaatcaaaagtcagttctttgagcttcagtgc

SEQ ID NO: 8302 - DNA, 352 bp, Mus musculus
ggagaaccactataaggaccagttttcattgctagcagaagccatctcacaggaacgtcaagaactcaaagtgagacagaaattccaggctcagacattacataaggtgaagagggagctgagagctaaaatggagaaggagattcagcaactgcagcacatgataacgcagaacgacgatgatgctttcttccgggagctagaagctgagcgcttcaaagctcggctgcagttggcttccttccagtacagtaaaaatcctttcccaagaggccaaacttcataggtgaagtttctagacaccttaatatgaacagagctagacctgagccagtaaacagtctaaaccaga

SEQ ID NO: 8303 - DNA, 488 bp, Mus musculus
  misc_feature (123)..(123): n is a, c, g, or t
  misc_feature (356)..(356): n is a, c, g, or t
  misc_feature (422)..(422): n is a, c, g, or t
  misc_feature (433)..(433): n is a, c, g, or t
  misc_feature (435)..(435): n is a, c, g, or t
aacataatcaggttgcttaacaatcaaaaaattacttaaggtataattaacacagttagttatttgacaattagtacagttaacagtattattatctatcaataaattcccactcaaagaagnctatggctctggaacacacgaacatacaaaaacttcagtcttattgtgtttgtcctgaaatgccatgatattccacataggaatccaggtaattgtggacgcccactcgccagcaagtaagatgccacaacaggatccttctgcaacatgtttattgggagagcatggactgcgtaggcgaaagaccccgagccccagaaatggtgctacttatataggcctagggagtgacntgtccataactgattggttatgctaccagtacctcattaatatgcctcgagccaggcagtgactcngcaaaaaactntnggcacatgcgcacattggttgtttacccatattcatgggcattggcttactga

SEQ ID NO: 8304 - DNA, 408 bp, Mus musculus
  misc_feature (193)..(193): n is a, c, g, or t
  misc_feature (199)..(199): n is a, c, g, or t
  misc_feature (233)..(233): n is a, c, g, or t
  misc_feature (239)..(239): n is a, c, g, or t
  misc_feature (246)..(246): n is a, c, g, or t
  misc_feature (248)..(248): n is a, c, g, or t
  misc_feature (255)..(255): n is a, c, g, or t
  misc_feature (257)..(257): n is a, c, g, or t
  misc_feature (275)..(275): n is a, c, g, or t
  misc_feature (277)..(277): n is a, c, g, or t
  misc_feature (300)..(300): n is a, c, g, or t
  misc_feature (367)..(367): n is a, c, g, or t
  misc_feature (380)..(380): n is a, c, g, or t
tgtctgggacatacccaaggctggcctgtttaggtccaaggactgcgtaaatcatgttggttttttttaattattaagttttataactgaatatttattattttatgtgaatgacatcaggactaggggacagtctgttggctgagactgagatgtgactctccgcttggacttctgcacagcattgcatttntctgtntcctcactaccttcctccacagagcagggaaagnccctgnctggggntntggcagntnctggtagtggcacgaggntntggaagctgtcactgggcaacanccttgaggggtggcggggggacttgaacccagggtactgactttgaacttgttggcagctctggctngcaacccgctggntcggaacagattttataaactccacaac

SEQ ID NO: 8305 - DNA, 432 bp, Mus musculus
ataaacatcacagtcgagggcggaagaatcagccgctttcttcatctttccatgacatcttaaatccccacaaagaccatggcttgagagcagagcccagagacaaagaggaaaataggcaaacccttccctattcgtacagcattaatcacccctgctttgccgaaatagaagacaccctttccagccagatcaacgagagtctgcgttgggatgggattctcaccgaccctgaggcagaaaaggaaaggatccgcatctacaagctcaaccgaaggaagcggtaccgcctcatggccctcaagtgcttccattccgacccctgcgtggaggagagcgtggagaatctgccctacctctcagacaaagactgcagcccctgcagcaagcagcccagctctaagggcgaccacgcgcatagctactttgagg

SEQ ID NO: 8306 - DNA, 535 bp, Mus musculus
  misc_feature (142)..(142): n is a, c, g, or t
  misc_feature (375)..(375): n is a, c, g, or t
  misc_feature (442)..(442): n is a, c, g, or t
ggacttagtgttggcagctgttcctccccacaaaccatcattcttcagtggacactggtcccccctgacctccaccctctcccctgcaccaggtcaggatcattgccctggcagcgaggctgtcggaggggctggtcctcanagcagctgggctaggagagagctcagtcaggtcagctaacttgtggggtcagccacacgagtaccacatcttgctttaaccctttccctctgctttcagttattgaggtcatggtgagtctttttctaggacctaggcgctgggccaggctttccttcagagctgctttatagccagtctactgcattaggtctaaatctgaactttctgaggcttggatctgagattttttnagagtaggagacaggtctctgggcccgtcaccacctcagaattttcccaaagggagaagggaccaantctcccagggccagtgcaccgttcctggtggagctgggatgcctggctgcaatgtttgggggcagctagctgactaacaggtgactttcccgg

SEQ ID NO: 8307 - DNA, 544 bp, Mus musculus
aggctcgcctcaaactttacagagatccacctgcctctgcctctgcctcccaagggctgcgattaaaggcatgtgccaccaccattcagatctaaaacacaaaatttaatactaattttgaagcttcttaatttttaaaataaaggtatgggtgagctaaaggtggtgcaaaggtcaaccaactccaatttcaggaggaaaaccgcaaagtccacttgagcaaacatctgatggcaatagccccccatcctccacccctcttaacaacagccagttagtctacagcagcatggtcaaggtacatataaactaagacatctggcagaaaaaagataacccagccatcctatttgtcaggtggttttgcccctgtgtttggttcctgcaaattacagcagaaatgcagttttaaaaatattaatttgctgacctgtatggaattccccaagcttgctgtaaccaccataaataccctgcacccctagactcgaggctctcacttctgaccactgcaccggtgatggagtgctcttgagctcctaat

SEQ ID NO: 8308 - DNA, 543 bp, Mus musculus
  misc_feature (208)..(208): n is a, c, g, or t
  misc_feature (232)..(232): n is a, c, g, or t
  misc_feature (278)..(278): n is a, c, g, or t
  misc_feature (320)..(320): n is a, c, g, or t
  misc_feature (344)..(344): n is a, c, g, or t
  misc_feature (391)..(391): n is a, c, g, or t
  misc_feature (398)..(398): n is a, c, g, or t
  misc_feature (406)..(406): n is a, c, g, or t
  misc_feature (408)..(408): n is a, c, g, or t
  misc_feature (450)..(450): n is a, c, g, or t
  misc_feature (481)..(481): n is a, c, g, or t
ttgatgactcttcctactgccaaggttctgatgtccttcccacctcaccctgatctcaagctggcacctagcatgctgaaaccaggaaaggtgggcttcgagctgtgctgcacaacctggcgggtagtgctgagtggtgggatcggggaagaagggcacagacagagggcagcacccagaccaagcagcgcaccagggaagggcttancttccacagaaccctgttccaagncagagacctgatcatctctctcttcctcccctcctttacgccgagnctgctattccccagcaccttcgaggcccccactttggaagtncctcgtggcctctgccctttgaanccggacttcttcctagcacccacaggaaagtcaagggcaaaggcaanttcaagnccagactngncagcacacccagggctgaggcataccccaagaagaggctgancctccctaatcccttcactcttactttggcntcccaaaacctgaggctcataggggctgcgaggctagagaaaccactgctctgatcttcact

SEQ ID NO: 8309 - DNA, 463 bp, Mus musculus
  misc_feature (72)..(72): n is a, c, g, or t
  misc_feature (81)..(81): n is a, c, g, or t
tgaagaagaccagcctttattagctgcttggtgccttccaagaggtttggacctcctgttaacagctttccntgttaagcnagttcaatgatgtaatacctgagtgtatccatttccacgtttagtttaggttagtcccttggtgtctaatctgtgccagaagttatatgtccctaccaatgtcattaaatctgtagtagtaagaaacaaacagacaaacaaaagcatgatttatttgaactgtgagccccaaaacagtatttccatatggtattttaaagtcatagattccaaagacatttgacttttatttttcagttgaataaacttggcccccagatccagatgaaattgtttttaaaaacaatctgaaaatggtatttttccattatttccttttatatgacttaaaaaacacctgataaacatgttctttttaaaaatctgttccttcaatatgtaa

SEQ ID NO: 8310 - DNA, 375 bp, Mus musculus
  misc_feature (103)..(103): n is a, c, g, or t
  misc_feature (109)..(109): n is a, c, g, or t
  misc_feature (196)..(196): n is a, c, g, or t
atgctgacctacacttctcgaatcgtccggcaggctttgcaggtccagaagtcaggctcaagaggggacacacaggctgcagaggacctgctgcttctcagcnaaccantcacagacctcatcagcctgcttatcccactgcttcccagcgaggaccctgagatctccgaggtctcatccaagtgcctgtccatcntggtgcagctgtatggaggcgagaaccccgagagcttgtccccagagaacatggtgacctttgccaacctcctgatgaccaaggaggaccccaaggaccagaagcttctgctgaggatcctcaagaggatggtaacgtccaatgagaggctcttggaaagcctcaagaacaccggcagc

SEQ ID NO: 8311 - DNA, 561 bp, Mus musculus
  misc_feature (46)..(46): n is a, c, g, or t
  misc_feature (62)..(62): n is a, c, g, or t
  misc_feature (65)..(65): n is a, c, g, or t
  misc_feature (71)..(71): n is a, c, g, or t
  misc_feature (89)..(89): n is a, c, g, or t
  misc_feature (105)..(105): n is a, c, g, or t
  misc_feature (149)..(149): n is a, c, g, or t
  misc_feature (177)..(177): n is a, c, g, or t
  misc_feature (202)..(202): n is a, c, g, or t
  misc_feature (226)..(226): n is a, c, g, or t
  misc_feature (229)..(229): n is a, c, g, or t
  misc_feature (245)..(245): n is a, c, g, or t
  misc_feature (253)..(253): n is a, c, g, or t
  misc_feature (379)..(379): n is a, c, g, or t
  misc_feature (390)..(390): n is a, c, g, or t
  misc_feature (397)..(397): n is a, c, g, or t
  misc_feature (403)..(403): n is a, c, g, or t
  misc_feature (409)..(409): n is a, c, g, or t
  misc_feature (418)..(419): n is a, c, g, or t
  misc_feature (425)..(425): n is a, c, g, or t
  misc_feature (456)..(456): n is a, c, g, or t
  misc_feature (474)..(474): n is a, c, g, or t
agcggcctgtcctgatgacttttttttttaattgtatttctgtagnaaaagggcttgttganagnctgggnaaggacctcagctttcanagtctgttctctcccnttctgtgggtcctgtgaactcaagtcagctctcaacaagagcancaagagcctttacccgcagagccatctngacaccccatcagtcattcttcaantttattatttggagaaacttaacntgntggtcttggggtgccnttagcctntgggaaaaactcctactaaaccttcaaaacaactgcaataaggagtggagggattcaaaaagtctcggggcgctgggttgggctggaggccatgcagtgcggctggtcagtgggtggcagaaacancgcccactctngattctnttttcncttctntcttccctnntcagtntctggggaagtgacttgtacgggacgcatgncccagcgtggagactgtncacccttcacattgaacctgaaatctcgtgggtgggcctgtgttcgaatccccaggttctcaggaacccttccacagtgcgaagata

SEQ ID NO: 8312 - DNA, 497 bp, Mus musculus
  misc_feature (120)..(120): n is a, c, g, or t
  misc_feature (151)..(151): n is a, c, g, or t
  misc_feature (229)..(229): n is a, c, g, or t
  misc_feature (443)..(443): n is a, c, g, or t
gaagaaagcctatcagccagaaatagtcaaacttcttgtagaaaaaaggcagttcaagtctttcctgggagacctctcaagtgcctctgataagctgatagaggagaaactagccgctgntccagtccctttttctgaggaggaagtcttngctcccttttctagactggcagcagattcccacctgagtagatcagttgaagatagctttctgtcacccatcatctcncaggctagaaagagcaagattccaaggccagtatcctgggtcagcacagatcaaattaatggctccgcttcacctcagttcttgcctcggccaccaccaggaaagccaccagtcaggcctggagtagaagccaggtaacttcatgcttaccatgtgtgtagtgtgtaagggtgtttcaagtattgctttaccatacatatgacagcagtggtcnaagttccttcttttgaacttgttttcttctgttccttccacagtacaccattag

SEQ ID NO: 8313 - DNA, 508 bp, Mus musculus
  misc_feature (67)..(67): n is a, c, g, or t
  misc_feature (112)..(112): n is a, c, g, or t
  misc_feature (142)..(142): n is a, c, g, or t
  misc_feature (178)..(178): n is a, c, g, or t
  misc_feature (195)..(195): n is a, c, g, or t
  misc_feature (197)..(197): n is a, c, g, or t
  misc_feature (289)..(289): n is a, c, g, or t
  misc_feature (292)..(292): n is a, c, g, or t
  misc_feature (369)..(369): n is a, c, g, or t
  misc_feature (382)..(382): n is a, c, g, or t
  misc_feature (384)..(384): n is a, c, g, or t
  misc_feature (388)..(388): n is a, c, g, or t
  misc_feature (390)..(390): n is a, c, g, or t
  misc_feature (419)..(419): n is a, c, g, or t
  misc_feature (428)..(428): n is a, c, g, or t
  misc_feature (432)..(432): n is a, c, g, or t
  misc_feature (434)..(434): n is a, c, g, or t
  misc_feature (438)..(438): n is a, c, g, or t
  misc_feature (441)..(441): n is a, c, g, or t
  misc_feature (445)..(445): n is a, c, g, or t
  misc_feature (455)..(455): n is a, c, g, or t
attctggtctgataactatgtcccgttggcaccgtcgagggcagtgaccttcccttctgtgctctcnctgttagttcacagcgctgtgtgtgtgggaccaggaccggcaggnatcgagcgctgcttccctaggacaaagtcnacttgccttagctgtggtgctccccccaaccccggngttaagcaacttgaagnangagtgaggggaggactcacgatttccaggagtccagagccctcattccacctgcaaacctgtgccagtcccgccctcctctctaaagaaaanganggcagagtcgggactaagtgtggaggaattctgggtcttggtggaaagaagaagcaggacagtttcaaattcgccantggaagagagacnangccntntccaccaacccaaaggccttccgccccanccccgggantgcntnttgntgntatnttcccttcantcttgctggcaaagacaggtaatgtaagagagtacctagcctgcaggtgtttc

SEQ ID NO: 8314 - DNA, 551 bp, Mus musculus
  misc_feature (57)..(57): n is a, c, g, or t
  misc_feature (70)..(70): n is a, c, g, or t
  misc_feature (78)..(78): n is a, c, g, or t
  misc_feature (92)..(92): n is a, c, g, or t
  misc_feature (103)..(103): n is a, c, g, or t
  misc_feature (122)..(123): n is a, c, g, or t
  misc_feature (284)..(284): n is a, c, g, or t
  misc_feature (293)..(293): n is a, c, g, or t
  misc_feature (331)..(331): n is a, c, g, or t
  misc_feature (338)..(338): n is a, c, g, or t
  misc_feature (358)..(358): n is a, c, g, or t
  misc_feature (363)..(363): n is a, c, g, or t
  misc_feature (400)..(400): n is a, c, g, or t
  misc_feature (414)..(414): n is a, c, g, or t
  misc_feature (418)..(418): n is a, c, g, or t
  misc_feature (443)..(443): n is a, c, g, or t
  misc_feature (445)..(445): n is a, c, g, or t
  misc_feature (486)..(486): n is a, c, g, or t
  misc_feature (503)..(503): n is a, c, g, or t
gaaacacatagatttaacttactgacacagagagcacagtactgactccccgtttgntctggaaggtggncatccaancccttcctctaganttctcatttanttttgttttggtaattttnngtttttctttcttccatgacaagggtttggtctcatataaaacttatctatgtcatttatgtgttcatgcaggtattagtgtgggtttagactttgaaactggaaagagcaaacagagatttggatgaattcagttgtggactgtggccatgtgtggtggngagtggaancgaggggtcccgggagtgggagggcaaagcggtggggnagaatcnacaaaagagtctctgcttgnaaatntcatcattaaacctaatacttagtatgttaacttttnaaattaattgttcnaaancctgtcagaccatcaaatatacttncnaaattttagcttaagctctttatcgttttgttgagagacantcaaaaagcagaaaatntccacaactttcaaatttttattaatttttcttaagatgggcattatg

SEQ ID NO: 8315 - DNA, 212 bp, Mus musculus
tcgagtgtgaactactactttgagagagaagtcagacacctggaatacgtccagcagcgcaaagaaatccgtgagcaagaaaagatagatatggccctggaactggtgaagaagaaagcgaaaatctatcaaaagacaaaagagcaaatggaggccgagctgaagttggaatacgagagctatctggatcttgagaagtctgtcctcttcgc

SEQ ID NO: 8316 - DNA, 262 bp, Mus musculus
  misc_feature (68)..(76): n is a, c, g, or t
  misc_feature (79)..(79): n is a, c, g, or t
  misc_feature (88)..(89): n is a, c, g, or t
  misc_feature (92)..(92): n is a, c, g, or t
  misc_feature (94)..(94): n is a, c, g, or t
  misc_feature (96)..(96): n is a, c, g, or t
  misc_feature (98)..(98): n is a, c, g, or t
  misc_feature (108)..(108): n is a, c, g, or t
  misc_feature (122)..(122): n is a, c, g, or t
  misc_feature (129)..(130): n is a, c, g, or t
  misc_feature (133)..(133): n is a, c, g, or t
  misc_feature (141)..(141): n is a, c, g, or t
  misc_feature (146)..(146): n is a, c, g, or t
  misc_feature (157)..(158): n is a, c, g, or t
  misc_feature (171)..(171): n is a, c, g, or t
  misc_feature (173)..(173): n is a, c, g, or t
  misc_feature (182)..(182): n is a, c, g, or t
  misc_feature (186)..(186): n is a, c, g, or t
  misc_feature (197)..(197): n is a, c, g, or t
  misc_feature (210)..(210): n is a, c, g, or t
  misc_feature (219)..(219): n is a, c, g, or t
caatcacacaggctgttgagaggatgaacttagtcccctactttccgcctcctgggcagaatgtgagnnnnnnnnnacnttacacccnnganantntnacctttgctnacaccatggagaantcatccnncancccaaganagacncagggaacctnntccttccgcaagntnctggagggnccgnttccagagagntttggcacgcgtntccaagttnttcaggagaggatgccaatcaacccgaggcggagaccactgga

SEQ ID NO: 8317 - DNA, 98 bp, Mus musculus
gtctttggctacctctagctgaacaccctcagccctctctcttttggcctccaggatgggggtcagtcactgacaagctctccgtgtgaggagggagc

SEQ ID NO: 8318 - DNA, 482 bp, Mus musculus
  misc_feature (314)..(314): n is a, c, g, or t
  misc_feature (356)..(356): n is a, c, g, or t
  misc_feature (390)..(390): n is a, c, g, or t
aatagcccacgtttgtggtctcagtgctctgtgtcctcagctcccatacttgggagccacacagtcaagtaggaataaaatgtagtgtcagttggccacaatgtccctggcagatcctgacgtcctggggcaagttcacaggttgatgaccgtgctgctccagggtcctgcagcataacagatcaggcattagggaccaccatcaaccctatcctccctgcctctgaggaagaccacgttgtccgccaggactcccaacctgatcctaaggtccgcagcatctttaatacttgtcacgagaactgaagctctgnccacccacgggtacatttgaggccagcaggtggacagtgggnccatgctctcgaaccagtgaggacatggagtttnttccttgggttcccacccaaggcagacacctccttgcttgaggtagtggggaataccagaggtggattcctgacaccggaatgtgctgactg

SEQ ID NO: 8319 - DNA, 537 bp, Mus musculus
ttctgagacagcgaaagtgttccttctgttcatgtacttggactgtggattactgactttgataatgaattccaggcatttctgctttctgtgaaaaagaaaaatcacttcttgaccatcagaggcagtgtggaagcagacggagaaaagaagggtggagattctgatgcaagaaccatgggcgaactgtccaatgagatatgatttctttataccttattcagatgtgtttttgcaagacagatgtggttttttgtttgccctacagtttcagagaggccattcaaagatattcatgctaaaatgactactttatagtgacttttttcccatacaagtttcttaacactcaatacaatgttaagtatctttaatgctttaggatctcttaacaagagttttgccttttgttggattatttattggagttaaagtgtaggtccaggctaatgttacccaaaaagtttttggggaaattttatttggctatgcatgagaagccttcagcagaggggtatagactggatactcagataa

SEQ ID NO: 8320 - DNA, 554 bp, Mus musculus
  misc_feature (32)..(32): n is a, c, g, or t
  misc_feature (39)..(39): n is a, c, g, or t
  misc_feature (87)..(87): n is a, c, g, or t
  misc_feature (129)..(129): n is a, c, g, or t
  misc_feature (191)..(191): n is a, c, g, or t
  misc_feature (196)..(196): n is a, c, g, or t
  misc_feature (198)..(198): n is a, c, g, or t
  misc_feature (237)..(237): n is a, c, g, or t
  misc_feature (303)..(303): n is a, c, g, or t
  misc_feature (314)..(314): n is a, c, g, or t
  misc_feature (332)..(332): n is a, c, g, or t
  misc_feature (347)..(347): n is a, c, g, or t
  misc_feature (389)..(390): n is a, c, g, or t
  misc_feature (394)..(394): n is a, c, g, or t
  misc_feature (397)..(397): n is a, c, g, or t
  misc_feature (431)..(431): n is a, c, g, or t
  misc_feature (472)..(472): n is a, c, g, or t
aagattccacagtcaatgatcacaaaatctcnaactagnccttgctgcagaatagagcaaatgcttacagttaatggcgctgtagcnaatggtggttgccaggctacagttatgtatgtaatgtatagnctgacaacattaaatgacattttcctgatggtctttctgttttcgttaataaaacaacaacnaaacnancaaaaaagtgattttacagtgggggaaaaaatcataccnaaagaaaacttgaatatgtgtttgaacagttattgtattttgtaaattaagttatatgctgttccnagggacttttnccttattgaagaggcagnaaactatgattggantccttgagaatgctttatcaaggatattatttttctaatgtnnacgnttntccatcgcgtattcttttcacatggactgcatancaattttcataaaatgtaaatagaaggaacaactgctgctntcccgtgcttggtatgtaacattcaggtttatgcattgaaaaaaacattcggaaaatattcctgttacaaattttatagcaa

SEQ ID NO: 8321 - DNA, 547 bp, Mus musculus
  misc_feature (59)..(59): n is a, c, g, or t
  misc_feature (65)..(65): n is a, c, g, or t
  misc_feature (88)..(89): n is a, c, g, or t
  misc_feature (93)..(94): n is a, c, g, or t
  misc_feature (335)..(335): n is a, c, g, or t
  misc_feature (341)..(341): n is a, c, g, or t
  misc_feature (343)..(343): n is a, c, g, or t
  misc_feature (368)..(368): n is a, c, g, or t
  misc_feature (383)..(383): n is a, c, g, or t
  misc_feature (386)..(386): n is a, c, g, or t
  misc_feature (388)..(388): n is a, c, g, or t
  misc_feature (450)..(450): n is a, c, g, or t
  misc_feature (461)..(461): n is a, c, g, or t
agatgagaggttttgttctctacgatgagagtaatacagaggtcatgtgacatggaaanccaccnatatatttctatttgtattattnncttnnctgagtactttgttatatgaatagaaaaaatctgtatacacaaaaaaccacccttgttaggtggttagtaatctataaatttgatactaacattaatagttaaagagaacattttatttttatctattttcatgttaatttaagaaaatgctttatagtcaaaatacatcagtgaaacaaaaccttcagtgaaagtaatatatttatttaacatatactttatgagcatatttactttctntacatnancctgtattttgacataagtatttgnatatttgacttttanttntntacttttaccttttaactgcataatacaagaaaagaaactatagcaaacaaagcgaaacatntgcattgcatnccatgaaacaaggcaaacagtagaaacgttatgttaaaagcttcctacagggtagtgttgagattctgtaagaagcataaacttga

SEQ ID NO: 8322 - DNA, 433 bp, Mus musculus
  misc_feature (34)..(34): n is a, c, g, or t
  misc_feature (38)..(38): n is a, c, g, or t
  misc_feature (58)..(58): n is a, c, g, or t
  misc_feature (85)..(85): n is a, c, g, or t
  misc_feature (202)..(202): n is a, c, g, or t
  misc_feature (230)..(230): n is a, c, g, or t
  misc_feature (234)..(234): n is a, c, g, or t
  misc_feature (245)..(245): n is a, c, g, or t
  misc_feature (251)..(251): n is a, c, g, or t
  misc_feature (254)..(254): n is a, c, g, or t
  misc_feature (275)..(275): n is a, c, g, or t
  misc_feature (289)..(289): n is a, c, g, or t
  misc_feature (294)..(294): n is a, c, g, or t
  misc_feature (296)..(296): n is a, c, g, or t
  misc_feature (335)..(335): n is a, c, g, or t
  misc_feature (338)..(338): n is a, c, g, or t
  misc_feature (346)..(346): n is a, c, g, or t
  misc_feature (387)..(387): n is a, c, g, or t
ggagctcatgtaccactacaagactatgaggccnagcnaacagtgtgacacccaaaanggttgtattggatgcagggcggtaccngaagctaagagttgagagtccaggattctgtcatttcaactcttacaatcaggaacaaagatcaaatacatctactggttattatccatctggggtgaaaatttcgggccctcacancagtgttcgcggaagaggaattacccgnttantagagagcatntcaaantcntccaacaacatccatagattntccagctgtgaganttcantntcaccttacacgccccaaaaagatgggtacaaacctttntcntccttttnttaatgatggtactttgtgcgatttctggaaaaataacaanccaacttcctttctgactacagtcatattaacaaacatcacatcaa

SEQ ID NO: 8323 - DNA, 60 bp, Mus musculus
ggcaggtgtgtttcaagttggttttctgttgctgaggctttcatacacatcagttaccat

SEQ ID NO: 8324 - DNA, 293 bp, Mus musculus
  misc_feature (60)..(60): n is a, c, g, or t
  misc_feature (73)..(73): n is a, c, g, or t
  misc_feature (86)..(86): n is a, c, g, or t
  misc_feature (109)..(109): n is a, c, g, or t
  misc_feature (114)..(114): n is a, c, g, or t
  misc_feature (119)..(119): n is a, c, g, or t
  misc_feature (121)..(121): n is a, c, g, or t
  misc_feature (124)..(127): n is a, c, g, or t
  misc_feature (137)..(137): n is a, c, g, or t
  misc_feature (142)..(142): n is a, c, g, or t
  misc_feature (144)..(144): n is a, c, g, or t
  misc_feature (148)..(148): n is a, c, g, or t
  misc_feature (202)..(202): n is a, c, g, or t
agaaaacagagttctccccatgccaacgagtatagggattttccttgactgtgataaagncaaagtgagcttntatgatatggacncacatgaaatgcctgtatgagcnccagntggantnttnnnnatacaatgtntccgncntttnccttgatgggcagcggaggaattcagcttgaggaagccatcacagcaaagtatntggaatatgaagaggatgtgtagcttggacaccccacgtgactgatgaggataagaaccgtgaacaaagccatgccttgatgttaatctaa

SEQ ID NO: 8325 - DNA, 518 bp, Mus musculus
  misc_feature (289)..(289): n is a, c, g, or t
  misc_feature (292)..(292): n is a, c, g, or t
  misc_feature (297)..(297): n is a, c, g, or t
  misc_feature (306)..(306): n is a, c, g, or t
  misc_feature (319)..(319): n is a, c, g, or t
  misc_feature (321)..(321): n is a, c, g, or t
  misc_feature (323)..(323): n is a, c, g, or t
  misc_feature (325)..(325): n is a, c, g, or t
  misc_feature (327)..(327): n is a, c, g, or t
  misc_feature (349)..(349): n is a, c, g, or t
  misc_feature (352)..(352): n is a, c, g, or t
  misc_feature (357)..(357): n is a, c, g, or t
  misc_feature (371)..(371): n is a, c, g, or t
  misc_feature (375)..(375): n is a, c, g, or t
  misc_feature (379)..(379): n is a, c, g, or t
  misc_feature (381)..(381): n is a, c, g, or t
  misc_feature (390)..(390): n is a, c, g, or t
  misc_feature (397)..(397): n is a, c, g, or t
  misc_feature (454)..(454): n is a, c, g, or t
  misc_feature (457)..(457): n is a, c, g, or t
  misc_feature (493)..(493): n is a, c, g, or t
agccatcgtgatgaggaccgtacacgcctgctggtagactccatcctgcagggcttcaaaccccaggtctttcccgatgcctacaccctcaccttcatccctgtcataagcacaaccacgaccagcacacctctcaaggtactccgcctgacggtgcacactcccaaggctcagggtgagccacagctgtacgagactgaccagggggaggtatttctaaggcgcgatgggagcatccagggcccactgtcggttggcgccatccaggactggtgcaggcagaagtggncgntgganctgggcaanctggaagagaagntnangntnttaacgctggaaaaggagcagnttnagcancagctgaggcagcnccanccantntcctgcagntgctgtntcctgtgaggacataagatgtgggctaagacttggagtaaaacctacctgggccacntcntttcccttggcattgcacacacaggagccacagganttcacctcagtgtgggcacagtaac

SEQ ID NO: 8326 - DNA, 391 bp, Mus musculus
  misc_feature (49)..(49): n is a, c, g, or t
  misc_feature (67)..(67): n is a, c, g, or t
  misc_feature (73)..(73): n is a, c, g, or t
  misc_feature (77)..(77): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (93)..(93): n is a, c, g, or t
  misc_feature (103)..(103): n is a, c, g, or t
  misc_feature (108)..(108): n is a, c, g, or t
  misc_feature (115)..(115): n is a, c, g, or t
  misc_feature (121)..(121): n is a, c, g, or t
  misc_feature (137)..(137): n is a, c, g, or t
  misc_feature (143)..(143): n is a, c, g, or t
  misc_feature (150)..(150): n is a, c, g, or t
  misc_feature (161)..(161): n is a, c, g, or t
  misc_feature (173)..(173): n is a, c, g, or t
  misc_feature (177)..(177): n is a, c, g, or t
  misc_feature (238)..(238): n is a, c, g, or t
  misc_feature (269)..(269): n is a, c, g, or t
  misc_feature (279)..(279): n is a, c, g, or t
  misc_feature (294)..(294): n is a, c, g, or t
  misc_feature (296)..(296): n is a, c, g, or t
  misc_feature (305)..(305): n is a, c, g, or t
  misc_feature (311)..(311): n is a, c, g, or t
  misc_feature (314)..(314): n is a, c, g, or t
  misc_feature (319)..(319): n is a, c, g, or t
  misc_feature (330)..(330): n is a, c, g, or t
  misc_feature (357)..(357): n is a, c, g, or t
aactcctcagatttctctagcacaaggttctacagagctaggtatccantcctcccccttcctccangtgttncaancctnagntantaccantccccagcanctacnactggangctcanttccgggtacaactgnagcaantgcgggntatgggctttntgaatcttgaanccantctccaggccctcattgctacagagggtgatgtagatgctgctgtggagaaattgaggaantcttaggagctctagttatttggaccatatnttttcctttntgcctttcccccatntnttattaccntagttntcntattnttgaatacagntgcactataaaccaaattactatgatnttctttactgtggagacaatgttctggagtcaat

SEQ ID NO: 8327 - DNA, 532 bp, Mus musculus
  misc_feature (280)..(280): n is a, c, g, or t
  misc_feature (311)..(312): n is a, c, g, or t
  misc_feature (315)..(315): n is a, c, g, or t
  misc_feature (358)..(358): n is a, c, g, or t
  misc_feature (365)..(365): n is a, c, g, or t
  misc_feature (373)..(373): n is a, c, g, or t
  misc_feature (386)..(386): n is a, c, g, or t
  misc_feature (444)..(444): n is a, c, g, or t
  misc_feature (460)..(460): n is a, c, g, or t
  misc_feature (474)..(474): n is a, c, g, or t
  misc_feature (484)..(484): n is a, c, g, or t
  misc_feature (488)..(488): n is a, c, g, or t
ttctgactgctcctgtcatgtatgatacatttttgtgcatgcctgatgtgacattcataaattgtaccactatgactttatccatgtaaaatagctatttattgaatttcttccaacagctggacttatttttttgtctccatttgaacatcttaacagagaatttgttactgtttattaaaagaattgagtttgaaagcataaaaaatctgctttgcaatcgtatgaagaaaaacaatgcctttattatcacgtgttaataagcacaattcttatagcnaacggtgatgaattctttgtttctttcattnnccncaatattttcatatgaacaaaccaaaaatccatggtgagcagnggcggtntcggctgncccatcctgtgtntccagggcactcggaggatgtggacgttgacgagtgtgacctggtgctgtgactggancaatactttactttcntcacgtgtgcttcnccgtgctatnccgnccttttaatgtttagttttcctcttgtcatggtcaactgctgaa

SEQ ID NO: 8328 - DNA, 158 bp, Mus musculus
ttgaattcgttctcattctccgttgcctgtgtgttgctgtctctcgttcttcgtagccagaactaccattaaagattaccgaagaagggggaacaatcatctgcgaaggagaattaggagacgaatcaagcgtgctactgaacttcgattgatgcgga

SEQ ID NO: 8329 - DNA, 361 bp, Mus musculus
  misc_feature (26)..(26): n is a, c, g, or t
  misc_feature (186)..(186): n is a, c, g, or t
  misc_feature (220)..(220): n is a, c, g, or t
  misc_feature (230)..(230): n is a, c, g, or t
  misc_feature (240)..(240): n is a, c, g, or t
  misc_feature (242)..(242): n is a, c, g, or t
  misc_feature (254)..(254): n is a, c, g, or t
  misc_feature (264)..(264): n is a, c, g, or t
  misc_feature (266)..(266): n is a, c, g, or t
  misc_feature (269)..(269): n is a, c, g, or t
  misc_feature (274)..(274): n is a, c, g, or t
  misc_feature (283)..(283): n is a, c, g, or t
  misc_feature (292)..(292): n is a, c, g, or t
  misc_feature (309)..(309): n is a, c, g, or t
  misc_feature (330)..(330): n is a, c, g, or t
atgtggatttatggcactaaacactntcctccactgtgttactttgcgaagctggatggagcagactttcacttagcaagcaccaagtgtgaaaacaactgtctggtttcttcataagactagaatactttctgacactttgctagaaaaaaaaaattcaaagctgtgcctttgagtctatactanactgtgtatgtgtggaaataaaaaaaatgtattntactttgggnaaattttttntnaggtattttttntcagatttgnangcnatttntgaggtttnttagagatnaacataggttttctttntgtattataagatgcaccaancaattatggtggacctattaccctatgggta

SEQ ID NO: 8330 - DNA, 363 bp, Mus musculus
  misc_feature (120)..(120): n is a, c, g, or t
  misc_feature (127)..(127): n is a, c, g, or t
  misc_feature (137)..(137): n is a, c, g, or t
  misc_feature (141)..(141): n is a, c, g, or t
  misc_feature (146)..(146): n is a, c, g, or t
  misc_feature (184)..(184): n is a, c, g, or t
  misc_feature (195)..(195): n is a, c, g, or t
  misc_feature (213)..(213): n is a, c, g, or t
  misc_feature (215)..(215): n is a, c, g, or t
  misc_feature (228)..(228): n is a, c, g, or t
  misc_feature (245)..(245): n is a, c, g, or t
  misc_feature (248)..(249): n is a, c, g, or t
  misc_feature (251)..(251): n is a, c, g, or t
  misc_feature (278)..(278): n is a, c, g, or t
gagcaggctaacaagtcatgggaaaacttcttggctaggacatcaaatgctaaaacattaaagaaagcaaagaagcttcaagaaaaggctatagaatcctccagatatactgaacgaccncagaatncaacattccnccanacagntattaaaggtcttaacacaacggtgccttcgggtcggntggtgacagtncaaagcacacctacccgncntactgggaggacntctggctgacacagacntcnntntgaaaaaactgcctattcgaggagggnccttgcagcgggtgaaagtgaagccaccactgaatgatcctaaaaagagcatccctacatgatgtgttccacagctcctgaaata

SEQ ID NO: 8331 - DNA, 407 bp, Mus musculus
  misc_feature (29)..(29): n is a, c, g, or t
  misc_feature (330)..(330): n is a, c, g, or t
  misc_feature (352)..(352): n is a, c, g, or t
  misc_feature (356)..(356): n is a, c, g, or t
  misc_feature (360)..(361): n is a, c, g, or t
tttccctaattctgttcatcatttagttngtgattgtatctaatttagatttggtggtgactgatctaaattcagaagtgcacacacagctttagcaaccaaggatgcccacatttccatgtggaggctctagggtattccagtgcatctccctcccaccatcaagaaggttggttcatttgtcatattgaataacagtatctcaaagtccgtcagttggaaaagtggttaaacctattatttttctaaaggaaatttgatggtgtcatgaataacctgattgttaaaaggtcttgtttcttgagggtttgtcctaagagatttgtgggntcttttggtttttgtttgtttntttntttnntttaaattttaaaggaacatatactttgaataacaatcctccaggc

SEQ ID NO: 8332 - DNA, 475 bp, Mus musculus
  misc_feature (253)..(253): n is a, c, g, or t
  misc_feature (274)..(274): n is a, c, g, or t
  misc_feature (280)..(280): n is a, c, g, or t
  misc_feature (282)..(282): n is a, c, g, or t
  misc_feature (316)..(316): n is a, c, g, or t
  misc_feature (341)..(341): n is a, c, g, or t
  misc_feature (343)..(343): n is a, c, g, or t
  misc_feature (371)..(371): n is a, c, g, or t
  misc_feature (379)..(381): n is a, c, g, or t
  misc_feature (385)..(392): n is a, c, g, or t
  misc_feature (402)..(402): n is a, c, g, or t
  misc_feature (409)..(409): n is a, c, g, or t
ggtcacctggtgaactgtattaaagagtcacagcattaggaagttaagaactgctggtttagtgtcttctatcgaactgtagctttttgtcaacatctattaagtattttttagaagtgttgtttctgcatgtgtataccaaattatattatctttacgtttgtctggggaaaaggtttttaatttgttttatgtcaaacacctcaataactcattcaaaagaaacatgtttttagtaacttttctgtagacnatatggtaagggtggagatanaatgtnanggcttgttccttgtatattttggctttcattttnaactggattcccatgtattcatagnanacagtttacttcctctctatatttcctnatctgttnnnttcnnnnnnnnctcaccagtntatatgntctcctttcctgtgatttttcacctctggatatgagtttgtatgtcaacttgagggttttctccaa

SEQ ID NO: 8333 - DNA, 39 bp, Mus musculus
gttggaaacccagacagcttttgtgatgtttcaaattaa

SEQ ID NO: 8334 - DNA, 546 bp, Mus musculus
  misc_feature (141)..(141): n is a, c, g, or t
  misc_feature (253)..(253): n is a, c, g, or t
  misc_feature (280)..(280): n is a, c, g, or t
  misc_feature (282)..(282): n is a, c, g, or t
  misc_feature (304)..(304): n is a, c, g, or t
  misc_feature (308)..(308): n is a, c, g, or t
  misc_feature (313)..(313): n is a, c, g, or t
  misc_feature (329)..(329): n is a, c, g, or t
  misc_feature (332)..(332): n is a, c, g, or t
  misc_feature (341)..(341): n is a, c, g, or t
  misc_feature (360)..(360): n is a, c, g, or t
  misc_feature (383)..(383): n is a, c, g, or t
  misc_feature (396)..(396): n is a, c, g, or t
  misc_feature (407)..(407): n is a, c, g, or t
  misc_feature (421)..(421): n is a, c, g, or t
  misc_feature (492)..(493): n is a, c, g, or t
agggaagctccagaagttcctcttctcaggatctgcgggaaaatgatgacccaggaaaaccacactttccaatcgagaagtacttggaaactgagatcgaagagcaagaaatcaccgaggggcataacggaccttggttgnccgagctcagcggtatgcatgttactgagggaaaaccaactatgggaatccaagctttatcggagagtgaacacaaggagcctaggcgggtggcttcttcagaggtgagggntaagagtcagctccagaaggaagcagncntccctggggtggaagaagaggntaantacancccatgaggtgacatnccnctgtacctntgcatggaagctgatttgntcattgctactgccagagcaatnggctggatgattntggaaggattntttatttccctttnttcttgtcacagaattacacatgtattttcagcttgctatttcccttctattgcattttaaaaatcacttnntcattcttaaatagcttgtttcctattttctgtaaattccttcctatgataat

SEQ ID NO: 8335 - DNA, 482 bp, Mus musculus
  misc_feature (306)..(306): n is a, c, g, or t
  misc_feature (308)..(310): n is a, c, g, or t
  misc_feature (313)..(313): n is a, c, g, or t
  misc_feature (315)..(315): n is a, c, g, or t
  misc_feature (330)..(330): n is a, c, g, or t
  misc_feature (348)..(348): n is a, c, g, or t
  misc_feature (372)..(372): n is a, c, g, or t
  misc_feature (379)..(379): n is a, c, g, or t
  misc_feature (381)..(381): n is a, c, g, or t
  misc_feature (385)..(385): n is a, c, g, or t
  misc_feature (395)..(395): n is a, c, g, or t
  misc_feature (423)..(423): n is a, c, g, or t
  misc_feature (425)..(425): n is a, c, g, or t
taaaaatccttctgcatcttggctgatggggcaaacagcactgttcaggctgaaggctactcccccctaagtgcacagctgcagcgtgaccttactggatggattttcagggagccagaaggcaggggagaaagatggccaggatgctgaagccttctttctagtccctacatcatggcctacatgctaggacccgcaaatgcccaagtacagaaactaaacctgacatttcattttcactttctttttttatttggtgcttcatcaaatcaaccctttctatagtcacatctctctccaagaggntnnncanantgcgaagcccttagnccaagcaacaaagcatgnaaaggtgaaaacagcaggcatttnagctgantntagntctcaagccnaggaggaagtgcatgagtaagctggatntnttccttagcacttcttagcacgcacacacactagaaccatgcttctttgggcacatt

SEQ ID NO: 8336 - DNA, 508 bp, Mus musculus
  misc_feature (45)..(45): n is a, c, g, or t
  misc_feature (63)..(63): n is a, c, g, or t
  misc_feature (227)..(227): n is a, c, g, or t
  misc_feature (230)..(230): n is a, c, g, or t
  misc_feature (234)..(234): n is a, c, g, or t
  misc_feature (238)..(238): n is a, c, g, or t
  misc_feature (240)..(241): n is a, c, g, or t
  misc_feature (243)..(243): n is a, c, g, or t
  misc_feature (257)..(257): n is a, c, g, or t
  misc_feature (263)..(263): n is a, c, g, or t
  misc_feature (265)..(265): n is a, c, g, or t
  misc_feature (267)..(267): n is a, c, g, or t
  misc_feature (270)..(270): n is a, c, g, or t
  misc_feature (274)..(274): n is a, c, g, or t
  misc_feature (282)..(282): n is a, c, g, or t
  misc_feature (299)..(299): n is a, c, g, or t
  misc_feature (338)..(338): n is a, c, g, or t
  misc_feature (347)..(347): n is a, c, g, or t
  misc_feature (375)..(375): n is a, c, g, or t
  misc_feature (430)..(430): n is a, c, g, or t
  misc_feature (433)..(433): n is a, c, g, or t
  misc_feature (453)..(453): n is a, c, g, or t
ggaacattgctgaccaggtacgcctggagcaggtcatggctggtnccaacctcggcaacgttntgtggtgcaggctacaggagctgaaagatcagggcccactccccacctttttgcagctgatgaaggtgatacgtgaggaagaagaagaagaagacgcctactttgaacaagagagcagggaggagccgggggaaagggagggctctggctgctggaacaattcnagnaacnactnannanatatccccactccntccctnantntgntggncgatgctngacaagagacgatgctngacaaggctaaccccattacagtggattcttcttaagtncaggactgnagctaaacattaggactgaaggtttttntcttttctttcttttcttttgttttgatagggtctcaccttatagcccaagttgnccnttgaactgacattcttcctncctcaacctcccaaattgagagttctgggattagaggaacatcccaccactagtt

SEQ ID NO: 8337 - DNA, 541 bp, Mus musculus
  misc_feature (357)..(357): n is a, c, g, or t
  misc_feature (359)..(359): n is a, c, g, or t
  misc_feature (369)..(369): n is a, c, g, or t
  misc_feature (373)..(373): n is a, c, g, or t
  misc_feature (375)..(375): n is a, c, g, or t
  misc_feature (384)..(384): n is a, c, g, or t
  misc_feature (386)..(386): n is a, c, g, or t
  misc_feature (391)..(391): n is a, c, g, or t
  misc_feature (405)..(405): n is a, c, g, or t
  misc_feature (418)..(418): n is a, c, g, or t
  misc_feature (420)..(420): n is a, c, g, or t
  misc_feature (440)..(440): n is a, c, g, or t
  misc_feature (465)..(465): n is a, c, g, or t
  misc_feature (479)..(479): n is a, c, g, or t
  misc_feature (482)..(482): n is a, c, g, or t
  misc_feature (484)..(485): n is a, c, g, or t
  misc_feature (494)..(494): n is a, c, g, or t
gtatttctgctgtcttaggctgccagcacattggcttacatggatctggaggactggtcacactagtattgtcgttcatggcagcaaaaagatgggctgaagagaaggttggaatccaaaaaattgttgcaaacacatggaatgtttttcagccgcttctttttggcttagttggaacagaagtatctgttgaatctcttgaatcaaaaaccattggcatgtgccttgctaccttgggtttggcactatctgttcgaattttatccacttttgtactgatgtcttttgctaacttccgttttaaggagaaagtatttattgctttatcatggatccctaaagctacagtccaggctntnttaggacctntggntntagaaacancnaaggntcatggcaccccanttggaaggatacncngaaggctgtgatgacagtgnccttcctagccatcctgattacagntccaaatggagccntcntnntcggcatantgggacccaaaatccttgaacagagtgaggtgacattccctttgaaa

SEQ ID NO: 8338 - DNA, 536 bp, Mus musculus
  misc_feature (153)..(153): n is a, c, g, or t
  misc_feature (231)..(231): n is a, c, g, or t
  misc_feature (330)..(330): n is a, c, g, or t
  misc_feature (334)..(334): n is a, c, g, or t
  misc_feature (346)..(346): n is a, c, g, or t
  misc_feature (361)..(362): n is a, c, g, or t
  misc_feature (371)..(371): n is a, c, g, or t
  misc_feature (387)..(387): n is a, c, g, or t
  misc_feature (401)..(401): n is a, c, g, or t
  misc_feature (459)..(459): n is a, c, g, or t
  misc_feature (472)..(472): n is a, c, g, or t
  misc_feature (474)..(474): n is a, c, g, or t
  misc_feature (491)..(491): n is a, c, g, or t
  misc_feature (495)..(495): n is a, c, g, or t
gagctctatggtgttcctgaagacacaaaggagcaagagaccagccatgtggagaacaatggtattaatccatactggggggagactttctatttccggctccaggtacctgaacttgctatgttgcgttttgtggtaaaggattatagcagnaaatcccgaaataactttattggccaatacaccctaccttggacctgtatgaaacaaggctaccgacatgtatccttnctctccagagatggcactagcctcaatccagcttccatctttgtatacacctgcatgcaggaagacctggatatggatgagccctgagaaacacagggnaggnccttgaagaacnatctacagatgcacnntcctttccnacctacaacttcctcnaaatccagagccanccaaaggatcaatgaaggatcaaggttgccaggcaaaggttgaggaagaatgcctgantcaaaactgtgantntagagaacaatgcacancccntgagaccccactggactgctgctccttagctggtctaaata

SEQ ID NO: 8339 - DNA, 196 bp, Mus musculus
  misc_feature (30)..(30): n is a, c, g, or t
  misc_feature (32)..(32): n is a, c, g, or t
  misc_feature (34)..(34): n is a, c, g, or t
  misc_feature (50)..(50): n is a, c, g, or t
  misc_feature (57)..(57): n is a, c, g, or t
  misc_feature (62)..(62): n is a, c, g, or t
  misc_feature (80)..(80): n is a, c, g, or t
  misc_feature (90)..(90): n is a, c, g, or t
tagtggtgatggcacaccccaacaggaacntntntgtgtggattgggggntccattntagcntcattgcatgctttccantcctgttggntcctacgggaacaatatgaagaaaggggaccccaggttgtataccgaaaatgctactaacatggggaaaggcgggaagggctaagggcagtaaagcttttcttggc

SEQ ID NO: 8340 - DNA, 534 bp, Mus musculus
  misc_feature (341)..(341): n is a, c, g, or t
  misc_feature (343)..(344): n is a, c, g, or t
gtaaaacctttgtgtgtagtcttagaaatcaagagccaatttatattgcagaggaaccctataaatatagtcaatgtggtaaagttttgcacttcataatttgttaaacaacagtaaaacctttgatgttatctgttaatgcctttacacatcacagtaattttgagtgctgataaaactcatactgaatagataaaacttatactgaatggaatttttgactataaaagatttgataagatttttagccaatacatttacattaagttatagaaaattatttattcagaggaataaacctgacaactttcaacaaagtattcaagaattatgtccctctntnntatgcactgatgacctggaagaaatataagatggattgcatcagaagtatctgaagccttggcactttaaagaaatttcagagtcccaaatctctacaaaatgaagaagagtgaaaagaaagatcaggagagaaactgacaagtcttaaaaagtggctgagcacttggccaatgccacaagacagtttat

SEQ ID NO: 8341 - DNA, 561 bp, Mus musculus
  misc_feature (276)..(276): n is a, c, g, or t
  misc_feature (349)..(349): n is a, c, g, or t
  misc_feature (365)..(376): n is a, c, g, or t
  misc_feature (379)..(379): n is a, c, g, or t
  misc_feature (381)..(382): n is a, c, g, or t
  misc_feature (384)..(385): n is a, c, g, or t
  misc_feature (393)..(393): n is a, c, g, or t
  misc_feature (398)..(398): n is a, c, g, or t
  misc_feature (413)..(413): n is a, c, g, or t
  misc_feature (425)..(425): n is a, c, g, or t
  misc_feature (427)..(427): n is a, c, g, or t
  misc_feature (436)..(436): n is a, c, g, or t
  misc_feature (464)..(464): n is a, c, g, or t
  misc_feature (478)..(478): n is a, c, g, or t
  misc_feature (503)..(503): n is a, c, g, or t
  misc_feature (529)..(529): n is a, c, g, or t
  misc_feature (531)..(532): n is a, c, g, or t
aagaccacgcaggaagcggacatttatgagaccaaatacaaggagatgagcaagaccctggagtatctcaagaactcggtggagaagatgtttaagaagatcaactgcgatgccactgagatcctgggcaagctgggcgagtccgggaaggtcacggacatcaatctgcagcagtattttgctatcatagaaaagaagacaaatgacctgctgcttctagagtccttccggcgcctgcaggaggcagaggggcccgatgtcgatgtcccacaaccntttgtcaaccccttctggggcggctctgccctcctcaagcccccagagcccataagggttgtgctgcctgtgntttggggcagactccnnnnnnnnnnnnctngnngnngtggactntcctntggaccacagtaccntccagcagatgntnttggagaanttccttcagagggaacgcacaaaagaantacaggacaccatntcagagaagggggacgagataaggntcaagaagaaggtgataggctgagcntnngtgggtgcctgtattccacaccagagaga

SEQ ID NO: 8342 - DNA, 140 bp, Mus musculus
  misc_feature (49)..(49): n is a, c, g, or t
  misc_feature (112)..(112): n is a, c, g, or t
  misc_feature (115)..(115): n is a, c, g, or t
gatgaacatgccaggattctgtgaaggaagaaaaatggagttttgtttngtacaccccgcttggtagaatgttagcacgtgagagagaaggtgtgacccgtgtgttgagttnttnttccctcatttaaaagctcaattaa

SEQ ID NO: 8343 - DNA, 176 bp, Mus musculus
  misc_feature (35)..(35): n is a, c, g, or t
  misc_feature (68)..(68): n is a, c, g, or t
  misc_feature (79)..(79): n is a, c, g, or t
  misc_feature (85)..(85): n is a, c, g, or t
  misc_feature (98)..(98): n is a, c, g, or t
  misc_feature (129)..(129): n is a, c, g, or t
gtactcttccactgtgtttgcagcagtcaccacgnacgggaaggcccatgtgtttgacttagcggtcnacaagtatgangctatntgcaaccagcctntggtagccaagaagaagaacaagatcacccncgtgcagttcaatcccatccaccccatcataatcgtgggcgacgacc

SEQ ID NO: 8344 - DNA, 423 bp, Mus musculus
  misc_feature (35)..(35): n is a, c, g, or t
  misc_feature (68)..(68): n is a, c, g, or t
  misc_feature (79)..(79): n is a, c, g, or t
  misc_feature (85)..(85): n is a, c, g, or t
  misc_feature (98)..(98): n is a, c, g, or t
  misc_feature (129)..(129): n is a, c, g, or t
  misc_feature (177)..(177): n is a, c, g, or t
  misc_feature (192)..(192): n is a, c, g, or t
  misc_feature (210)..(210): n is a, c, g, or t
  misc_feature (219)..(219): n is a, c, g, or t
  misc_feature (240)..(240): n is a, c, g, or t
  misc_feature (248)..(248): n is a, c, g, or t
  misc_feature (259)..(259): n is a, c, g, or t
  misc_feature (275)..(275): n is a, c, g, or t
  misc_feature (283)..(283): n is a, c, g, or t
  misc_feature (292)..(292): n is a, c, g, or t
  misc_feature (295)..(295): n is a, c, g, or t
  misc_feature (299)..(299): n is a, c, g, or t
  misc_feature (301)..(303): n is a, c, g, or t
  misc_feature (314)..(314): n is a, c, g, or t
  misc_feature (321)..(321): n is a, c, g, or t
  misc_feature (325)..(325): n is a, c, g, or t
  misc_feature (333)..(333): n is a, c, g, or t
  misc_feature (359)..(359): n is a, c, g, or t
  misc_feature (384)..(384): n is a, c, g, or t
gtactcttccactgtgtttgcagcagtcaccacgnacgggaaggcccatgtgtttgacttagcggtcnacaagtatgangctatntgcaaccagcctntggtagccaagaagaagaacaagatcacccncgtgcagttcaatcccatccaccccatcataatcgtgggcgacgaccntggccacatcatctntctcaagctctctcccancttgcgaangatgccaaaggagaagaaggngcaggaantgcagaagggnccagctgtggagatcncaaaattngacaaactnctnaacntnnntgagggaagtnaaaaccnaaancctgagantctggcccagaccctgctccgtgttntgaacccaatacaagcaaggacgtncctcaccctgaccaatcccagtatttgcttttctcattc

SEQ ID NO: 8345 - DNA, 367 bp, Mus musculus
  misc_feature (95)..(95): n is a, c, g, or t
  misc_feature (106)..(106): n is a, c, g, or t
  misc_feature (122)..(122): n is a, c, g, or t
  misc_feature (169)..(169): n is a, c, g, or t
  misc_feature (187)..(187): n is a, c, g, or t
  misc_feature (225)..(225): n is a, c, g, or t
  misc_feature (237)..(237): n is a, c, g, or t
  misc_feature (241)..(241): n is a, c, g, or t
  misc_feature (244)..(244): n is a, c, g, or t
  misc_feature (247)..(247): n is a, c, g, or t
  misc_feature (256)..(256): n is a, c, g, or t
  misc_feature (266)..(266): n is a, c, g, or t
  misc_feature (268)..(268): n is a, c, g, or t
  misc_feature (270)..(270): n is a, c, g, or t
  misc_feature (276)..(276): n is a, c, g, or t
  misc_feature (282)..(282): n is a, c, g, or t
  misc_feature (289)..(289): n is a, c, g, or t
  misc_feature (291)..(291): n is a, c, g, or t
  misc_feature (300)..(301): n is a, c, g, or t
  misc_feature (316)..(316): n is a, c, g, or t
ctttattgaattttgtgctgccgtaactatggcaagcttatgaagatgaagtacagcttagatggttagaacgatcagcacttactcataagatnaactttagaangtcccctcctacatgntactccacaagaactccaggagtttaaatctgaactgtttctgattncaaaatgtttacgagttnaagacatctttcacactgcatgataatctgctaaaatntcagggaaaccntcancanacnacaaagggnccatgagcantntntgcttntattgntaagcantnctaaatttnntttatgtgtagaaanttaaattcatggcacgcttagctgacaggacacagcctaacatacccacgt

SEQ ID NO: 8346 - DNA, 326 bp, Mus musculus
  misc_feature (66)..(66): n is a, c, g, or t
  misc_feature (121)..(124): n is a, c, g, or t
  misc_feature (126)..(126): n is a, c, g, or t
  misc_feature (140)..(140): n is a, c, g, or t
  misc_feature (142)..(142): n is a, c, g, or t
  misc_feature (162)..(162): n is a, c, g, or t
  misc_feature (167)..(167): n is a, c, g, or t
  misc_feature (193)..(193): n is a, c, g, or t
  misc_feature (204)..(204): n is a, c, g, or t
  misc_feature (220)..(220): n is a, c, g, or t
  misc_feature (233)..(233): n is a, c, g, or t
  misc_feature (238)..(238): n is a, c, g, or t
  misc_feature (248)..(248): n is a, c, g, or t
  misc_feature (250)..(250): n is a, c, g, or t
  misc_feature (267)..(267): n is a, c, g, or t
  misc_feature (275)..(275): n is a, c, g, or t
  misc_feature (277)..(277): n is a, c, g, or t
gggatgaagaactgaaggcgttccttcatgtctcctggaactctggctcctgtcgaagttaccgcnccccacatcccccacaagagaagcatggttaatagtcagggtagaatggaaattnnnntntttaggacgaccantntcctactggatgacgggatnccatntgggatgagccagggtgcagacctantggggagtcantccaggacccctgtantccttggacattnttcantatttcattntnttgccttcacccgttantttttttntnttcccacttgcaagtaaaactgaccagagtcctggagggaaatatctta

SEQ ID NO: 8347 - DNA, 89 bp, Mus musculus
  misc_feature (30)..(30): n is a, c, g, or t
  misc_feature (32)..(32): n is a, c, g, or t
  misc_feature (38)..(39): n is a, c, g, or t
  misc_feature (42)..(42): n is a, c, g, or t
  misc_feature (46)..(47): n is a, c, g, or t
  misc_feature (49)..(52): n is a, c, g, or t
gtgtattataggctcctgcatttttacgantngacacnntcntcanntnnnngcaatggcatttctgtagttgcacaagaactgagcag

SEQ ID NO: 8348 - DNA, 180 bp, Mus musculus
  misc_feature (30)..(30): n is a, c, g, or t
  misc_feature (32)..(32): n is a, c, g, or t
  misc_feature (38)..(39): n is a, c, g, or t
  misc_feature (42)..(42): n is a, c, g, or t
  misc_feature (46)..(47): n is a, c, g, or t
  misc_feature (49)..(52): n is a, c, g, or t
  misc_feature (90)..(90): n is a, c, g, or t
  misc_feature (92)..(92): n is a, c, g, or t
  misc_feature (109)..(109): n is a, c, g, or t
  misc_feature (124)..(124): n is a, c, g, or t
  misc_feature (131)..(131): n is a, c, g, or t
  misc_feature (152)..(152): n is a, c, g, or t
gtgtattataggctcctgcatttttacgantngacacnntcntcanntnnnngcaatggcatttctgtagttgcacaagaactgagcagntnttagagtttcagctttntgctgtaaaggggantacgcantagtcagttactgatatacantccttctgtgactgcctagtagacccaa

SEQ ID NO: 8349 - DNA, 565 bp, Mus musculus
  misc_feature (242)..(242): n is a, c, g, or t
  misc_feature (258)..(258): n is a, c, g, or t
  misc_feature (266)..(266): n is a, c, g, or t
  misc_feature (279)..(280): n is a, c, g, or t
  misc_feature (284)..(284): n is a, c, g, or t
  misc_feature (287)..(287): n is a, c, g, or t
  misc_feature (293)..(294): n is a, c, g, or t
  misc_feature (300)..(300): n is a, c, g, or t
  misc_feature (309)..(309): n is a, c, g, or t
  misc_feature (318)..(318): n is a, c, g, or t
  misc_feature (323)..(326): n is a, c, g, or t
  misc_feature (333)..(335): n is a, c, g, or t
  misc_feature (359)..(359): n is a, c, g, or t
  misc_feature (364)..(364): n is a, c, g, or t
  misc_feature (391)..(391): n is a, c, g, or t
  misc_feature (406)..(406): n is a, c, g, or t
  misc_feature (408)..(408): n is a, c, g, or t
  misc_feature (422)..(422): n is a, c, g, or t
  misc_feature (453)..(453): n is a, c, g, or t
  misc_feature (479)..(479): n is a, c, g, or t
  misc_feature (530)..(530): n is a, c, g, or t
gccacaaatccagaagttgctattatatttatatttcattatattaatttatatttttagttttatttgtatttagtgctacagatggtataagtttttaatttaaaatttttatggtagaaaagtgtatagtaattactagctagtgtttggaagataatattcttatgaacaggtagtaggttttcacagtgttaaactgtctgtctgtctgtctgtccatctgcctacctacctatctntagaagaagtgacttntctcagancaaggatatactnnactncantacccnntttttnttctgtatnttctgaatnttctnnnntgaggtnnnctaatcttaagaaattccacaaangcttnatgtaggatccattaaatcaaaggtcnatatgaactgttatntntaaaatggcttgcntcagaactgaccacctgacagcacttccttnacctgcatatgaacttgtgatttttntctttataagctgacagaaaaagatatccattgtcacagttcagataattntgaattatgtttccagtctggccagtagtagggtg

SEQ ID NO: 8350 - DNA, 572 bp, Mus musculus
  misc_feature (67)..(67): n is a, c, g, or t
  misc_feature (73)..(73): n is a, c, g, or t
  misc_feature (79)..(79): n is a, c, g, or t
  misc_feature (82)..(82): n is a, c, g, or t
  misc_feature (89)..(89): n is a, c, g, or t
  misc_feature (91)..(91): n is a, c, g, or t
  misc_feature (93)..(93): n is a, c, g, or t
  misc_feature (97)..(97): n is a, c, g, or t
  misc_feature (103)..(103): n is a, c, g, or t
  misc_feature (107)..(107): n is a, c, g, or t
  misc_feature (111)..(111): n is a, c, g, or t
  misc_feature (116)..(116): n is a, c, g, or t
  misc_feature (118)..(118): n is a, c, g, or t
  misc_feature (120)..(120): n is a, c, g, or t
  misc_feature (124)..(125): n is a, c, g, or t
  misc_feature (131)..(131): n is a, c, g, or t
  misc_feature (137)..(137): n is a, c, g, or t
  misc_feature (145)..(145): n is a, c, g, or t
  misc_feature (154)..(154): n is a, c, g, or t
  misc_feature (157)..(157): n is a, c, g, or t
  misc_feature (163)..(163): n is a, c, g, or t
  misc_feature (286)..(287): n is a, c, g, or t
  misc_feature (289)..(290): n is a, c, g, or t
  misc_feature (292)..(292): n is a, c, g, or t
  misc_feature (296)..(296): n is a, c, g, or t
  misc_feature (307)..(307): n is a, c, g, or t
  misc_feature (312)..(313): n is a, c, g, or t
  misc_feature (317)..(317): n is a, c, g, or t
  misc_feature (320)..(320): n is a, c, g, or t
  misc_feature (322)..(322): n is a, c, g, or t
  misc_feature (325)..(325): n is a, c, g, or t
  misc_feature (329)..(329): n is a, c, g, or t
  misc_feature (332)..(332): n is a, c, g, or t
  misc_feature (334)..(335): n is a, c, g, or t
  misc_feature (345)..(356): n is a, c, g, or t
  misc_feature (359)..(361): n is a, c, g, or t
  misc_feature (363)..(366): n is a, c, g, or t
  misc_feature (368)..(368): n is a, c, g, or t
  misc_feature (370)..(371): n is a, c, g, or t
  misc_feature (373)..(373): n is a, c, g, or t
  misc_feature (376)..(381): n is a, c, g, or t
  misc_feature (383)..(383): n is a, c, g, or t
  misc_feature (408)..(408): n is a, c, g, or t
  misc_feature (417)..(417): n is a, c, g, or t
  misc_feature (425)..(425): n is a, c, g, or t
  misc_feature (427)..(427): n is a, c, g, or t
  misc_feature (440)..(440): n is a, c, g, or t
  misc_feature (476)..(476): n is a, c, g, or t
  misc_feature (544)..(544): n is a, c, g, or t
gcaatcttcctacaggtgtgagacaaaccaacattccccttgaaatccagaaacttcagcccaactngaaaangtcctngcncagtccnanantccnggccantgtncccnagccnantnttanncgtccnaaggtntctgacancttaagggntgncgagcncttgaccagttcaattgatgggacaatgcgccgtgcaggccccctgaccagcatgcaggtcattaaaccaaaccgaatgctcgctcctcgaggcggcacagccaccctgtctcccaagaaagnncnncntcgnttctacacaanccctnnatcntcntnagnatgnacncnnggttcatgcnnnnnnnnnnnnaannngnnnnanannanttnnnnnnanccaagatgaaggaatatgaagccantgtatccantaaagagntngacccaggaaaanccagcaaagctgcgtggatccgtaagatcaaaggcntccctattgataatttcatgaaggaagggaaaacagcagcccccgaacttggacaaaatgtgtttatntaaaccaggcttgagaaattacagcagc

SEQ ID NO: 8351 - DNA, 531 bp, Mus musculus
  misc_feature (153)..(155): n is a, c, g, or t
  misc_feature (159)..(159): n is a, c, g, or t
  misc_feature (161)..(161): n is a, c, g, or t
  misc_feature (165)..(165): n is a, c, g, or t
  misc_feature (171)..(171): n is a, c, g, or t
  misc_feature (174)..(174): n is a, c, g, or t
  misc_feature (181)..(181): n is a, c, g, or t
  misc_feature (200)..(200): n is a, c, g, or t
  misc_feature (202)..(202): n is a, c, g, or t
  misc_feature (207)..(207): n is a, c, g, or t
  misc_feature (214)..(214): n is a, c, g, or t
  misc_feature (219)..(219): n is a, c, g, or t
  misc_feature (221)..(221): n is a, c, g, or t
  misc_feature (224)..(234): n is a, c, g, or t
  misc_feature (236)..(238): n is a, c, g, or t
  misc_feature (240)..(244): n is a, c, g, or t
  misc_feature (251)..(252): n is a, c, g, or t
  misc_feature (258)..(261): n is a, c, g, or t
  misc_feature (264)..(264): n is a, c, g, or t
  misc_feature (266)..(268): n is a, c, g, or t
  misc_feature (270)..(270): n is a, c, g, or t
  misc_feature (274)..(274): n is a, c, g, or t
  misc_feature (276)..(278): n is a, c, g, or t
  misc_feature (280)..(282): n is a, c, g, or t
  misc_feature (284)..(284): n is a, c, g, or t
  misc_feature (293)..(293): n is a, c, g, or t
  misc_feature (295)..(295): n is a, c, g, or t
  misc_feature (304)..(305): n is a, c, g, or t
  misc_feature (319)..(319): n is a, c, g, or t
  misc_feature (321)..(322): n is a, c, g, or t
  misc_feature (324)..(324): n is a, c, g, or t
  misc_feature (331)..(331): n is a, c, g, or t
  misc_feature (341)..(341): n is a, c, g, or t
  misc_feature (351)..(351): n is a, c, g, or t
  misc_feature (353)..(354): n is a, c, g, or t
  misc_feature (358)..(358): n is a, c, g, or t
  misc_feature (360)..(360): n is a, c, g, or t
  misc_feature (367)..(367): n is a, c, g, or t
  misc_feature (369)..(369): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (418)..(418): n is a, c, g, or t
  misc_feature (421)..(421): n is a, c, g, or t
ccctgagggccctcccagagagggttttaacggtggggggggggccccgattttttaagggcttttttccgaaaagaaaagaaggccaaaggttttttggcgccttttttttagaaaaccccccgagtttttttaagattgtcaaaggccccnnnagtntnagcnagtgcnggngcctcangttttgttttatcccgtcncncccanaggaggngggtnanttnnnnnnnnnnnannngnnnnnccctttnnccccannnnctngnnngncccnannntnnntntaaacacantnacgaagaannatgcagccaccggngnntnatccctngcaggcaccntggctgtttntnncccntnttttgantntaatttcntntntgtggcctgcgaccggcgctgggaagaacatgagacnttntttgagactggggataccaggcgaaaaggaaagagaccttatggagcaaacaacatcaagaactggcacaggacttactgagcctgggcaagatcagcaataaagtggaa

SEQ ID NO: 8352 - DNA, 127 bp, Mus musculus
  misc_feature (28)..(28): n is a, c, g, or t
  misc_feature (58)..(58): n is a, c, g, or t
acagtgtaggcccatgaatgctgcagantaagaaccacagaacaaccttgttgggagntcgttgaaccatctgtgactgttaagcttaagttaccagcaaaagccaggttttataattgtaatgcaa

SEQ ID NO: 8353 - DNA, 520 bp, Mus musculus
  misc_feature (301)..(301): n is a, c, g, or t
  misc_feature (329)..(329): n is a, c, g, or t
  misc_feature (350)..(350): n is a, c, g, or t
  misc_feature (353)..(353): n is a, c, g, or t
  misc_feature (363)..(367): n is a, c, g, or t
  misc_feature (379)..(379): n is a, c, g, or t
  misc_feature (440)..(440): n is a, c, g, or t
  misc_feature (443)..(443): n is a, c, g, or t
  misc_feature (459)..(462): n is a, c, g, or t
  misc_feature (466)..(466): n is a, c, g, or t
atcaataacgttcattctgcagagaaacttgcccaactgtggaggaagtgacaggcttttagtgtttcttcaaaccttaaataacaatgatcttcttcctgaacattgacgttatcatttgaaggatgtagtagaggcattagttatcattcaatcctgattcaacctcaataattcattcctgacagaaactgtacttatgtgcagaaaaagaccaaggcttagctacttatgtctatataagcatgaaagcctaacatctgaatgcgtgctttcctggatcatagtgccttatgggccnatctgggggctttttctttttctttttnttctactttttcttttctttnctnttcttttctnnnnnttctctcttttnggggggatggggcatttttttgattgttaactggtgtagtagtgtccagacaggacaagcntcnccaccttggggaagtnnnnttcntgggttacgtaaggatggggtgggcaggagactaatacgtcaggaagcatggct

SEQ ID NO: 8354 - DNA, 532 bp, Mus musculus
  misc_feature (92)..(92): n is a, c, g, or t
  misc_feature (94)..(94): n is a, c, g, or t
  misc_feature (96)..(96): n is a, c, g, or t
  misc_feature (104)..(104): n is a, c, g, or t
  misc_feature (107)..(112): n is a, c, g, or t
  misc_feature (130)..(130): n is a, c, g, or t
  misc_feature (270)..(271): n is a, c, g, or t
  misc_feature (273)..(274): n is a, c, g, or t
  misc_feature (276)..(283): n is a, c, g, or t
  misc_feature (324)..(325): n is a, c, g, or t
  misc_feature (335)..(336): n is a, c, g, or t
  misc_feature (344)..(345): n is a, c, g, or t
  misc_feature (347)..(347): n is a, c, g, or t
  misc_feature (349)..(350): n is a, c, g, or t
  misc_feature (352)..(354): n is a, c, g, or t
  misc_feature (358)..(358): n is a, c, g, or t
  misc_feature (382)..(383): n is a, c, g, or t
  misc_feature (389)..(390): n is a, c, g, or t
  misc_feature (396)..(396): n is a, c, g, or t
  misc_feature (398)..(399): n is a, c, g, or t
  misc_feature (424)..(424): n is a, c, g, or t
  misc_feature (426)..(426): n is a, c, g, or t
  misc_feature (428)..(428): n is a, c, g, or t
tcagctgtgtcttctaaagtggatcagtgagagaggctcctggacctgcgagctgtgctgttatagataccacgtcacagccattaaaatgnancnaccttgcnagnnnnnnttgtgcatgaaggagctnccgtttacagagtgtttaagcgatggcgagctgttaatttgcactgggatgtgttaaattatgacaaagccacagacattgaagaaagcagccgaggagagtcttccacaagtaggactttgtggctaccattgtcagcnntnngnnnnnnnnacttggtccacccaacgcaactaacctcaccacggtttcanntgtggctatnngctattanntntnntnnnatcngatgagggcccatgaagatgtatnngaagannaacggntnntggggaggtagtgatgagagtgacntntngtgtgacagatgtacacagcagcagagtgtggaaccctgcacatttcggaatgtaattgcaatgaatggcaaaaccatagcacttctaactgtacatccacgaa

SEQ ID NO: 8355 - DNA, 295 bp, Mus musculus
  misc_feature (64)..(64): n is a, c, g, or t
  misc_feature (129)..(129): n is a, c, g, or t
gaaatcacagagaccatcaacagcaaatattcctatttccaatcccgatcaaaaagacaccagntgccttttgttctcttacacccgatcaaaaagtgcagctgctcagatgccatccagagctgcttntgaaatttcagaaattgaatacattgatgttactgaccagagtgagctttttggaggtaacactgctgatcgacaagccttagacactttggagaaagaattaaatatactgagaaaacctgcagatccttcagaagaccctcacagcctaccctcagaagagtta

SEQ ID NO: 8356 - DNA, 495 bp, Mus musculus
  misc_feature (268)..(268): n is a, c, g, or t
  misc_feature (270)..(271): n is a, c, g, or t
  misc_feature (274)..(275): n is a, c, g, or t
  misc_feature (277)..(278): n is a, c, g, or t
  misc_feature (280)..(280): n is a, c, g, or t
  misc_feature (284)..(285): n is a, c, g, or t
  misc_feature (287)..(288): n is a, c, g, or t
  misc_feature (290)..(290): n is a, c, g, or t
  misc_feature (294)..(295): n is a, c, g, or t
  misc_feature (304)..(304): n is a, c, g, or t
  misc_feature (316)..(316): n is a, c, g, or t
  misc_feature (321)..(321): n is a, c, g, or t
  misc_feature (328)..(328): n is a, c, g, or t
  misc_feature (334)..(334): n is a, c, g, or t
  misc_feature (336)..(336): n is a, c, g, or t
  misc_feature (340)..(340): n is a, c, g, or t
  misc_feature (353)..(353): n is a, c, g, or t
  misc_feature (358)..(358): n is a, c, g, or t
  misc_feature (370)..(370): n is a, c, g, or t
  misc_feature (374)..(374): n is a, c, g, or t
  misc_feature (377)..(377): n is a, c, g, or t
  misc_feature (382)..(382): n is a, c, g, or t
  misc_feature (384)..(384): n is a, c, g, or t
  misc_feature (394)..(394): n is a, c, g, or t
  misc_feature (402)..(402): n is a, c, g, or t
  misc_feature (404)..(404): n is a, c, g, or t
  misc_feature (407)..(407): n is a, c, g, or t
  misc_feature (409)..(409): n is a, c, g, or t
  misc_feature (412)..(412): n is a, c, g, or t
  misc_feature (441)..(442): n is a, c, g, or t
  misc_feature (455)..(455): n is a, c, g, or t
gtggctcaggttgactacataaatactggcttttcctggagacagccagagaaagtcaccccagagaccatcatgaggtgcatgagaaccggccagccccagaggaccaagaccgacggtctggaggagacatctcagcagccatcgactctcgcaagctatcttccagatcatacagagcataaggatgggcatgtgagagggccaggaagttgtatgcggatgccctcctgctggcaggtgaaggaccactgaggccttcagcggntnntanngnnancaannanncnatgnntgatagaanggaggccccctntttcntcccacnccatgntngagntcagaccaaattnccttntcacaagacatntccntgnatctntntcctccagcngaaaggantntgntnttntgttggctgattggaagtcacgtgggggnnccgggcggcggcnctggctggctggctggttccccgggtttcactgtggtgtg

SEQ ID NO: 8357 - DNA, 451 bp, Mus musculus
  misc_feature (175)..(175): n is a, c, g, or t
  misc_feature (244)..(244): n is a, c, g, or t
  misc_feature (259)..(259): n is a, c, g, or t
  misc_feature (263)..(263): n is a, c, g, or t
  misc_feature (270)..(270): n is a, c, g, or t
  misc_feature (273)..(273): n is a, c, g, or t
  misc_feature (277)..(277): n is a, c, g, or t
  misc_feature (279)..(279): n is a, c, g, or t
  misc_feature (282)..(282): n is a, c, g, or t
  misc_feature (290)..(290): n is a, c, g, or t
  misc_feature (296)..(296): n is a, c, g, or t
  misc_feature (323)..(323): n is a, c, g, or t
  misc_feature (331)..(331): n is a, c, g, or t
  misc_feature (338)..(338): n is a, c, g, or t
  misc_feature (353)..(353): n is a, c, g, or t
  misc_feature (377)..(377): n is a, c, g, or t
  misc_feature (383)..(383): n is a, c, g, or t
  misc_feature (419)..(419): n is a, c, g, or t
atattgtattatgccttgaagttttaagcatttaatataaaacattataacattagtttgtactttttgctaatagtttgagcacaaattgaagcccagaaatactgaaagcttattattttatatcctttaggtaatatatgtatatgctatatatataattatatacatatantgtaatctcaattaggcaattttaatagacttcacaaaaatattttaataatcagactgagtgctcttnttttataaatttcanctgntgtttcnatnttancnatnaatattanaatatnttttatattttattcattaatataacnacaatccnatcaggnaaagtttctagaaanccaacgagggtcagtagtttagtntcattnctggaattaacttatcatgcatttgcttagttaaantcaaaatttaatattggttctttaactgaaat

SEQ ID NO: 8358 - DNA, 279 bp, Mus musculus
  misc_feature (69)..(69): n is a, c, g, or t
cacggctgtccctaactggaggaaactctatatgatgcttcctttcccattggggagagtttatgcagnccgcaccagcacttctcttcagcattcagtttctggggggctctatttggacaaaggggagcaggaagttgctactaggagcgaaccagagttatctcagcagcactgacaagagcgcctcctcattccgtcagcctctccgtgtgttctcaccaccgcctcagaatacagcaacctgcacccgtagccgggcgatcagtcaggtcgatt

SEQ ID NO: 8359 - DNA, 282 bp, Mus musculus
agctgaaccaagtctcctgataaatcctgaagacattgtccccaaagaaccaggaagttcagaagagactctccggacaatccagagaccaggtgacaaagtttctcaccagtataagacaacgtcttctgagatcaacgctgtggttggagctgtcccctccatgtgtcaccccatattcggtgttccaaccattcgatctgacatctctgctccccggattcgtcgagtcagtgacatgaataactacggtgacgaaggcaatgcttactctctgctgca

SEQ ID NO: 8360 - DNA, 559 bp, Mus musculus
  misc_feature (436)..(438): n is a, c, g, or t
atctcatatccttcaaactcttgcaaggaaggaagagcaggtagagaaaactgtaaaacaccaggctgtctgaatccgaggaagaggaagagagttacttttggagaggacttaagccctgaagtgtttgatgagtctttaccagccaatactccattgtgcaaaggaggaacacctgttcgcccaaggaccgtaaaaactaccagtcccctgcagtcccccgttcatgagcagtttcttcagccaaactttgatgacaaggaggagaaccttgaaaacatagagccacctcagggatcatttgcaaatctgagtcttagtaaatcctcactctctgagactcctccaggcactaacacttgcagttctttaaataaagatgaagaaataatctgcagtattgttagacctacacggacctctcaaagaagaaagnnnacgctgagttctacaggtgtttgcagctcatatactacacaagctgagccccgtaaagagaagatgagcaggaggaaatctcgagaaaaaaagcacacaagcgcggcacttcctaaaaaga

SEQ ID NO: 8361 - DNA, 410 bp, Mus musculus
aaaaccaaggtgagacgcagcacaaggctccagagagacttggaaaatacagggcttgtgtggctgtctccaagtccttccactttgcagaagcccagaaggagaatgacgatctgcaccttagacagcaggggatttgaatgtccatcctccaaagaagagaccatatcctcaggacaaaacccagggccgctgcccgctgtctcgggcagtgagagccagggtgttggttcttctgcgctacctaggaagaggagaagcctttgtgggtctaccctcacagatgctaacagtgccacccagccaccagactgcaagagaaaaccctcgctcaagggagaaagcgctcagctgccctgagggggctgggcccaggagaacaaaggcaggaacagacaatcccacctggc

SEQ ID NO: 8362 - DNA, 368 bp, Mus musculus
  misc_feature (294)..(294): n is a, c, g, or t
  misc_feature (304)..(304): n is a, c, g, or t
gaaagtgaaattgatgcccagaccatatgttatgaagagccattccttttcagaagactggagtccctgataaggaggaaccaagacgggatagtaataaagcagaatgaagatggctttctgataaagaaggcagaggaaggcaaaaagaaaaagaaaacatccaggagggcatcagcacacccagaaacagattctgattccagcgctccacagaccggagaggctcctttcgaaagtaaaccacccgaagaacaaccagagggagaagagaagaaacgcaagaaagaaaanaagaaaaagnagaaaaaagacaaagacggctgagaaaggaggaggaggacagggcaaaacatggcctccaatgt

SEQ ID NO: 8363 - DNA, 480 bp, Mus musculus
  misc_feature (218)..(218): n is a, c, g, or t
  misc_feature (241)..(241): n is a, c, g, or t
  misc_feature (262)..(262): n is a, c, g, or t
  misc_feature (271)..(271): n is a, c, g, or t
  misc_feature (291)..(291): n is a, c, g, or t
  misc_feature (294)..(294): n is a, c, g, or t
  misc_feature (316)..(316): n is a, c, g, or t
  misc_feature (324)..(324): n is a, c, g, or t
  misc_feature (335)..(335): n is a, c, g, or t
  misc_feature (422)..(422): n is a, c, g, or t
ggaacaacacagtcctacatggcccctcccccaaccgtgccttcctgtctcgtctgctttctcttcctctcaagttagcatctactgccataaggtagtgtgttcaaagactggctactctaggcgtgtgcagctcatgtgcgtgaatgcatgcaatgcagagcaccttaatctggctgctcgttattgggagcccttaatgtgtatgtagtagcatnatcacattaagtaacattaaatnttctaattcattactcttctnacgtatatnaacttaaaaacacatttttntcnaaatttaaacattgctgtcacnggggaagntctgagagtantgctatgcttggactttaccaggtgagataagaccattttcttaattaatgtgtggaacagggatgctaggaaaaactccatgaacntcctagcatttgctaaaggctgtattgatggctcaacgtgacgatgtatgcactcaat

SEQ ID NO: 8364 - DNA, 477 bp, Mus musculus
  misc_feature (41)..(41): n is a, c, g, or t
  misc_feature (46)..(46): n is a, c, g, or t
  misc_feature (67)..(67): n is a, c, g, or t
  misc_feature (84)..(84): n is a, c, g, or t
  misc_feature (116)..(116): n is a, c, g, or t
  misc_feature (120)..(121): n is a, c, g, or t
  misc_feature (248)..(248): n is a, c, g, or t
  misc_feature (262)..(262): n is a, c, g, or t
  misc_feature (266)..(266): n is a, c, g, or t
  misc_feature (276)..(276): n is a, c, g, or t
  misc_feature (302)..(302): n is a, c, g, or t
  misc_feature (304)..(304): n is a, c, g, or t
  misc_feature (316)..(316): n is a, c, g, or t
  misc_feature (318)..(318): n is a, c, g, or t
  misc_feature (343)..(343): n is a, c, g, or t
  misc_feature (394)..(394): n is a, c, g, or t
ggagatattcccaagtccccagaagataccatccagtcccnggaangaaatcaccgcgtccgaagangacaccatccagtcccnggaaggtaacactatcaagtcttcagaagaanatgnncagctctcagagagcaaactcttaggccttggagcagaaatagagaccctggaggaaggcttggtgagagtgatcaaagacaaggaggaatttgaggaggtgctcaaagacgctggagagaagctgntggctgtggatttntcanccgcttggtntggcccctgcagaatgatgaagccantnttccattccctntntttgaagcacgaggatgtgatattnttggaggtggacactgaggattgtgagcagctggtgcaagactgtgagatntttcacctcccgactttccagttttataaaaacgaagaaaaggtgggtgaattttctggtgcccttgtgggaaaactcgaaag

SEQ ID NO: 8365 - DNA, 585 bp, Mus musculus
  misc_feature (164)..(164): n is a, c, g, or t
  misc_feature (212)..(212): n is a, c, g, or t
  misc_feature (297)..(297): n is a, c, g, or t
  misc_feature (305)..(305): n is a, c, g, or t
  misc_feature (315)..(315): n is a, c, g, or t
  misc_feature (318)..(318): n is a, c, g, or t
  misc_feature (323)..(323): n is a, c, g, or t
  misc_feature (330)..(330): n is a, c, g, or t
  misc_feature (346)..(347): n is a, c, g, or t
  misc_feature (352)..(352): n is a, c, g, or t
  misc_feature (376)..(376): n is a, c, g, or t
  misc_feature (405)..(405): n is a, c, g, or t
  misc_feature (416)..(416): n is a, c, g, or t
  misc_feature (452)..(452): n is a, c, g, or t
  misc_feature (483)..(483): n is a, c, g, or t
ggctctgagaaatccgatgatggtggtagcctcattcagttttagtttatgatgaagacggtattgctttataaattttatctcccaataaaagctatctatcaaaaacgctttgaaaattggtaattaccttgaagatagagtatgtccatcaaagagtaaanttgtctctttcttttcatgataaactttaaacatgctagatgtttgantatgcatctgctccaagttaagcatcttggattttttatacttgtattttccttatgtttttggtcaaccataaaagatgattcnatttcatngattagttanatntaatnacttgcnataggtatgcaattanntcccnacttttatagttggaaaacatttngatgctgaacacaaaatagctaagaaagnatgctgaattntgttgattttaacattttcaagtagtttcttttctntgtggagcaaagaggggaacagatataacantcatttaaaagtaacatgttttggacaatgtcactagagggatattttaaagtaattattagaattcaacaaaaatggtacgagctatgttaaccaataaag

SEQ ID NO: 8366 - DNA, 528 bp, Mus musculus
  misc_feature (287)..(287): n is a, c, g, or t
  misc_feature (296)..(296): n is a, c, g, or t
  misc_feature (347)..(347): n is a, c, g, or t
  misc_feature (474)..(474): n is a, c, g, or t
tcacagctgcccattgttggttagttggattgcagcctgagtcattccaataaattcccataatatatagagacattccataagttctgtgactctagagaaccctgacaagataccacccaagtctttatatcactgcttgtctggacactgttgtgacagtctgggtggtaaaacaagctgggaacagttttcctgtaggcgaagctcccatgtcttctgtgctctgtcccagttgttactctgaggtgggggtaacgggcattcctcctcagggctggctgttnttctctctntggggctccagttaagctctgtctgacagatggtcgctactgagaggactncattgatcctaattttcttctttcatggtcatctttttgctttgttttccaagagtgagaattttgtaagcttttcttacgtttcaaactgtttttcttagttcctgtgttcagttcttatattttnttctctttaagttttgcatttgtttatatgtaagtagcctaacagcatctaatt

SEQ ID NO: 8367 - DNA, 400 bp, Mus musculus
  misc_feature (218)..(218): n is a, c, g, or t
  misc_feature (227)..(228): n is a, c, g, or t
  misc_feature (275)..(275): n is a, c, g, or t
  misc_feature (292)..(292): n is a, c, g, or t
  misc_feature (295)..(295): n is a, c, g, or t
  misc_feature (311)..(311): n is a, c, g, or t
  misc_feature (313)..(313): n is a, c, g, or t
  misc_feature (333)..(333): n is a, c, g, or t
  misc_feature (351)..(351): n is a, c, g, or t
  misc_feature (353)..(353): n is a, c, g, or t
  misc_feature (355)..(355): n is a, c, g, or t
gaggagacagttctggcagctttcctgtcctacgttccaggcatggatgtgtccctgcggatgtacccactcaagataaactggtggttctgcgcacttccctacagtgttctcatcttcgtctatgatgaaatcagaaaacttatcatccggagacggcctggtggatggctggagaaggagacgtactactaactgcctcagagaaagatcttcanacgacattnntctcacgagagccaggactgagtataacaatgacacctgagataganctgagcaggggcccctnttntatgggttgaattgantntggatgagagagacacattnctggggctggaggaagantntntggtaggagatggaataggttgggagaaagaaagcccagcctgtt

SEQ ID NO: 8368 - DNA, 333 bp, Mus musculus
  misc_feature (175)..(175): n is a, c, g, or t
  misc_feature (204)..(205): n is a, c, g, or t
  misc_feature (270)..(270): n is a, c, g, or t
  misc_feature (298)..(298): n is a, c, g, or t
aagaaaacaaatgtctggttcagtatttgagggcaaagatatagaaaatcatggattggcatgaagtcttgagaactcttctactttctctgtgaaaatgtattaatgcattgtttaaagatatcagctataacttttgcctgtattagaaattgtgatatatatatgtatatantgtgtatatacatatagatacacacacanntatatgtatatatatatgatacatgaatgcatatatgtatacacacactcacacactcattcatnaactttgaagctgagccagagtgaattntgcttcatttatgtgtattacatttcttttgaaac

SEQ ID NO: 8369 - DNA, 482 bp, Mus musculus
  misc_feature (291)..(291): n is a, c, g, or t
  misc_feature (329)..(329): n is a, c, g, or t
  misc_feature (358)..(358): n is a, c, g, or t
taccttttatgagatttccctttatttctctctcccatgcaaattacttcatattttataccaagtatctttcttttactattggtagagtttgatcacacttaaaaaaaacgttttcaggttataaagtacccatggttttaatttaaaaaatgtttaggttgtgtgcgtgcacacattcatgctacagagcatgtggagagtcggctctgctttcctcatgaggacctgctagagggtggaactcaagtcacctgctttgctttttgcccactgagcggtttttgtganccctacatttaaatttcagactaatacagagtttgttngtatgatgtgaagtatacctgtaatattntactatttctcaagtgatttattgacttaagagctcgtatctatctactgatttgaagtttttagcgttgtgttgtattcccatgtgtgtcaattgttgattttcctgactcctattcacttat

SEQ ID NO: 8370 - DNA, 202 bp, Mus musculus
acgacaaaaaggtcagcatcgctgtggtctggcaagcacgatctgcccatggaaagagcatctaagaaccaagaaaagaagtggcttttaagtttgtacattgtcttaattatcctcgcttcagtgttcctcataggcacagggtggaaaggcttgaaacagtgcggttccaaggaagaggagtccatgagtagcgaaagca

SEQ ID NO: 8371 - DNA, 294 bp, Mus musculus
  misc_feature (245)..(245): n is a, c, g, or t
agctgagacggaactgcaccatctaccggccctggttttccccttacagctacttcgtatgcacagacaaagagagccacctggaggcctatgggttcccagaggtggaccgagaagagggcagaggggataactgccttcttgaggatgtggctgaaagtgtctgctcatcttcttcctcccaagagaacacatatcccagggaggccaacaggaaatccaagcatggtttggattctatcacntcccaggacatcttaatggcttccaagtggcacccagcccagcagaatg

SEQ ID NO: 8372 - DNA, 337 bp, Mus musculus
  misc_feature (200)..(200): n is a, c, g, or t
  misc_feature (217)..(217): n is a, c, g, or t
ggccatctctacttcctgagtggaaaccatgctgaggccaaagaatgctatgagagaactattagttttgtagttgatgcttctgagatgcacttcatcttcctacgcctgggacacatctacttggaagagaaagagtatgaaaacgcaaagagaacgtacatgcatgcctgtaagagatcaccttcgtgcctcacttngctaggactagggattncctgttaccggctggaggagctcacggaagctgaggatgctctgtctgaagccaacgcgttgaataactgcaacgccgaagtgtgggcctatctggctctggtctgcctgaaagttggac

SEQ ID NO: 8373 - DNA, 525 bp, Mus musculus
  misc_feature (78)..(78): n is a, c, g, or t
  misc_feature (87)..(87): n is a, c, g, or t
  misc_feature (105)..(105): n is a, c, g, or t
  misc_feature (121)..(121): n is a, c, g, or t
  misc_feature (142)..(142): n is a, c, g, or t
  misc_feature (495)..(495): n is a, c, g, or t
tcatgctctggagatactattgatgttgctggttatgttaaataccttcaacatccactggtgcaagcccgtattatnagaatgagnatctccaaggtaggactnctgtacataccgaagntcctagactcaaccatagggntacagtcctgctactgtaggctatatagtttcatacgttgaacatcctttctaaccctgttaaaactgagtcctatgtgcctaaagtattaatccagtatttcgtgcagataatattctttcattagctgtaaacatttattcacaattaaaagcagcataatttgtaggaaatattattacaggacacataaaagcctgtgacaaaagacagtccccatatatatgattgtcttactataacaatccttggtatgaacaaataagagtaaggaaactgttattgactttgtacttatattgaaagcagtaacatccaggaaacttaggaaaatatgttcaactaaaagtacnaacgttgccgcaaacactgagataatttag

SEQ ID NO: 8374 - DNA, 206 bp, Mus musculus
ttacaatggtgcaacacccaaagaaaagttgccatttcccatcattgatgataaggacagggacatttccatccttttctgcatgttggatccagtagagaaggatgctaacagcatgcctctgacggcccggggggtgttcatttttggccctgacaagaaactaaagatgtctctcctctaccctaactccacgggcaggaact

SEQ ID NO: 8375 - DNA, 238 bp, Mus musculus
aatgcagttggtatcgaagccccaacagtttgatgtcatggtgatgcccaatctttatggcaacattatcaacagtatctgcacaggactggttggagggtcaggaattgtccctggagccaattatggtgattcatatgcaatatttgagatgggttcaaaggaaataggtaaagatttggctcacagaaatattgccaatcctgtcgccatgctgctgaccagctgtatcatgctg

SEQ ID NO: 8376 - DNA, 189 bp, Mus musculus
gaagccagtcgacctggttgtcagacgtcctatatgaccgtgaccctttggtcacggagttcattaaccagggcatcgaggatgtgaattcggaggcgcccacaatgggtgccaagatcattaagtgggtcattctagacaacgatttctctgtggatggtggggagcttggacccatgagcaagatga

SEQ ID NO: 8377 - DNA, 387 bp, Mus musculus
  misc_feature (188)..(188): n is a, c, g, or t
  misc_feature (192)..(193): n is a, c, g, or t
  misc_feature (195)..(195): n is a, c, g, or t
  misc_feature (197)..(198): n is a, c, g, or t
  misc_feature (200)..(200): n is a, c, g, or t
  misc_feature (202)..(204): n is a, c, g, or t
  misc_feature (207)..(207): n is a, c, g, or t
  misc_feature (209)..(210): n is a, c, g, or t
  misc_feature (212)..(212): n is a, c, g, or t
  misc_feature (215)..(216): n is a, c, g, or t
  misc_feature (218)..(220): n is a, c, g, or t
  misc_feature (223)..(223): n is a, c, g, or t
  misc_feature (225)..(225): n is a, c, g, or t
  misc_feature (228)..(233): n is a, c, g, or t
  misc_feature (236)..(237): n is a, c, g, or t
  misc_feature (242)..(245): n is a, c, g, or t
  misc_feature (252)..(254): n is a, c, g, or t
  misc_feature (256)..(257): n is a, c, g, or t
  misc_feature (259)..(261): n is a, c, g, or t
  misc_feature (322)..(322): n is a, c, g, or t
gctgaattttcccaaatgcgacaggaaagaattccatttccctgaactgccattcacagtgcaggcgaaggagatgaaagggatggaagttaaacagataaaagtgctgaagagagaatcaaagaaaacagattcatctaaaataccaactttacttagtatggacccaaatcaagaaaaacaagagncagnnancnngngnnnctntnnanganngnnntgntnaannnnnnagnnagccnnnnggaagannngnncnnngcaggtttccactgtttgcaacatctttcctgtttggtacaagagaagcaacctcaactgnccatcctgacctcccactgggtcaacccccacactctgcagagatcttgcttctctaaagtgaga

SEQ ID NO: 8378 - DNA, 501 bp, Mus musculus
  misc_feature (92)..(92): n is a, c, g, or t
  misc_feature (108)..(108): n is a, c, g, or t
  misc_feature (140)..(140): n is a, c, g, or t
  misc_feature (174)..(174): n is a, c, g, or t
  misc_feature (324)..(324): n is a, c, g, or t
  misc_feature (378)..(378): n is a, c, g, or t
  misc_feature (380)..(380): n is a, c, g, or t
  misc_feature (389)..(389): n is a, c, g, or t
  misc_feature (437)..(437): n is a, c, g, or t
  misc_feature (444)..(444): n is a, c, g, or t
  misc_feature (446)..(446): n is a, c, g, or t
  misc_feature (460)..(460): n is a, c, g, or t
  misc_feature (468)..(468): n is a, c, g, or t
tgctgcatgggctgaaggttgacttaggctgcatatctgaggaagacccagcaaagcaaaaacatttcagaatgttgaatcaacttcatttncaaaaggctctgattncaagagaaaatgagtttgtaagtgatgaaganacagtgagtcaccacgagcgccagcagtaccagnaggccctggacatgctgtcggctgtgccgaaggacgaaaacaagatgttctctttaccgggcgaatttttaatacccgcccataaagtcaagcattcagagggtgttataattcaacaggtcaatgacgaaacagataatgaagcctcanccctggaatgaaaacaatccaagtgtttctgatagtgtaatagaccaggaaacntnctgtggatntcattgaaggtgacagtgactttgaaagggctgagacttccagggaantctgttntntgagcacatcactntccccatntggtccattccccagcatcaatggtggcagtaa

SEQ ID NO: 8379 - DNA, 407 bp, Mus musculus
  misc_feature (78)..(78): n is a, c, g, or t
  misc_feature (144)..(144): n is a, c, g, or t
  misc_feature (147)..(147): n is a, c, g, or t
  misc_feature (195)..(195): n is a, c, g, or t
  misc_feature (330)..(330): n is a, c, g, or t
  misc_feature (373)..(373): n is a, c, g, or t
aggccactgggacaactacaagcgtcatcagaaggtgcatggccatggtggagcaggagggcctggtctctctgcccntgagggctgggccccacctcatagcccaccctctgttttgagcactcggggtccagcagccctggngtnctactggtagcagggctcttcattcagactcaccttgaactaactagnttcttttacctggggctctaggaattagccctatgcctcctgcattttatacaaatgaactagaaaccacctttccctttctcccccgctggtcaggggctccacacagactaacctaggcactatatggaccancctgaatcccatggtcagggggccatatagaccaggggacttntcttagctcacgtaccagatgagctaagtgatta

SEQ ID NO: 8380 - DNA, 274 bp, Mus musculus
  misc_feature (40)..(41): n is a, c, g, or t
  misc_feature (43)..(43): n is a, c, g, or t
  misc_feature (45)..(45): n is a, c, g, or t
  misc_feature (54)..(54): n is a, c, g, or t
  misc_feature (88)..(88): n is a, c, g, or t
  misc_feature (94)..(94): n is a, c, g, or t
  misc_feature (96)..(96): n is a, c, g, or t
  misc_feature (124)..(124): n is a, c, g, or t
  misc_feature (160)..(160): n is a, c, g, or t
  misc_feature (179)..(179): n is a, c, g, or t
  misc_feature (208)..(208): n is a, c, g, or t
  misc_feature (210)..(210): n is a, c, g, or t
tctcctgcttcttgccatacttgtggcaacggaactggtnntntntggcaaaantcctatccttcaatgcatgggtaacagaggattntgtagntnttcctgcaaaaagagtgaacaggcctanttctactgcagaactttccagatgtgctgcctccantcctacgtgaggatcagcntcacaggagtagatgacaacactaactgntnttacgagaagcactggccaagaataccgtgacagcctgcacaccgtgtacagacttccagggaa

SEQ ID NO: 8381 - DNA, 304 bp, Mus musculus
aagagttcatgaggctgcctgagctgcagcagaatccgctggtgggccgagtgatcgacatcttcgacacagacggcaacggggaagtggacttccacgagttcatcgtgggcacctcccagttcagcgtcaagggtgatgaagagcagaagctaaggttcgccttcagaatctacgacatggataatgatggcttcatctccaatggggagctcttccaggtgcttaagatgatggtgggaaacaacctcaaggactggcagctgcagcagctggtggacaagagcatcttggtcctggataa

SEQ ID NO: 8382 - DNA, 282 bp, Mus musculus
atcataaaagatgcagccgctaagggcattcaggagatcgctgactctgtaaaggttctgtcgaagaaagcacgggatgggaaattgatgccagaggagtaccaaggaggatcttttagtatttccaacttggggatgtttggcatcgatgagttcgctgcagtgattaacccgcctcaggcctgtatcttggccgttgggagattccgccccgtgctgaagctgacggaggatgaagaggggaaccctcaactgcagcagcaccagcttataacggtcaca

SEQ ID NO: 8383 - DNA, 481 bp, Mus musculus
  misc_feature (45)..(45): n is a, c, g, or t
  misc_feature (57)..(57): n is a, c, g, or t
  misc_feature (144)..(144): n is a, c, g, or t
  misc_feature (276)..(278): n is a, c, g, or t
  misc_feature (283)..(283): n is a, c, g, or t
  misc_feature (307)..(307): n is a, c, g, or t
  misc_feature (316)..(316): n is a, c, g, or t
  misc_feature (336)..(337): n is a, c, g, or t
  misc_feature (420)..(420): n is a, c, g, or t
tagaaagcagacaattaagcccggggcagttagcctggggctctngacttcctgctntagaatattgcaatgcttggaaaattagagcccacaaatataagacagaaaattgtatcagctcaaaaaccgggcccagactgcttnctgaaggttgaaagatgctgggtaaagatgccatctttgtgacttgctggagatactgtttttctgttcccctttttattctcaggatgatatagtttgtaccattgtggcaagagagagctctaggctgcnnngagcnaggcaggggtgggatacaagatanccagctcancaatcccccccctttttttnnagatagttgacttgatatttatggtattagggatcaaaccatgtactgaatcttcttgtgtggttttgttttttttttttttnaaataacaaaaccctttgcatttttaagccagcgacttgtccaccgtcttgcagcacagaa

SEQ ID NO: 8384 - DNA, 544 bp, Mus musculus
  misc_feature (204)..(204): n is a, c, g, or t
  misc_feature (302)..(302): n is a, c, g, or t
  misc_feature (308)..(308): n is a, c, g, or t
  misc_feature (383)..(383): n is a, c, g, or t
  misc_feature (400)..(400): n is a, c, g, or t
  misc_feature (406)..(406): n is a, c, g, or t
tccggcctggtgaagagttggttttgtcagcagtttggtctctccatgtttgacagcttccctttgctcacccaagcatctgctagaactatgtgagagtctggacattttctggccttcttgtaaaagaagataaagggatgtgtttctgagtgtcatcctgatctttccaaagtgttgcagtgtggtccagagagcagagcnagcctttttgctgtggatcccatcaccatccattgctgaagaagaagcagggctcaggacaagcatgtcaaacacacctgacactacaaatctacacntttgcnactggctctcatcacatgctgtcttctcacccttctccactgaaaaataaaaggaaaatgtatgatggccaagtnaaaaatgacaggaaatnttctantcaagcttaatagtatttgctatgtttagcttacagaactgaaaaatacctattagtgtaaagacattaagaaatgcacagaaagatgaaaataaaacgaaaccccatcccaagagatcccctgcttttagcatttta

SEQ ID NO: 8385 - DNA, 481 bp, Mus musculus
  misc_feature (260)..(260): n is a, c, g, or t
  misc_feature (288)..(288): n is a, c, g, or t
  misc_feature (360)..(360): n is a, c, g, or t
  misc_feature (370)..(370): n is a, c, g, or t
  misc_feature (376)..(376): n is a, c, g, or t
  misc_feature (378)..(378): n is a, c, g, or t
  misc_feature (381)..(381): n is a, c, g, or t
  misc_feature (397)..(397): n is a, c, g, or t
  misc_feature (429)..(429): n is a, c, g, or t
  misc_feature (448)..(448): n is a, c, g, or t
ggaagctccaggtagtacaccaggagcagcaggcggccccccggccagccttggcagccaggttccctgtgtcagcccagggatcagggacagaaaagcccttggaagcctgggtcagcaagacagccagcatggagaagcaggctcctcttctgcagtctacctgtgccccactgagggagactgataatgggctcatggccctaggaggccaagaacttcctgctgcctcctccagcctcctcctgcccctgcagaanctgggagtcctccaccgtggccagcagncccctcaccaggctgcagctccaggaggcactgctgaacctcatccagaatgatgacaacttcttaagcatnatctatgaancctatntnttnagcgtgacacaagcanccatgagaaccacgtaaccagctacatgagancaaagactaagaattgatnttccaggttcttcatgtgaactggtgtgaccaa

SEQ ID NO: 8386 - DNA, 457 bp, Mus musculus
  misc_feature (77)..(77): n is a, c, g, or t
  misc_feature (120)..(120): n is a, c, g, or t
  misc_feature (171)..(171): n is a, c, g, or t
  misc_feature (187)..(187): n is a, c, g, or t
  misc_feature (205)..(206): n is a, c, g, or t
  misc_feature (209)..(209): n is a, c, g, or t
  misc_feature (234)..(234): n is a, c, g, or t
  misc_feature (237)..(237): n is a, c, g, or t
  misc_feature (262)..(262): n is a, c, g, or t
  misc_feature (275)..(275): n is a, c, g, or t
  misc_feature (288)..(288): n is a, c, g, or t
  misc_feature (295)..(295): n is a, c, g, or t
  misc_feature (315)..(315): n is a, c, g, or t
  misc_feature (326)..(326): n is a, c, g, or t
  misc_feature (337)..(337): n is a, c, g, or t
  misc_feature (360)..(360): n is a, c, g, or t
  misc_feature (365)..(365): n is a, c, g, or t
  misc_feature (384)..(384): n is a, c, g, or t
  misc_feature (398)..(398): n is a, c, g, or t
  misc_feature (400)..(400): n is a, c, g, or t
ttacttcctggagctataataacgtgcttgggtgtgtgacttgccgaggttggctttcccaatgctttatgtaaacnctgctgttggcacttgcagctgtaggaagctgtcggagggatnacttacttacggttatagcatctgggggtcctcttgcagctgcaatgcctnggatcttttgcaactntgactttttcagtagcannctnggaatgttaaaatatggtgaccctnttntctgtgaaggaagggcctgacaatntgccagcagggantcctgttaaagantgggaantcagtgcagtggttttcctncctttcccttntcctttggtcnatagtgatactgacagcaatacnaagtnaaatctgtgtatataaaantcctaagtatgagntnttaaatgttctggaattttagaaaaaacttaattggatgcaattgtttataattaac

SEQ ID NO: 8387 - DNA, 75 bp, Mus musculus
tatagggataattttgagaaggcatacttggactcaacagagaggttttatagaacacaggcaccctcatattta

SEQ ID NO: 8388 - DNA, 293 bp, Mus musculus
  misc_feature (83)..(83): n is a, c, g, or t
  misc_feature (247)..(247): n is a, c, g, or t
  misc_feature (252)..(252): n is a, c, g, or t
  misc_feature (254)..(254): n is a, c, g, or t
aggtcctatctctgcaacaacctaaccaacctggagccttttgtgagactcaaggccagtcaacccatgtccacactaccttntgccaaaagctgtccaagctgcgtgggcaagcacgaccaggaatgtcttccaagctttgtcaccacagagaattgcccctttgctgcttcctcatgttacagttccaccttaaaatttcaagcagggaatctcaataccaccttcctcatcatgggctgtgctngtgantncacacaagcttttagcagattttcagcacattgggagca

SEQ ID NO: 8389 - DNA, 401 bp, Mus musculus
  misc_feature (101)..(101): n is a, c, g, or t
  misc_feature (124)..(124): n is a, c, g, or t
  misc_feature (153)..(153): n is a, c, g, or t
  misc_feature (161)..(161): n is a, c, g, or t
  misc_feature (165)..(165): n is a, c, g, or t
  misc_feature (168)..(168): n is a, c, g, or t
  misc_feature (175)..(175): n is a, c, g, or t
  misc_feature (177)..(177): n is a, c, g, or t
  misc_feature (204)..(204): n is a, c, g, or t
  misc_feature (287)..(287): n is a, c, g, or t
gagtaaattgggtagtttccagatgaaatgtgcagagtgttagcaaggaaattaggtgaatgtactggagaatgaggtagactatttgataactaaaactntattttaacaaaaacctagctgngtagatatagcattgatcacacacagttntaattcantttnatnttgaccnanatatgcttttgtaatttcaattttctnatctgaatatttataaattattttgaatttaattatctgacctcatttaatatacattgaacaccgatcctgtttgtagcgantcttgtttttataaggtttcaataatatctaaaacaacacattaaaaagctgagaccattttatgagctaatcctttgtaatcccagatgttggaagtaagaaggtgccattgt

SEQ ID NO: 8390 - DNA, 553 bp, Mus musculus
  misc_feature (356)..(356): n is a, c, g, or t
  misc_feature (359)..(359): n is a, c, g, or t
  misc_feature (369)..(369): n is a, c, g, or t
  misc_feature (385)..(385): n is a, c, g, or t
  misc_feature (411)..(411): n is a, c, g, or t
  misc_feature (416)..(416): n is a, c, g, or t
  misc_feature (418)..(418): n is a, c, g, or t
  misc_feature (425)..(425): n is a, c, g, or t
  misc_feature (500)..(500): n is a, c, g, or t
  misc_feature (524)..(524): n is a, c, g, or t
gtagcaggaaaagttcccaccaccgcaggacaggcatgagtcgccacagttccaaggacaagagccggaaaacatcttcctaccggtctgtatctgggaaaacgagagaggacaaagggaaagggcatggcagattaaggggcaagagacacagctcctctcacaaaagtgagtccaggactggtcacaaaaccaggaagaaccgatcaccagctggcttggggtctgtgagtaagagagctactaagattacatcatttttcaggagtttcctagtaaggcctactccaaaagcaggggacacctcatgtgatagaggaggggtagacattgtgacaaagttggtagagaagaancangacatagagnccgtgatggagaaaancaaggattcagagttcaaagataccntaatntntgagacnatggagaagatcatccttgaaaccaaatccatttaaagaagatccagagctggaagcagccccagagaccagggntcagaggaacagtagggagccaantccagcttgcttccataaaggcactttca

SEQ ID NO: 8391 - DNA, 548 bp, Mus musculus
  misc_feature (74)..(74): n is a, c, g, or t
  misc_feature (275)..(275): n is a, c, g, or t
  misc_feature (284)..(284): n is a, c, g, or t
  misc_feature (300)..(300): n is a, c, g, or t
  misc_feature (303)..(303): n is a, c, g, or t
  misc_feature (350)..(351): n is a, c, g, or t
  misc_feature (353)..(353): n is a, c, g, or t
  misc_feature (356)..(356): n is a, c, g, or t
  misc_feature (362)..(362): n is a, c, g, or t
  misc_feature (372)..(372): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (394)..(394): n is a, c, g, or t
  misc_feature (410)..(410): n is a, c, g, or t
  misc_feature (412)..(412): n is a, c, g, or t
  misc_feature (419)..(419): n is a, c, g, or t
  misc_feature (422)..(422): n is a, c, g, or t
  misc_feature (430)..(430): n is a, c, g, or t
  misc_feature (460)..(460): n is a, c, g, or t
  misc_feature (479)..(479): n is a, c, g, or t
  misc_feature (481)..(481): n is a, c, g, or t
  misc_feature (503)..(503): n is a, c, g, or t
  misc_feature (516)..(516): n is a, c, g, or t
  misc_feature (523)..(523): n is a, c, g, or t
aaatccctctgtgatggctcgcgagggccgcaccgtggtaacccgctgggtacgtgccagcaacttggctcaanaaactgcattatatccacgctaccgcgttgatgatgagtgtggcttagcaacacttcgttctgatcttgagagatgccagaaggagctggacgatgccgaggcctgggggccacacggactttcctttccttggttcgtgggccaaggtctgagtgcccggcggcgccggcagcttgcactgttcttggcacgcaggcacnttaagaacntggaggcaactcactncantccactggagcctgaggacttccaattgccctggagactatagccanngntantgtgantcatgcattngggcatntntanacgttctagntccccccaactgttcntntccttanatntatacagnaaagctggccgtgctggggatcttggtgtntgggagagtaggcagtatntnttccttcactttctttctgttntttcctgcttccntcctttntcttccttgcaaacatctgaatgtc

SEQ ID NO: 8392 - DNA, 161 bp, Mus musculus
  misc_feature (74)..(74): n is a, c, g, or t
  misc_feature (76)..(76): n is a, c, g, or t
  misc_feature (115)..(115): n is a, c, g, or t
  misc_feature (122)..(122): n is a, c, g, or t
  misc_feature (136)..(136): n is a, c, g, or t
gacaacgtaaagaactatgagaacttgggcaactaacacacaaggactttacacactgccctattacagtgcantntcagggaacagttttaggagatgctcaggacctggcttntgctttntaccccagttgatntcatctttctggaagcacaaaatag

SEQ ID NO: 8393 - DNA, 90 bp, Mus musculus
  misc_feature (45)..(45): n is a, c, g, or t
  misc_feature (53)..(53): n is a, c, g, or t
acgggcaagtgacactgtggacctcggtcacctccctccctgaanccagtgcncctgtgcatttgcaacatttgttttaagttctggcac

SEQ ID NO: 8394 - DNA, 360 bp, Mus musculus
  misc_feature (335)..(335): n is a, c, g, or t
gaggccatcagcttgcggcccagcagcagcgcctccgttcttgacaagtgacagtattgagtgagccggtgacaataaaccggaaaattctctgtttgcactttttattaagacgcccctccccgtttccggggtgatcttaaaacaaaaaataacacgatatttacaactctcactggatttaacagtgtggattcttgtagaaacttcaaaaggcaggtggcttccccccacccccaacacacactcccttttttgggggcaaacatataccattttgtacatcagccacggggtggacaagaggagggtaatgggagggtatccaagggggntcccatcgacagatttataacttgt

SEQ ID NO: 8395 - DNA, 573 bp, Mus musculus
  misc_feature (369)..(369): n is a, c, g, or t
  misc_feature (399)..(399): n is a, c, g, or t
  misc_feature (422)..(422): n is a, c, g, or t
  misc_feature (442)..(442): n is a, c, g, or t
  misc_feature (487)..(487): n is a, c, g, or t
gaatcccagcaaagtgctccagcagctgttagtgcttcaaccagaacagcagttaaatatctacagaaccctgaagattcatctcaccgagaaagggatcctgcagcccaccttgaaggtgtagctgcccttgaggacgacgggctgctgaggaggagctcacagaccagctctgactggagccgtgcactgagccagcctggggctaaaactcagtagatgcaggctttgcagatacaaaggtttctttttctgaatttacaattactgtgaatatttaacaaacacgtggtctaaggtgagtgcagcagtcgcccacccgtgaaagatcctgtacttttctaaaatgtattttccaatgttaagttntctgccctcactggccaggttccatgattnaggtagacttgcgttttaaagantcaaacactatcaactgagnccctcgtagggtgttgacctttgccctggtgctgccctggcgtanccatagctgaatgcactggaggcaccttgggaatcgaggtctcggggtttcctcctctaatgatctcaagcatttctgaagggctg

SEQ ID NO: 8396 - DNA, 511 bp, Mus musculus
  misc_feature (179)..(180): n is a, c, g, or t
  misc_feature (183)..(183): n is a, c, g, or t
  misc_feature (195)..(195): n is a, c, g, or t
  misc_feature (200)..(201): n is a, c, g, or t
  misc_feature (203)..(203): n is a, c, g, or t
  misc_feature (207)..(207): n is a, c, g, or t
  misc_feature (213)..(213): n is a, c, g, or t
  misc_feature (230)..(230): n is a, c, g, or t
  misc_feature (293)..(293): n is a, c, g, or t
  misc_feature (317)..(317): n is a, c, g, or t
  misc_feature (321)..(322): n is a, c, g, or t
  misc_feature (327)..(327): n is a, c, g, or t
  misc_feature (346)..(346): n is a, c, g, or t
  misc_feature (360)..(360): n is a, c, g, or t
  misc_feature (369)..(369): n is a, c, g, or t
  misc_feature (394)..(395): n is a, c, g, or t
  misc_feature (403)..(403): n is a, c, g, or t
  misc_feature (410)..(411): n is a, c, g, or t
  misc_feature (414)..(414): n is a, c, g, or t
  misc_feature (423)..(423): n is a, c, g, or t
  misc_feature (478)..(478): n is a, c, g, or t
gaacaggctccatgttaccaagctgaggtgcagcctggctgctctccagaggaggcaggtgcttccagggctagcctctccagtgccccccaggacactcaggagtctcatgccctggctgctgaggcttcaggaccaggatctggcccaggcatcggtacgggagcttgagctcaaannganactcttatgtanaaatnntnaacngtacgnagacttcaaagtctggnttccttcaaaactactatacacacacacacacacacacacacacacacacacacacacacacncacacatatatatattttagcttngacnnacacnaaagtggtaataaagaganccctcctcaacccnaaatgtganccacctgtggcatcccttcctcttnnacaaaccnacagacnnaantctcttgantcctttgcctctttaataatgtgttgttctgttttgtaatgtgtgcttgggtttntgaggtgtgtgggattgagttctctgctttttt

SEQ ID NO: 8397 - DNA, 335 bp, Mus musculus
  misc_feature (127)..(127): n is a, c, g, or t
  misc_feature (129)..(129): n is a, c, g, or t
  misc_feature (134)..(134): n is a, c, g, or t
  misc_feature (137)..(137): n is a, c, g, or t
  misc_feature (147)..(147): n is a, c, g, or t
  misc_feature (177)..(177): n is a, c, g, or t
  misc_feature (181)..(181): n is a, c, g, or t
  misc_feature (183)..(183): n is a, c, g, or t
  misc_feature (192)..(192): n is a, c, g, or t
  misc_feature (223)..(223): n is a, c, g, or t
  misc_feature (230)..(230): n is a, c, g, or t
  misc_feature (296)..(296): n is a, c, g, or t
gaagacctctgagccagaagacaggccacatgaagagaggaaaagtatagtattttcatcggatgaagaactaatgcccaaacatccaagcattttaaaaataagctcatctcaacaagaggtaaantngaganatntacccataantcctgagagaataaggaggaggaatttagntttntntccagcagnatgaggtaccaactgaaaggaagagggctantttgggntcctgagagttgaaatgaaaaggtggctttcaaagggaagatccaacagaagttcaactaagtgantttcccccagcaaagcttcagacaggaaaacccaaaaga

SEQ ID NO: 8398 - DNA, 409 bp, Mus musculus
  misc_feature (220)..(220): n is a, c, g, or t
  misc_feature (242)..(242): n is a, c, g, or t
  misc_feature (251)..(251): n is a, c, g, or t
  misc_feature (287)..(287): n is a, c, g, or t
  misc_feature (312)..(312): n is a, c, g, or t
  misc_feature (314)..(314): n is a, c, g, or t
  misc_feature (324)..(324): n is a, c, g, or t
  misc_feature (342)..(342): n is a, c, g, or t
  misc_feature (345)..(345): n is a, c, g, or t
aaagatgttctgctgaactattggaagatcagcagcacccaggtctcagatggacaccacaccccctgcctgttacgccagccgtactgacactgctactgcctacaaagagatcacccaggctgcccgtggtcgcttccactggtttggagagacaggtatttatgaaagtgatgatatcaacgccatcgtatttgagatagagaaagccctcaactantcccaaaagtgtgccttccttntggcctctntgaagaaccattcagaaaaagaactgcagagtgganccctcgagaaagacaagccaaggantntgaagcaaantcaacccaagaaacactntcntcccaagcccacagccccctcggtggccagaatggtttgacacctttccctaataacacacagg

SEQ ID NO: 8399 - DNA, 441 bp, Mus musculus
  misc_feature (110)..(110): n is a, c, g, or t
  misc_feature (292)..(292): n is a, c, g, or t
  misc_feature (313)..(313): n is a, c, g, or t
  misc_feature (317)..(317): n is a, c, g, or t
  misc_feature (322)..(322): n is a, c, g, or t
  misc_feature (339)..(339): n is a, c, g, or t
  misc_feature (367)..(367): n is a, c, g, or t
aaagagcacttgaaagcttggctttttctgttttcatcacttagtatctttgtattagaacctgaataatccattaatatgaaatgttggtattatgtgactcagaagantcttgggttttaaagtttctagcatgagttaaactataatataatgtactgatgaaatttaattgaaatatccttgactagaaacactgatgtttttgatgttagtgttttttttcttagctttagaaatcctggtattaaaaagagtgtaatcacaccacataaatttcctttagatgatntgcggggaaactgattgggantgcnaggantgactgtaggagggacnctctgatcactgataagctttagaactntcaaatgaatcacactgagggcagtcacataagatagcccaccccaccacagtcactgcatgcaaagtggttaa

SEQ ID NO: 8400 - DNA, 219 bp, Mus musculus
  misc_feature (45)..(49): n is a, c, g, or t
  misc_feature (51)..(52): n is a, c, g, or t
  misc_feature (55)..(57): n is a, c, g, or t
  misc_feature (59)..(76): n is a, c, g, or t
  misc_feature (78)..(79): n is a, c, g, or t
  misc_feature (82)..(82): n is a, c, g, or t
  misc_feature (86)..(87): n is a, c, g, or t
  misc_feature (89)..(90): n is a, c, g, or t
  misc_feature (92)..(95): n is a, c, g, or t
  misc_feature (102)..(102): n is a, c, g, or t
  misc_feature (105)..(107): n is a, c, g, or t
  misc_feature (111)..(111): n is a, c, g, or t
  misc_feature (131)..(131): n is a, c, g, or t
  misc_feature (140)..(140): n is a, c, g, or t
  misc_feature (146)..(146): n is a, c, g, or t
  misc_feature (148)..(148): n is a, c, g, or t
  misc_feature (158)..(158): n is a, c, g, or t
  misc_feature (160)..(160): n is a, c, g, or t
  misc_feature (167)..(167): n is a, c, g, or t
  misc_feature (169)..(169): n is a, c, g, or t
  misc_feature (176)..(176): n is a, c, g, or t
  misc_feature (178)..(178): n is a, c, g, or t
  misc_feature (182)..(182): n is a, c, g, or t
attccactcgcccacctgcgcagtgcccttcacgcacgaggacannnnncnngannnannnnnnnnnnnnnnnnnnannagnaggnngnngnnnntcaaggnggnnnagtngcaacccccggagtttcaanccacagagnccagantngacccgcagntntcagaantntgggggntntgantcagacaagatccttccagatcgccaaaggaccagaa

SEQ ID NO: 8401 - DNA, 535 bp, Mus musculus
  misc_feature (83)..(83): n is a, c, g, or t
  misc_feature (313)..(313): n is a, c, g, or t
  misc_feature (315)..(315): n is a, c, g, or t
  misc_feature (318)..(318): n is a, c, g, or t
  misc_feature (320)..(320): n is a, c, g, or t
  misc_feature (336)..(336): n is a, c, g, or t
  misc_feature (349)..(349): n is a, c, g, or t
  misc_feature (377)..(377): n is a, c, g, or t
  misc_feature (400)..(400): n is a, c, g, or t
  misc_feature (430)..(430): n is a, c, g, or t
  misc_feature (470)..(470): n is a, c, g, or t
aactgaggagcgctgcatagctgatggagttatttattccattagaacaaatggtgtacttgtatttataccaaggtttgggnattaaaggtgctgcttatctgaagaataaagatagcttagtgatctcctgtggcccagagggcagctctgaatggaagccaggatccctacaaagatctcaaaacaagatcatctctaccacagctggagggcagtctgttacatttcatctatttgaccatgtgacggtaagaatttctgtccaggcctcgcgctgccactctgatacaatcaggcttgaaatagtaancnacnanccatacatgatcccanacacagaactctntcaccagagctccctgctgaagagtganttagtgaaggaagtaacccgatnctgtggaggaagcgcagcttgcacaagaantcaaaggcaaggtgattcaggaagagcatcaagaatactnccagacaaagggaagaagtctgtacacacttctggaggagataagggacctagctcttctggatg

SEQ ID NO: 8402 - DNA, 569 bp, Mus musculus
  misc_feature (123)..(123): n is a, c, g, or t
  misc_feature (144)..(144): n is a, c, g, or t
  misc_feature (182)..(182): n is a, c, g, or t
  misc_feature (330)..(330): n is a, c, g, or t
  misc_feature (353)..(354): n is a, c, g, or t
  misc_feature (360)..(360): n is a, c, g, or t
  misc_feature (397)..(397): n is a, c, g, or t
  misc_feature (401)..(401): n is a, c, g, or t
  misc_feature (450)..(450): n is a, c, g, or t
gcctggcagcggagcgacagtctctgccgcggcagggcctcccgggacccctggtgctgaggcgtggctgggcagcactgtgggcagaccagaaggaggcaggctgactgacttctgcactgncgttgtcccactgtggtgttncggggccgggggtcgacagcccactgctgccttggggncggcagaaccacatagtgcggctagagacaggagttcagagtcagtgcctggcaccgtaggcaccctgcccactggtagtgactagcggtcactggggcagaaggtctgagccctgtgggctctgtagacacttggtgtcccctggcnaccattgagtcctcaccatctgnntcaggngtgacagagagaatgacaacatacatttaagagggangcanaagagacggggagggtgggtgcgccatcttcctttcctgggtcaggggncctgggcggatggtcagggccccctggggggtcctgagtgcccagccacccttgttcatttttgaacagtgtcccaatcacacaaagaaagacaaacactagggatctgtgcatgcccc

SEQ ID NO: 8403 - DNA, 470 bp, Mus musculus
gtttaggtttacatgaccctcttctctttcccttaccccagacatgtatatatacatatataagatatgtatatattttacctttataaaatatatatatatacacatatatgtatctatatccctttgtttgtctgctaaaactggccatgaaagagggagctgccttcaatctgtagtttaagaagatgccagggagcatcataaacggaggctattgtatattaatttagactttttcactaaaaagaacatgaatgaatttgcttgccgaaggaggaaccagttctctagactccatgctcactctacaaggccagctttggtcaagctgccactggggcctgaagagctgactctgtcctaccttattccactaaagtaccatcttgataatttccccttaaaaaatattctcaaaaatgtactggaaagtgggtggcaggagcttgtacagttcagcttccaac

SEQ ID NO: 8404 - DNA, 451 bp, Mus musculus
  misc_feature (151)..(151): n is a, c, g, or t
  misc_feature (163)..(163): n is a, c, g, or t
  misc_feature (189)..(189): n is a, c, g, or t
  misc_feature (216)..(216): n is a, c, g, or t
  misc_feature (239)..(239): n is a, c, g, or t
  misc_feature (243)..(243): n is a, c, g, or t
  misc_feature (250)..(250): n is a, c, g, or t
  misc_feature (260)..(260): n is a, c, g, or t
  misc_feature (298)..(298): n is a, c, g, or t
  misc_feature (320)..(320): n is a, c, g, or t
  misc_feature (342)..(342): n is a, c, g, or t
gctggactggtggtaattgacttcttattctcagttttgccctcagcttcctgatacagtataagaattgctgatgaatagatatgtattttaaggatttatgatagatatgactgcttttcatataaaagtttagatttgtgattctttnaagattctcacnatattactttaaagataaataataanataactactcttttctttgtaaccacnaattgcatcctgccagtaagagnaacnggctgancaaactcccntgcttactcacactttgttaatctataacaagttgctnagttacgaatgtatgtggcttngggggaataatttgttttcttnacctgtactatctaatgttatttcttgtaaaggtattggaaaacccattgtattttcataaccatttactagaagaaaactaaaacctcagcacattgtaattgtatat

SEQ ID NO: 8405 - DNA, 371 bp, Mus musculus
  misc_feature (33)..(33): n is a, c, g, or t
gccagctcctgccaaattaagtacttcctcttnaagaaacccctgcaggctcccactagatcacactgaacgctggcttctgtttgaggctgaagtcccagatcactgtttgccagtaattgaagcgcagccagatatgtgtcttcgctgcccaaactagtagactccccgtgtgcggctgagaggctggggcagctcagccaagagcacagatcccacttaggataccattgctttgttgctggcctgctgctcttaaacactggcctatctactgcaaatatgcctctgagaatagtacagaaaacatctggagataaccaacacagctcagcaaaactgaagaggtctacaaatttgcttcctgcttg

SEQ ID NO: 8406 - DNA, 541 bp, Mus musculus
  misc_feature (124)..(124): n is a, c, g, or t
  misc_feature (126)..(133): n is a, c, g, or t
  misc_feature (135)..(137): n is a, c, g, or t
  misc_feature (141)..(143): n is a, c, g, or t
  misc_feature (145)..(156): n is a, c, g, or t
  misc_feature (159)..(162): n is a, c, g, or t
  misc_feature (164)..(164): n is a, c, g, or t
  misc_feature (166)..(168): n is a, c, g, or t
  misc_feature (171)..(174): n is a, c, g, or t
  misc_feature (180)..(180): n is a, c, g, or t
  misc_feature (193)..(193): n is a, c, g, or t
  misc_feature (200)..(200): n is a, c, g, or t
  misc_feature (278)..(279): n is a, c, g, or t
  misc_feature (282)..(282): n is a, c, g, or t
  misc_feature (287)..(289): n is a, c, g, or t
  misc_feature (306)..(306): n is a, c, g, or t
  misc_feature (317)..(317): n is a, c, g, or t
  misc_feature (319)..(319): n is a, c, g, or t
  misc_feature (323)..(323): n is a, c, g, or t
  misc_feature (329)..(329): n is a, c, g, or t
  misc_feature (347)..(347): n is a, c, g, or t
  misc_feature (430)..(430): n is a, c, g, or t
  misc_feature (445)..(445): n is a, c, g, or t
  misc_feature (447)..(447): n is a, c, g, or t
  misc_feature (501)..(501): n is a, c, g, or t
ccacactcaggaacgtgcttgatataagaggatagagaggccaaggggaactcaggttagacatgacagaacccggtctccacagtaaaagttgtgggtaaacttctcagtgctttgatgactntnnnnnnnnannntttnnntnnnnnnnnnnnnttnnnntntnnnacnnnnaacctncagtcacaaatgntggaatntgctttataaggcaataggaaaaagacagaagccaaaatacaaggattctactcaagccttctggaaaggactgtgtnnccnttgannncatggagcaaagaattnttagattttcntnccancccctngaaaccggacctgtgatntcaagttgggttttgttgttgtttgttttaacctgccatgagatgggttgacaggatcaatcattttacaccatgatcccttntccctgggaggactntntgagacattagagaaatgggatacagacttcctcactgggctgggggagctggntcaggtgcagagtacttgccacgatatgaagatccacttt

SEQ ID NO: 8407 - DNA, 266 bp, Mus musculus
gaaatgttgaaccactggtctgcacacacatatctgtagaaatgttgtacacagtcacaatcagattctgtttgcactgagtgcttggagtaagaagggatgggctactgcttcagcaaactggtgatgcagttaatggaagagagtacgtttgtacatttgaatgcccaagttccgttaccttccaagcaggggaacaaaagtgaaattttgttatgactaacaaaatgtttactatgcagccattttgtggcaataagacagat

SEQ ID NO: 8408 - DNA, 336 bp, Mus musculus
  misc_feature (216)..(216): n is a, c, g, or t
  misc_feature (265)..(265): n is a, c, g, or t
  misc_feature (305)..(305): n is a, c, g, or t
  misc_feature (307)..(307): n is a, c, g, or t
aagtggcataccttggctctatgtggtgtttgctatactctttgtatttttcctttttgtcatgttctcgccttttttgctcgagatagaccagcacaccaagaaattctttctcaggtgccgatgttctctgcgcaatgtttcctataaggataaagacaatattaagatgaagatgaaccatctgggaggggcaagatgtcttcttcaggcccntgggagagaagctccaagaagagaggcagctggtgggagaggagacagntcagttctggtggagatggtgggagagaggacccaggaantntgcccagtgacagcagtttgaggcgacca

SEQ ID NO: 8409 - DNA, 383 bp, Mus musculus
  misc_feature (203)..(203): n is a, c, g, or t
  misc_feature (209)..(209): n is a, c, g, or t
  misc_feature (215)..(215): n is a, c, g, or t
  misc_feature (245)..(245): n is a, c, g, or t
  misc_feature (270)..(270): n is a, c, g, or t
  misc_feature (274)..(274): n is a, c, g, or t
  misc_feature (286)..(286): n is a, c, g, or t
  misc_feature (294)..(294): n is a, c, g, or t
  misc_feature (317)..(317): n is a, c, g, or t
  misc_feature (351)..(351): n is a, c, g, or t
aatgaaagttccgagtcgggagatggtaatgcaagcaacatttacccaggccgggtcatctagcaagggagctggtcgtggagtgcggcagagacctctccacccagaagccctttctgtgtccccctctgcctcccttcttccctcctctttattgaaaccaatgtgttcgcagttaccattttcacccgtgccactccttnttgggntctggnttgagcatccgtgggcagccacagggaccntcccagccagcacaggcaaaacagntgantcccccgtgtgntgccctgntgctgcccctcagcccagcagcntgggctcccagtgctgaggccctctgttcaggcntccgcccaccctgagtggaatggagccatgca

SEQ ID NO: 8410 - DNA, 377 bp, Mus musculus
  misc_feature (296)..(296): n is a, c, g, or t
  misc_feature (305)..(305): n is a, c, g, or t
  misc_feature (310)..(310): n is a, c, g, or t
  misc_feature (317)..(317): n is a, c, g, or t
  misc_feature (332)..(332): n is a, c, g, or t
  misc_feature (336)..(336): n is a, c, g, or t
  misc_feature (340)..(340): n is a, c, g, or t
  misc_feature (349)..(349): n is a, c, g, or t
  misc_feature (352)..(352): n is a, c, g, or t
aggcccctgagcacttactaacaagttcaccaggatcctgatcaccaaacaaggtggctcccatcccaggagctgttgcaccaattagtcctccttcgttggaacactgtgtaccaagaacttttagcaccagcttcatttctttgcaacacctttggaagactggtctcaccatcttctggttcctacaccactggcaccaacaccccatttataagacagcttgggaaacttgtgtttgtggcgacccttgaacttcagctccatccttaaacccattattagccgtggtcctntggacaggntgcantccatgntccaatcttactgcntctntccntcatgttanttnacacagagtgatccccttagatctt

SEQ ID NO: 8411 - DNA, 342 bp, Mus musculus
  misc_feature (106)..(106): n is a, c, g, or t
  misc_feature (231)..(231): n is a, c, g, or t
ataggagattcagcagccacgggcccctgttcattgtcaatgaagaaatctgggaggcactatatttccagctctagagtcaggctcactagccgtaaaagaaggnaagcccagcactcaaccaaaacagcaaatggtcttcaatctttgctaattgaaagactgccaacaagttccagattgaaaagctctggccaggacctttgtttgcaaaaggcaaaaaacacgganacaccaagagttcttcaacattctaagattctttggggatcggtaaagactaaaagatgaagagctaaggccagcttgtatgcatcgctgctcaccaagccttaggctgag

SEQ ID NO: 8412 - DNA, 50 bp, Mus musculus
tggagcccgtccctctgcactggatagatttgtacgacgagccagagaag

SEQ ID NO: 8413 - DNA, 175 bp, Mus musculus
  misc_feature (35)..(35): n is a, c, g, or t
  misc_feature (53)..(53): n is a, c, g, or t
  misc_feature (76)..(76): n is a, c, g, or t
  misc_feature (107)..(107): n is a, c, g, or t
  misc_feature (109)..(109): n is a, c, g, or t
  misc_feature (126)..(126): n is a, c, g, or t
ggaggaagttccaccatgcattgacagtgaccagnttccgaatggagacttgnccagttcctagaccctgaacagntccaaagacccatgaaacatcagtgaacggntntgggagctgagctgtgntcctttcaaggccacttttcaccacaaactaatttgtatgatggtgaaa

SEQ ID NO: 8414 - DNA, 282 bp, Mus musculus
  misc_feature (33)..(33): n is a, c, g, or t
  misc_feature (42)..(42): n is a, c, g, or t
  misc_feature (44)..(44): n is a, c, g, or t
  misc_feature (59)..(59): n is a, c, g, or t
  misc_feature (70)..(70): n is a, c, g, or t
  misc_feature (80)..(80): n is a, c, g, or t
  misc_feature (114)..(114): n is a, c, g, or t
  misc_feature (124)..(124): n is a, c, g, or t
  misc_feature (135)..(135): n is a, c, g, or t
  misc_feature (140)..(140): n is a, c, g, or t
  misc_feature (159)..(159): n is a, c, g, or t
  misc_feature (174)..(174): n is a, c, g, or t
  misc_feature (245)..(245): n is a, c, g, or t
gacaacgtggctatgtgcaatggagacaaactngactgtgantntcttggttcagtatnaggttcacttnatttatactntaagttattttacttcccctgggaccctttccantcctcgtttnacattcattcntcttnggatttgctttgtgatttngttgttgttgatgtngttgttgttgtgtaatgtaacagcactttaaaagggcgacaactgactcacgagatggcgaccatcttgancctatttggggagacctgtatccgtgacttttgtttt

SEQ ID NO: 8415 - DNA, 456 bp, Mus musculus
tgaggacttcgcagtcactgtgcagcctttcttccggaatacctttatcccactgaatgagcgtgagggcctggacctcactttcttctctgaagactgtttctacttctcagaccgtgggcatgctgagatggccattgccctctggaataacatgctggaaccagtgggctggaagacatcctccaataacttcatatacaacagaaccaaactcaagtgcccctcacctgaaaggcctttcctctacaccctccggaatagtcagcttcttccagacaaggctgaagaaccctccaatgcactctactgggcagtgccagtggcagcaataggtggcctggcagttggcatccttggagtgatgttgtggagaactgtgaaacccgtccaacaggaggaggaggaggaggacactcttccaaatacaagtgtgacccaggatgctgtatcaga

SEQ ID NO: 8416 - DNA, 532 bp, Mus musculus
  misc_feature (38)..(38): n is a, c, g, or t
  misc_feature (354)..(354): n is a, c, g, or t
  misc_feature (383)..(383): n is a, c, g, or t
  misc_feature (448)..(448): n is a, c, g, or t
ggactgaagagtgcatgtggccacagggtgtgctggtnaaacacagcaagaatgtctacaaagcagtgggccactacaacgtggccatcccctccgatgtctcccacttccgcttccatttctttttcagcaaccccctgcggatcctcaacatccttttgctgctggagggtgccgtcattgtctaccagctgtactccttaatgtcctcagagaagtggcaccagaccatctccctggccctcatcctcttcagcaactactatgccttcttcaagctgctccgggaccgcctggtattgggcaaagcctactcctactcagccagcccccagagggacctggaccaccggnttctcctgagtcccagggtgatcctccanacaacatccgggcttcacccaggggcttcctggccaagggctcttggggttgggggggagggatncaaaaaacaaaaacaaaaaacaacaaaaaaaaaccaacccaccagagctttgtatttttgttacgtactgtttctttctttgat

SEQ ID NO: 8417 - DNA, 389 bp, Mus musculus
  misc_feature (308)..(308): n is a, c, g, or t
caggaggccgctgcttcaggcttagccagcaatcccgctgccctgacttcttcctcttcctctgccgcttgctcagtcccatactcaaggccttcgcacaggcggccaccttcctccacttagggcagctgccagattcagaggtggcctactcagagaagttgttccagtttttacaggcctgtgcccaagaagaagggatctttgagtgtgcagacccaaaccttgctatcagtgcagtctggacgttcaaagatctgggggtacttcaggagatgcctagccctacaggaccccagctccacctntcccctacatttgccacccgggacaatcaggacaagctggaacaatttatccgacagttcatctgcagttagtaccaggtg

SEQ ID NO: 8418 - DNA, 486 bp, Mus musculus
  misc_feature (163)..(164): n is a, c, g, or t
  misc_feature (271)..(271): n is a, c, g, or t
  misc_feature (276)..(276): n is a, c, g, or t
  misc_feature (301)..(301): n is a, c, g, or t
  misc_feature (304)..(304): n is a, c, g, or t
  misc_feature (310)..(310): n is a, c, g, or t
  misc_feature (312)..(312): n is a, c, g, or t
  misc_feature (325)..(325): n is a, c, g, or t
  misc_feature (328)..(328): n is a, c, g, or t
  misc_feature (352)..(352): n is a, c, g, or t
  misc_feature (363)..(363): n is a, c, g, or t
  misc_feature (371)..(371): n is a, c, g, or t
  misc_feature (376)..(377): n is a, c, g, or t
  misc_feature (381)..(381): n is a, c, g, or t
  misc_feature (383)..(383): n is a, c, g, or t
  misc_feature (388)..(388): n is a, c, g, or t
  misc_feature (418)..(419): n is a, c, g, or t
  misc_feature (432)..(432): n is a, c, g, or t
  misc_feature (441)..(441): n is a, c, g, or t
  misc_feature (458)..(458): n is a, c, g, or t
aaagatccgcttggagctgggtgccatcaagaatgagctgagagtcgagaagaccctaagggtgaagaacagcagggctctggaggtgcttggaagacacgttgcttcagtggtaaggtcgtcaaatcctgctgaccactttactgggaatattttttaaacnnaaaaaacaaaaagcctttcactgggaacgctattgagccaaatcaatatttatcgtactatatatatttgtgtactgctaaaatgtatttgaaagcgtgtaatcttnacttntggtgaatcagagcacctaccaatnatncagatncngacttcaaagcanctntttctctttctgatgaaggcattntgagactctgnatgagaanttctnnaatntnttttntatgggatatatatatatatatatatatanncacaaaacaaccnaacaacccnaactgattcactagatngtagatgactgaatgagcagcactgtgt

SEQ ID NO: 8419 - DNA, 408 bp, Mus musculus
  misc_feature (69)..(69): n is a, c, g, or t
  misc_feature (84)..(84): n is a, c, g, or t
  misc_feature (115)..(117): n is a, c, g, or t
  misc_feature (119)..(121): n is a, c, g, or t
  misc_feature (125)..(125): n is a, c, g, or t
  misc_feature (127)..(127): n is a, c, g, or t
  misc_feature (129)..(131): n is a, c, g, or t
  misc_feature (134)..(134): n is a, c, g, or t
  misc_feature (136)..(136): n is a, c, g, or t
  misc_feature (141)..(141): n is a, c, g, or t
  misc_feature (143)..(143): n is a, c, g, or t
  misc_feature (145)..(145): n is a, c, g, or t
  misc_feature (162)..(163): n is a, c, g, or t
  misc_feature (165)..(165): n is a, c, g, or t
  misc_feature (168)..(168): n is a, c, g, or t
  misc_feature (176)..(176): n is a, c, g, or t
  misc_feature (180)..(180): n is a, c, g, or t
  misc_feature (184)..(184): n is a, c, g, or t
  misc_feature (187)..(188): n is a, c, g, or t
  misc_feature (193)..(193): n is a, c, g, or t
  misc_feature (201)..(201): n is a, c, g, or t
  misc_feature (229)..(229): n is a, c, g, or t
  misc_feature (247)..(247): n is a, c, g, or t
  misc_feature (260)..(260): n is a, c, g, or t
  misc_feature (292)..(292): n is a, c, g, or t
  misc_feature (297)..(297): n is a, c, g, or t
  misc_feature (327)..(327): n is a, c, g, or t
  misc_feature (344)..(344): n is a, c, g, or t
  misc_feature (347)..(347): n is a, c, g, or t
  misc_feature (349)..(349): n is a, c, g, or t
  misc_feature (374)..(374): n is a, c, g, or t
ttgctggcagtcaaactggataaataccacagtctgaatgaggaacttgatgtcttgattacaaagctnggagggcttctgganagcaaagaagaccactacagcagactcattnnngnnnatgncnannnccngngacangnangcagcctgataaataanntnacntcatatgnaganattntcnnatgtnctgaccanagacttgagatatcacattctcagattncacacttggaagagaggnatagacatttagnagatttaattagaatgcccagagagaaagccnaaagnccaagaccaagattagataatcacccaaantccttgaccttgataantcntnttgagggccaccataaagaatgttntatttccttgtgaactgacagtaatacatgatta

SEQ ID NO: 8420 - DNA, 334 bp, Mus musculus
  misc_feature (304)..(304): n is a, c, g, or t
gttcttgttcaaggaaacacactcggtgttgaacttgggcatccttctggagccctcgaccaccaacagcccgttaccgggcttcaagcagtggccccaggttctgtgctgcccaggcctgtccgaaggctgtcactactgggaggctgaggtgtccaactcgtggatgtgcctgggagtcacctaccgtcgcagccctccgctgagcggtcgcccccgtcgcaacatcgtctacctgctgggccgcaacccctactcatggtgtctggagtgggattcgctcaagttctctgtgtggcacaanaacacacagacggtgctacacggatcctac

SEQ ID NO: 8421 - DNA, 549 bp, Mus musculus
  misc_feature (31)..(31): n is a, c, g, or t
  misc_feature (36)..(36): n is a, c, g, or t
  misc_feature (43)..(43): n is a, c, g, or t
  misc_feature (52)..(52): n is a, c, g, or t
  misc_feature (56)..(56): n is a, c, g, or t
  misc_feature (64)..(64): n is a, c, g, or t
  misc_feature (74)..(74): n is a, c, g, or t
  misc_feature (81)..(81): n is a, c, g, or t
  misc_feature (84)..(84): n is a, c, g, or t
  misc_feature (89)..(89): n is a, c, g, or t
  misc_feature (94)..(94): n is a, c, g, or t
  misc_feature (107)..(107): n is a, c, g, or t
  misc_feature (113)..(113): n is a, c, g, or t
  misc_feature (118)..(118): n is a, c, g, or t
  misc_feature (128)..(128): n is a, c, g, or t
  misc_feature (133)..(136): n is a, c, g, or t
  misc_feature (139)..(139): n is a, c, g, or t
  misc_feature (144)..(144): n is a, c, g, or t
  misc_feature (151)..(151): n is a, c, g, or t
  misc_feature (159)..(159): n is a, c, g, or t
  misc_feature (183)..(183): n is a, c, g, or t
  misc_feature (188)..(188): n is a, c, g, or t
  misc_feature (193)..(193): n is a, c, g, or t
  misc_feature (331)..(331): n is a, c, g, or t
  misc_feature (372)..(372): n is a, c, g, or t
  misc_feature (384)..(384): n is a, c, g, or t
  misc_feature (400)..(400): n is a, c, g, or t
  misc_feature (413)..(413): n is a, c, g, or t
  misc_feature (415)..(415): n is a, c, g, or t
  misc_feature (418)..(418): n is a, c, g, or t
  misc_feature (427)..(427): n is a, c, g, or t
  misc_feature (439)..(439): n is a, c, g, or t
  misc_feature (446)..(446): n is a, c, g, or t
  misc_feature (459)..(459): n is a, c, g, or t
  misc_feature (462)..(462): n is a, c, g, or t
  misc_feature (464)..(464): n is a, c, g, or t
  misc_feature (467)..(467): n is a, c, g, or t
  misc_feature (470)..(470): n is a, c, g, or t
  misc_feature (509)..(509): n is a, c, g, or t
  misc_feature (511)..(511): n is a, c, g, or t
aagctagtccatgcaaatggccaaactttgnttaangtgagcnaattcgggncctncttctccnacattaggcntggccangangtcangggancacaggtttttcntcttcnttatngagtgtaaangcttnnnnctncgctnagaaccntagttaangagtcttctacatagtctgctttnctcangtgangaccttgtgttaatatttctctgcagagtgtgatgcccaaggtgccaaatccctggctccagagtcccgtcgtaggaatccccgtacagaaaaaccgctcaccgtatttcagggatctacggactgcccgggaaaaanggatcgaaagaggaccctttggagatgacccggttttaganccgagcaaattnttcaaagaagattttntttccacatcaantnttntttcctttnggagaatacagntcctgtntaggctggatggntcntnttnttntccttgacacccgcagcagcagacagggcacatcgtgtntnttccattgatactgaacaatgttctcactgtgtttaca

SEQ ID NO: 8422 - DNA, 175 bp, Mus musculus
  misc_feature (31)..(31): n is a, c, g, or t
  misc_feature (33)..(33): n is a, c, g, or t
  misc_feature (40)..(41): n is a, c, g, or t
  misc_feature (61)..(61): n is a, c, g, or t
  misc_feature (69)..(69): n is a, c, g, or t
  misc_feature (98)..(98): n is a, c, g, or t
  misc_feature (114)..(114): n is a, c, g, or t
agcctcagtgtcctgaaagctgccacaaatntnaaacagnncttcagaaagtacagccccngtctgganacccttcccattccctacaagccccggangttcgtttcagcaaanagatggaatgtctccaggccatgggatttgtgaattataatgccaacctgcaagcgctcat

SEQ ID NO: 8423 - DNA, 492 bp, Mus musculus
  misc_feature (283)..(283): n is a, c, g, or t
  misc_feature (289)..(289): n is a, c, g, or t
  misc_feature (295)..(295): n is a, c, g, or t
  misc_feature (317)..(317): n is a, c, g, or t
  misc_feature (320)..(320): n is a, c, g, or t
  misc_feature (324)..(324): n is a, c, g, or t
  misc_feature (359)..(359): n is a, c, g, or t
  misc_feature (374)..(374): n is a, c, g, or t
  misc_feature (435)..(435): n is a, c, g, or t
catccagggacttcgggttgcagagcaggctgtctactatggcattgatgcattttctcagctgtgtcaagatcccagactactgccaggagcaggtgccacagagatggctctggcaaaaatgctggtagacaaaggaagccgactgtctggccccaacggtctggccttccaagcatttgctcaagccctgagttctctgcctaaaaccctggcagagaatgcaggcttagctgcccaaagcgtgatggcagaattgagtggatttcaccaagctgggaanttcttngttggngtgggaacagacggcttagtanatntgantcatgaaggtatatgggacatactgaggaccaaancccaagggttacaancagttgctgagctggtgcagcagctggtgactgtggaccaaattatagtggccagaaagantcctttgtacagacagatcacagaccccaccttgaatgcaaaggtatcctcacccct

SEQ ID NO: 8424 - DNA, 189 bp, Mus musculus
  misc_feature (28)..(28): n is a, c, g, or t
  misc_feature (41)..(41): n is a, c, g, or t
  misc_feature (88)..(88): n is a, c, g, or t
  misc_feature (96)..(96): n is a, c, g, or t
  misc_feature (158)..(158): n is a, c, g, or t
  misc_feature (160)..(160): n is a, c, g, or t
tcactaccgccctttgttgaaagagctntcaacaggtactnggaagaagctcgaacatagcagcaagtgattaagaatgcaagtagantcagcatnccaaccaaagacctggaaatctgtgaaatggcttggtagctgagcaatgccaaactgtgtantntgaaaatatcagtactacacactgctttg

SEQ ID NO: 8425 - DNA, 434 bp, Mus musculus
  misc_feature (181)..(181): n is a, c, g, or t
  misc_feature (241)..(241): n is a, c, g, or t
  misc_feature (295)..(295): n is a, c, g, or t
  misc_feature (387)..(387): n is a, c, g, or t
  misc_feature (390)..(392): n is a, c, g, or t
  misc_feature (394)..(394): n is a, c, g, or t
  misc_feature (403)..(403): n is a, c, g, or t
cgcgcttggttctctgtctttattttcaggaattggcgagttcagataatatttgatgatgagtgatccgtgtcctcaagaatgcaagtaacactgtagagagaggaaagatcaccagtggccacttatgcgtataaactgccaggacgtgtccttcaagttctggaagagagtgctccantgcatttcaccatcatcttcacaggatggaagctatcagtttgtcctatggtttattttntaggaacccaagctactttcataatgaaaaaacagagatggaaaagacggtgtntgactgctggacaagtagttaccaggtgtgactaaagtatatcctgttgttacatccattcggctgacatggttccatgtaggcagactttnttnnntntagagcttntggaagaaaggaaacctcattcaaggactga

SEQ ID NO: 8426 - DNA, 450 bp, Mus musculus
  misc_feature (78)..(78): n is a, c, g, or t
  misc_feature (81)..(81): n is a, c, g, or t
ataattaggcaattccagcccgaagaactaatgacagcaataattggaaatgctacttgtgactggaaacaatttganaanaattcaaagtataaagatggatatgacaaatcacacccaactattctgctgttttggaaggctttccatgacttaactttggatgaaaagaaaaaattcctcttgtttcttacaggatgtgataggctgcatgtgaaaggcctacagaatgaaggaatagtattccggtgttctgaaaccttcagtgaagaagataacccaagatcattgacatgtcacaggatgctagacctacctaagtattcctcaatgcgaaggatgaaggaagcacttcaggttgcaatcaacaatagcacgggatttgtctcacaggaatgatgcagaaacattcacctcccagcagttcacagcctcgggaactaggtgttt

SEQ ID NO: 8427 - DNA, 420 bp, Mus musculus
  misc_feature (72)..(72): n is a, c, g, or t
  misc_feature (96)..(96): n is a, c, g, or t
  misc_feature (256)..(256): n is a, c, g, or t
  misc_feature (278)..(278): n is a, c, g, or t
  misc_feature (290)..(290): n is a, c, g, or t
  misc_feature (292)..(292): n is a, c, g, or t
  misc_feature (327)..(327): n is a, c, g, or t
  misc_feature (345)..(345): n is a, c, g, or t
  misc_feature (350)..(350): n is a, c, g, or t
  misc_feature (354)..(354): n is a, c, g, or t
acatctgaggtttctttcttcagtccacagaaaattttgtatgctaaatttgggaaacaaatctattacaantcattaacccagttgaaatttagntctgtcatcttaggctagcgtgcagtaaaggaagacctttgtagagtgaactgcctttcataccgctccagcgtcgtctccggcgtcgtcctgcttgtgctgatggtgtgactaggtgtatcgaatctgcttccgtttaacctcagacgttatcacacancctaacgactcacattgagctntcagtcatgaantncagaccacttttagttacaaagaggctagagcatntcagtggcatgatgcttnccaanccanccctaggcatctaagataattacggtattttagtatgcggtgtactgccataggaccagaggtcag

SEQ ID NO: 8428 - DNA, 366 bp, Mus musculus
  misc_feature (181)..(182): n is a, c, g, or t
  misc_feature (184)..(185): n is a, c, g, or t
  misc_feature (187)..(187): n is a, c, g, or t
  misc_feature (189)..(190): n is a, c, g, or t
  misc_feature (199)..(199): n is a, c, g, or t
  misc_feature (208)..(209): n is a, c, g, or t
  misc_feature (213)..(213): n is a, c, g, or t
  misc_feature (215)..(216): n is a, c, g, or t
  misc_feature (219)..(221): n is a, c, g, or t
  misc_feature (223)..(223): n is a, c, g, or t
  misc_feature (225)..(225): n is a, c, g, or t
  misc_feature (234)..(234): n is a, c, g, or t
  misc_feature (237)..(237): n is a, c, g, or t
  misc_feature (248)..(248): n is a, c, g, or t
  misc_feature (251)..(251): n is a, c, g, or t
  misc_feature (298)..(298): n is a, c, g, or t
  misc_feature (323)..(323): n is a, c, g, or t
  misc_feature (327)..(327): n is a, c, g, or t
aataatactaatttcctggtttgataaacctaaaaacccccccaacgggtgtgtcaccattttacccgtccactcttaaagcccatttatcagccctcttaggtcatataagagttgcacctcttgaaccaagtatttgtatttactatgggaaaggtgtagactccagattaggattatnntnntntnnatggactcnaagtaattnntaantnnggnnngngnaaagttttnaantactgtgtatnatnaaaggacacaacctgtgaaatatgccactttactgtttaagaattcnataagaatgacttattcacagaacngatnacattcctgatgaaatcagcagcactttgtaatttcctt

SEQ ID NO: 8429 - DNA, 511 bp, Mus musculus
  misc_feature (214)..(214): n is a, c, g, or t
  misc_feature (222)..(222): n is a, c, g, or t
  misc_feature (276)..(276): n is a, c, g, or t
  misc_feature (282)..(282): n is a, c, g, or t
  misc_feature (285)..(285): n is a, c, g, or t
  misc_feature (289)..(289): n is a, c, g, or t
  misc_feature (294)..(294): n is a, c, g, or t
  misc_feature (297)..(297): n is a, c, g, or t
  misc_feature (299)..(299): n is a, c, g, or t
  misc_feature (319)..(319): n is a, c, g, or t
  misc_feature (321)..(321): n is a, c, g, or t
  misc_feature (326)..(326): n is a, c, g, or t
  misc_feature (328)..(328): n is a, c, g, or t
  misc_feature (331)..(331): n is a, c, g, or t
  misc_feature (340)..(340): n is a, c, g, or t
  misc_feature (351)..(351): n is a, c, g, or t
  misc_feature (362)..(362): n is a, c, g, or t
  misc_feature (369)..(370): n is a, c, g, or t
  misc_feature (374)..(374): n is a, c, g, or t
  misc_feature (376)..(376): n is a, c, g, or t
  misc_feature (381)..(381): n is a, c, g, or t
  misc_feature (385)..(385): n is a, c, g, or t
  misc_feature (392)..(392): n is a, c, g, or t
  misc_feature (396)..(396): n is a, c, g, or t
  misc_feature (406)..(406): n is a, c, g, or t
aagtcagagaaagtgagccccagcaaaccctctccaggtgacagcagcgagcagcccctgttctgtgttgaatattccccttactgctccgtctttgctttctccccaacccagcagcccaataccaattactgctgcctccttctgcccttagttccaccagctgcccagggggcccagagcccttccacttccctccctcccgccatctttnccaccttntccaccccgccctcaagccccctgagccccttgctggggtctccagcatctctntgctanttncctntctcncancngactccagccgagacccctntnctgtntntancaggccccnagaaggcccantaaaatttacntcatatnntaantnacccntagngaggcanacancacaaaagantcagagagtgggggacagcagaaggcaggtggacaggagcaggccagagcaacaccaatggggtgtggtgtgcagggggacaggaagaggagacagcgcactgac

SEQ ID NO: 8430 - DNA, 344 bp, Mus musculus
  misc_feature (74)..(74): n is a, c, g, or t
  misc_feature (94)..(94): n is a, c, g, or t
  misc_feature (134)..(134): n is a, c, g, or t
  misc_feature (281)..(282): n is a, c, g, or t
accttctagatcaaaccttcatcacccagcaagcgccagtatcagactccaatagaatggtgtcacccgatgtnattcctcaaggattacaggnctctgacatagcctaggaagtagagcagcacagcagatgnctccacagtagatgcaggaagacccttgtgtatgtaaccttgctctgaacatgttcaagacagtttctcaaagaaaaagacaattccagctcaaaggttacctgtttgccatagaaattggtgtctcccctgaaggaagagcgaganncggtgaaggaaaacatcggcaaaggcactggaatggggacattcacacccacctaaagagaa

SEQ ID NO: 8431 - DNA, 351 bp, Mus musculus
  misc_feature (192)..(192): n is a, c, g, or t
  misc_feature (306)..(306): n is a, c, g, or t
  misc_feature (310)..(310): n is a, c, g, or t
  misc_feature (326)..(326): n is a, c, g, or t
agccattaaagcagcagccgttgcagccgttgcagccgcagctgcagccacagccacagaagcagcagcaaaggcagcagcagaggcagcagcagccaccgcgacagcagcagaaacaacagccactgcagcaacagggaaagtagagatcggaggtgagctgcccaccctccctccagcattttgaattgntgctccttttccagccagccgaaccagagccaccagagcagggggagaggaccagggtgatggggagaagagccatccatgtggctgtggagcagcaaaggtgggaggaatggnaacntttccccaaggcggantccatttcaaaaccggaatccaaag

SEQ ID NO: 8432 - DNA, 350 bp, Mus musculus
  misc_feature (111)..(111): n is a, c, g, or t
  misc_feature (119)..(119): n is a, c, g, or t
  misc_feature (121)..(121): n is a, c, g, or t
  misc_feature (130)..(130): n is a, c, g, or t
  misc_feature (140)..(141): n is a, c, g, or t
  misc_feature (143)..(143): n is a, c, g, or t
  misc_feature (146)..(146): n is a, c, g, or t
  misc_feature (148)..(150): n is a, c, g, or t
  misc_feature (152)..(153): n is a, c, g, or t
  misc_feature (168)..(168): n is a, c, g, or t
  misc_feature (185)..(185): n is a, c, g, or t
  misc_feature (219)..(219): n is a, c, g, or t
  misc_feature (289)..(289): n is a, c, g, or t
  misc_feature (297)..(297): n is a, c, g, or t
  misc_feature (299)..(299): n is a, c, g, or t
agtgctgacagcaactggtgcagttctccttctggctctgggttggctcctcagcaggatcctccgggggttggccccgtccctacaggcaccaagcaaaccagccaaagntcagttgntnaacagcatncagggaaatnnangancnnntnnagaggcaaatggagncaccaagaatagagatntcccagcaacattttgatggcagagcccaagatntctgtatggggagagattacctgttcaacacactcacgggagcccggcgttggctgtgaggcggagtagntgctttantntgtggggagttcccttttcccatgatcatagcctggatttccaaaccaatt

SEQ ID NO: 8433 - DNA, 123 bp, Mus musculus
  misc_feature (39)..(39): n is a, c, g, or t
  misc_feature (61)..(61): n is a, c, g, or t
  misc_feature (71)..(71): n is a, c, g, or t
  misc_feature (76)..(76): n is a, c, g, or t
  misc_feature (88)..(88): n is a, c, g, or t
agtccagctctggtctctgtattttcaccccataccctntcctttggtgccctgactcctnttcttgctgnccccntcttcccctcantccctcttcacaaaatggtttttacttctgtggat

SEQ ID NO: 8434 - DNA, 94 bp, Mus musculus
  misc_feature (34)..(34): n is a, c, g, or t
ttcttttcactgatgttcacgatgtgctttgatncctcaggagcttagcaccatgaaccttcctccatcccccactactactactaataaaatg

SEQ ID NO: 8435 - DNA, 159 bp, Mus musculus
  misc_feature (36)..(36): n is a, c, g, or t
  misc_feature (38)..(38): n is a, c, g, or t
  misc_feature (40)..(40): n is a, c, g, or t
  misc_feature (66)..(66): n is a, c, g, or t
  misc_feature (74)..(74): n is a, c, g, or t
tacactgtgcaattaggtacaccagatttcattttntntntgcctaaggttgacatatagttaggnaaatgatntgctgagttccacccagctgggttccccacctaagctgatctcatattgttagagataatatctatgtttattatatttggatac

SEQ ID NO: 8436 - DNA, 43 bp, Mus musculus
aacccgattccggatacaggcattttgtggacataagcttgga

SEQ ID NO: 8437 - DNA, 536 bp, Mus musculus
  misc_feature (30)..(30): n is a, c, g, or t
  misc_feature (50)..(50): n is a, c, g, or t
  misc_feature (110)..(110): n is a, c, g, or t
  misc_feature (378)..(378): n is a, c, g, or t
  misc_feature (398)..(398): n is a, c, g, or t
  misc_feature (421)..(421): n is a, c, g, or t
  misc_feature (427)..(427): n is a, c, g, or t
  misc_feature (473)..(473): n is a, c, g, or t
  misc_feature (487)..(487): n is a, c, g, or t
gtcagaatattcacacttgggagaatctcnataaatgtgcaaaatatagncaggtgtttagctgtaatttgtcactgcattagcatgagagaattaatactccaaaaatncaaagaatatagcaaggcctttacccgttttttcatactttatcctcagaaacttcatactgtagagaaactgcacatacaaataacatgtcaaacttttaataatatttcaaatctcagtcaacaccaaagaatgaattcagtaagcttcactgtttgactttacatctcggcatctaaggaaagctcaaccgtatgcttgtttgaatcggactaacttacagatgtgtctataggacatttttcttggatgttgattgatgcccantctcacccctggactggtgntcctgagtgaatgagaattctgnccaccnaaaatcagagggagcaagccagtaagcagaattcctcaatggtttntactttagttcctntctcaaggtttttcccttgagttctcatcctggctgaactggttgacta

SEQ ID NO: 8438 - DNA, 480 bp, Mus musculus
  misc_feature (34)..(34): n is a, c, g, or t
  misc_feature (105)..(105): n is a, c, g, or t
  misc_feature (343)..(343): n is a, c, g, or t
tattatgctggcagtaactctgaatatatgatantgaagaaacattttcattaaacttttacttgttcaccctcaaatattatatgatgaagtcaggtgtgaaanccagaagaatatgatgttgtgcaacaattcatggagatagaaatgatccattccaaaaggaaactaaataaagagtgtactatcgccttcaaaatgtctaataaaactggcagcattttgtatatttaattcaaatgaagaaattgacacagattgtacttgatagtgtatttgacaaactgagccaccaagactgcatgttcttaatcctataatatgcctacagatgtgaagtgtnctttgagtatccagtattcattattcttatcacgtcaatgtgacaaatgatttattggtttcacgtttcaggatagtgactgactatgagtcccttatgctctgtcaacatctccttcctcattgccctgtaaataa

SEQ ID NO: 8439 - DNA, 402 bp, Mus musculus
  misc_feature (241)..(244): n is a, c, g, or t
  misc_feature (246)..(246): n is a, c, g, or t
  misc_feature (255)..(255): n is a, c, g, or t
  misc_feature (273)..(274): n is a, c, g, or t
  misc_feature (278)..(278): n is a, c, g, or t
  misc_feature (286)..(286): n is a, c, g, or t
  misc_feature (288)..(288): n is a, c, g, or t
  misc_feature (299)..(299): n is a, c, g, or t
  misc_feature (304)..(304): n is a, c, g, or t
  misc_feature (318)..(318): n is a, c, g, or t
  misc_feature (325)..(325): n is a, c, g, or t
  misc_feature (329)..(329): n is a, c, g, or t
  misc_feature (332)..(332): n is a, c, g, or t
  misc_feature (345)..(348): n is a, c, g, or t
  misc_feature (350)..(351): n is a, c, g, or t
tacatctcccgggtcggtgtagtggattgctttgacacctgcacgggggaagtggtccagtgtatcactttccccatcgaattcaaccaccggcccctgctctcgttccatcaggacaacatctttcgtgtacacagccaccggcagagcgtggaaatcaacttacagaagatcaaggccaacaagtcgacaacctcagtacctctgttgcccaacagttgtcccttggatgtatcccatnnnntntgctccatnggagacagcaaggtattnntatntgggggtntnaccacagccancgatntccagaccaaggantacaccntcantcntaatgcttacttnnnngnnccaaaagataggtgaatggcagacccttgcctgcccacctgaggcactgga

SEQ ID NO: 8440 - DNA, 529 bp, Mus musculus
  misc_feature (199)..(200): n is a, c, g, or t
  misc_feature (202)..(202): n is a, c, g, or t
  misc_feature (301)..(301): n is a, c, g, or t
  misc_feature (311)..(311): n is a, c, g, or t
  misc_feature (314)..(314): n is a, c, g, or t
  misc_feature (316)..(316): n is a, c, g, or t
  misc_feature (318)..(318): n is a, c, g, or t
  misc_feature (327)..(327): n is a, c, g, or t
  misc_feature (344)..(344): n is a, c, g, or t
  misc_feature (349)..(349): n is a, c, g, or t
  misc_feature (356)..(356): n is a, c, g, or t
  misc_feature (359)..(359): n is a, c, g, or t
  misc_feature (361)..(361): n is a, c, g, or t
  misc_feature (364)..(364): n is a, c, g, or t
  misc_feature (432)..(432): n is a, c, g, or t
  misc_feature (434)..(434): n is a, c, g, or t
  misc_feature (445)..(445): n is a, c, g, or t
  misc_feature (452)..(452): n is a, c, g, or t
ttcagccacgttcttcagtttatgtattatggaactatagaactaagtatgaacactgtacatgaaatccttcaggcagcaatgtatgttcagcttatagaagtggtgaaattctgctgctcctttctcttagccaaaatctgcttagaaaattgtgcggaaattatgagactgttagatgatttcggtgttaacatcnnanggagtcagggagaagctggatgccttcctgctagacaacttcgtgccactaatgtccaggcctgactttttgtcttatctgagcttcgagaagctcatntcttatttgnatnangnccatctgancaggtttccagaaattnagctntacgagnctntncantcttggctgcgacatgatagacgacggtggagacacacagataccatcattcagaacatcaggttttntntgatgactccntccagcntctttgagaagacatcgtaaaaacttggttgatggatatcctccatgctaaagcactcagctttagttaccagatct

SEQ ID NO: 8441 - DNA, 318 bp, Mus musculus
  misc_feature (279)..(279): n is a, c, g, or t
  misc_feature (286)..(286): n is a, c, g, or t
  misc_feature (291)..(291): n is a, c, g, or t
tgtttccacattgaatggcgacagccacatttcagagcatcctgcagaaaatcctttgagccttgcagaaaagagcagattgcatgaagagtgcattcagtcccccgtggtggaaacggtccccgtttagttgcttaaattattctattacaggaccaagtcttctatttaaggcactgtattgcctttgctgggctcatcgttgtttaaacctgaaggccaagagttatgtggactgtgattaatcttccagacagtatttccttccttcctttctancttcccnactgnggcgtggcacaaatacagtcgctatgg

SEQ ID NO: 8442 - DNA, 349 bp, Mus musculus
  misc_feature (200)..(200): n is a, c, g, or t
  misc_feature (212)..(212): n is a, c, g, or t
  misc_feature (218)..(218): n is a, c, g, or t
  misc_feature (227)..(227): n is a, c, g, or t
  misc_feature (272)..(272): n is a, c, g, or t
  misc_feature (304)..(304): n is a, c, g, or t
  misc_feature (310)..(310): n is a, c, g, or t
  misc_feature (312)..(312): n is a, c, g, or t
ttaccagcatctgcgcttccgcacaccgggaaggcgcccaattggaggtgcggccacggccggggcaggcggcacaacgccggtaaagggaagaaagggaaaggccggcccaagacctccgggaagaagcagaagctgaagaagcaggaagtggacatcatgagccccgcagccatgctgaacctgtattacattgctcncaatgttgcggnctgccntgtacctgngaggcttcccctggccaggggctcccaaagggaaaagggggaaanaataagatttaggtgatagaattcaaagcacnccttgntntcaaagaacagaaagtaggagaatgcatttaggataa

SEQ ID NO: 8443 - DNA, 406 bp, Mus musculus
  misc_feature (200)..(200): n is a, c, g, or t
  misc_feature (212)..(212): n is a, c, g, or t
  misc_feature (218)..(218): n is a, c, g, or t
  misc_feature (227)..(227): n is a, c, g, or t
  misc_feature (272)..(272): n is a, c, g, or t
  misc_feature (304)..(304): n is a, c, g, or t
  misc_feature (310)..(310): n is a, c, g, or t
  misc_feature (312)..(312): n is a, c, g, or t
  misc_feature (350)..(350): n is a, c, g, or t
  misc_feature (361)..(361): n is a, c, g, or t
  misc_feature (373)..(373): n is a, c, g, or t
  misc_feature (375)..(375): n is a, c, g, or t
ttaccagcatctgcgcttccgcacaccgggaaggcgcccaattggaggtgcggccacggccggggcaggcggcacaacgccggtaaagggaagaaagggaaaggccggcccaagacctccgggaagaagcagaagctgaagaagcaggaagtggacatcatgagccccgcagccatgctgaacctgtattacattgctcncaatgttgcggnctgccntgtacctgngaggcttcccctggccaggggctcccaaagggaaaagggggaaanaataagatttaggtgatagaattcaaagcacnccttgntntcaaagaacagaaagtaggagaatgcatttaggataantcaaggacttnggccaaacgggntntaaaagacaagcggaaacacagagccactgt

SEQ ID NO: 8444 - DNA, 506 bp, Mus musculus
  misc_feature (258)..(258): n is a, c, g, or t
  misc_feature (260)..(261): n is a, c, g, or t
  misc_feature (290)..(290): n is a, c, g, or t
  misc_feature (336)..(336): n is a, c, g, or t
  misc_feature (355)..(355): n is a, c, g, or t
  misc_feature (394)..(394): n is a, c, g, or t
gaatcctacagagcacttgagcccaacatgtgccaccccgaaagagtcctcaaggtcacttggttggctagccgacaaaggcagaggcttgactagggacctcctgtgtctgtggaagcccagtgtgcagccccatgggaattaagtgcccagagagacatgtgaccctggagaaatggcatgagactcggaatcacagatgagcttgtccccactgttagatcccaatacaagtggccatgggtcctcatggcgacngnngggttgttatggcttgtatctttccgtanccttcctcgagttggctttcacccctatattccagattctgcccantctagctgaatatacggtnttgttcctggttatgggaaccgagagtttgcctgggctntgagggctgtatcacttcccttccatcacggaaccggttctcagcctgtttcatttcctgctgaggtccttggatgtggcccccagctctgtttccactacacatttgtgag

SEQ ID NO: 8445 - DNA, 336 bp, Mus musculus
  misc_feature (104)..(104): n is a, c, g, or t
  misc_feature (123)..(123): n is a, c, g, or t
  misc_feature (125)..(125): n is a, c, g, or t
  misc_feature (174)..(174): n is a, c, g, or t
  misc_feature (203)..(203): n is a, c, g, or t
  misc_feature (210)..(210): n is a, c, g, or t
  misc_feature (224)..(224): n is a, c, g, or t
  misc_feature (232)..(232): n is a, c, g, or t
  misc_feature (240)..(240): n is a, c, g, or t
gctcccatctccaggacctgaaggacatcacccacaatgtacactacgagaactaccgggtactcagactcaatgagagccacgtgctgccccgggggccaggntgggtgaacctggctccantntcccctggacagctgatggcccctggaccgggaaaggtccgaaagcgancaaacaaggataccaaggacgaagagtgntgagggnccgtggcccaaacntgctaggntccttccntcctcagcagccagcgcccaacacaccctagagcatttatgtgaacctggacttgctttgtacaaaaagctgtgctttgacaactaaagggtttgt

SEQ ID NO: 8446 - DNA, 441 bp, Mus musculus
  misc_feature (40)..(40): n is a, c, g, or t
  misc_feature (60)..(60): n is a, c, g, or t
  misc_feature (65)..(65): n is a, c, g, or t
  misc_feature (80)..(80): n is a, c, g, or t
  misc_feature (94)..(94): n is a, c, g, or t
  misc_feature (103)..(103): n is a, c, g, or t
  misc_feature (111)..(111): n is a, c, g, or t
  misc_feature (114)..(114): n is a, c, g, or t
  misc_feature (117)..(117): n is a, c, g, or t
  misc_feature (131)..(131): n is a, c, g, or t
  misc_feature (151)..(151): n is a, c, g, or t
  misc_feature (154)..(154): n is a, c, g, or t
  misc_feature (163)..(163): n is a, c, g, or t
  misc_feature (176)..(176): n is a, c, g, or t
  misc_feature (210)..(210): n is a, c, g, or t
  misc_feature (264)..(264): n is a, c, g, or t
  misc_feature (279)..(279): n is a, c, g, or t
  misc_feature (320)..(320): n is a, c, g, or t
  misc_feature (337)..(337): n is a, c, g, or t
  misc_feature (339)..(339): n is a, c, g, or t
  misc_feature (354)..(354): n is a, c, g, or t
  misc_feature (377)..(377): n is a, c, g, or t
aaagctccagagtacatcacctcaaattatgactctgatnccatgagcagttcctatgantcatntgatgaagaggaagnggacgggaaggggnagaaaactnggcatcantgnccntcagaggaggcctntatggacctggtgaaagacnccnagatctgtnccttcctgctgcncaagaaacgctttggccagtggaccaagctgctntgcgtcatcaaagacaccaagctgctgtgctataaaagttccaaggaccagcancctcagatggagctnccgctgcagggctgcagtatcacatacatcccgagagacancaagaagaagaaacacnanctgaaaatcacccancaaggcacagaccctctggttcnagctgttcagagcaaggaacaggctgagcagtggttgaaggtaatcaaagaagcctacagtggc

SEQ ID NO: 8447 - DNA, 559 bp, Mus musculus
  misc_feature (269)..(269): n is a, c, g, or t
  misc_feature (303)..(303): n is a, c, g, or t
  misc_feature (310)..(310): n is a, c, g, or t
  misc_feature (315)..(315): n is a, c, g, or t
  misc_feature (322)..(322): n is a, c, g, or t
  misc_feature (324)..(324): n is a, c, g, or t
  misc_feature (344)..(344): n is a, c, g, or t
  misc_feature (349)..(349): n is a, c, g, or t
  misc_feature (357)..(357): n is a, c, g, or t
  misc_feature (373)..(373): n is a, c, g, or t
  misc_feature (380)..(380): n is a, c, g, or t
  misc_feature (394)..(394): n is a, c, g, or t
  misc_feature (396)..(396): n is a, c, g, or t
  misc_feature (409)..(409): n is a, c, g, or t
  misc_feature (417)..(418): n is a, c, g, or t
  misc_feature (426)..(426): n is a, c, g, or t
  misc_feature (430)..(430): n is a, c, g, or t
  misc_feature (462)..(462): n is a, c, g, or t
  misc_feature (465)..(465): n is a, c, g, or t
  misc_feature (530)..(530): n is a, c, g, or t
gggccagtgaactacctatttataatttttggagcgacctaactataagcaatattagtatgatgagaacagttacttcttaaattaataacaaactttgttttaaaatatgagttttctttttccaaaatacaaggtttcactaaccacctgggaagcttagagttttaaatataaactcagacatgcgctgtaacccagattaaagttttaaatatctactcagacatgcgttgcaacccagattctaggtaaaaacacctcccccnccaacctgagggaatatttattgcagactttttnttcagcnatatnagtgttnanatagaagttggacaattggntcttnaaacattnatttgtacaaagaatnatatatnaacgtgaagatttntnatttaatttactnaccacatnnacggtacnaatnatttagaagtcatactgtaattttgctcgaantcnaagggaggggagacattagtgtaagcattcagtattccacattttatgtgccactgtgtttgatntctggtgacgacacataaggaccaggcta

SEQ ID NO: 8448 - DNA, 385 bp, Mus musculus
  misc_feature (269)..(269): n is a, c, g, or t
  misc_feature (303)..(303): n is a, c, g, or t
  misc_feature (309)..(309): n is a, c, g, or t
  misc_feature (311)..(311): n is a, c, g, or t
  misc_feature (323)..(323): n is a, c, g, or t
  misc_feature (332)..(332): n is a, c, g, or t
  misc_feature (335)..(335): n is a, c, g, or t
ccgttttcctctctgtagctctcatccagctgattttcaacttatctgaccataagactaaaacccaccatcactggaagcggaaaatcgaagcaaaatacgttgaaaaggaatgtgctcaaaaggaaacatgtccagtgtgtactcgagataagagatgtatttggtgccgagaagaaaaggtttgcaaaaagtactgttttccatattctgattgtaaattcaattctatattttgggcaaactgtaatgttgacctgtttggaatngtgatgctgatactgattgtaatattagcactancattcntntggtattgcctngcctattanttntacatgcaacagcatatggccctttatgcaagacatggacaagttcccgt

SEQ ID NO: 8449 - DNA, 408 bp, Mus musculus
  misc_feature (305)..(305): n is a, c, g, or t
  misc_feature (307)..(307): n is a, c, g, or t
  misc_feature (333)..(333): n is a, c, g, or t
  misc_feature (344)..(344): n is a, c, g, or t
  misc_feature (347)..(347): n is a, c, g, or t
  misc_feature (349)..(349): n is a, c, g, or t
  misc_feature (371)..(371): n is a, c, g, or t
  misc_feature (375)..(375): n is a, c, g, or t
  misc_feature (377)..(378): n is a, c, g, or t
gtgctttgggtatgatatacaccatggattagaccttccagaaatagggcttgtaatggatggtgcaacttgtggccctggaaaatactgtaaaaatcaaagatgtgttcttcatcaaactttgaaatttaattgcaacattagttcatgtaacttcagaggggtgtgtaacaaccagggcaactgtcactgtgttcaaggttggcaaccaccaaaatgtttacaaagaggaaaaggtggtagtgtaaacagtggccctataactaaccctctgaagagatatcgagccaaaatacatgtgagtntnaacaagctattaattattttaggtgntcgcatttttnttntngtggctttgattatttttggtncacntnncaaaagcagtattacgtccagaagtgcccc

SEQ ID NO: 8450 - DNA, 347 bp, Mus musculus
  misc_feature (110)..(110): n is a, c, g, or t
  misc_feature (128)..(128): n is a, c, g, or t
  misc_feature (143)..(144): n is a, c, g, or t
  misc_feature (148)..(148): n is a, c, g, or t
  misc_feature (150)..(150): n is a, c, g, or t
  misc_feature (157)..(157): n is a, c, g, or t
  misc_feature (160)..(160): n is a, c, g, or t
  misc_feature (166)..(166): n is a, c, g, or t
  misc_feature (202)..(202): n is a, c, g, or t
  misc_feature (208)..(208): n is a, c, g, or t
  misc_feature (244)..(244): n is a, c, g, or t
  misc_feature (250)..(250): n is a, c, g, or t
  misc_feature (257)..(257): n is a, c, g, or t
  misc_feature (289)..(289): n is a, c, g, or t
  misc_feature (291)..(291): n is a, c, g, or t
  misc_feature (312)..(312): n is a, c, g, or t
gtttgcagaggcctagcctcatccctgccactcaccatttcccatctgttgggagcacttggctgtggtatcttcgatgctcaccgtcccgttgggcttgaggataaganccccagcctaggatgagntgccacccatagtgnnccgntnttcccanttntttcancacaatcaggaaaatacccacaggtgtgcccagagntccagntccaagttgacaatgaccaccaagcaagcacaagantccagntaatttntcagcgcattaggatgcaagaagacactttantntcagcagatgtcacaccatgntcttggactacccagcttttcaaaccatgagctta

SEQ ID NO: 8451 - DNA, 266 bp, Mus musculus
  misc_feature (27)..(27): n is a, c, g, or t
  misc_feature (36)..(36): n is a, c, g, or t
  misc_feature (40)..(40): n is a, c, g, or t
  misc_feature (43)..(43): n is a, c, g, or t
  misc_feature (53)..(53): n is a, c, g, or t
  misc_feature (82)..(82): n is a, c, g, or t
  misc_feature (117)..(117): n is a, c, g, or t
  misc_feature (119)..(119): n is a, c, g, or t
  misc_feature (138)..(138): n is a, c, g, or t
  misc_feature (162)..(162): n is a, c, g, or t
  misc_feature (172)..(172): n is a, c, g, or t
gacagcaaaacaggccatacaaactanttccacacngctnccnaggggaaaantattcgttcttcaagcatttggggaaggnccatgattcctgaggaagaagggagaagagaatgntntaagatggaaccaggtgtnccagaaaagacttgaagacacctntggagacatntgggagaatgcatggtaaaacggcagtgttagcaaacagtagctatcactactactgtggaatgaaagtgacgagaaaccattaaaaccctcat

SEQ ID NO: 8452 - DNA, 147 bp, Mus musculus
  misc_feature (42)..(42): n is a, c, g, or t
tacctggaacatcccaagacccaggaccctttccatgttttnttccaaaacgagtgcgaaagtggttttttcagtagagaccggtcacttcacccatacatgaaaaatgtttgggcattgttgattacactgtaataaaataccttg

SEQ ID NO: 8453 - DNA, 271 bp, Mus musculus
gaacaaccctttgtgacttaggagaacaacttgagcaacactggagggctgctcctgaaagatgctgcccctgtgttctggaaccaaagaaaacctgtatcctgctttggtggtttatctgtgtgcatcccatgggtgacttctgaggcatggcttacataccttgaagaactgcaaaactgaggagggggagctgcagcacactgattgtcacctttgagggactgaccaacgaggaggtgactggagtctgtagaccatgttcctcggg

SEQ ID NO: 8454 - DNA, 309 bp, Mus musculus
gttctacatctctctgatcaagtctcagcagtccgcagagaggagccagtctgaacctgccagcattcagactcatgccggacgggcagcctcaaaagcactcagttcaacccctgcagtgggtgactctccagaaaaccactctggctctgtggaaagctctccagggagcctaaagaaagaagatgtttctaatagccgtgctgaagccacggccaaggacaagagtcagggagccatagaccagctctctttcattttgtccccccagcaccagatttctcagaagctctacatccctcgaagtac

SEQ ID NO: 8455 - DNA, 459 bp, Mus musculus
  misc_feature (237)..(237): n is a, c, g, or t
  misc_feature (294)..(294): n is a, c, g, or t
  misc_feature (317)..(317): n is a, c, g, or t
agtcagctggaatctctcaaattagaaaatcatcgtctttctgaaacagtgatgaagctggaactgggcttgcatgagggctcgctgcccacctctcctctgggatcgatagctaccaggtttctggaagaggaggagctgaggtctcaccatattctagagcgcctggacgcccacattgaagaactgaaaagagagagtgagaagacggtgaggcagttcacagccctcgtgtanccctgcacagccacagacggaagactggattataaagttgtaatgaagcaatgctcncaagggcggcactgaggagtctngcagactgggcacttgggtattttcactgcgttgtgtggaggactgcttccataggaacttgtgagaataaaccgctttgcagacttttctcacatgaatgtttattaccacagagcaatgctttctctttccgacttacat

SEQ ID NO: 8456 - DNA, 420 bp, Mus musculus
  misc_feature (111)..(111): n is a, c, g, or t
  misc_feature (362)..(362): n is a, c, g, or t
  misc_feature (383)..(383): n is a, c, g, or t
  misc_feature (394)..(394): n is a, c, g, or t
gctcctctcggctgaatgtatctgttcaggcttcagcgttcctagccgagaagtgtcctggagcttggtgacatgtttgctgctttgtgtgctagaggctgcaaagcttangcatccgcaaacagaaacagggctttctgcccagcctgtgaaactcctggtgtgggtgctgggcctagctacagggcatcctcctgtgcctggcctccgttattcagcacgagctgccctataggctttgaggaaaccaaattgcacgtactgggttctcctccagcccttgggtatagggtctctgtgcacttgagccaggaacctagtcgcatctcttccacattccactcaaagcatgggtccctggntcccagccccagcctgcaagnccgccttggtntgagatgctgctatgtcaccaggact

SEQ ID NO: 8457 - DNA, 537 bp, Mus musculus
  misc_feature (26)..(26): n is a, c, g, or t
  misc_feature (277)..(278): n is a, c, g, or t
  misc_feature (391)..(391): n is a, c, g, or t
  misc_feature (424)..(424): n is a, c, g, or t
  misc_feature (446)..(446): n is a, c, g, or t
  misc_feature (450)..(450): n is a, c, g, or t
  misc_feature (455)..(455): n is a, c, g, or t
  misc_feature (492)..(492): n is a, c, g, or t
  misc_feature (512)..(512): n is a, c, g, or t
gctgaaagacatggaggcctcaaaangaggggaccagctgctatcagtgaacggagtgagtgtggaaggggagcaccatgagaaagctgtggaacttctcaaggctgctaaggacagtgtgaagctggtggtcagatacaccccaaaagtcctggaagagatggaggctcgtttcgagaagctgcggacagctcggcgtcgacagcagcagcagttgctcattcagcagcagcaacagcagcagcaacaacaaccacaacaaaaccacatgtcatanngcgctcgaaggaaagctagcaggtcaatcatccgccagtcacaaatttggaacccgtgctccggaatcccagcacacagaaaaagggaaagaaaacaccagtaatgacacccntcacaaagctgtgaacacatggtgtatccattngttaccaaggcaattcagtatnttcntcctntgggcaccagccccccattcattgcttttttacctantcagaccttttccatccatntcagtggaaactcgcagtgtattga

SEQ ID NO: 8458 - DNA, 337 bp, Mus musculus
  misc_feature (30)..(30): n is a, c, g, or t
  misc_feature (105)..(105): n is a, c, g, or t
  misc_feature (180)..(180): n is a, c, g, or t
  misc_feature (239)..(239): n is a, c, g, or t
  misc_feature (243)..(243): n is a, c, g, or t
  misc_feature (307)..(307): n is a, c, g, or t
atggattgtttttggatggagcttcctggnacaggaagaccaagaaacttgcagaatcacatcctaaagttctgtatgacacagtccccgtgatgtggctaaagnccatgcaaaaagtcagacatacccaaacgaccaagttatgttgctccactgtataagacaagcgagaggaggggnacactctccaccactggccactccacaaatttcgtgattgccatgattcttccctctgnccancccaaggaacactggattggacggggtgtggcactgctgtgtcaactaaactcataatctgaangtggcatcatctcttgcaacttcttgttag

SEQ ID NO: 8459 - DNA, 533 bp, Mus musculus
  misc_feature (45)..(45): n is a, c, g, or t
  misc_feature (60)..(60): n is a, c, g, or t
  misc_feature (120)..(120): n is a, c, g, or t
  misc_feature (158)..(158): n is a, c, g, or t
  misc_feature (199)..(199): n is a, c, g, or t
  misc_feature (228)..(228): n is a, c, g, or t
  misc_feature (295)..(295): n is a, c, g, or t
  misc_feature (299)..(299): n is a, c, g, or t
  misc_feature (366)..(366): n is a, c, g, or t
  misc_feature (385)..(385): n is a, c, g, or t
  misc_feature (445)..(445): n is a, c, g, or t
  misc_feature (460)..(460): n is a, c, g, or t
taacagagattgttccactgacacacagtgttgatcaaaggagcntgtacagacacaccntgtatgtgggtattgatatgaccaccgttagatcaatctgtaatctacggcagatagctnccaccaccacagggccctaaagggaacagcaatggagncaagcattgatcaggaaggaaaatgaatgtcaaaagcaaancaacaatcaaaatccctgtatgaacaaancggtaaatggtcacgtgatcgctgagaacgttttctattgtactaaaattgtgattataagaaatantccnaatgtttctggagaattttcagtgttgtatatagaaaatacagaatttcatggcgatattagaaatntaaatattgtacaatattntcatgtacaagcatacttaatgcacactttatcttttattgtacaaagaaatagtgtacnaaaatctttggtttntatggagtacacctaccagagactaccagtgtaaagtgataaataaaaatacaacctaaatgcttttctatga

SEQ ID NO: 8460 - DNA, 151 bp, Mus musculus
gttggcttttgtcatgccagagctcctactcaaagtggtggcaaggctttaagagggtcaaccactgagcttcaaaccttaaatatgcttggtaattaggtcccagcaatgatccctttagggcaaaagggattatgcaagagctcttctc

SEQ ID NO: 8461 - DNA, 570 bp, Mus musculus
  misc_feature (310)..(310): n is a, c, g, or t
  misc_feature (312)..(312): n is a, c, g, or t
  misc_feature (327)..(327): n is a, c, g, or t
  misc_feature (340)..(340): n is a, c, g, or t
  misc_feature (355)..(355): n is a, c, g, or t
  misc_feature (365)..(365): n is a, c, g, or t
  misc_feature (427)..(427): n is a, c, g, or t
  misc_feature (437)..(437): n is a, c, g, or t
  misc_feature (439)..(439): n is a, c, g, or t
  misc_feature (441)..(441): n is a, c, g, or t
  misc_feature (443)..(443): n is a, c, g, or t
agtcggaggaacagcttctcgcgcacatctgtgacatgagttgcattttgtcattgttcatgcttgtgtgcacgacaaactccatgcggctcctgacgtgtctgtcctttaacttaacagcagacactgtgcaatgcatgttttctcacttaaaaacatttttttggggggtgggggtggaaggaggtggggagggtctcactctgtagccctggctaacctggaactcactatgtagtctaggctagtcttcagttcagagatctgccgggtttgcttcaagcactgggattaaaggcgtgcaccaccnanaccctgctgttttcncactttttttttnttttttttttttttnaaggaaaggnaagaggaagggagagtggggggagcatgttggagtaacaagtcctgatatccccttcttggnccacccttancntntnttcctcaggtcctcaatcccatgttttcacactttttaacgttccttttacttagtgttagacaagtaaacttgatgttgattttccaaaagattgaacagaaacggagacccttaacttgtggcat

SEQ ID NO: 8462 - DNA, 547 bp, Mus musculus
  misc_feature (253)..(254): n is a, c, g, or t
  misc_feature (256)..(256): n is a, c, g, or t
  misc_feature (258)..(262): n is a, c, g, or t
  misc_feature (264)..(267): n is a, c, g, or t
  misc_feature (270)..(271): n is a, c, g, or t
  misc_feature (273)..(283): n is a, c, g, or t
  misc_feature (285)..(285): n is a, c, g, or t
  misc_feature (325)..(325): n is a, c, g, or t
  misc_feature (342)..(342): n is a, c, g, or t
  misc_feature (347)..(347): n is a, c, g, or t
  misc_feature (352)..(352): n is a, c, g, or t
  misc_feature (379)..(379): n is a, c, g, or t
  misc_feature (384)..(385): n is a, c, g, or t
  misc_feature (391)..(391): n is a, c, g, or t
  misc_feature (396)..(396): n is a, c, g, or t
  misc_feature (403)..(403): n is a, c, g, or t
  misc_feature (410)..(410): n is a, c, g, or t
  misc_feature (445)..(445): n is a, c, g, or t
  misc_feature (473)..(473): n is a, c, g, or t
  misc_feature (494)..(494): n is a, c, g, or t
tgcaaatcagggtgtctgccaggccctatcacctgctccaggaacccaagcctgacctggttattggatttaactccggctttggtctcaaagatacatggctgagctctctaccccggttacagtctctccgagtgccagcattcttcactgagagcagtgagtacggctgtgtgatggacgatcagactatggcggtggccaccggagggggcaccagctcgccacagcccaaccccttccgctccccatnncncnnnnnannnnctnncnnnnnnnnnnncnggtactgcaacgccttcatcttccatttggtctacaagcntccccaaggcggcacantccgntcggntcccggccctgcacctagacccccaantcccnntgcacntcctntcccggntcgaagncgccgaggagaaaagaaagctgcacgcgggccccnccggcgcagatgagagcggacttggcanccgtccattcccaagcatgcnccctaaaggaaaacattccaaggcccagggaagactgattgtcggaacacaaa

SEQ ID NO: 8463 - DNA, 350 bp, Mus musculus
  misc_feature (171)..(171): n is a, c, g, or t
  misc_feature (216)..(216): n is a, c, g, or t
  misc_feature (238)..(238): n is a, c, g, or t
  misc_feature (252)..(252): n is a, c, g, or t
  misc_feature (262)..(262): n is a, c, g, or t
  misc_feature (293)..(293): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (325)..(325): n is a, c, g, or t
tcatgaagtcttcaccctggactgtccctcacaaagaagtggcaatggccttttgggttagggctcagcacagcaatatttcccataggtctcagcaatctgttccggaggaattttcagccccgctggaactgttgcagcctctctcaggcctggtggatggtagggtantatttctctcccctcccccaccttccatagcaggtgcccttagangtccgctagggctaagccctanttctactcccaganctgcctcttngagagctggctatagccccattcccagtcancagtatttctttccacccttntctnttntctntttagactatgggctcagacccaag

SEQ ID NO: 8464 - DNA, 557 bp, Mus musculus
  misc_feature (300)..(300): n is a, c, g, or t
  misc_feature (310)..(310): n is a, c, g, or t
  misc_feature (317)..(317): n is a, c, g, or t
  misc_feature (320)..(320): n is a, c, g, or t
  misc_feature (344)..(344): n is a, c, g, or t
  misc_feature (353)..(353): n is a, c, g, or t
  misc_feature (436)..(436): n is a, c, g, or t
  misc_feature (461)..(461): n is a, c, g, or t
  misc_feature (466)..(466): n is a, c, g, or t
  misc_feature (471)..(471): n is a, c, g, or t
  misc_feature (474)..(474): n is a, c, g, or t
  misc_feature (489)..(489): n is a, c, g, or t
tatctgatttctttttctaagtggggattgtaatatttaaatattaatgcccgtgtttaaggttcatttagaatgcctcagtgaccttatttatttatttatttttgcccagcagccttatctagtgtgatataatgtattttaattagattgtttatgagctatgcattctgttactagaagcaaatgtgtccttttggatttggtatctgttccttaaataagaagtcataacagccagactgtgaaacaggcaaccagtcctctgcacagttgggggggtgggtattaccattaaantttgagcagntcgtttntgncccagaagaaaggaccttaggctnggctttatnaactattttcagattttaagtggagacaggataaaactctgttagatactcttgcgtgtattatgttccttctcagtgacttntccctttcttttgaacatgggtgancctanaaatnccnacgggtgtgaacctnttccagagcagagctgttgcaccagagtgaagatgttcagtgcgctcaagcgctgatgtgttcattat

SEQ ID NO: 8465 - DNA, 298 bp, Mus musculus
ctgtggtttgaagtcccagaggtgaaaaatagaagacagaacccagaacccaagcgttcttcagcctttaaaccctggataaaaaatggagtggctgtttcttttgttcccaagcctgggcctctgaacaaaagcatcgactacatgagcttcaatgtcttcaagaaggaaactgacccccatccctgtatccacacagacatgcatgctgtgttagagccccacatggaaagctctaagaagacccaggcctcctgtgacccctgtctaccccctgggcccaagactggagcctgtg

SEQ ID NO: 8466 - DNA, 353 bp, Mus musculus
  misc_feature (57)..(73): n is a, c, g, or t
  misc_feature (88)..(88): n is a, c, g, or t
  misc_feature (146)..(146): n is a, c, g, or t
  misc_feature (169)..(169): n is a, c, g, or t
  misc_feature (184)..(184): n is a, c, g, or t
  misc_feature (208)..(208): n is a, c, g, or t
  misc_feature (220)..(220): n is a, c, g, or t
  misc_feature (223)..(223): n is a, c, g, or t
  misc_feature (235)..(235): n is a, c, g, or t
  misc_feature (265)..(265): n is a, c, g, or t
  misc_feature (282)..(282): n is a, c, g, or t
  misc_feature (284)..(284): n is a, c, g, or t
gcccaggaacctctaaaaggcaccaacaggggagtatgtgctcatggtctgtgatgnnnnnnnnnnnnnnnnnctgggccacaggctncccaccaccttcaaacacctgcggatcttagccaagggggacacccactggccccatntccctgaagatcaccagaagctntaagctagcggctantcttggctgttggacataaagganccagcaataccntcntgggaaggccanccttccctgaatggagattgatgctgcttntcccagggaccacatcntntctattcctaaacaacctgagcgttaggactgcccacgtgagccccacagctactgacgtcaataaaat

SEQ ID NO: 8467 - DNA, 117 bp, Mus musculus
  misc_feature (32)..(32): n is a, c, g, or t
  misc_feature (57)..(57): n is a, c, g, or t
  misc_feature (67)..(67): n is a, c, g, or t
ctatgcttgaagtggcatcccctctgctgtanccccctcccccccgcccccccaaancccctgcagncctctaaactctaaagaggttcatctcatctcaagtaaagccagtcattc

SEQ ID NO: 8468 - DNA, 373 bp, Mus musculus
  misc_feature (35)..(35): n is a, c, g, or t
  misc_feature (332)..(332): n is a, c, g, or t
  misc_feature (337)..(337): n is a, c, g, or t
  misc_feature (342)..(342): n is a, c, g, or t
  misc_feature (348)..(348): n is a, c, g, or t
agcagccagactcaactaaaattcaaatttaaatncctgtaacccaggacactgatacaggttacagctggagccaggagatgtaaatcaagagtaggaaaatctcaaatataaactgaaatcttccaacatgttagtgatttcacaagcttctgagatctagttgtagagtacttcctgtttaatgtttaataggactaatatatttcagcaggtatttctgaggttagttagaactcctttcatacacacaaataagtctgttaccttattagaacttcgcccagatgtccagacagcgccccatctatgtactcttctgtatttgcaanctttngacanaaaganaggtattagtatagctgcacgggag

SEQ ID NO: 8469 - DNA, 523 bp, Mus musculus
  misc_feature (69)..(69): n is a, c, g, or t
  misc_feature (167)..(167): n is a, c, g, or t
  misc_feature (367)..(367): n is a, c, g, or t
  misc_feature (369)..(369): n is a, c, g, or t
  misc_feature (371)..(371): n is a, c, g, or t
aactcttacaccgtgctgtgtgagctggtggctgccgtatcaaaggattgcacatttggtggctggaancagcaatccactctttgctatgctggctatcgggagtcagacatcagtctcactgatgtgaatcaagctgtaagcagcatggctgtactgccgggggntctagggaaggctgccacaagtgtctcccaggttctgatggcccacttacccttggctagagtcatctgctgtccaagaagcagaacctgatgaataggttccacagggctctggtctagccaggaatgccggaagtgttaaaggccctagaagagaagtgaggaggtttgggaggcctgcgcaggacaggtagcagagntntnttcctgtgaatggtcagctacggcagcatcgatagcaacagccacagtggcagcaccagtggcaggtgccacagggtcggcagcgtgaacctggccagctaggcaggtccaaggtctagcgatgaatgtttcccaagtgtgacagctcagta

SEQ ID NO: 8470 - DNA, 550 bp, Mus musculus
  misc_feature (215)..(215): n is a, c, g, or t
  misc_feature (296)..(296): n is a, c, g, or t
  misc_feature (304)..(304): n is a, c, g, or t
  misc_feature (306)..(306): n is a, c, g, or t
  misc_feature (314)..(314): n is a, c, g, or t
  misc_feature (329)..(329): n is a, c, g, or t
  misc_feature (331)..(331): n is a, c, g, or t
  misc_feature (333)..(333): n is a, c, g, or t
  misc_feature (335)..(335): n is a, c, g, or t
  misc_feature (339)..(339): n is a, c, g, or t
  misc_feature (341)..(341): n is a, c, g, or t
  misc_feature (350)..(350): n is a, c, g, or t
  misc_feature (357)..(359): n is a, c, g, or t
  misc_feature (362)..(362): n is a, c, g, or t
  misc_feature (370)..(370): n is a, c, g, or t
  misc_feature (380)..(380): n is a, c, g, or t
  misc_feature (394)..(394): n is a, c, g, or t
  misc_feature (398)..(398): n is a, c, g, or t
  misc_feature (418)..(418): n is a, c, g, or t
  misc_feature (444)..(444): n is a, c, g, or t
  misc_feature (499)..(499): n is a, c, g, or t
tttcctgggaacactgtagctcagaaagccctgagagactttgggaaggtccccaaggagcaaccggggcacaggcatggtgcggcagataccatgcgcccccgcgtgcccgtatctccgcccaccaagcctgtaaaaactaagccgaagagagagtattgcgtcccaacagacccagtccagggacgccagctccaccccccagcaccggtctntaaagtgccaagtcccaggttccacaatcaggccgctgcttttgttgatcaaaagagatgcgtggcagaaagggccagacngccccagnantgtgaggntttacagcctcgccncntncncgtncncacagagantcagaannngcnccaaaatntcctgtggantcgagctgggaaanttcntcaggggacacccccctttnctgtagggactatgttggccgacatntcccggttatgtgaacagaaaattctggctcagaatttcagaggaaaagcttttntcccccagaaataatccacctcttaacagtactcagcaccctcaataaatg

SEQ ID NO: 8471 - DNA, 243 bp, Mus musculus
aatatggtttggatggcaacataaaagagaatgaagagataacatagaacagttgaaacataccccatatttaaaactatttacacaagtggggctggccaaatttaacatgttgtttcaataaaatattgagagtaaaaagatgagtatcatttcccctcaaagtttcaaatgttcatgtttacaaatttgtcctgcacattaatctgtaaacatacattatggtgagcagatgttcgggaa

SEQ ID NO: 8472 - DNA, 280 bp, Mus musculus
ttggcagcaggagtgagcagcaccagaggacaggagaaggtcacaagacagaaggggacaaggagtttcaaaaatcaaccagtcacagaggtgttggcgatgacaaggacaaaggcagcaagcgcaataggtggcacaaaggggtcagccatgtccccatcacaaaggagtcccggagctctcacaaactgtcccggaccatctccactgccagctctgcctctacgagcaagagggtgggcagaatcagcttgttcctgagaaacatcagagccagctt

SEQ ID NO: 8473 - DNA, 510 bp, Mus musculus
  misc_feature (223)..(223): n is a, c, g, or t
  misc_feature (242)..(242): n is a, c, g, or t
  misc_feature (261)..(261): n is a, c, g, or t
  misc_feature (265)..(266): n is a, c, g, or t
  misc_feature (285)..(285): n is a, c, g, or t
  misc_feature (301)..(301): n is a, c, g, or t
  misc_feature (312)..(312): n is a, c, g, or t
  misc_feature (341)..(341): n is a, c, g, or t
  misc_feature (353)..(353): n is a, c, g, or t
  misc_feature (358)..(358): n is a, c, g, or t
  misc_feature (364)..(364): n is a, c, g, or t
  misc_feature (366)..(366): n is a, c, g, or t
  misc_feature (382)..(382): n is a, c, g, or t
  misc_feature (385)..(385): n is a, c, g, or t
  misc_feature (387)..(387): n is a, c, g, or t
  misc_feature (403)..(403): n is a, c, g, or t
  misc_feature (423)..(423): n is a, c, g, or t
  misc_feature (425)..(425): n is a, c, g, or t
  misc_feature (436)..(436): n is a, c, g, or t
  misc_feature (441)..(441): n is a, c, g, or t
  misc_feature (444)..(444): n is a, c, g, or t
  misc_feature (451)..(451): n is a, c, g, or t
  misc_feature (453)..(453): n is a, c, g, or t
  misc_feature (472)..(472): n is a, c, g, or t
acaagaattgtgacagcattttccacaagaagaccttgtatccccaagttgtcccccttatccggaagaacatgatctgtaccaccaattatggggaggacttgtgctatggagaccccggggggccattggcttgtgagatcgatggcagatggattctggctggggtattctcatgggagaaggcctgcgccacagtaccgaatctaagtgtatacacccntatcaccaaatataccatntggatcaaggaccaagtgngccnnggggcgcagctggggcccntgcaggacctcctggnttcttctcctnccctggctgctgcagctcccagtgagccntatgacttcccntcccntcttcntnttcctgttttgcatgntgncntgtccatatcccacantcagggtggcaacggaatgntnccctggagaanttggntcntgctttntnatcctggcagggagggctntggtgggttactgggcctcgcttgactgaccaggagaa

SEQ ID NO: 8474 - DNA, 467 bp, Mus musculus
  misc_feature (297)..(297): n is a, c, g, or t
  misc_feature (309)..(309): n is a, c, g, or t
  misc_feature (316)..(316): n is a, c, g, or t
  misc_feature (320)..(320): n is a, c, g, or t
  misc_feature (340)..(340): n is a, c, g, or t
  misc_feature (347)..(347): n is a, c, g, or t
  misc_feature (349)..(349): n is a, c, g, or t
  misc_feature (353)..(353): n is a, c, g, or t
  misc_feature (388)..(388): n is a, c, g, or t
  misc_feature (393)..(393): n is a, c, g, or t
  misc_feature (398)..(398): n is a, c, g, or t
aagttggaggacgtcaccccagtgggctcaggggagaccatgcctgccgaggcggcacgtgcgttcttcctaccggacaaggtccttgtcgaagatgccatgaaactttttgattgtctccctggtggcactgagcctgaggtggccttgcacaggggtcctggccctggactgcgggacagtggtggcggtggggatgacttcccaaccgacattcgctccctgcacctgccagatgacctgctgtcctttgactacagtgtccccgagatcctagatgcggtggccaatgtggantactttttcagnttcaagncccntggatgatgaaccaccagtnccgcatntngggntccctgccactgacacagtggccccaggcctgcgntcccntcaantggggaaaaaacccagcatgcccaccaagaaagggaagccaggcagcagacacaggcagaccacaggcc

SEQ ID NO: 8475 - DNA, 386 bp, Mus musculus
  misc_feature (53)..(53): n is a, c, g, or t
  misc_feature (56)..(56): n is a, c, g, or t
  misc_feature (71)..(71): n is a, c, g, or t
  misc_feature (74)..(74): n is a, c, g, or t
  misc_feature (91)..(91): n is a, c, g, or t
  misc_feature (95)..(95): n is a, c, g, or t
  misc_feature (99)..(99): n is a, c, g, or t
  misc_feature (105)..(105): n is a, c, g, or t
  misc_feature (126)..(126): n is a, c, g, or t
  misc_feature (148)..(148): n is a, c, g, or t
  misc_feature (156)..(156): n is a, c, g, or t
  misc_feature (189)..(189): n is a, c, g, or t
  misc_feature (216)..(216): n is a, c, g, or t
  misc_feature (239)..(239): n is a, c, g, or t
  misc_feature (257)..(257): n is a, c, g, or t
  misc_feature (290)..(290): n is a, c, g, or t
agccgaatcaggttcaggccacgttcccctcaataattttttcactgactctnttntcactggagctaccnacngacacccatttgaaacnaagnccgnagtttnaaaggaggtcttccagtatcnctgttctgagaatgaaggccanggagcacncccccaatatttcatgggccatgtaacatacantactcttttatttttcttttcatagcnaagtaaaacattcttatttctcntatttaaaggataccacnataagctgctgtgtgtggaagggctaaaggtcnagatatacggtgagaccagcttacatgaatagttgttattatttaacatttaaatctaagaatggatccctgaaaggactaaataggtttaccatg

SEQ ID NO: 8476 - DNA, 296 bp, Mus musculus
  misc_feature (63)..(63): n is a, c, g, or t
  misc_feature (65)..(65): n is a, c, g, or t
  misc_feature (68)..(68): n is a, c, g, or t
  misc_feature (70)..(70): n is a, c, g, or t
  misc_feature (82)..(82): n is a, c, g, or t
  misc_feature (88)..(88): n is a, c, g, or t
  misc_feature (98)..(98): n is a, c, g, or t
  misc_feature (119)..(119): n is a, c, g, or t
  misc_feature (121)..(123): n is a, c, g, or t
  misc_feature (142)..(142): n is a, c, g, or t
  misc_feature (178)..(178): n is a, c, g, or t
  misc_feature (182)..(182): n is a, c, g, or t
  misc_feature (204)..(204): n is a, c, g, or t
  misc_feature (220)..(220): n is a, c, g, or t
  misc_feature (236)..(236): n is a, c, g, or t
  misc_feature (243)..(243): n is a, c, g, or t
cagccaaaacacacggatgtccactcctcattctggaagagccccctctggagggattcagcntnttntngtccgagccagntggaantccccagaangcaaagttgaccagaggcccntnnntgggagattcccagtcatncaggacaatgcaacagtcacgggggagtgagcagancccntggagtggagcaaggcaccatntcacatggagtgcgtntcagtgccctttcaantcagagntccatgcagctcaagtgcacagctgcccctgcccttaaagcagcaggcatagc

SEQ ID NO: 8477 - DNA, 182 bp, Mus musculus
  misc_feature (106)..(106): n is a, c, g, or t
  misc_feature (117)..(117): n is a, c, g, or t
  misc_feature (130)..(130): n is a, c, g, or t
  misc_feature (134)..(134): n is a, c, g, or t
  misc_feature (142)..(142): n is a, c, g, or t
  misc_feature (145)..(145): n is a, c, g, or t
  misc_feature (152)..(152): n is a, c, g, or t
  misc_feature (154)..(154): n is a, c, g, or t
atggatccaagagaagacaaagccctcaccaccacgtcgtcctaaacactgtaggccaggtcctccggggccccagcaccaacctcggcgcgttccagggaagggncccccagggantggagaggctgcngctntccaaganatncgaaggntncctgcatctgtggaaaagtccccaggag

SEQ ID NO: 8478 - DNA, 189 bp, Mus musculus
  misc_feature (32)..(32): n is a, c, g, or t
  misc_feature (47)..(47): n is a, c, g, or t
  misc_feature (52)..(52): n is a, c, g, or t
  misc_feature (55)..(55): n is a, c, g, or t
  misc_feature (65)..(65): n is a, c, g, or t
  misc_feature (71)..(71): n is a, c, g, or t
  misc_feature (101)..(101): n is a, c, g, or t
  misc_feature (104)..(104): n is a, c, g, or t
  misc_feature (110)..(110): n is a, c, g, or t
  misc_feature (112)..(112): n is a, c, g, or t
  misc_feature (114)..(114): n is a, c, g, or t
  misc_feature (116)..(116): n is a, c, g, or t
  misc_feature (126)..(126): n is a, c, g, or t
  misc_feature (132)..(132): n is a, c, g, or t
tttccccctggttgaggacagagccctgccantcgatggcaggaatntaagnttntccccctttntgcctntcagtttgaatcatccgcagctcagttggnttntgccantntntntcttgttccntcctgntcccagccaccttcccctcttgccgaagctcactcatcaaggcgcctgagttttgtt

SEQ ID NO: 8479 - DNA, 458 bp, Mus musculus
  misc_feature (27)..(29): n is a, c, g, or t
  misc_feature (31)..(31): n is a, c, g, or t
  misc_feature (36)..(36): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (49)..(50): n is a, c, g, or t
  misc_feature (56)..(57): n is a, c, g, or t
  misc_feature (62)..(62): n is a, c, g, or t
  misc_feature (65)..(65): n is a, c, g, or t
  misc_feature (68)..(69): n is a, c, g, or t
  misc_feature (72)..(72): n is a, c, g, or t
  misc_feature (80)..(80): n is a, c, g, or t
  misc_feature (82)..(82): n is a, c, g, or t
  misc_feature (85)..(85): n is a, c, g, or t
  misc_feature (88)..(88): n is a, c, g, or t
  misc_feature (99)..(99): n is a, c, g, or t
  misc_feature (105)..(105): n is a, c, g, or t
  misc_feature (298)..(298): n is a, c, g, or t
  misc_feature (300)..(300): n is a, c, g, or t
  misc_feature (331)..(331): n is a, c, g, or t
  misc_feature (342)..(342): n is a, c, g, or t
  misc_feature (344)..(344): n is a, c, g, or t
  misc_feature (346)..(346): n is a, c, g, or t
  misc_feature (349)..(349): n is a, c, g, or t
  misc_feature (420)..(420): n is a, c, g, or t
  misc_feature (422)..(422): n is a, c, g, or t
  misc_feature (424)..(424): n is a, c, g, or t
tggagtcgttcctctattgtccaaacnnncnaatanaaatantnanaanntgaggnntcacntgngcnnaanccatctcncnatnttntatgtgggganggaacnagagtggccttcggagaacacaaggcagtggctccactggtgcgttatctgaagtcaaatgacaccaatgtgcatcgagctacagctcaggccttgtaccagctctcagaagatgctgataactgcatcactatgcacgagaatggtgctgtaaagcttctactggatatggttgggtccccagaccaggatntncaggaagcagctgctggctgtatatccaatntccgaagactngntnttnctacagaaaaggctagatacaactgaaatgtgaacatacacaagctaccaaatgttctaaggatatacccntntnttgaccaggaagccagagttgagaagcatttaca

SEQ ID NO: 8480 - DNA, 498 bp, Mus musculus
  misc_feature (27)..(27): n is a, c, g, or t
  misc_feature (150)..(150): n is a, c, g, or t
  misc_feature (153)..(154): n is a, c, g, or t
  misc_feature (156)..(158): n is a, c, g, or t
  misc_feature (164)..(164): n is a, c, g, or t
  misc_feature (173)..(173): n is a, c, g, or t
  misc_feature (228)..(228): n is a, c, g, or t
  misc_feature (444)..(444): n is a, c, g, or t
tcccctgagactcctcgaggaggccgntcctccccacacccctcaccccctggacgcattgacagagggacagctgctcgggttctaatgctcctgctctctctctttcccctccaaccagttcaatctcatccctcccagcagctcccnctnncnnncccccncggggaacntgaagattgtcctggccgcgacctgagacctccatgagtggagggaagagtgatntatgtctcttccccccagcagctgggaccagtcctagccccgtccccaacccctttcccttggggagttgggggaattcctgccaagcaccttgaatgggaggggtccttcaagtgggccgggctggggtccaacgggggtgggggaggttcctgctctgccccagctgggtcctacccagtcttgtcctcccatcctctcatctattcccccccnccccctggagacggaagatcttttattttctattatttataacctcagacttgg

SEQ ID NO: 8481 - DNA, 512 bp, Mus musculus
  misc_feature (101)..(101): n is a, c, g, or t
  misc_feature (104)..(105): n is a, c, g, or t
  misc_feature (107)..(109): n is a, c, g, or t
  misc_feature (115)..(115): n is a, c, g, or t
  misc_feature (124)..(124): n is a, c, g, or t
  misc_feature (179)..(179): n is a, c, g, or t
  misc_feature (395)..(395): n is a, c, g, or t
ctggacgcattgacagagggacagctgctcgggttctaatgctcctgctctctctctttcccctccaaccagttcaatctcatccctcccagcagctcccnctnncnnncccccncggggaacntgaagattgtcctggccgcgacctgagacctccatgagtggagggaagagtgatntatgtctcttccccccagcagctgggaccagtcctagccccgtccccaacccctttcccttggggagttgggggaattcctgccaagcaccttgaatgggaggggtccttcaagtgggccgggctggggtccaacgggggtgggggaggttcctgctctgccccagctgggtcctacccagtcttgtcctcccatcctctcatctattcccccccnccccctggagacggaagatcttttattttctattatttataacctcagacttgggccccctgttcttctccattaacttgagtgttctgtgtgagaccaacagacagatgcctcaag

SEQ ID NO: 8482 - DNA, 399 bp, Mus musculus
  misc_feature (106)..(106): n is a, c, g, or t
tttccacctggcatagttcagcttaggtaggttgtttatgttcttgtcactgctccagcaatagatgaagacatcctacagctccacactactaagacacaagctntctacatttacttcagactcaagcccgagtggcatcttccttgtgtcccttctctgcaaggtaccagcttcacccattctccagaactttaaagaaaaaatgtacttgaacaatttctgatttctaggatgatctctactgccagttagatcttcttgaggtttccatgacatcatacaccagaggtccattcttggtcctttgctgccaactgctcattcttgacttagctctagccatttgtgacaaccacccttgtttccttacaaatcctcgcatgtaactttggtact

SEQ ID NO: 8483 - DNA, 549 bp, Mus musculus
  misc_feature (67)..(67): n is a, c, g, or t
  misc_feature (77)..(77): n is a, c, g, or t
  misc_feature (97)..(98): n is a, c, g, or t
  misc_feature (123)..(124): n is a, c, g, or t
  misc_feature (163)..(163): n is a, c, g, or t
  misc_feature (208)..(208): n is a, c, g, or t
  misc_feature (220)..(220): n is a, c, g, or t
  misc_feature (262)..(262): n is a, c, g, or t
  misc_feature (310)..(310): n is a, c, g, or t
  misc_feature (428)..(428): n is a, c, g, or t
  misc_feature (505)..(505): n is a, c, g, or t
gggagcgaccgagcgcacttcttgcccctggacctcgcctccctggcctccgtccgaggcttcgccngcgacttccnggcgctgggactccccctgnncacctgctcgtcaacaacgcgggcnngtgatgctggagccgcgggctgagactgaggacggcttngagcgccacctgggtgtgaacttcctgggccacttcctgctgacnctgctgctcctncccgccttgcgcgcgtcaggggccgaggggcggggctcgcgngtcgtcaccgtggggtcggccacacactacgtgggcaccgtggacatnggccgaccttcacgggcgccacgcctactccccgtacgcagcctacgcgcagagcaagctcgccctcgccctgttcgccctacagctgcagcgcatcctggacgcccgcggtgacccngtgacctccaacatggccgaccccggcgtggtcgacaccgagctgtaccggcacgcggggtgggtcttgcgcacggngaagcggttcctcgggtggctcgttttcaagagcccggaggagg

SEQ ID NO: 8484 - DNA, 221 bp, Mus musculus
gattctcctgtcttctgagttcagtgaggaggatggaggatatgaagttggctatagagagtgccctgaagcctgaagagcaggtgtgctggagggagccgggcactgctcggtggagacactcttctagctggaaggaggagctcattgcaccagcacactccgacttcaaggactgaaggctatcttttaaatgactccattcagagagtctgagtcat

SEQ ID NO: 8485 - DNA, 536 bp, Mus musculus
  misc_feature (343)..(343): n is a, c, g, or t
  misc_feature (351)..(351): n is a, c, g, or t
catgaatatgctgtgatcctcgtttgatggaattacgcaaggaaagaacgggaagaaaggatattttgctgcaagattaagttacagttctcagtggaagtcatttgtgatggggtctaattcttattacttcaacaaatattgttttgacttggggggcggggctataaccctatttttcattgactttactgagctctttaggatgatgactgattattcaaaacgtattataacactttcgtagcaaaaattaaccttttttttccagtcacagtatttgtgaaaagtaatgagccatagtacccattaatgttaaagaatattaaagcatggagaggancatgaggnacaatgaattccaacatatggctttagaacatcaggatgttcttgtattggatatagtatctagtattcaaaaatgcctgcatctcttatttattgtaagtttttaaatgtataaattgtcttatatttcttaacctcttttataaaaattttcctagaaggtttatactgccttcttgctttaa

SEQ ID NO: 8486 - DNA, 282 bp, Mus musculus
  misc_feature (113)..(113): n is a, c, g, or t
  misc_feature (125)..(125): n is a, c, g, or t
  misc_feature (201)..(201): n is a, c, g, or t
  misc_feature (207)..(207): n is a, c, g, or t
  misc_feature (224)..(224): n is a, c, g, or t
  misc_feature (228)..(228): n is a, c, g, or t
  misc_feature (241)..(241): n is a, c, g, or t
  misc_feature (247)..(247): n is a, c, g, or t
  misc_feature (253)..(253): n is a, c, g, or t
  misc_feature (257)..(257): n is a, c, g, or t
gacttttgtaaaaatatcctcgtagtagttacctctggtattcataccttttttttttttaatctgctgctcaattgtatatgagatcagccattagttttcatttctttttntgttcacagatntactcttcagctcttctcccttcccagaagaaagtgaatgtacaatttccagtgcagtgcagcgtaccaaatggangtcacnagctgacctccccaaancctntctgacactcgantcaganttattnttcntcctgtaaatgtgaaagtgcacctt

SEQ ID NO: 8487 - DNA, 306 bp, Mus musculus
  misc_feature (63)..(63): n is a, c, g, or t
  misc_feature (66)..(66): n is a, c, g, or t
  misc_feature (69)..(69): n is a, c, g, or t
  misc_feature (71)..(71): n is a, c, g, or t
  misc_feature (73)..(73): n is a, c, g, or t
  misc_feature (78)..(82): n is a, c, g, or t
  misc_feature (85)..(86): n is a, c, g, or t
  misc_feature (88)..(88): n is a, c, g, or t
  misc_feature (91)..(91): n is a, c, g, or t
  misc_feature (95)..(96): n is a, c, g, or t
  misc_feature (111)..(111): n is a, c, g, or t
  misc_feature (113)..(114): n is a, c, g, or t
  misc_feature (116)..(117): n is a, c, g, or t
  misc_feature (119)..(119): n is a, c, g, or t
  misc_feature (125)..(125): n is a, c, g, or t
  misc_feature (127)..(128): n is a, c, g, or t
  misc_feature (133)..(134): n is a, c, g, or t
  misc_feature (150)..(150): n is a, c, g, or t
  misc_feature (159)..(159): n is a, c, g, or t
  misc_feature (186)..(186): n is a, c, g, or t
  misc_feature (199)..(199): n is a, c, g, or t
  misc_feature (201)..(201): n is a, c, g, or t
  misc_feature (204)..(204): n is a, c, g, or t
  misc_feature (227)..(227): n is a, c, g, or t
  misc_feature (259)..(259): n is a, c, g, or t
gagcatccccacgaggcggctgcgctgtctcgggccgttactgtgggattgactgggttcgcnccntcntntntccgnnnnngcnntntgnagcnncctccacgaccccantnntnnangagaananngccgnncctcccggtaggctcngttgaaagnctggccagtaagaagcacgcctttaantccactttcccantnatntgggaagctgatgttggggactntccaccctgctgctttaggttaaaaaacgganccgtgcactaggcaagcagaagcaggatcttcacaagtttggggcca

SEQ ID NO: 8488 - DNA, 513 bp, Mus musculus
  misc_feature (241)..(241): n is a, c, g, or t
  misc_feature (249)..(249): n is a, c, g, or t
  misc_feature (252)..(252): n is a, c, g, or t
  misc_feature (284)..(284): n is a, c, g, or t
  misc_feature (308)..(308): n is a, c, g, or t
  misc_feature (349)..(349): n is a, c, g, or t
  misc_feature (351)..(351): n is a, c, g, or t
  misc_feature (373)..(373): n is a, c, g, or t
  misc_feature (425)..(425): n is a, c, g, or t
gtggacgacagcaacctggtgtatccacccaaggatggagtttgggttcggggcctgtacctggagggtgttggctgggaccgaaagaattcttgtttagtggaggcggagcccatgcagctggtctgcctcatgcccacgatccacttccgtccagcagagagccgaaagaaaagtgccaagggcatgtactcctgtccctgctattattatcccaaccgggcaggcagcacagatcgancctccttngtnataggcatcgatctccgatctggatccatganatctgatcactggattaagagggncactgctctactgatgagcctggacagctgatgagctcttntntcctccttgagagggtcggaanccctaggaccttgaactaaagctggatctcaggctttgactttagctgaatntagcatatagtgacactctgacagtacctagtggcgctagcggaaaaggtggaagacttgtattggcgctcagtgcagtaaaaaccgt

SEQ ID NO: 8489 - DNA, 475 bp, Mus musculus
  misc_feature (131)..(131): n is a, c, g, or t
  misc_feature (327)..(327): n is a, c, g, or t
  misc_feature (344)..(344): n is a, c, g, or t
  misc_feature (351)..(351): n is a, c, g, or t
  misc_feature (364)..(364): n is a, c, g, or t
  misc_feature (438)..(438): n is a, c, g, or t
ggaccaagccatgaatatcctctcactctcatgattatacgattctccttctttcgagtgtatcccagtatcctctgcgtgtttccaggggcaaaaccaaaaccaagcaacttacaaacatcatgaatganatatgtggagttggtgtcttttgaggacgtcactgtgaagttcacctgggaggagtggcagaatctcaacgacgctcagaagatgctgtacaggagtgtgatgctggagacatataatagcctgctgtcactggggcaatgcatccctaaacctgagttgatctttaaattggaacagggagaggagccatggacnagcagaagaacctgcanacaagantctgccagtattntgcagtgtggatggcataattgagaccaaccagaagagtcgagagagacatttgtggcaagttactgccagtgnccacaatagagaaactgagcaagcacgtggaccagaa

SEQ ID NO: 8490 - DNA, 253 bp, Mus musculus
  misc_feature (35)..(35): n is a, c, g, or t
  misc_feature (41)..(41): n is a, c, g, or t
  misc_feature (51)..(51): n is a, c, g, or t
  misc_feature (53)..(53): n is a, c, g, or t
  misc_feature (57)..(57): n is a, c, g, or t
  misc_feature (76)..(76): n is a, c, g, or t
  misc_feature (99)..(99): n is a, c, g, or t
  misc_feature (111)..(111): n is a, c, g, or t
  misc_feature (164)..(164): n is a, c, g, or t
  misc_feature (166)..(166): n is a, c, g, or t
  misc_feature (192)..(192): n is a, c, g, or t
  misc_feature (194)..(194): n is a, c, g, or t
  misc_feature (199)..(199): n is a, c, g, or t
  misc_feature (201)..(201): n is a, c, g, or t
  misc_feature (205)..(205): n is a, c, g, or t
  misc_feature (211)..(211): n is a, c, g, or t
  misc_feature (214)..(214): n is a, c, g, or t
tgtttccacactgctttgcaatgaagattcattantgtatnttaatgtttntntttntgggcctgttgttaaactnaggaagtgaagatattcccgaantcaacagtaccntggactgtaaaaatcaaacgctgtgtagttcggagaatacaaatggagactgntntgatgttcagaaagtggggctgtgtntnttacntnttantcaaantcntcagcaacagacctaaagaaattgggtacaaggaatgca

SEQ ID NO: 8491 - DNA, 467 bp, Mus musculus
  misc_feature (56)..(56): n is a, c, g, or t
  misc_feature (58)..(58): n is a, c, g, or t
  misc_feature (76)..(76): n is a, c, g, or t
  misc_feature (86)..(86): n is a, c, g, or t
  misc_feature (101)..(101): n is a, c, g, or t
  misc_feature (137)..(137): n is a, c, g, or t
  misc_feature (158)..(158): n is a, c, g, or t
  misc_feature (181)..(181): n is a, c, g, or t
  misc_feature (195)..(195): n is a, c, g, or t
  misc_feature (353)..(353): n is a, c, g, or t
  misc_feature (366)..(366): n is a, c, g, or t
  misc_feature (380)..(380): n is a, c, g, or t
  misc_feature (382)..(382): n is a, c, g, or t
  misc_feature (391)..(392): n is a, c, g, or t
  misc_feature (410)..(410): n is a, c, g, or t
  misc_feature (417)..(417): n is a, c, g, or t
  misc_feature (429)..(429): n is a, c, g, or t
  misc_feature (441)..(441): n is a, c, g, or t
aatcactgtgactttgtaaagctacgggaaatgcttatttgcacaaacatggaggntntacgggagcagacacatntgaggcactntgagctgtacaggcnctgcaaactgcaggagatgggctttgtagatatggncccagagaacaagcccctcantcttcaagagacgtatgaagccnaaagacacgagttntatggtgagcgtcagaggaaggaagagcagatgaagcagatgtttgtgcagcgggtcaaggagaaagaagccattctgaaggaagcggaaagagagcttcaggccaaatttgagcacctcaaaagaattcatcaggaagagagaatgaaacttgaagnaaagagaagaatnttggaggaagaatngnttgcttttnntaagaagaaagctacctntgagctnttcccgaaccantcatttttggcntcaggtagcagcattaggaaggacaa

SEQ ID NO: 8492 - DNA, 385 bp, Mus musculus
  misc_feature (39)..(39): n is a, c, g, or t
  misc_feature (111)..(111): n is a, c, g, or t
  misc_feature (198)..(198): n is a, c, g, or t
  misc_feature (200)..(200): n is a, c, g, or t
  misc_feature (274)..(274): n is a, c, g, or t
  misc_feature (360)..(360): n is a, c, g, or t
gataagcacggccaggctacagcgcagcagctggtgcanttgcttaacaagcagaatcagcttctcctggagcgacagaacctgtctgaggaagtggcccggctgcgagcncagttacccagcatgccacaatctgattgctgacctggatgaaacagagtgaaataaatgatttacaaagagatatttacattcatntnatttgtacttaatgtgccacagtgcaccgaaacctccccagggagacaccaccagggactgcagggggggctgntcctcatgccatggtctgtccctgtgctatggacagggagtgcttgcttcagcatcaactggctagggctcgttgggagtgtgtgntcagaacagcttcaagtcactgatt

SEQ ID NO: 8493 - DNA, 460 bp, Mus musculus
  misc_feature (354)..(354): n is a, c, g, or t
  misc_feature (367)..(367): n is a, c, g, or t
  misc_feature (381)..(381): n is a, c, g, or t
  misc_feature (387)..(387): n is a, c, g, or t
gtagcggattggacaaacgtatgtaaggattcagagtttgaacctgaggagaggaaggaaaaggggaattagattttacaatgtaacatacaaagaaatataactatgacccgaaggggagagaaacagcctcctctcagaatcgactggagctgcaaagagcaccatagagtcatgactcactatactgtgacagctgtcctcatcaccaagatccttttccctcctcaccctgaaatacgctactgagaagtgagctgaacagggtttccaactggaactgtatttaagaataagcaaatagactgaggtgaaaaaagaatgctaaataataaaggtaccatatataacatntcctagacatggntcaagtacttcagntcatantcaggagaaggtgtgacctgcagcagcaccgcaatcccctgaggaccttcagaggactttgattctgctcaat

SEQ ID NO: 8494 - DNA, 493 bp, Mus musculus
  misc_feature (42)..(42): n is a, c, g, or t
  misc_feature (75)..(75): n is a, c, g, or t
  misc_feature (130)..(130): n is a, c, g, or t
  misc_feature (144)..(144): n is a, c, g, or t
  misc_feature (152)..(152): n is a, c, g, or t
  misc_feature (162)..(162): n is a, c, g, or t
  misc_feature (254)..(254): n is a, c, g, or t
  misc_feature (258)..(258): n is a, c, g, or t
  misc_feature (267)..(267): n is a, c, g, or t
  misc_feature (298)..(298): n is a, c, g, or t
  misc_feature (335)..(335): n is a, c, g, or t
  misc_feature (337)..(337): n is a, c, g, or t
  misc_feature (356)..(356): n is a, c, g, or t
  misc_feature (370)..(370): n is a, c, g, or t
  misc_feature (443)..(443): n is a, c, g, or t
  misc_feature (448)..(448): n is a, c, g, or t
atatgcactgcgctgttaaggtcccagctaaaaatcagtggngaagaggccagattctcagaatggttacagacnaactggtagaggtcttgctttatgatgttggtgttgaactagtagtgaatattcnctgcttaagagaanttcaaganaatctaaagncaatgggaagattatctttggaatgttcacttgttgatataaggccaactggcggaagtgacaagtggacagcaacagcttgtgactgtctntcantgcacctcnctggagccatagcaaccataatcttacaggnaagcaacacaacgtggccattacctgtgaaaattttntnccgagatgaaaaaggagancgtgttgatgtttntaaatatttgattaaaaaaggtttggcattgagagagagaagggcctcctcctcctaagacattcccaagtantcatnttcattcaacagtcatttaagccagagcttgtcaatgttaccatg

SEQ ID NO: 8495 - DNA, 496 bp, Mus musculus
  misc_feature (297)..(298): n is a, c, g, or t
  misc_feature (328)..(328): n is a, c, g, or t
  misc_feature (336)..(336): n is a, c, g, or t
  misc_feature (346)..(346): n is a, c, g, or t
  misc_feature (376)..(376): n is a, c, g, or t
  misc_feature (391)..(391): n is a, c, g, or t
tgaccgttttgtctgaattcccaactcggctataattcaaagcgtttgccgtgaaggtttattccgcatcagtctccttaagctagccattcagattcaggattgtggcccaaaggactaatggagaatccaggttggctcacaatatgcacaagtaaaattcattctttgggttacgacttcaggcgctctgtcttctcgacacaaggaagaacgaagcaagtgctgtgtctgcccagatgtttacaactgccacgaagtcgtccagtgcaacctgcaagcaccccctcttccttnnttggctctagctacacaaccttagcttttnagatgagnacgatggttntccacgaatcctgactgacctagtgcattntcctcgggtgcaggntcattggagagtgaatgaggctaatacataaagtagtacctaaaagctctaatggaggactgcgtggcaactatcaatcacattaaacaggacccgtgcttctaa

SEQ ID NO: 8496 - DNA, 491 bp, Mus musculus
  misc_feature (31)..(31): n is a, c, g, or t
  misc_feature (33)..(33): n is a, c, g, or t
  misc_feature (38)..(38): n is a, c, g, or t
  misc_feature (41)..(41): n is a, c, g, or t
  misc_feature (47)..(47): n is a, c, g, or t
  misc_feature (49)..(49): n is a, c, g, or t
  misc_feature (52)..(52): n is a, c, g, or t
  misc_feature (95)..(95): n is a, c, g, or t
  misc_feature (97)..(97): n is a, c, g, or t
  misc_feature (106)..(106): n is a, c, g, or t
  misc_feature (108)..(108): n is a, c, g, or t
  misc_feature (110)..(110): n is a, c, g, or t
  misc_feature (125)..(126): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (148)..(148): n is a, c, g, or t
  misc_feature (150)..(150): n is a, c, g, or t
  misc_feature (153)..(153): n is a, c, g, or t
  misc_feature (157)..(157): n is a, c, g, or t
  misc_feature (159)..(159): n is a, c, g, or t
  misc_feature (163)..(163): n is a, c, g, or t
  misc_feature (175)..(175): n is a, c, g, or t
  misc_feature (265)..(265): n is a, c, g, or t
  misc_feature (278)..(279): n is a, c, g, or t
  misc_feature (281)..(281): n is a, c, g, or t
  misc_feature (288)..(288): n is a, c, g, or t
  misc_feature (319)..(319): n is a, c, g, or t
  misc_feature (329)..(329): n is a, c, g, or t
  misc_feature (342)..(342): n is a, c, g, or t
  misc_feature (376)..(376): n is a, c, g, or t
  misc_feature (459)..(459): n is a, c, g, or t
ctatgactctggaaacaaagccttttacaangngacanatnagtccntnatntacagcttccctccgacccctttccatgaagctctcagacctntnttttccccntntnttccgaatgaggggnngaatacagaccctnttntcntntnccncatntnaggnacatgccctganccttgagcaaagacaaggccaaggagcagcctagtcattaacgtggttactgtattcaaagacatcacatatcagattaccccgaacaanaaaaaaaaaaaanntnttccctntccccaaagactttccacaaacccagttgtncaatgaagancctactaaaaatntattcagcaccaagaatagaaagatgataccctncctttaacccagttgattatctgagctatgctgtgtgtgctggccacttaacaaacagcgttgtcactgtccattcttgcctntcaatctgtcataggccagttttataaataca

SEQ ID NO: 8497 - DNA, 332 bp, Mus musculus
  misc_feature (280)..(280): n is a, c, g, or t
acacttctggtactgagctctcgggcagggctgattcaggctagaaactttcagagtcctgaaccaggccttacagagctcagagagatggccagccttctcccctgctccgtggagactgccacccaggcttgaggaatcactgtacgctaaccaaagggaaaacctggcccttgaagaaaagctagagaacttgcctaccgtggtgtatgaggacctggagagcattatgatcatcccagaggaatccaggctcactcaggaaacagatgaagactcncaagtcaaagcagagggacattcaaaagaaagcaagggtcagccagcaagca

SEQ ID NO: 8498 - DNA, 488 bp, Mus musculus
  misc_feature (279)..(279): n is a, c, g, or t
  misc_feature (281)..(281): n is a, c, g, or t
  misc_feature (284)..(284): n is a, c, g, or t
  misc_feature (287)..(287): n is a, c, g, or t
  misc_feature (305)..(305): n is a, c, g, or t
  misc_feature (315)..(315): n is a, c, g, or t
  misc_feature (317)..(317): n is a, c, g, or t
  misc_feature (325)..(326): n is a, c, g, or t
  misc_feature (339)..(339): n is a, c, g, or t
  misc_feature (343)..(343): n is a, c, g, or t
  misc_feature (354)..(354): n is a, c, g, or t
  misc_feature (370)..(370): n is a, c, g, or t
  misc_feature (377)..(377): n is a, c, g, or t
ggagaaacccaatatctttaacaagtataagaaagcctttagtatgagaagacacgtgattgtataccaaagagtccaaaatgaagaggagccaaatgactgcagtgaatgtgggaaagttttctgtgtgagctcagccctcatcaaacatcagagcatacatacaggtgaaaagccatatgcatatgataagtatggggaagtcttcagtgtgatctcagcactcatcaaacatcagagaatccatactggagaaaagccatataagtggaagaaatntngcnaanccttctatgtgaactcantgcttattantnaccggagnnttcactctggagnaaanccatgtgagtntgggaatgtagaaaancattcantcagagtcaaaccgagtgatcaccagagaatccatactggagagaaatgctacgagtttgatgagtgtggggaaggtttccgaagatactctaaccttaccaaacaccaga

SEQ ID NO: 8499 - DNA, 366 bp, Mus musculus
aaataaacccattcagtgtgctaatgagagggagagagagcaagaacaagagccagagggagcagcaagagagagagagagaatcaaagcttcagtagactctgaaggactcacagagaggtgactgagctaatttcaccctcccatacccagttccacagtgcctgctagagtatggaaatgccccctcccatgctaagcacgattctagtttgtcagtggctgtattttctgtttcctgctgctttggagaacagaatgcattctttaggcgcaccgatgttgagtgactcaccgagtgctcacatctatatttccctgctgctgtgggattctccaaccaatcacctggccatatagtattta

SEQ ID NO: 8500 - DNA, 521 bp, Mus musculus
  misc_feature (249)..(249): n is a, c, g, or t
  misc_feature (256)..(256): n is a, c, g, or t
  misc_feature (277)..(277): n is a, c, g, or t
  misc_feature (294)..(294): n is a, c, g, or t
  misc_feature (307)..(307): n is a, c, g, or t
  misc_feature (310)..(310): n is a, c, g, or t
  misc_feature (330)..(330): n is a, c, g, or t
  misc_feature (341)..(341): n is a, c, g, or t
  misc_feature (358)..(358): n is a, c, g, or t
  misc_feature (379)..(379): n is a, c, g, or t
  misc_feature (480)..(480): n is a, c, g, or t
gagaacatttccataatgactctgtaatttaatgagaggtaataattaaactcctattatttgaaatataaattacatcattcttcctagtaaattttatccataattagtatatatatgtatatatgcatatatattagatatatatatcttaatttgaaaaaattttcaaagtggagcttagtaattgttcattaatatttattgttctttgtgtaattataatttatagaaaggtttgtaagttcnagatatngtattggaaagtgtgatggtnttttattatgaattatnaattgatatatgnatntgagtcaccttgtatgtgtnaaagaaatacnatatgctccaaatttcnatactgttacttatatgtttncatgacaatttttgtgaacacctaaatttgttacaaattgactggttctgcataaataataagatttgtataattctgatgagcatttgctcttgtatctnccaacttacaagtgtatgggatctcaggcattttttttctc

SEQ ID NO: 8501 - DNA, 573 bp, Mus musculus
  misc_feature (402)..(402): n is a, c, g, or t
  misc_feature (410)..(410): n is a, c, g, or t
  misc_feature (432)..(432): n is a, c, g, or t
  misc_feature (445)..(445): n is a, c, g, or t
gaaacacttgcaaagcggactcataaaaccgagaaatctggcttagtttccacaagtaaatcacttctgtaaggcagctagaaaactaggattttgttctataaagctgattctgtttctgcagtccacatactaattgttctgttaggatagcataaacatgcatagccccaaagggcttctttcctgtctaaggaatggcttgggattataacagaattatttctgactttaatcatgtatgctaaggtcccattgcctgcgtatcaggcagcaagagagggaagtgctcacctcccaatgtgaggaagctgagtgcagccagtctgtgctgggcacaaaacccaaggacttctaaagtgggaggactatgcagacacctaagatttgtttcagaagcanacggaatntctttgctgcttttacattctnttttgtaatattnttccttaacaccaaggactttgtgcagtgtgcacagtaaccgtcactgtgccagagtcatgctgccactgagacacagcagatgcacagcttcatgctgcctccgtctgtttcaccactgtttgtgat

SEQ ID NO: 8502 - DNA, 517 bp, Mus musculus
  misc_feature (265)..(265): n is a, c, g, or t
  misc_feature (269)..(269): n is a, c, g, or t
  misc_feature (271)..(271): n is a, c, g, or t
  misc_feature (290)..(290): n is a, c, g, or t
  misc_feature (292)..(292): n is a, c, g, or t
  misc_feature (311)..(311): n is a, c, g, or t
  misc_feature (313)..(313): n is a, c, g, or t
  misc_feature (322)..(322): n is a, c, g, or t
  misc_feature (356)..(356): n is a, c, g, or t
  misc_feature (377)..(377): n is a, c, g, or t
  misc_feature (409)..(409): n is a, c, g, or t
gatttgcagcatcaagtgcccgatatctgccttccagagcaaggcgtctttactggataaagaaaaccagcagttgcaggagaactgcctccggctcatgcagcaaattggcctcttggaacaaattataaggagcatccagattcgcagagaagaggaaacagtaattactgacaacgctgcatttgaaatactcaaaaagatactacctttacaaaactccagtttctcagggacaggcttcgtattgtcagctgaaaatctncagnanactgagctgcacaaatggnanggcgcagcagcaatccccnantcccccgancctctttcacgttcacaggattcagaaagtgganatataaatgtgacttctctanaagagacacacaacacacaaggggaccaaaanccagaactatgacctcactggtagctacaagactattcatgcctactaactcagagcctggatacaaaggtgcaaaccgagcaggagcagtctcacagaacaccctgg

SEQ ID NO: 8503 - DNA, 312 bp, Mus musculus
tgatgtgtccaccagaaacctcctgtcggacagtgaacccattggggaagagaaagaacatgaggaaaaaccagagtcagacagcccaccagggtctcccgcggttgaagagagaccaagggcaaagacacctgactggctcgtgaccatggagaatggctttaggtgtatggcctgctgcagggtcttcgccaccatggaaagcctccaagagcatgtgcagtatgggatcagggaaggcttcagctgccacgtcttccatctcaccatggctcagctgattggcagcatggaatcagagagcacccagga

SEQ ID NO: 8504 - DNA, 135 bp, Mus musculus
  misc_feature (44)..(44): n is a, c, g, or t
gatggaaaatttgtacttataggtctaacgttaatgactaatancctaatatatttagggaccaaatgtgtagtaggtggcatttaatttataaaccatctttattagttgcacattattaaacctgtatttttg

SEQ ID NO: 8505 - DNA, 164 bp, Mus musculus
  misc_feature (86)..(86): n is a, c, g, or t
  misc_feature (88)..(88): n is a, c, g, or t
  misc_feature (109)..(109): n is a, c, g, or t
gagggcaggctgagataaacagtttttagggtgatggtttgaattcatgttgggaacaataatttaactggtagttaggtgaattntntccccaaagggaaaaccttcntcctttcttgctacatccccttaaaagttggccaagtgtacttcactattatata

SEQ ID NO: 8506 - DNA, 124 bp, Mus musculus
  misc_feature (63)..(63): n is a, c, g, or t
  misc_feature (67)..(67): n is a, c, g, or t
taggagtcccgatcctgtaggcgacactgttcaggtgtatgtaaatgagtagcttgtttgaantttntgtacaggccgacatgcgtgtggccgacatgcctactgctgtcattttctgtgggtt

SEQ ID NO: 8507 - DNA, 107 bp, Mus musculus
gaaatttctgaagatgataccaccaacataatggaacatgttttttggtagttctgtattttaacccctgagggcgcttgttcaacattttacaggcattagctggg

SEQ ID NO: 8508 - DNA, 130 bp, Mus musculus
agacccaagcacccgaggccaggtgggccccgaccccttttttcccaggcccagcagcgcaagcgggacgggcccaacatggctgactattactatgatgtgaacctgtgatgggaaccccgcataaagc

SEQ ID NO: 8509 - DNA, 85 bp, Mus musculus
cgggagaagcccttgctgcggtttttttttaaaacgggattcagggcgaacctttaaagagttcatccaccatagtacataccca

SEQ ID NO: 8510 - DNA, 51 bp, Mus musculus
cacgcacactagacatgccatctaacgctactcactggattttgcagattt

SEQ ID NO: 8511 - DNA, 342 bp, Mus musculus
  misc_feature (101)..(101): n is a, c, g, or t
  misc_feature (109)..(109): n is a, c, g, or t
  misc_feature (112)..(112): n is a, c, g, or t
  misc_feature (118)..(118): n is a, c, g, or t
  misc_feature (138)..(138): n is a, c, g, or t
  misc_feature (151)..(151): n is a, c, g, or t
  misc_feature (166)..(166): n is a, c, g, or t
  misc_feature (173)..(174): n is a, c, g, or t
  misc_feature (201)..(201): n is a, c, g, or t
  misc_feature (203)..(203): n is a, c, g, or t
  misc_feature (312)..(312): n is a, c, g, or t
gaattctaatgactatctccacttgaaccctcagaactttcagattcattttgtgaaacatggaaagtatgaaatccgtggcaatcccacccttgagaacntgctatanttntcccanaaattccgttgcagctgttntgcccacctgaantgtcaggagagagcngacatannaagtgttagcactgtcagtgtgtgtantntggaagacatttgcatcaattcccttgtaatttcagacaaaagcgaactacccaaggactggaatcgcccttactttgttaatagcaatcagtcagatattacatcatntgccacagtgagtccatgtgtgccaagaaa

SEQ ID NO: 8512 - DNA, 517 bp, Mus musculus
  misc_feature (344)..(344): n is a, c, g, or t
  misc_feature (346)..(346): n is a, c, g, or t
  misc_feature (374)..(374): n is a, c, g, or t
  misc_feature (384)..(384): n is a, c, g, or t
  misc_feature (397)..(397): n is a, c, g, or t
  misc_feature (436)..(436): n is a, c, g, or t
gtatccaatggcacttctgctatggaaccgagccgccattcaagggaacgcttttgctagagtaaaaattggagattaccattactatggctacgggactaagaaggactacgaaacagcagccacacactacagcatcgcagcagacaagcatcacagtgcacaagcaatgttcaacctggcatatatgtatgaacatggcttgggtattgcaaaggacattcacttggccagaagattgtacgacatggctgctcagacaagcccagatgctcacatacctgtgttctttgcccttatgaaactggaaaccatgcatctgctccatgatatcctgttttttnantttaccatgaaatggaaatggctgaaantggacagcantgttggaccatantgggatttattggtgattggcctaattgttgccatgctnatcttcctgcttagaaatcgccataggtaggctttagaccatcagataacctacttataggttcatgccaagctatcctca

SEQ ID NO: 8513 - DNA, 569 bp, Mus musculus
  misc_feature (346)..(346): n is a, c, g, or t
  misc_feature (348)..(349): n is a, c, g, or t
  misc_feature (356)..(356): n is a, c, g, or t
  misc_feature (358)..(359): n is a, c, g, or t
  misc_feature (361)..(361): n is a, c, g, or t
  misc_feature (363)..(364): n is a, c, g, or t
  misc_feature (366)..(366): n is a, c, g, or t
  misc_feature (376)..(376): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (399)..(399): n is a, c, g, or t
  misc_feature (419)..(419): n is a, c, g, or t
  misc_feature (457)..(457): n is a, c, g, or t
  misc_feature (467)..(467): n is a, c, g, or t
  misc_feature (477)..(477): n is a, c, g, or t
  misc_feature (479)..(479): n is a, c, g, or t
  misc_feature (485)..(485): n is a, c, g, or t
  misc_feature (494)..(494): n is a, c, g, or t
tggaggccaaaagcttctgccagatgctgggtagccaagcaaccactgtgtcggacattttgaagagtcgagaccaagtggtctacacggccatccaatatggcatagacatcgtgaatcagcaagcgatgtctgactcacatagaatccgaaagtggatcatcttggagaaggacttttcgatccagggtggggagctgggaccgacatcaaaacttaagagaagtgtgataacccagaaatacaaagcacagattgacagcatgtacttgtcataatgactgtgacaggagcgtcctcctgtcctcatgcctccaacagatcagcctcatctcaatggagaacntnntccccancnngnanncnacacccccgntgntntgnttccaaagaaggcancccacagtagagacaacaanccttccaggcgtaagtggaaagtggaaagtggagtganttcatgcagntgtgactggntnttcctntcctaggantctgtattcgaaaagaggtgtgaacacccagagcccaaaacaccttcctgggagcagcatggaaacccctcaaat

SEQ ID NO: 8514 - DNA, 195 bp, Mus musculus
  misc_feature (26)..(26): n is a, c, g, or t
  misc_feature (67)..(67): n is a, c, g, or t
  misc_feature (69)..(69): n is a, c, g, or t
  misc_feature (72)..(72): n is a, c, g, or t
agattcaaaggattccttaccaaagnagagtgacacacagttgggtgaacaaaggaaggatcagatntnatntgatcaaagtaaaagagccaaatagaatttgtgaagtactttggaagcccctcaaccttcccagagtggatgggagcagaggaagattccacctcagcaaatatatggcattgcttgcaataa

SEQ ID NO: 8515 - DNA, 258 bp, Mus musculus
  misc_feature (29)..(29): n is a, c, g, or t
  misc_feature (33)..(33): n is a, c, g, or t
  misc_feature (114)..(114): n is a, c, g, or t
atattaaaattctattgggcttcaaaaangacntaataatcaattgacttatagagatacctaagggttttttcttctcacttacactttaccccttgctgtagggaatgtgtntattttaaaggcaccattacaaagtatatcttttatgatcacatttcttaaagtgttaagattctatgactcatttctatgtattttttttactttacaaaataacttgaaacagtatagattttgtaacacttaatttgagca

SEQ ID NO: 8516 - DNA, 441 bp, Mus musculus
  misc_feature (29)..(29): n is a, c, g, or t
  misc_feature (33)..(33): n is a, c, g, or t
  misc_feature (114)..(114): n is a, c, g, or t
  misc_feature (259)..(260): n is a, c, g, or t
  misc_feature (296)..(296): n is a, c, g, or t
  misc_feature (316)..(316): n is a, c, g, or t
  misc_feature (323)..(323): n is a, c, g, or t
  misc_feature (333)..(333): n is a, c, g, or t
  misc_feature (335)..(335): n is a, c, g, or t
  misc_feature (338)..(338): n is a, c, g, or t
  misc_feature (341)..(341): n is a, c, g, or t
  misc_feature (352)..(352): n is a, c, g, or t
  misc_feature (383)..(383): n is a, c, g, or t
atattaaaattctattgggcttcaaaaangacntaataatcaattgacttatagagatacctaagggttttttcttctcacttacactttaccccttgctgtagggaatgtgtntattttaaaggcaccattacaaagtatatcttttatgatcacatttcttaaagtgttaagattctatgactcatttctatgtattttttttactttacaaaataacttgaaacagtatagattttgtaacacttaatttgagcannctttttttttaatcacattgaattatatcaagtgcnatgctaccttaggaaaaatnatatttngctgcttcantnttnctncaaaacatttnctgtaatgaaggaatttgtatttccaatgtntcttgacggcattttataacatttactgctttcttcctaattctgctctaaagtattg

SEQ ID NO: 8517 - DNA, 405 bp, Mus musculus
  misc_feature (137)..(137): n is a, c, g, or t
  misc_feature (239)..(239): n is a, c, g, or t
attagccctgccctgaaaggacttccctaccccatcccccatgcctccaggtctaaccacaaacactcctcaccacgtgcctcagtttaccttggagacatccttctgtcaggctgagcaaagtaagaattttgaanaataaagctattttgagtattcagggagaaaaactctctggtactagtttctccgacttaacacagctgattatgtgcctgagtggggtttttttttttttnctgaagatatacatgaaaaaaatggtctctgatttcaatttcaaaaaggttatgagatgtggctcagttggaagagcgcttgcctggcacacttggagccctgtgttccatccccagctacacataaacctttatggtggtgcaagcctataaccccggtgcattg

SEQ ID NO: 8518 - DNA, 513 bp, Mus musculus
ttggcatttggaactcggagcacatgctgtggctggtagtaaaagccaagtttgccatgcctatagtctgtatatagaatgtcagctaaatgcttactgcactggtaccatagctactttggtaccaagtatatgactaagccaaaatcacttctatcattttgtgccaagatacactgctggtgcctgaaatggagcggtcagtgtttgggtgcctgctcttacaccactggggcagtgatgtgtgagaagtctaagtcacgtttcgtctgattgtgactcataacttgtagactagtcatgtgcatacagctgtttacatcccatgccacccactcttcatttatacaggcaaatgtctgaaccgtgtgcagctagctctattttaactgcttggcagccaggatatcccttgggaaaaaccacataagagccaaaccctggcctttccattttaaatatttttattcagtcccttctctggttcttttcctcttactctgattttccttt

SEQ ID NO: 8519 - DNA, 537 bp, Mus musculus
  misc_feature (383)..(383): n is a, c, g, or t
  misc_feature (387)..(387): n is a, c, g, or t
gggttaccctgatgaaaccaattcagagagcagaccaccacagcagagctgcgtcctgcaaaggggtgcacaggaagcggaggaaaacccagatgctgaccgtgagtttgatgatgagagcagtgaggacggtgaaaagcgagaccataaagtcaagtccagaggagaagacaccggcgcctccatgaaacaccccaagcatcacaagaatcgcgcccactcaagatcatctagtgaggaaagggggctcgggaccaagcaccactcacgaggttcccagtcaagaggacatgagcaccaggacaggcagtccagagaccaagagagctgtcacaaggaccgcagccaccgggaagaaaagagttctcataggcacagagagnccantcataaagatcactactggaagaagcatgagcaagaagataaactgaagggacgagaacaggaagaaagacaggacagagaagggaagagggaaaaatattcctcaagggaacaagaaagagatagacaacggaatgatcacgaccgata

SEQ ID NO: 8520 - DNA, 109 bp, Mus musculus
  misc_feature (32)..(32): n is a, c, g, or t
cgtaagtggccctgatgcgagtgaactgcttnatcggtgtcacacctgccacagcaaggcaaatcacttttcatttgtagaaaaactgttgtaaaagaatgggtatcca

SEQ ID NO: 8521 - DNA, 220 bp, Mus musculus
  misc_feature (75)..(75): n is a, c, g, or t
  misc_feature (112)..(112): n is a, c, g, or t
  misc_feature (116)..(116): n is a, c, g, or t
agtatttcacaatcttttcaaaggattctgatctctgacctcccatttccctcacactggctggtttttcaatanaaagtattcagaataggtccatttcatccagttgggnaaantggagagaagtaacacaaatatatttcactttgcataaagcaaggtcaaggaacttaaccctacattcccctccctacctcctgtgccatcaagtggagaaagg

SEQ ID NO: 8522 - DNA, 365 bp, Mus musculus
  misc_feature (97)..(98): n is a, c, g, or t
  misc_feature (103)..(103): n is a, c, g, or t
  misc_feature (143)..(143): n is a, c, g, or t
  misc_feature (154)..(154): n is a, c, g, or t
  misc_feature (156)..(156): n is a, c, g, or t
  misc_feature (171)..(171): n is a, c, g, or t
  misc_feature (177)..(177): n is a, c, g, or t
  misc_feature (190)..(190): n is a, c, g, or t
  misc_feature (192)..(192): n is a, c, g, or t
  misc_feature (197)..(197): n is a, c, g, or t
  misc_feature (215)..(215): n is a, c, g, or t
  misc_feature (223)..(223): n is a, c, g, or t
  misc_feature (228)..(228): n is a, c, g, or t
  misc_feature (230)..(230): n is a, c, g, or t
  misc_feature (235)..(235): n is a, c, g, or t
  misc_feature (237)..(237): n is a, c, g, or t
  misc_feature (285)..(285): n is a, c, g, or t
  misc_feature (321)..(321): n is a, c, g, or t
gtctgcatgtgatgactggctgcctccgtggactgaggttcagacgtgcctggaaacaaacctaaagctgccctacctaagaatcacatcccaagcnngactngaccctcatacctgtgaacccagacggtccagaaacaagnttaccagtgantntgggctcaggaacanggtgtntgtgcccttggtncnggggntattggattggcctaccnacatcctnaacantntccantntgcctgaatgatcctgagggtatcagaaagccctacactgttggtacntgggccccaacatactgtgaacggaaatgggccttntttcttttcctataggttatttgctgacagttctattaaacttg

SEQ ID NO: 8523 - DNA, 509 bp, Mus musculus
aagagtgaaacctgatccacgccttccttgttgttccaggttgttggaattagggatcctggggatgtgtggtggactgcggacctgagactgattgacagtaggactcccaagcgatcaatgcaaaggccttaggggatgccctgctaggcttgtcccaggtgatcttcccagactgccctgatgctacctgactcctggctgcctcttgcgggacccatcttcacctaccacccggtttctggtgtttccaccagcctgcttctgtccctggggatctggggttcagagattgtccaggagaggagtgacaagcgaattctaatgccacactattgtttaatgctcctgacttggaacaagaaaggctgctgatacttgtgttcttgcttagaacccaacttgtttaggtgtcacataaatgcggaggaaaagacacacagtcacacaccaaaaaatggctgcacagtgaatctatgaaattgctacatagcacttggttgatattt

SEQ ID NO: 8524 - DNA, 375 bp, Mus musculus
  misc_feature (161)..(161): n is a, c, g, or t
  misc_feature (163)..(164): n is a, c, g, or t
  misc_feature (170)..(170): n is a, c, g, or t
  misc_feature (187)..(188): n is a, c, g, or t
  misc_feature (211)..(211): n is a, c, g, or t
  misc_feature (213)..(213): n is a, c, g, or t
  misc_feature (310)..(310): n is a, c, g, or t
  misc_feature (328)..(328): n is a, c, g, or t
  misc_feature (330)..(331): n is a, c, g, or t
  misc_feature (334)..(334): n is a, c, g, or t
  misc_feature (341)..(341): n is a, c, g, or t
ttccgtgtgatctccaagcgccgtgcctagtttgctgtggcttccgcccgccccgccctggccctgcaagcctctccctgcgccttgatgccgcagggcgccttctgctgctgctggggcggtgggcggccaggcagctggaggagcccacgacgaggacnanngatgangaatgaagacgggaccnnagacgcccccagatcatggcgtntntgcggaaaccgacacatagacgaaggaccttgtatacagagctattttacagaaattgcgagtggcaccatggtattttttgtggagcctcaccctntcctgggcccgcaccccntnntcntcctcantccctgggcagacattcataagcccgttaccggt

SEQ ID NO: 8525 - DNA, 138 bp, Mus musculus
  misc_feature (28)..(28): n is a, c, g, or t
  misc_feature (48)..(48): n is a, c, g, or t
caggaacgatgtggaagggatataaatntcccccaggagggacccctntggaagtaaacaaagatgaccctggtgaaccaatgcagctgtgaagatcacccaactgcacagttcctgttgtaggtttcgcataaagta

SEQ ID NO: 8526 - DNA, 321 bp, Mus musculus
ctgtcctcaccctgttctcaaaagaaagagaagacactggagaagtcaacttctagagatgtgtctccttttgttgtgagtatgcagaagaataaatgggatgcctcaagatccttgagattcaaccaagatgcacaaagagaagatgatcagcggcggatgtctgaaattacagggcatctaataaaaatgagattgggtgatctggaccgagtcaaggcaaaggaatcaaaggaatttgcaggaggtatttattctaggcttgaagcacaagtcagagcctcagtacctgtcactgcccggcagaacagctcagacaaa

SEQ ID NO: 8527 - DNA, 538 bp, Mus musculus
  misc_feature (35)..(35): n is a, c, g, or t
  misc_feature (63)..(63): n is a, c, g, or t
  misc_feature (146)..(146): n is a, c, g, or t
  misc_feature (150)..(150): n is a, c, g, or t
  misc_feature (153)..(153): n is a, c, g, or t
  misc_feature (361)..(361): n is a, c, g, or t
  misc_feature (370)..(370): n is a, c, g, or t
  misc_feature (374)..(374): n is a, c, g, or t
  misc_feature (377)..(378): n is a, c, g, or t
  misc_feature (447)..(447): n is a, c, g, or t
  misc_feature (454)..(454): n is a, c, g, or t
  misc_feature (464)..(464): n is a, c, g, or t
gcagaccatcgtgagcctagaggaaaggctctgcnaagtgactcagtactaccagaagatagnaggggagatcacaacgttgaaaaacaacgatacaggaccgaaggaggaagcctcccaagaccttacagcaggaccccccctgnacantgntgacaaagaaatagcgtgcgaccatctgatagatgacttactaatggctcagaaggaaatcctatcccagcaggagataatcatgaagctgaggactgacctcggggaagctcacagccggatgtcagacctgagaggggaactaagcgagaagcagaagatggagctggagcggcaggtggccctggtgcgacagcagagcgggganctgagcatnctgnagnncgaaggtggcgcagacgactggcctgatggagaagaaggacagggaactgaaggtcctcagggaggcgntcaggtntgggaagggntccgtgtgacgtgaccaccccaaggccctggccctggcactggcacagagagggctcagtaaatgctggctgaa

SEQ ID NO: 8528 - DNA, 555 bp, Mus musculus
  misc_feature (73)..(73): n is a, c, g, or t
  misc_feature (93)..(94): n is a, c, g, or t
  misc_feature (101)..(101): n is a, c, g, or t
  misc_feature (114)..(114): n is a, c, g, or t
  misc_feature (116)..(116): n is a, c, g, or t
  misc_feature (118)..(118): n is a, c, g, or t
  misc_feature (121)..(121): n is a, c, g, or t
  misc_feature (160)..(160): n is a, c, g, or t
  misc_feature (167)..(167): n is a, c, g, or t
  misc_feature (183)..(183): n is a, c, g, or t
  misc_feature (189)..(189): n is a, c, g, or t
  misc_feature (191)..(193): n is a, c, g, or t
  misc_feature (195)..(205): n is a, c, g, or t
  misc_feature (207)..(207): n is a, c, g, or t
  misc_feature (267)..(267): n is a, c, g, or t
  misc_feature (270)..(272): n is a, c, g, or t
  misc_feature (275)..(275): n is a, c, g, or t
  misc_feature (325)..(325): n is a, c, g, or t
  misc_feature (333)..(333): n is a, c, g, or t
  misc_feature (339)..(339): n is a, c, g, or t
  misc_feature (350)..(350): n is a, c, g, or t
  misc_feature (360)..(360): n is a, c, g, or t
  misc_feature (393)..(393): n is a, c, g, or t
  misc_feature (440)..(440): n is a, c, g, or t
  misc_feature (502)..(502): n is a, c, g, or t
  misc_feature (515)..(515): n is a, c, g, or t
tggatcctttggaagcgcagcctgtgctcttaactgggcatccatctctccagttcctttttttttttttttntttttgcatttagttcaatnntggaaanaactgaatattangnancanttattatcttcttacaacttcctccaacactcctttaanaaatgtntgtttttcttctctanaaatanannnannnnnnnnnnnantcttttgttattttgagataagagtctctacttagccttgggtatcctggaactcactgnttnnnccnagttggcctggaaccaacttgcagaccagactgggcttgaactcacaganttctatanatcttnacaggcatttnggctacttgnattttatacagtttgaacaactgaattctatanataaatataatatttgatttataaataaatatatttataaatatatnaaatatacccaatgacttatgtttctattaaaagagagagaagctgggcatggtaacacatncctataatcctancatttgggatgcagatgcaggatgattgttgaaagttcaa

SEQ ID NO: 8529 - DNA, 425 bp, Mus musculus
  misc_feature (197)..(197): n is a, c, g, or t
  misc_feature (384)..(384): n is a, c, g, or t
acctctgaatgcttctgcactgaacccgacactactgcctcaacagccaaccacaagaccattgacctcttggtccaaattctctggaactgcctacattatttcatgcctctgagttttcccatatccaagaaggagctaggtgccatgaattcagaagaattactgtctctccctctgaaagagtgcttcaagcnatatgaagtcggactccagaatctctgccgctcctaccaaagatgtgctgactcacaagccaaggtctctgaggaaagcctgcgcatctcccagaaaaaactccaggaaacagaggagaaactccagaagctgaggaccaacattcagacgctcctgcaaatggctcagcagggcataaacatcagngcagatgatgagctagatgcctacattgaggatcttgtcag

SEQ ID NO: 8530 - DNA, 517 bp, Mus musculus
  misc_feature (261)..(261): n is a, c, g, or t
  misc_feature (264)..(264): n is a, c, g, or t
  misc_feature (266)..(266): n is a, c, g, or t
  misc_feature (271)..(271): n is a, c, g, or t
  misc_feature (275)..(275): n is a, c, g, or t
  misc_feature (278)..(278): n is a, c, g, or t
  misc_feature (298)..(298): n is a, c, g, or t
  misc_feature (313)..(313): n is a, c, g, or t
  misc_feature (323)..(323): n is a, c, g, or t
  misc_feature (331)..(331): n is a, c, g, or t
  misc_feature (336)..(336): n is a, c, g, or t
  misc_feature (343)..(343): n is a, c, g, or t
  misc_feature (352)..(352): n is a, c, g, or t
  misc_feature (359)..(359): n is a, c, g, or t
  misc_feature (392)..(392): n is a, c, g, or t
  misc_feature (410)..(410): n is a, c, g, or t
  misc_feature (432)..(432): n is a, c, g, or t
  misc_feature (434)..(434): n is a, c, g, or t
  misc_feature (437)..(437): n is a, c, g, or t
agagcagcaggcaaaggcccagactgaggcagagcagttccagagaaggagatggcatgccgaggaggcagaggagctgctccaagtgagcaagcgggtgctggcagagctggctgaacagaagagcaggcaggccaggagtcatgcgcacaagaccaccagggacagggcgcagcacctgcaggaggtgaacatcctgcgcgagaggaaccatcatattttgaagctgacagcggagaaggaggagaagtgtcacatcanggncntcaangaanccntcaagaagaaggaacaaagnttagcgcagatgacntcagggaaanatcccatnttccnaggagtntcagaaggntcccgcntcctccaagataaaccgctgctttgaccaggtngcagcagagccccagctntccgtgcacctgcagagtggantntantgagaacccaggaggaagaaggcacagcctggcagccagacagagacaccatcatgcaattccgctttataatccgattt

SEQ ID NO: 8531 - DNA, 364 bp, Mus musculus
  misc_feature (132)..(132): n is a, c, g, or t
  misc_feature (138)..(139): n is a, c, g, or t
  misc_feature (161)..(161): n is a, c, g, or t
  misc_feature (163)..(163): n is a, c, g, or t
  misc_feature (198)..(198): n is a, c, g, or t
  misc_feature (200)..(200): n is a, c, g, or t
  misc_feature (211)..(211): n is a, c, g, or t
  misc_feature (243)..(243): n is a, c, g, or t
  misc_feature (250)..(250): n is a, c, g, or t
  misc_feature (258)..(258): n is a, c, g, or t
  misc_feature (263)..(263): n is a, c, g, or t
  misc_feature (299)..(299): n is a, c, g, or t
  misc_feature (301)..(301): n is a, c, g, or t
  misc_feature (304)..(304): n is a, c, g, or t
  misc_feature (312)..(312): n is a, c, g, or t
  misc_feature (339)..(339): n is a, c, g, or t
gggagaccctgaacgctctcagaccagagtgctttctctataatttatctgctgtcgtaattcaccatggaaaaggatttggctcaggacactacactgcctactgctacaattccgaaggagggttctggntccacnncaacgattccaagctgagcatntncacgatggaagaagtacgcaaggcccaagcttatntnttattttatantcagcgagttactgagaatggacattcgaaantcttgcntcccgagntcctntccaatagccagcaccccagtaaggagactgatgcntnttntaatgaantccttagctgatccagacagtgggctntcgttatctgtatatatccttttta

SEQ ID NO: 8532 - DNA, 329 bp, Mus musculus
  misc_feature (41)..(41): n is a, c, g, or t
  misc_feature (50)..(50): n is a, c, g, or t
  misc_feature (58)..(58): n is a, c, g, or t
  misc_feature (62)..(62): n is a, c, g, or t
  misc_feature (65)..(65): n is a, c, g, or t
  misc_feature (74)..(74): n is a, c, g, or t
  misc_feature (78)..(78): n is a, c, g, or t
  misc_feature (104)..(104): n is a, c, g, or t
  misc_feature (111)..(111): n is a, c, g, or t
  misc_feature (136)..(136): n is a, c, g, or t
  misc_feature (149)..(149): n is a, c, g, or t
  misc_feature (233)..(233): n is a, c, g, or t
  misc_feature (236)..(236): n is a, c, g, or t
  misc_feature (259)..(259): n is a, c, g, or t
  misc_feature (303)..(303): n is a, c, g, or t
ggatgcaagttcagctccaagcaactcaatctctcaatgantaaaatccnagacaaantacnagncaaagcttnactnagcagaggtagcaggaaatgcaatgntggcagncaatgaggaaaacaacctggaatgnttaaaagacacantgagccacctgaccttccagtggtccttcacaattcaccaagagcagaaaagggacataaacacatggattttatacagcaatntcntccttacctccatataccataantcttacatttcccctaaaaatttcaatgagaatcaattgttttntctcgagttattaaaaatctgaccct

SEQ ID NO: 8533 - DNA, 428 bp, Mus musculus
  misc_feature (212)..(212): n is a, c, g, or t
  misc_feature (214)..(214): n is a, c, g, or t
  misc_feature (217)..(217): n is a, c, g, or t
  misc_feature (254)..(254): n is a, c, g, or t
  misc_feature (256)..(256): n is a, c, g, or t
  misc_feature (316)..(316): n is a, c, g, or t
  misc_feature (319)..(319): n is a, c, g, or t
  misc_feature (339)..(339): n is a, c, g, or t
  misc_feature (350)..(350): n is a, c, g, or t
  misc_feature (356)..(356): n is a, c, g, or t
  misc_feature (396)..(396): n is a, c, g, or t
ttcagcaatcaacccggaacacgcattgctttgtgctgtctcgggagagacagctctgtctgcgtgcagcacagtcccaagaaggactcctcgtgctgagcatgtgtggacctaagaagcaaggccagacctcatgtcccaacctcaagctcatgagcagcctgccagcccctgagccctgcctgtagagggcacatgggcaggggatacantntantccactgcccacaggtgaaggtggacaaaggtcaggntntggaaggttacgctgtatatgagagacccaaaatcctgctgcccaagtttctgtgcaagntcntcagccctgagtagccattntcctgcctgantttttnttccactgtgcacggaggccagtgtgtagggcctggcagntcaggaggggttttcctatgcaaaggcaataa

SEQ ID NO: 8534 - DNA, 443 bp, Mus musculus
  misc_feature (250)..(250): n is a, c, g, or t
  misc_feature (255)..(255): n is a, c, g, or t
  misc_feature (264)..(264): n is a, c, g, or t
  misc_feature (268)..(268): n is a, c, g, or t
  misc_feature (270)..(270): n is a, c, g, or t
  misc_feature (274)..(275): n is a, c, g, or t
  misc_feature (281)..(281): n is a, c, g, or t
  misc_feature (289)..(289): n is a, c, g, or t
  misc_feature (305)..(305): n is a, c, g, or t
  misc_feature (313)..(313): n is a, c, g, or t
  misc_feature (321)..(321): n is a, c, g, or t
  misc_feature (323)..(324): n is a, c, g, or t
  misc_feature (342)..(342): n is a, c, g, or t
  misc_feature (345)..(345): n is a, c, g, or t
  misc_feature (351)..(351): n is a, c, g, or t
  misc_feature (409)..(409): n is a, c, g, or t
  misc_feature (412)..(412): n is a, c, g, or t
tgaaggcaacgttgtttcccgagcagaggcaggtttgcacccgaagttgctaagcatcttcatctcccctccctgatcctgtttctctaggccactatgaaggcaggcaacttcatctcatcataaattcgttagactcacagaattcctcctctgctcaataacctacaacggttccacagaacctgagatgggcctctgggtccctccctcccccttttaactgcatccagtctcacagcatacaacnccatnaactctaangccntnaganncaggtnaagctccnagcatcccgggccgantcactccnataggggntnnacaccacagatgtttttnctnggaggnctgaagggttctgggggcctatagggagaggacctgctttccagcatggattgcagtnccntctcccgacactagactgaaggctcgcacat

SEQ ID NO: 8535 - DNA, 337 bp, Mus musculus
  misc_feature (212)..(212): n is a, c, g, or t
  misc_feature (272)..(272): n is a, c, g, or t
  misc_feature (292)..(292): n is a, c, g, or t
  misc_feature (310)..(310): n is a, c, g, or t
actgcttatcgctttggttcttcaaactcccagtctagagctccacctcagacacgcccagaaaagagaaagccacataattaccccaattctccctaaaacaataaggatccttggtaggtgactgcaaaatgcaggctgagtatcttggcaaatccctcctgccctacttggcatgacatctagactgggtacaagccaccggtcctggntctgtgacccctccacttgctgacttccttcttattggattctgggatcacatgcccatnatatgcccaggctatgtgantcaaggttggcagttgtntctgggttctgtcttcaggctttgcag

SEQ ID NO: 8536 - DNA, 419 bp, Mus musculus
  misc_feature (188)..(188): n is a, c, g, or t
  misc_feature (201)..(201): n is a, c, g, or t
  misc_feature (217)..(217): n is a, c, g, or t
  misc_feature (242)..(242): n is a, c, g, or t
ggaacttggtttgcactgtggagacttggcctgagctgtgttctgctgtgtgcacttctggtgggactgcttatcttcttctttatggcgttgttgggggtgatagccactaattctcaggattccttcttatctctctctgtgtgtgtgtgtgtgtgtgtgtgtgtgtgtggtttcatggaactctntgctctttctgtnctcacatctggatacnatagacgattatgaggattcaccanctcttttgtgtttaccttttctacatgttaagctctgcagtagctttgaaactgtaatttatttttgtatcacatgcactatattcagtgacttcctgttgtatgtattagaagcactgcagtgaactgtgagttgtctgtacactgaacaagaactctaggtatgacccattgcaa

SEQ ID NO: 8537 - DNA, 503 bp, Mus musculus
  misc_feature (251)..(251): n is a, c, g, or t
  misc_feature (255)..(255): n is a, c, g, or t
  misc_feature (260)..(260): n is a, c, g, or t
  misc_feature (267)..(267): n is a, c, g, or t
  misc_feature (282)..(282): n is a, c, g, or t
  misc_feature (285)..(285): n is a, c, g, or t
  misc_feature (346)..(346): n is a, c, g, or t
  misc_feature (356)..(356): n is a, c, g, or t
  misc_feature (378)..(378): n is a, c, g, or t
atattctggtattcagcctgctggctagtagaatcttacattaattgattctataaaaatctacatcccagcagccaaacgtgttcagctgagaaacaactgaacaattcactgcagaatcaaatggttccacacacaaaggaataaatagatggtaaaacaatagttagtttcacagaccatctggacaagctaacaggctgcatctgacgtccgtcaacctggccatcctagaagttcctagattgtantctnttggnacatccntgagaggataggatnaantcagactcatttttcaaaccaaattttaaatgtgtgcctacatggaagagcttttcctttntcagatattnaactatatcatgccacatttgnccaacaattcctaacaacatttatgagaattatgccaagaactgcaattcaactgactgcagcacataaattccccaggactgagttatcggtggaagtagagcgtcaatatcatgtcatagcat

SEQ ID NO: 8538 - DNA, 577 bp, Mus musculus
  misc_feature (62)..(62): n is a, c, g, or t
  misc_feature (64)..(64): n is a, c, g, or t
  misc_feature (70)..(70): n is a, c, g, or t
  misc_feature (72)..(73): n is a, c, g, or t
  misc_feature (86)..(86): n is a, c, g, or t
  misc_feature (104)..(104): n is a, c, g, or t
  misc_feature (148)..(148): n is a, c, g, or t
  misc_feature (155)..(155): n is a, c, g, or t
  misc_feature (164)..(164): n is a, c, g, or t
  misc_feature (178)..(178): n is a, c, g, or t
  misc_feature (180)..(180): n is a, c, g, or t
  misc_feature (198)..(198): n is a, c, g, or t
  misc_feature (366)..(366): n is a, c, g, or t
  misc_feature (376)..(376): n is a, c, g, or t
  misc_feature (454)..(454): n is a, c, g, or t
  misc_feature (487)..(487): n is a, c, g, or t
  misc_feature (501)..(501): n is a, c, g, or t
  misc_feature (504)..(504): n is a, c, g, or t
  misc_feature (512)..(512): n is a, c, g, or t
ggtttacagttttctcatcccagaggtacaaaaagactttgtcaaagagaaagtgaggaatncncagcgnanncacatcctggcancccatgagatcattcacngcaacaccgaaacgatgctggaggagcaagtctataaggaactncagtcanaggactttnagctagaggaggangnctgagagcctagactctnaggtgccaactgtctcagtctctaaaacatcaactataaaacctactcaggatgagggagaaggctaggtgagtctacctttccacccggaaggaagtcttggaggaggggaagcagctccattcagccttgggcactacttcaaccaagtgtggcatgagcggactntctgttgttnaaacagaacaacaacaacacaatgaaaacgaagcactttcactaaaactggctcacctcatctaggttagggtacctntcgttgagtttattagacagttagagttggctntattgaaacttaanctnttgcaatntaaaaaataagactattggttatttggggggaggtcattttagcctataatgtactccatcacaa

SEQ ID NO: 8539 - DNA, 347 bp, Mus musculus
  misc_feature (113)..(113): n is a, c, g, or t
  misc_feature (115)..(115): n is a, c, g, or t
  misc_feature (117)..(146): n is a, c, g, or t
  misc_feature (148)..(148): n is a, c, g, or t
  misc_feature (150)..(151): n is a, c, g, or t
  misc_feature (153)..(154): n is a, c, g, or t
  misc_feature (156)..(157): n is a, c, g, or t
  misc_feature (160)..(161): n is a, c, g, or t
  misc_feature (164)..(165): n is a, c, g, or t
  misc_feature (168)..(171): n is a, c, g, or t
  misc_feature (173)..(174): n is a, c, g, or t
  misc_feature (185)..(185): n is a, c, g, or t
  misc_feature (193)..(193): n is a, c, g, or t
  misc_feature (202)..(202): n is a, c, g, or t
  misc_feature (212)..(212): n is a, c, g, or t
  misc_feature (214)..(214): n is a, c, g, or t
  misc_feature (249)..(249): n is a, c, g, or t
  misc_feature (287)..(287): n is a, c, g, or t
  misc_feature (292)..(292): n is a, c, g, or t
  misc_feature (298)..(298): n is a, c, g, or t
  misc_feature (300)..(300): n is a, c, g, or t
  misc_feature (306)..(306): n is a, c, g, or t
  misc_feature (322)..(322): n is a, c, g, or t
gtggagttcttcaggagtttgaatcctacaggattgatgacaatgcctgttggggacttccggaaagccatgatccagcaaagcaatatccccatcaaccggtaccaggtgangnannnnnnnnnnnnnnnnnnnnnnnnnnnnnntntnntnnanntcnnttnnctnnnnanngaagatttgancaagacantggaacccnagcctgaggnantccagtccacgtgacaaggggacaatgttcaggantccgagttttttaaaagcctggaaatcacaacagccgntcagntctgantngaagtnccaatcaaagaagttntggcaagttgtgtggctatgagaag

SEQ ID NO: 8540 - DNA, 302 bp, Mus musculus
  misc_feature (58)..(58): n is a, c, g, or t
  misc_feature (67)..(67): n is a, c, g, or t
  misc_feature (71)..(71): n is a, c, g, or t
  misc_feature (73)..(74): n is a, c, g, or t
  misc_feature (138)..(138): n is a, c, g, or t
  misc_feature (145)..(145): n is a, c, g, or t
  misc_feature (147)..(147): n is a, c, g, or t
  misc_feature (152)..(152): n is a, c, g, or t
  misc_feature (160)..(160): n is a, c, g, or t
  misc_feature (167)..(167): n is a, c, g, or t
  misc_feature (183)..(183): n is a, c, g, or t
  misc_feature (186)..(186): n is a, c, g, or t
  misc_feature (200)..(200): n is a, c, g, or t
  misc_feature (225)..(225): n is a, c, g, or t
  misc_feature (259)..(259): n is a, c, g, or t
ccactgtgtaacatctgggaacttaaattactgcagttccgtttccccacacaaaatnttcccaggntgcntnntctgcagacccctgacaaccagcccctcaccagtgggatttcaaagccacctgagagcattccntagaatncntgctnttcaaggntcctttnttagcctcattttttntgntccagacagctgcntcagagacatttgtaaagggagcanccttgtagaccactaaaaaaccaggagtggtccntcccccacatgcaaagaccatacagcaccaataaactttgcag

SEQ ID NO: 8541 - DNA, 178 bp, Mus musculus
  misc_feature (38)..(38): n is a, c, g, or t
  misc_feature (80)..(80): n is a, c, g, or t
  misc_feature (123)..(123): n is a, c, g, or t
  misc_feature (133)..(133): n is a, c, g, or t
gaggaacatcctccttctctagctcaccacagccccanccctgtttttacccagaaaggattcaggatcaacattatgcnttctgaattggatgcatattcctaactactgtatttgttaccnaaagtggttntacaaatgctactgaaaaaaatctggaaattcctaatttcctgag

SEQ ID NO: 8542 - DNA, 179 bp, Mus musculus
  misc_feature (73)..(73): n is a, c, g, or t
  misc_feature (94)..(94): n is a, c, g, or t
  misc_feature (96)..(96): n is a, c, g, or t
  misc_feature (116)..(116): n is a, c, g, or t
ccaggtttcaagctttgagtatttctgcattgacagttgcaaccgattaattccattggatggtttcttgttntgaagttaaaatttcaaagtntntgatcctggcttaatgtcantcaagaacttacaaaagcaaagttaaaacctgcccttctaacaaactgcttatttaggctttt

SEQ ID NO: 8543 - DNA, 114 bp, Mus musculus
  misc_feature (33)..(33): n is a, c, g, or t
  misc_feature (46)..(46): n is a, c, g, or t
  misc_feature (59)..(59): n is a, c, g, or t
  misc_feature (75)..(75): n is a, c, g, or t
  misc_feature (79)..(79): n is a, c, g, or t
gggtaaaagcgtggactgactgcatcctaaatntcaaataccagantccggatcttcanccttgttaagggaacncctnttctgaacctgttgtgttctgtagagggcctcatt

SEQ ID NO: 8544 - DNA, 475 bp, Mus musculus
  misc_feature (414)..(414): n is a, c, g, or t
tgcctccaccttacttgagtgttaggggacagacacagcatgttcatggcccagtgggccacaggtgctctgggtacaactgcaagtcctttcctgagcccataagaaacaggaacccacagtaaactgaccatggtgcatagtggccccaggtaccctgtgactgatgggcctagtacagggtaaggctgcctcagtcatccttgccactccaatccaaggttgctgcagggctttgagctcaggaactgatagaaagccctacagactgggaccaccactcccacactagcccagacgggacacacctcccagttcccaccctcaacctacacagcttttttgacagcctggcctgtttgtttgtaacttgatgcagcatcgctctgtcttgtgatgacctctgtacttaangggtgcattgttctcttcccttggttcccccaaggcatctcacacattgttgctgccttta

SEQ ID NO: 8545 - DNA, 451 bp, Mus musculus
  misc_feature (184)..(188): n is a, c, g, or t
  misc_feature (190)..(194): n is a, c, g, or t
  misc_feature (196)..(197): n is a, c, g, or t
  misc_feature (199)..(204): n is a, c, g, or t
  misc_feature (206)..(208): n is a, c, g, or t
  misc_feature (210)..(210): n is a, c, g, or t
gaccgggactcagaggactacgcttacaatctgctggtagttgtccaggaaaagctgctgaaactgcaggaccaactggagagccaggacgtgcctgagttgctgcgacacatagcagaccgagagttcctggccacgctagaaggaaagctgcccctatacaacacccgcatccttctgcccnnnnncnnnnncnngnnnnnntnnntngatgaagaggagagtgaggatgatgaccgtgatgtggtgacccgcgctgccttcaagctccgttcccagaagttaatcgaagcccgcagcaagaagcgcaataggttgcgcagatcttagactcgcagtcaagtcctatcggatgcctccgggactctagggagccctccgaccctctgggtccacctacgggtggtgtgtgtctgggagccccggaggctccttcaagggcttggaggaa

SEQ ID NO: 8546 - DNA, 464 bp, Mus musculus
  misc_feature (163)..(163): n is a, c, g, or t
  misc_feature (217)..(217): n is a, c, g, or t
  misc_feature (230)..(230): n is a, c, g, or t
  misc_feature (295)..(295): n is a, c, g, or t
taaagtccagcctattacaaacaaacaaacaaacaaacaaacaaaggacctccatttggagaattgcaaggattttatcctgaattatagtgttggtgagttcaagtcatcacgccaagtgcttgccatcctggttgctattctaagaataattaggaggagnaacctagccaattgcagctcatgtccgtgggtgtgtgcacgggtgcatatgttngaaggggtgcctntccccttggggacagaaggaaaatgaaaggcccctctgctcaccctggccatttacgggaggctntgctggttccacggtgtctgtgcaggatcctgaaactgactcgctggacagaaacgagacttggcggcaccatgagaatggagagagagagagcaaagaaagaaacagcctttaaaagaactttctaagggtggtttttgaacctcgctggaccttgtatgtgtgcaca

SEQ ID NO: 8547 - DNA, 257 bp, Mus musculus
gtgagccacggagccacggagtcaacggagccacggagccacggtcatctctgccaaggccatctctgagtaggaccagagtgaacaactgtgcgtgttgtaagcctcccgggacgcatttgagatgactccggctgagtaagactagaacagaaactgttaactctttttacccaggagaaaaaggaacactacctgcagtcagaacacaggacctcctctggggtgtcaggaaactccacaacatcatccaaaaa

SEQ ID NO: 8548 - DNA, 202 bp, Mus musculus
cagggctcgggcagttgcttccagcctgggaccggcctcggcctctggcagagtgccccggggcctggacatgagtgcccaggagaccccacagggtcgaagattccccattgaggccggagactcccctggccttgcctccgcccccgagtcccaggatagcccggagcctgtagctacggatcaaaaccctgtcaggccg

SEQ ID NO: 8549 - DNA, 70 bp, Mus musculus
gggaaaatggctgtaaagccaactagcaggaatgctgtattgtttttccgaacaattgccacttgccggc

SEQ ID NO: 8550 - DNA, 486 bp, Mus musculus
  misc_feature (300)..(300): n is a, c, g, or t
  misc_feature (303)..(303): n is a, c, g, or t
  misc_feature (374)..(374): n is a, c, g, or t
  misc_feature (379)..(379): n is a, c, g, or t
  misc_feature (386)..(386): n is a, c, g, or t
  misc_feature (410)..(410): n is a, c, g, or t
  misc_feature (418)..(418): n is a, c, g, or t
  misc_feature (422)..(422): n is a, c, g, or t
  misc_feature (449)..(450): n is a, c, g, or t
  misc_feature (452)..(452): n is a, c, g, or t
ttttattgttagtgttctggtggctttctcaattcctgtagtgggagcaaagtggccttggacttcagggattagcgattttgatgattttttgagaccagctctttgagtagttgagacctaaggctttgactactttattgaataatgaaacctttcgttgtgtttaaaattagaggagggagccaggggaatattattcttttaggaagctataagatctggagataggtggaggatttagattctgtaagggttctcttggaagaagacagcattcatttgtacagggacataacnccnaaatgacattggggaagttatttcttttcaatatatttgatttttgtagagaggctatcttttattggagncagtnccttccnaatgcccctttaagacccctttanagcttcanggcnaaacctattcccagctagacattaatnntnttcatattcatacacttttcagtgagtcacttct

SEQ ID NO: 8551 - DNA, 309 bp, Mus musculus
  misc_feature (102)..(102): n is a, c, g, or t
  misc_feature (106)..(106): n is a, c, g, or t
  misc_feature (108)..(109): n is a, c, g, or t
  misc_feature (137)..(137): n is a, c, g, or t
  misc_feature (146)..(146): n is a, c, g, or t
  misc_feature (148)..(148): n is a, c, g, or t
  misc_feature (151)..(151): n is a, c, g, or t
  misc_feature (162)..(162): n is a, c, g, or t
  misc_feature (165)..(165): n is a, c, g, or t
  misc_feature (174)..(174): n is a, c, g, or t
  misc_feature (177)..(177): n is a, c, g, or t
  misc_feature (179)..(179): n is a, c, g, or t
  misc_feature (184)..(184): n is a, c, g, or t
  misc_feature (186)..(186): n is a, c, g, or t
  misc_feature (221)..(221): n is a, c, g, or t
  misc_feature (268)..(268): n is a, c, g, or t
gaactacaagtaggagttgccatatgccattttatatatacatattttttttccaaaaatgggttatcttttgtaaccagcaccaaatcaagaagaaatatnaccnanntccgagaagccacccatgagccctttcntgccagcantntcntcaagagggantcncagaatatntantntcttntntctagcttcctttgtttgaattacttaagcaagantcgggcttaatgtatataaagcttgcctatttattattattactgtntcctagtacattgtgaaaattgtccataatttgcttttctg

SEQ ID NO: 8552 - DNA, 481 bp, Mus musculus
  misc_feature (270)..(270): n is a, c, g, or t
  misc_feature (322)..(322): n is a, c, g, or t
  misc_feature (327)..(329): n is a, c, g, or t
  misc_feature (346)..(346): n is a, c, g, or t
  misc_feature (378)..(378): n is a, c, g, or t
gcccctgttgacagcatgcctgaaggcaagccaaaggcctctttggatgcagaagtccccaaactagaactgcctaccctggaagagaacgggatctgtgaggacagagattgtccggggccccctaggtcattgcctccaaagtccggcccaaacgccaagggtcaggctggcgatggacctggactggagtccgtagagctgcccctgcccctggagacagaacaccgcaacgcgatggagctggagaaggtgcgcatggagtttganctgacgctcctcaagtacctgcaccaggagaacgagcggcagaggcagcatnaggannntgatggagcagctgcancagcagcagcagcagcagcaggctttgcctcnccagttctcaggaagcctccaggacctcttgctcccccagaaccaattcgccatgttcttctactgcttcatcttcatccacatcatctacgttgccaaggag

SEQ ID NO: 8553 - DNA, 532 bp, Mus musculus
  misc_feature (134)..(134): n is a, c, g, or t
  misc_feature (282)..(282): n is a, c, g, or t
  misc_feature (284)..(284): n is a, c, g, or t
  misc_feature (341)..(341): n is a, c, g, or t
ctggcctgtgcctcttgggagcaaggcctgctggaggcaggcggggaactcagtcactgtccagcctacccctgcccaggctaagccttgctttcatgttgctcctctgcagaacggcatgtagcagctaacangggggccagttgcctttactctattttctatgatgaatacttgtggagaaactgtgacaaatccattgatcctaatattttttattgttggagtcttgtggcttctcgaaataatttctatttgattgtactgtgtagaattcatacncnctagggatatgttaataaagctaaaatgcatagtataatatagaatagcaaaaaaantttttgtgaacaatttatatagaagagtaagttgttttttaagtgttaggccatttcttttaggaacttaaaatgttataagagttttttaaacattcaatatttttaattataagagacatttgttactagagctaattatttcgggtgttctaattggaatattgatttttcttacctcatatacctct

SEQ ID NO: 8554 - DNA, 410 bp, Mus musculus
  misc_feature (343)..(343): n is a, c, g, or t
  misc_feature (348)..(348): n is a, c, g, or t
tagtattcgtagatggccaagccccgagtctgcggaccctgcagttctgacctctacacttcgcggagaacgaacaccataaagaaaccaacgggcagtccagttataggtggaaattggtcccacccggagtggagagagccggcttctgattggccagagaagtgcccctagaccctcattggaagaagtggccgcctctctttggcatagagctgtgaaggaagagctcagaaagagccatcttcgacagcctgggaattatttaaatgacttacacaatatattttttaaatcacacctttgcttgggacaccttatattagaagattgaagtacgggncctcnccttccaaaataaggatcaacatgctaaagatcaacaaataagggctcttggattcccttgc

SEQ ID NO: 8555 - DNA, 302 bp, Mus musculus
  misc_feature (56)..(56): n is a, c, g, or t
gaggaagcatataaggcccaaaatcagaaggacaaggaggaaaaggagaagattcnctttcaagaaattatgaagcaaagagaccggaaactgaccaaacaaaccaaaccctatgaaataattctgtcagaaaaagaaagtggctcagaaaagaaatgtgggttcttcgagctgaaacccagcaccgcaccaaatgctaagtgaactcggtgtagaagagttttcttagagtcagtctgcagccatttttaaaaaggagttgctattttggcacccattagtagtcacagcatagtcttaaa

SEQ ID NO: 8556 - DNA, 270 bp, Mus musculus
atttcaccttttatcacattcggagactttgggtggcaagaattgagaacaggagatggaagcgattaacaagagagctcaagaaagcttttgggcagctgcaagttcgagtattaaaagaaggggatgaagaagttaatccaaatgctgacagctgtgtcatctgctttgaagcctataagcctaatgaaatagttcggattctcacttgcaaacattttttccacaagaattgcattgacccctggattctagcccacggcacatgcc

SEQ ID NO: 8557 - DNA, 451 bp, Mus musculus
ggagggttagacacgtccagccactgagctagtcagagcatatcaaagttagatggtgtgtgtctctcattcacaaatcccgggaacacttggccagccgggagtcaggggtctaagcactacagggtttggaaaccagccaacactagaatctgcacttgtgactgagcaggggtacggacaacagctaacagtctacttgagctgcactgcggctcagaagatcacttcccggagaaaattcaccttggagtccgacatatctcacctttggaagctagaaacaacttctaatttccttcactggaacaatgggtaaaaagccctcttgtaagctagtgggggccaatcagaccaaatgtggcagaatgtagaacacctggttggtgggacgggaagtcaggatttattgggttgcggcttaattaatgctcagcacagactgactcct

SEQ ID NO: 8558 - DNA, 264 bp, Mus musculus
  misc_feature (68)..(68): n is a, c, g, or t
  misc_feature (79)..(79): n is a, c, g, or t
  misc_feature (122)..(122): n is a, c, g, or t
  misc_feature (150)..(150): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (163)..(163): n is a, c, g, or t
  misc_feature (174)..(174): n is a, c, g, or t
  misc_feature (188)..(188): n is a, c, g, or t
  misc_feature (192)..(192): n is a, c, g, or t
  misc_feature (229)..(229): n is a, c, g, or t
gaacccagctctcaactgtgttcatcaaactcctcagtgatccccatcgataggcccagcagctgtantgccgccttanccgagtgagctctagccaggatgcttggcaccgccagcccccntcacctcaagcatccacctagaatccancnangatntnatntccagctttantaatagtgaccttntggncaagatggaagattagagctttaattatgtaaagaancaaaaagtaattgcaataacgatttggaaacatga

SEQ ID NO: 8559 - DNA, 172 bp, Mus musculus
aggaggccatgagcataccaacattttttgagctctgctcagataacatgaagaaagcatgttcagagtgcttcacagctgtgtcccacacttccccctgtggtctgcagaacccagctctcaactgtgttcatcaaactcctcagtgatccccatcgataggcccagcagc

SEQ ID NO: 8560 - DNA, 118 bp, Mus musculus
aggaagcgctactggcccttctggagcaaggtctcatttcccagtgtgacattgaaggctaagtatgtcctgctctgctggagcggtctgctcccagccgtgatgatgaatgcaggaa

SEQ ID NO: 8561 - DNA, 464 bp, Mus musculus
  misc_feature (29)..(29): n is a, c, g, or t
  misc_feature (33)..(33): n is a, c, g, or t
  misc_feature (135)..(135): n is a, c, g, or t
  misc_feature (234)..(234): n is a, c, g, or t
  misc_feature (236)..(236): n is a, c, g, or t
  misc_feature (243)..(243): n is a, c, g, or t
  misc_feature (247)..(247): n is a, c, g, or t
  misc_feature (263)..(263): n is a, c, g, or t
  misc_feature (270)..(270): n is a, c, g, or t
  misc_feature (295)..(295): n is a, c, g, or t
  misc_feature (400)..(400): n is a, c, g, or t
tgttgcttaagatatttgacccctttttnttantaaaacctataaatgcatcacgctcttttcaggagacataagcccgactctctaaactcttggattcatctgattactgtaaatttccccctttcttctganagggagtgaagggccccagcaggctgaccattgcacacacagcggagcatagcagacatggcactgacaggttttgtcgtttacccctctcccccactnanctgttangctngatcctgaagctcacnaccaagntctggccccttattcagtcactgantcattcctgagaccgagcaccaaggtctagctatcagaattcagtatttcgactaacctaactaacataaccaaccagatcttaccagcacgttctcgctcactntaagacagagctccccctttcctcttacgattaacacctgcaaagctatttactgttgtttctg

SEQ ID NO: 8562 - DNA, 496 bp, Mus musculus
  misc_feature (289)..(289): n is a, c, g, or t
  misc_feature (330)..(330): n is a, c, g, or t
  misc_feature (333)..(333): n is a, c, g, or t
  misc_feature (344)..(344): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (368)..(368): n is a, c, g, or t
  misc_feature (390)..(390): n is a, c, g, or t
  misc_feature (392)..(392): n is a, c, g, or t
  misc_feature (399)..(399): n is a, c, g, or t
gagttaagcatctcgtgacacgaagaaccccgacagttctttattacgaagggatctctaggtacatggaagggcaagtcctccacttgcagaagcaaatagaagaacaggccgagaacgctcaggacagtggggtggagatactcaaggccttggagacccttgtggctcaaaataccaccggccccgtcttctacccgaggctctaccatctgatggcctatgtctgcatactaatgggagacgggcacagctgtgacttcttcctgaacacagccttggagctttntgagacacatgggaatttgctggagaaatgttggctaagcntgngcaaggaatgntgntantcagcntccgagttaacnggagatcaatggcttcagacantnttgattnttccatcatgggataaaattgtatcaggcaaggtaacccttcaggatgttcaaaagaacaagtacctgatgagagttaacattctggacaatccttt

SEQ ID NO: 8563 - DNA, 289 bp, Mus musculus
  misc_feature (68)..(68): n is a, c, g, or t
  misc_feature (72)..(72): n is a, c, g, or t
  misc_feature (81)..(81): n is a, c, g, or t
  misc_feature (95)..(95): n is a, c, g, or t
  misc_feature (110)..(110): n is a, c, g, or t
  misc_feature (116)..(116): n is a, c, g, or t
  misc_feature (124)..(124): n is a, c, g, or t
  misc_feature (129)..(129): n is a, c, g, or t
  misc_feature (163)..(163): n is a, c, g, or t
  misc_feature (203)..(203): n is a, c, g, or t
  misc_feature (220)..(220): n is a, c, g, or t
  misc_feature (230)..(230): n is a, c, g, or t
taccccaagaccaacgtgccgaggtggatggaggaagtttcacaaggtaccactcctgaagtgctacnagcnagcagtgtntgctgagagaaagnatccattttctctgngacagntccccganacccnatcccaagtggtcaatacactctgtaggtcatgngtaggtgtgaatgtgtatgtatgcatgtataaaacaacanttctagaggagattatncactttggantcatagatacaggaggagctggagagggaagaaggaggcatgggaatgaggtaaataca

SEQ ID NO: 8564 - DNA, 309 bp, Mus musculus
tggccggtagcatttccacaggcggtaggcaaggaagaccagtgcaagcagccccagcaccaagctgccaatccataggacgacggtggaggctgaaagagtaggaagagaaaggctgccatcagtcccagtgcctgtgggctccacagagggaacatacataggcccttacagtttaaaagtggacttaactagccagcctctacttgggtagaaaacagccacccaaccagacatactcaaagacagcatggaagaatgaatctacttaaagggaagcttttgtttctaaattacggtctcactctg

SEQ ID NO: 8565 - DNA, 334 bp, Mus musculus
  misc_feature (67)..(68): n is a, c, g, or t
  misc_feature (73)..(75): n is a, c, g, or t
  misc_feature (78)..(78): n is a, c, g, or t
  misc_feature (80)..(80): n is a, c, g, or t
  misc_feature (82)..(83): n is a, c, g, or t
  misc_feature (88)..(88): n is a, c, g, or t
  misc_feature (94)..(94): n is a, c, g, or t
  misc_feature (105)..(106): n is a, c, g, or t
  misc_feature (143)..(143): n is a, c, g, or t
  misc_feature (214)..(214): n is a, c, g, or t
aagaaaccatctgcggatcaaccactgtacagcagcagcctgtggggcccagcagttgaaggctgcnnctgtnnngtngntnngggcntgtggntgccgcaactnnaagtaggggactggctggtctttgacaacatgggtgnttacaccgtggacacaaagtccctccttggggggacccaggcccgcagagtcacttatgccatgtcccggntagcctgggaagcgcttcgagggcagctgttgcctgcagaagaagaccaggacgccgagggtgtgtgcaaacctctgtcctgcggctgggagatcacagacaccttgtgtgtgggccctg

SEQ ID NO: 8566 - DNA, 403 bp, Mus musculus
  misc_feature (225)..(225): n is a, c, g, or t
  misc_feature (235)..(235): n is a, c, g, or t
  misc_feature (276)..(276): n is a, c, g, or t
  misc_feature (287)..(287): n is a, c, g, or t
  misc_feature (289)..(289): n is a, c, g, or t
  misc_feature (292)..(292): n is a, c, g, or t
  misc_feature (294)..(294): n is a, c, g, or t
  misc_feature (319)..(319): n is a, c, g, or t
  misc_feature (327)..(327): n is a, c, g, or t
  misc_feature (329)..(329): n is a, c, g, or t
  misc_feature (349)..(349): n is a, c, g, or t
  misc_feature (354)..(354): n is a, c, g, or t
  misc_feature (364)..(364): n is a, c, g, or t
cattgccattttggttggagccctccaaagtgcaaagaagagggacacagtgggagcatagacagtgggtcccctccggttcaaaggcgcataataaaacagaacctagagccagtagtgtatttaagaatactctttggtcgtatttacttcctctttgttgcactgctctttggcattgccactcgtgtaggagttactaagatatttaggtttgaagacttncaagctgctntacgttcttggcaagaacaagcaaaggacaagtaaaatganttagccccctntntcntntaagataaagagaatggaaaaaaantctgaatntnattaggggacaaggtagaantccantccacagttntggatggcctttgtttatatcatgggacataagacgtgt

SEQ ID NO: 8567 - DNA, 483 bp, Mus musculus
  misc_feature (148)..(148): n is a, c, g, or t
  misc_feature (188)..(188): n is a, c, g, or t
  misc_feature (217)..(217): n is a, c, g, or t
  misc_feature (258)..(258): n is a, c, g, or t
  misc_feature (273)..(273): n is a, c, g, or t
  misc_feature (294)..(294): n is a, c, g, or t
  misc_feature (337)..(337): n is a, c, g, or t
  misc_feature (348)..(348): n is a, c, g, or t
  misc_feature (353)..(353): n is a, c, g, or t
  misc_feature (366)..(366): n is a, c, g, or t
  misc_feature (387)..(387): n is a, c, g, or t
  misc_feature (431)..(431): n is a, c, g, or t
ggtctggccgtaaccatcgtgagaagattggggtccatgtcatctttgaccaggtattaaccatggaaccttactgctgcagggacatgctctcctctcttgacaaagagacctttgcctatgatctctccgcagtggtcatgcatcncgggaaagggtttggctcaggacactacacagcctattgntacaacacagagggaggtttttgggtccnctgcaatgactcaaagctggatgtatgcagtgtcgaggaangtgtgcaaaacccanggcctacattcttttttacanctcgaagaacagttcagggcagcgcaaaactctcagaaccccntctccaagctnaggtncactccagcagcnaggacgaacgcagaacatacncattgccctgactgggaggcaagcatcaaaacggcctccaggtntcctcttgggcttgccaggaacagatccctgggtttgcctcactggtctagg

SEQ ID NO: 8568 - DNA, 429 bp, Mus musculus
  misc_feature (39)..(39): n is a, c, g, or t
  misc_feature (344)..(344): n is a, c, g, or t
  misc_feature (366)..(366): n is a, c, g, or t
aagcgcatgacattggtacagttcaggagaatgatggcnaaacgtccagcaattaaaaaggccgtggacatgcgctccccagttttgtctacgctgctgccgtctctcagagaaaaagctcaacatatcgcagagaaaaagtatgtggcaggcatcaaactccaaccccgagaggagaacataataacagatctggaatctgtggctatgccaatagttggcatcttgggggagcctcgaaatctgttcaacccgaatactctcctccccctggaattagaagaaaacacaaaaccaagtggaagaagttcttccatagtcgagacaaataacacaaagatccnaaacacactgagtttagtcatntcaaaactagcttcgccaagcacctgccctaaataatctaattggttccagttccttacctag

SEQ ID NO: 8569 - DNA, 297 bp, Mus musculus
aggtttccgttggtccatcatctaagaaaacttactccttacggagccaagcatctacagttagtgcaaacatagcctctaaaaaaagagagggaacactacagaaatttggagacttcttgcagcattctccaacaattcttcaatcaaaagcaaaaaagataattgaaacaatgagttctccaaagttatcaacggtagaagtaagtaaagaaaatgtgtcccagccaaaaaaagccaaacggaaattatacagaaatgaaatttcatctcccatcaacatatctggccaagtga

SEQ ID NO: 8570 - DNA, 483 bp, Mus musculus
  misc_feature (324)..(324): n is a, c, g, or t
  misc_feature (326)..(326): n is a, c, g, or t
  misc_feature (338)..(338): n is a, c, g, or t
  misc_feature (344)..(344): n is a, c, g, or t
  misc_feature (352)..(353): n is a, c, g, or t
  misc_feature (362)..(362): n is a, c, g, or t
  misc_feature (380)..(380): n is a, c, g, or t
  misc_feature (406)..(406): n is a, c, g, or t
ataagcataagagcaaggaccagtaaaaaaggaaggagcagaagaggcaaacgaataagcagcagcagaaaagaaagccgaagattaaaaagagggagaggaattagtgggggagataaagccaataagtagccgagcctttcacagccctaagaatgagtctccaggaagcaaaagctgtgggaagctgccactctcagtgggcaaggaaggaaggacccgtctgtcacaagtgttcaatggacaggtgtttacatactatttcagtactttacatatttcatttgaacttctcctatagctttggatattcttgttcttgtntntttgggctgatnttttantcaccagnnaatgctttnttccacatagattttttnttgtatgcaatatactatattcctgnatttctcactgttcccaggactttcatttcaagtaacaattacctattatgtaaggacaatttccatgacattcatt

SEQ ID NO: 8571 - DNA, 303 bp, Mus musculus
  misc_feature (270)..(270): n is a, c, g, or t
atgccatgctcagcagcaaacacaggaccagaccccagacattttcccgtgagtctaataggcttttttcttctgaaaccataagaagtatgtttgtcagtcaaatggtttcctgagaatgataggaccccatttctatatactggtatatgaatatctcatgcactaattattctcagttttaaaatgtaatagactagtaagtcccataatgaaacgtcaaaagaagatttttgttctgtaatttagaaaaattattaaccagtgatnttagaaatatttttaacagcactatccttgagg

SEQ ID NO: 8572 - DNA, 313 bp, Mus musculus
  misc_feature (209)..(209): n is a, c, g, or t
  misc_feature (216)..(216): n is a, c, g, or t
  misc_feature (219)..(219): n is a, c, g, or t
  misc_feature (239)..(239): n is a, c, g, or t
  misc_feature (252)..(252): n is a, c, g, or t
  misc_feature (254)..(254): n is a, c, g, or t
  misc_feature (258)..(258): n is a, c, g, or t
ggtgatgtttcttacaagccttcttacttatttgaattttctcttccgtgtgttttggacacataccattcccctgcgtataagcatgcatgggttttctacatctcagttgctggcatgtcaaattagaaggcagaagttaatgagtgtcctgacagagactcggggggcatcgatgtgaaagacagagatgaggggaggaggggctntcggaantcntgggaagttcctccccgggncagtgggcagagntnttantcctggcttatagaggaagtagtagaggggagctgagggagtgtccctacttact

SEQ ID NO: 8573 - DNA, 350 bp, Mus musculus
  misc_feature (113)..(113): n is a, c, g, or t
  misc_feature (117)..(117): n is a, c, g, or t
  misc_feature (119)..(119): n is a, c, g, or t
  misc_feature (133)..(133): n is a, c, g, or t
  misc_feature (141)..(142): n is a, c, g, or t
  misc_feature (148)..(148): n is a, c, g, or t
  misc_feature (153)..(153): n is a, c, g, or t
  misc_feature (169)..(169): n is a, c, g, or t
  misc_feature (203)..(203): n is a, c, g, or t
  misc_feature (211)..(211): n is a, c, g, or t
  misc_feature (213)..(213): n is a, c, g, or t
  misc_feature (224)..(224): n is a, c, g, or t
  misc_feature (232)..(232): n is a, c, g, or t
  misc_feature (245)..(245): n is a, c, g, or t
  misc_feature (248)..(248): n is a, c, g, or t
  misc_feature (278)..(278): n is a, c, g, or t
  misc_feature (299)..(299): n is a, c, g, or t
  misc_feature (316)..(316): n is a, c, g, or t
ccaccatgcagggagtcttcaagaggatactgagccagcagggctggccggggctgtacagaggcatgacacccactttactgaaggtgttgccagcaggcggcatcagctanctgntntatgaagccatgangaaaaccnngggtgnacaantcctgagcagatgacntgccctgaacaagaagagaatggaagacccagtntccctgantntcaaaaagcantccaaggntcaggctttaagnccnattttggtttgcaaaaaccacccaggactnggattagaaaagcgctgggantcctccaattgggattntgagttgggattccagccgggtttttgcaggctt

SEQ ID NO: 8574 - DNA, 49 bp, Mus musculus
tcatctgccagtcccaacatgtatgagtctgacgttcctgaacacaaca

SEQ ID NO: 8575 - DNA, 233 bp, Mus musculus
  misc_feature (50)..(51): n is a, c, g, or t
  misc_feature (61)..(61): n is a, c, g, or t
  misc_feature (65)..(65): n is a, c, g, or t
  misc_feature (67)..(67): n is a, c, g, or t
  misc_feature (69)..(69): n is a, c, g, or t
  misc_feature (80)..(80): n is a, c, g, or t
  misc_feature (119)..(119): n is a, c, g, or t
  misc_feature (121)..(121): n is a, c, g, or t
  misc_feature (123)..(123): n is a, c, g, or t
  misc_feature (139)..(139): n is a, c, g, or t
  misc_feature (166)..(166): n is a, c, g, or t
  misc_feature (169)..(169): n is a, c, g, or t
  misc_feature (174)..(175): n is a, c, g, or t
atgaattgcctatgtgagctttccaaggaggacattaaaccaatctttgnntggtgagccncttncntnacccttccggncaataaacgtgtttgttccaaacccgggggccacccgcntncntcccgcatggaagctntttgcccagctacagtggggagaggcntcntccanntttgcgcttgcccagggcatccagccgcccggactgcgcacagccaacgggcacctgt

SEQ ID NO: 8576 - DNA, 547 bp, Mus musculus
  misc_feature (203)..(203): n is a, c, g, or t
  misc_feature (210)..(210): n is a, c, g, or t
  misc_feature (353)..(353): n is a, c, g, or t
  misc_feature (445)..(445): n is a, c, g, or t
  misc_feature (458)..(458): n is a, c, g, or t
  misc_feature (486)..(486): n is a, c, g, or t
  misc_feature (507)..(507): n is a, c, g, or t
agagctgctcatagtgaatccagaaaacaactctttggcgttggtctacagagacagagaaacgctgaggtttgtgaaacacatcaaccaccgcagcctagagcagagcaaagccttcccaagcagaagcggcttctgggacttcgcattcatctactatgagtaacaagatggggcagagccagctagcattcactccaccnagtgccnggaacatggggtcttcgtggagtgagggagagtggggcatgctgggtaacagcgtcctccgagcaggctgtccttgcaggctgtgtgggtgcacacctgtgatgccagcctcgggaggcagagaaaggggaccttcagttccnaaggtcagtgtggcttacacggtgagaccctgtccccaagcaaaacaactcttggtcatcctttcagaaaattcatctagacctcatgctanagctatgtactcntccctgggttgcagaaaaaaatgttttncccccattgcaattctcttcnttctgtagtaactgccttggcgactttctaactttggtga

SEQ ID NO: 8577 - DNA, 367 bp, Mus musculus
  misc_feature (221)..(221): n is a, c, g, or t
aattttcccagcgagttttctgccacggggcacccccttttgttgtgttaaatatgcagcattggaaacctgaagacctggcatatgtaccctattacttggatttatctgatcacaaatatttgctggaaggcgccactttatttaacaaagaggagcatcattattctgcagccttccagattgacggacattggatgcactatgatggcctcagaaantgtgaatttaattttgttaaataaacccccagagtttctcctcttgtcatcattggtttatattcgagcaacagagaaataaatatagactgatgctgaattaaattgttctcccgcctgcccatgctcccagatgaagggctttt

SEQ ID NO: 8578 - DNA, 428 bp, Mus musculus
  misc_feature (153)..(154): n is a, c, g, or t
  misc_feature (258)..(258): n is a, c, g, or t
  misc_feature (265)..(265): n is a, c, g, or t
tgaatccctcatacacagttttctcccggttctgaggaagtagcagcgggaaatggcgcaacaggcttgcttctgcttcgtccatggcgcacaggaatggccgccgcacatgcgcagtctgcaaagggacggggcggaaacccgcttcggcgnnaaaaactaactggtgggtacgctgccctgacctggacaatgaactgggccaactggtctgcttagtagcaggagaaagcaggagaaaggaagatcactcacaantccacangcctgacggttcaggattattctgaccttgactgtcaaaaaataaaactagcaaaatcctcttgttgatttcattgaagactgatgcaactccaaagctgactttcctactttgacagggcatttacagtgtgcccatagcatactgtttttaccctgaacct

SEQ ID NO: 8579 - DNA, 452 bp, Mus musculus
  misc_feature (89)..(89): n is a, c, g, or t
  misc_feature (104)..(104): n is a, c, g, or t
  misc_feature (121)..(121): n is a, c, g, or t
  misc_feature (143)..(143): n is a, c, g, or t
  misc_feature (200)..(200): n is a, c, g, or t
  misc_feature (202)..(202): n is a, c, g, or t
  misc_feature (211)..(211): n is a, c, g, or t
  misc_feature (213)..(213): n is a, c, g, or t
  misc_feature (215)..(215): n is a, c, g, or t
  misc_feature (236)..(236): n is a, c, g, or t
  misc_feature (256)..(256): n is a, c, g, or t
  misc_feature (263)..(263): n is a, c, g, or t
  misc_feature (271)..(271): n is a, c, g, or t
  misc_feature (276)..(276): n is a, c, g, or t
  misc_feature (278)..(278): n is a, c, g, or t
  misc_feature (282)..(283): n is a, c, g, or t
  misc_feature (286)..(286): n is a, c, g, or t
  misc_feature (288)..(288): n is a, c, g, or t
  misc_feature (313)..(313): n is a, c, g, or t
  misc_feature (325)..(325): n is a, c, g, or t
  misc_feature (362)..(362): n is a, c, g, or t
  misc_feature (388)..(388): n is a, c, g, or t
  misc_feature (427)..(427): n is a, c, g, or t
tcatcccaacagcagttaccatggagcacatctcggagaaggtgtccccttcaggaaacatctcaagtgcacccaaggagttctctgtntatggcgttatgaanaaatgtgaaggagaagnaatattcctaggtcagtttatntataacaaaatggaagcaaccattcaaacatttgagctccagaatgaagcttctgantntttgctatntntnaaacttcaaatccttagcaantggggacatccaaagtatangtgtttntaccgatntagantnccanngcntnccccagtgattacacttagaagagntggtgcagaagncagtggctgtgcagccagaatgtccaaggatgtttantatttccttacgtcagattgcacccntaagaatcaaagattgggagtgggagggaaaccccaaantcattcctactaggcagtaagaatt

SEQ ID NO: 8580 - DNA, 495 bp, Mus musculus
  misc_feature (69)..(69): n is a, c, g, or t
  misc_feature (123)..(123): n is a, c, g, or t
  misc_feature (137)..(144): n is a, c, g, or t
  misc_feature (171)..(171): n is a, c, g, or t
  misc_feature (185)..(185): n is a, c, g, or t
  misc_feature (205)..(209): n is a, c, g, or t
  misc_feature (238)..(238): n is a, c, g, or t
  misc_feature (297)..(297): n is a, c, g, or t
agaacccagtaggtactggcatcttggctgatgtcggtatccacagccattactgagggccaagtctgntaccattcattgcctagggcccctagtattggggagagtgccagaacaagtggnccttcccccccccnnnnnnnntttaaaatccagatgagatcatagganaaaggaaacctatntaggggacttcccccccccnnnnnaacacttttaccccaagggctccttgccntcaaaactggaggatatttcagttactcttaatgctcatgtgggtcaaacttggttttngaaagaggtttaaagccaggcacaaggttagtttcaaatactagttaatccaatttttttcctttttttttttttttttgcacagaagctggtaatataggacctatgtgtgaactttatatgaatatttttttgtacttggcttacttgggttgttatgataacatatttaagttccttgaacactgtggattcccc

SEQ ID NO: 8581 - DNA, 523 bp, Mus musculus
  misc_feature (65)..(65): n is a, c, g, or t
  misc_feature (67)..(67): n is a, c, g, or t
  misc_feature (69)..(69): n is a, c, g, or t
  misc_feature (371)..(371): n is a, c, g, or t
  misc_feature (440)..(441): n is a, c, g, or t
gtgccattattccaaactgctgtctgtgcgggcctagggcgggactcctgggctcatctcctcanancnccatgtcctagctcggagctggaagaccataccactgccttcgggacatgggccctgcagcttctgccccgtgtccctcagagtctgagtgacgttcatcatatcatctggacacttgttagccatagcagatgcctgtggtcggccactgtggataatggctggatgcagcttgaggcaaagaccaccaaagcctttttcctctgtgccccgggaaagcaggaactgatggacccagaggtgtaagagcccagggtgggggcagagggatgtcagtggagcaggagttgtgctggaacagnccctccctccagcccctgaagtggcttccgcaaggcagtcgcatggggggctggttgtcaggctttagnngagttggttcaggggttcacaggcggactgcctacatttcctgctttccctagaatgtattatcctggttttcacttgtgca

SEQ ID NO: 8582 - DNA, 419 bp, Mus musculus
gagagacacagaccggccagtagcacggaacttttggctgtccaagaaggaattaaagttcttgaaacattggttgctcttggggaagaacagaacagagtccagttactcgctcttctagtgcccactttgatctcttacctgctggatgaaaattcttttgcctcagcaagttcgatctccaaagatcttcatgagtttgcactgcagaacttaatgcatattggacctctgtacccacatgctttcaagacggtaatgggggctgctcctgaactgaaagcacgactagaaactgctgtccgagcaagccaggcgagcaaagctaaagccgctgccaggcagcccgcccccaccacacattccacaccgacaattaagctgaaaacaagctttttttagtgtgcttttccgctcat

SEQ ID NO: 8583 - DNA, 535 bp, Mus musculus
  misc_feature (169)..(169): n is a, c, g, or t
  misc_feature (404)..(406): n is a, c, g, or t
ggaatgccatcagtctttgaacactgaaagcccactgctgctgacataactcctcaagcaaaaccacacctcctaaacctccgaaactgccatcagccgggagcccaaggctctgagggccatctcattcacacaaacacaaacataaatcacttaaaaaataacaaanggggcggggcgagttgtgctgctccacagtagaccatgtgcttagaaccccactcgggttagaggtgtgctttagaaacaccactagcttagcatgtaggggacttttgattccatttctagaactgaaaagaaaaaagtcagtacaaagtatctttataaaggaatgcaaagggctaggagatggctcctttggtagaacccttggcttgcaagcaagaggacctgagttcagnnnccccccccaaacccgtgtgaaagatctgggcactgtggcatgtcctaagatcctggcaccggggaggcagaggcaggtagatcctttggcttgctggccagccagcttatgctagtctgtgagccacta

SEQ ID NO: 8584 - DNA, 341 bp, Mus musculus
  misc_feature (277)..(278): n is a, c, g, or t
  misc_feature (285)..(285): n is a, c, g, or t
acgcccacattacctgggtgtgaaaaaaacccactctcctgttggacttaaaaccatcctgttggcagtcctacggtcacatcagtgcctctcactgtcctgggacagaccctcaattttgcggagcaagtaatgcagagaagaagccaggagtaaggtggacttatttgagccctgggaatgcctgttccagccctctgaagcccagaagataccctcattctccactccacagaaagctcggccttctcctgcccccatttcccaggaagccttnnattaganagaaacccaaagaccgaagccgtgggacccagaagtccaaggatagcaaatgccta

SEQ ID NO: 8585 - DNA, 321 bp, Mus musculus
gtgcatatctgtatgggtgtgtacattgggaaacttctagaatgaggattgggatctgtgagaactttctaatatgaaaaaatttattttaatatacagagacttccaaaaactccttaccaaccctggataaatgatagcaacctggaaccattgaatttacagctagatcattgtagaatatcttaaaaagcttagtctgaccagtctgatatgcatggacatgctttctcattgtaaccagttagaatttgatgtagtcattgcatctgataaaaaccaaacccattttgctaatcagaattgttatgctgcctcagg

SEQ ID NO: 8586 - DNA, 509 bp, Mus musculus
  misc_feature (90)..(90): n is a, c, g, or t
  misc_feature (94)..(95): n is a, c, g, or t
  misc_feature (280)..(280): n is a, c, g, or t
  misc_feature (419)..(419): n is a, c, g, or t
agagcccagctatattgctgtgattggtaatgcatttgtatacttgctgtgtcatagttaacttctgaagcgcttcagacaatgaagccnagcnnaacacagagcagagtgcctggagcttcctttggactgaggaagaaggagaaggtgacctgtcgtttgtgggaagaggaacggaaagccatcaaggtccctcagagggggctgaggaggtccagcattggtgtcagtttgtgaagatcatgcagaaccatgccagaagggtgaggggtctgcactncatgttgagaactgtaggtcctcgaggcaagaagtggatggaggtgtctcaggcatcaagaggagaccctgagggaaagaggaggtcggcctgcagagaagctttgcattttgttgtttgtctacttgttaagtgtggngaatggctttcccatggggccagagcccgagcagtagactcgaccacactttttattttctttaaagctcttgcatgtctgctgtagtgt

SEQ ID NO: 8587 - DNA, 481 bp, Mus musculus
  misc_feature (77)..(77): n is a, c, g, or t
  misc_feature (255)..(255): n is a, c, g, or t
  misc_feature (329)..(329): n is a, c, g, or t
  misc_feature (440)..(440): n is a, c, g, or t
  misc_feature (456)..(456): n is a, c, g, or t
gccctgtttgaccttcgtgaaattatgcaggagcaaaaccctgtgcatgttattggggtagaagaaccttcagtggncaactccatgctgtttgacaccagagaatctagataggaagataattctttagatatcttttgagttaccaggcacaaacattatgcccacacagtgtatgggtggcaagagatggcacaatatcagtattgacctctgacttcctaaggaagtggtgcctcccacacagttgaggtnggtggttctcaaacgtatcaaactcagctcctgtttttgttttctgagacaaggtgtcatgtggcccaagctgncctcaaactcactatatatccaaggatgaccttgaattttctgatttttctgttttcatttgcctccctaagtctgggatcatagctgtgtgccactagacccagcaacancagacaccttgagatntcttctccattatcccacagtgagt

SEQ ID NO: 8588 - DNA, 446 bp, Mus musculus
  misc_feature (180)..(180): n is a, c, g, or t
  misc_feature (196)..(196): n is a, c, g, or t
  misc_feature (203)..(203): n is a, c, g, or t
  misc_feature (210)..(210): n is a, c, g, or t
  misc_feature (218)..(218): n is a, c, g, or t
  misc_feature (235)..(235): n is a, c, g, or t
  misc_feature (237)..(237): n is a, c, g, or t
  misc_feature (246)..(246): n is a, c, g, or t
  misc_feature (266)..(266): n is a, c, g, or t
  misc_feature (268)..(268): n is a, c, g, or t
  misc_feature (273)..(273): n is a, c, g, or t
  misc_feature (282)..(282): n is a, c, g, or t
  misc_feature (295)..(295): n is a, c, g, or t
  misc_feature (297)..(297): n is a, c, g, or t
  misc_feature (321)..(321): n is a, c, g, or t
  misc_feature (378)..(378): n is a, c, g, or t
  misc_feature (391)..(391): n is a, c, g, or t
tgcttccccgagagtcgccgtgggatgcagcgcacgggcgagagaagctccaaagcttcccaagtccaggctgttctccttcctgcttcctcagcccagccacgccgtggtagaggacggcgcccgtaaccacggctgtgggcaagggacccccaaccctggggaaccgctgggaggcgnaactccaggagccganctgcggngtgaccnggcgcccntccaagacaggccgcgntnctctgggtnccctgctcggtgccgaattntntgatnctccgagcnctttgtggttgcntncagaccgttgcttcaatcataaantctgcagttctgaatgaatatttttggactccataaggctggcttctggactttggncaaggacaggctnatgatttatagttagtgttaatattttttaggaactactagtatgtgtatgtgac

SEQ ID NO: 8589 - DNA, 236 bp, Mus musculus
  misc_feature (38)..(38): n is a, c, g, or t
  misc_feature (42)..(42): n is a, c, g, or t
  misc_feature (44)..(44): n is a, c, g, or t
  misc_feature (46)..(46): n is a, c, g, or t
  misc_feature (54)..(54): n is a, c, g, or t
  misc_feature (76)..(76): n is a, c, g, or t
  misc_feature (115)..(115): n is a, c, g, or t
  misc_feature (121)..(121): n is a, c, g, or t
  misc_feature (128)..(128): n is a, c, g, or t
  misc_feature (176)..(176): n is a, c, g, or t
  misc_feature (179)..(179): n is a, c, g, or t
  misc_feature (194)..(194): n is a, c, g, or t
ggatactcagacatacttctgcagaggatcgacagctntcancntnttattaantgaacgaagtatattataatantcagattcacaggagagtaaggataacaattgttaaagntctttntaaaatntctgaaacaagtacaccctagcttttttcgatgtgaaatgttttaatnttntctatatttatgtantcctttagaaattattagctgcaatgtatgaaaagactagtt

SEQ ID NO: 8590 - DNA, 475 bp, Mus musculus
  misc_feature (226)..(226): n is a, c, g, or t
  misc_feature (317)..(317): n is a, c, g, or t
agaagcctttgaggtcatccattcccagccttagacccttcccttgtctccatggctacatgcctacacctccttcggagcgctgcccccaccctcaaggacagacaagcacccgccgctggggacggcaacttcggtacagctatcgcaaagagacaacttccacatcagtttccagtgcagcatcccaggcaccgacctgaagggtcacaaaacaggcttctgntgagactcgcccatctgttgttgcctccagctgccacagctccatttctgcttcattctcagatgcgctcacatgtttctccctccctccnccagctgtgtgttggtctggtcccagccccaccccttgtcaggtcagtgctatctagaactgagtggcaggacacctgttctaaccatcaaagcctttggccccttctcctctgcacaagcctccacagagccttggaggacagaggttcccatccca

SEQ ID NO: 8591 - DNA, 451 bp, Mus musculus
  misc_feature (69)..(69): n is a, c, g, or t
  misc_feature (75)..(75): n is a, c, g, or t
  misc_feature (141)..(141): n is a, c, g, or t
  misc_feature (199)..(199): n is a, c, g, or t
  misc_feature (214)..(214): n is a, c, g, or t
  misc_feature (227)..(227): n is a, c, g, or t
  misc_feature (246)..(246): n is a, c, g, or t
  misc_feature (250)..(250): n is a, c, g, or t
  misc_feature (256)..(256): n is a, c, g, or t
  misc_feature (266)..(266): n is a, c, g, or t
  misc_feature (270)..(270): n is a, c, g, or t
  misc_feature (272)..(272): n is a, c, g, or t
  misc_feature (285)..(285): n is a, c, g, or t
  misc_feature (287)..(287): n is a, c, g, or t
  misc_feature (289)..(290): n is a, c, g, or t
  misc_feature (295)..(295): n is a, c, g, or t
  misc_feature (314)..(314): n is a, c, g, or t
  misc_feature (324)..(324): n is a, c, g, or t
  misc_feature (364)..(364): n is a, c, g, or t
  misc_feature (397)..(397): n is a, c, g, or t
  misc_feature (402)..(402): n is a, c, g, or t
catacccaacctcacaatttaaacaacttaaatttctttaaagggttcatcttcaaatattgttactancctatngggggttataggttcaacacatgattctgaggtaggaccacaattcagttggcagcaatctctttnagaaaatgacactcatctgagtaatgaatagcaagaagccagtcatgccacaactagntggtggggcattgcngggagaagagacngcaagtacaagagtggccnaggnagatanccttggtcanttanangagactattagantntnnaacancctgggtaatggctcagtntgaacctgangacttgatttcaatccccaccccaccccccaagctgacanaaaggtgaaaagagaatcaactccacaaagttntcctntaccctggtacccacaatcctacagagatggtgatgaaccccagaggct

SEQ ID NO: 8592 - DNA, 312 bp, Mus musculus
tccctctaaaactcctttctgttctgcctgttttctcccatgtcaagtcagaattgtttaacccttcttgtccttctagattaatttttagtgttggactatagtctttttcccttttaaactgagcagtaattgagactttctgataaccagactgccggacctctttctgtcacacctctgctctgtgcatgttcaccctgcccttccaccagcataagaaagtgcatggctcctgcattccaaacagccatggtgtctgctggagacagccaggcacaaatttagtctcctcattttgtttacacactg

SEQ ID NO: 8593 - DNA, 520 bp, Mus musculus
  misc_feature (56)..(56): n is a, c, g, or t
  misc_feature (327)..(327): n is a, c, g, or t
  misc_feature (332)..(332): n is a, c, g, or t
  misc_feature (353)..(353): n is a, c, g, or t
  misc_feature (370)..(370): n is a, c, g, or t
  misc_feature (449)..(449): n is a, c, g, or t
  misc_feature (471)..(471): n is a, c, g, or t
agactggtgccttggcagcttttttttgggtcacctgattggagatgacaggtagnctttcagcacaaggtcacaatacatgtgatgcgatggcaggtttaaaaggccagccatgcagacagcctacacctggtatcaccctcctgctgagcacaccatgcgcgccttgtgctcatctacagagagccaggggactcaagactgctgctccaagctgccgacgcaatagccaccacatgcagtgtgccatttcccaagagctgagaaacaggagaaccttggctttctgctcataatctggttcttgtgcccgggtgcaggtttccntcgtntgggaagaacggagtaacgantctcacacagaaaaaantcttgagaacaccttgtggcgcacccagtgtaactgttacggtaggtgaccctcacaacggtaccatcagaactgcttntgcaagcctttgctagggactncccaggtgctctgtatggagctgggaagcatggcctgcttgctgatgaa

SEQ ID NO: 8594 - DNA, 487 bp, Mus musculus
  misc_feature (256)..(256): n is a, c, g, or t
  misc_feature (258)..(258): n is a, c, g, or t
  misc_feature (260)..(260): n is a, c, g, or t
  misc_feature (266)..(268): n is a, c, g, or t
  misc_feature (276)..(276): n is a, c, g, or t
  misc_feature (281)..(281): n is a, c, g, or t
  misc_feature (285)..(285): n is a, c, g, or t
  misc_feature (292)..(292): n is a, c, g, or t
  misc_feature (296)..(296): n is a, c, g, or t
  misc_feature (325)..(325): n is a, c, g, or t
  misc_feature (327)..(329): n is a, c, g, or t
  misc_feature (335)..(335): n is a, c, g, or t
  misc_feature (338)..(338): n is a, c, g, or t
  misc_feature (340)..(340): n is a, c, g, or t
  misc_feature (342)..(342): n is a, c, g, or t
  misc_feature (357)..(357): n is a, c, g, or t
  misc_feature (359)..(359): n is a, c, g, or t
  misc_feature (386)..(386): n is a, c, g, or t
  misc_feature (403)..(403): n is a, c, g, or t
  misc_feature (405)..(405): n is a, c, g, or t
  misc_feature (409)..(409): n is a, c, g, or t
  misc_feature (411)..(411): n is a, c, g, or t
gaggctggatacatctcatctgaaaactcctgcaccaggtaacctaagctacagaatgctgtttccttgtgaaaacaatttattaggccccgtggaaccaatatcctggagttgtagaggagaaaaataaattcttgcctcatatttcctcacctgaaacatggaacgcaacgttgtaatttcgaggcctgggttttatgtgaaggtcgtctttaagggatacagccataacaatttgggctgcatagcagacgcntntnagactnnncaagtatntattnagangtgtgcntttntaaatcaacaaaggaactgagtgggaccntnnnagattnctntncnaggaaggtacctttntntcaatgatagctgggacatcgagcctntatgttctggaagagtntntgtntnagatggccggcttaatggccttcccatttccatcactaaccatgttgacagcctaccttttccaactgatatgctg

SEQ ID NO: 8595 - DNA, 237 bp, Mus musculus
gttactcagtgatagcaaactactactgttatttttaagctttgggggtttccaattcctgagcttgaaaggattcctgttgtttatgatttttgtataacaactttgtaaaacagcattttacaaatattgaaagtacttaaagacagtggttgtactagattagattaccaaggatcgctatctatagtggagtttgaaacagttatgtaaccagaagcatctaactattatgta

SEQ ID NO: 8596 - DNA, 472 bp, Mus musculus
  misc_feature (150)..(150): n is a, c, g, or t
  misc_feature (264)..(264): n is a, c, g, or t
gtgcaggtctacatgtctgtgtcgatgtgggatgtacctgtgtgtgcgtatatgagtatgtgcacacaaacatgtgcatatggcctgtgtacacgtgtgtatgcatgccaaagatagcgtttccagtgtgaccttttgacctggtattcntcggtgtgttcctgcaatacaatctccaatcagacttttaaggcccagactgcttcaggcaacattgaaaagtggcataatacaaaatttacttctagattgtttgaaactatngttgttacttggaagaagaaagtgttaaaagtccatttttcttgttgaaagttaatcaacttgagtaaacctttatagattggtgctggtttacctagtgaaatggctttgatcttggttacctgagcctattggtgatttcattctatctgtgtccagtaccacatgtgtaaagccagttctaactcctgttttgtgactatggcca

SEQ ID NO: 8597 - DNA, 292 bp, Mus musculus
  misc_feature (47)..(47): n is a, c, g, or t
  misc_feature (67)..(67): n is a, c, g, or t
  misc_feature (141)..(141): n is a, c, g, or t
  misc_feature (264)..(264): n is a, c, g, or t
tactggctctcaaagtcatccactgcactgtggtagacacagctgtnctgttcccacatcaccgggncctgccctataagcgctccctgcggaacctcatggctgactacctcagacagatcatccaagacaatgtgaatnggcacagctccagtgaggatgccagtgcctgtatgcagcttgtcatctggaagatccgagaagacgccaagaccaagccaagactcccacccaacactaccataccatcccccttcttccaanccttgctgcccttagccggaatccctta

SEQ ID NO: 8598 - DNA, 109 bp, Mus musculus
gcggacgctgtagctgctctgaagtgtgccagcctaagcctgcggagggggacgctggagcgcagagcatgaggaactggtgtctgtgccagatttgcacctgcggctc

SEQ ID NO: 8599 - DNA, 311 bp, Mus musculus
  misc_feature (116)..(116): n is a, c, g, or t
  misc_feature (121)..(122): n is a, c, g, or t
  misc_feature (127)..(128): n is a, c, g, or t
  misc_feature (131)..(131): n is a, c, g, or t
  misc_feature (140)..(140): n is a, c, g, or t
  misc_feature (148)..(148): n is a, c, g, or t
  misc_feature (153)..(153): n is a, c, g, or t
  misc_feature (162)..(162): n is a, c, g, or t
  misc_feature (168)..(168): n is a, c, g, or t
  misc_feature (187)..(187): n is a, c, g, or t
  misc_feature (199)..(199): n is a, c, g, or t
  misc_feature (213)..(213): n is a, c, g, or t
  misc_feature (223)..(223): n is a, c, g, or t
  misc_feature (239)..(239): n is a, c, g, or t
  misc_feature (248)..(248): n is a, c, g, or t
gcggacgctgtagctgctctgaagtgtgccagcctaagcctgcggagggggacgctggagcgcagagcatgaggaactggtgtctgtgccagatttgcacctgcggctctatcagnacttnnatatnnacntgacctatncactctgntcctngattttccnagtatnttggaccctgcataggacnaaatcacttcancactttccagcacntcctttgcancagacattgctgagtntcatgattnttctgactttagagtttcctagacatggaggactagaggagctgtctaaccaggatgcttcac

SEQ ID NO: 8600 - DNA, 80 bp, Mus musculus
gaccagaggctgagaccacaggaatcctagacatgggggccatgcgcagtgatcaagatctatggcagcgcaggcccctg

SEQ ID NO: 8601 - DNA, 354 bp, Mus musculus
  misc_feature (310)..(310): n is a, c, g, or t
  misc_feature (321)..(321): n is a, c, g, or t
  misc_feature (329)..(329): n is a, c, g, or t
gttagaacagactgctctgacccacccttgggtctttctgaggcacggaccaagagttggtttttctgtcaacttccagaatgctgtggatggatgctgttagtctgagaagtgccaccttaaaaatcatcttacacggcacccactcgaaagtgaacactaggaagtctttacacgcctcaggtcaatgatgcccgttatacagaggaggaagttgagtgtctaaaggaagatcactggcaaatggtggagcaggtgataacctaaacccaggccagcatctcttcaaagcttgctctctacactaccnttaacaccgantacatttngaatcctcgagttgtttgtggaaac

SEQ ID NO: 8602 - DNA, 444 bp, Mus musculus
  misc_feature (28)..(28): n is a, c, g, or t
  misc_feature (97)..(97): n is a, c, g, or t
  misc_feature (221)..(221): n is a, c, g, or t
  misc_feature (230)..(230): n is a, c, g, or t
aactggcaggcccaatgcatgaacagtngtgggtccctgggaggcccaggcagggatagtggccaggtttctcttcggccatttgtgagagcaactntgcaggaatcacttcagcttcacagacctgatttcatctcccactctggggagcgcataaagcgtctgaagttacttgtccaggagaggaagctccagagcctgttccagagtgagcgggaggnctctgttcnactcagcgaggcccctgcccaggagagtcctcctggctgtccagaagaacaagcctattggaaagaaggaaatgattcagaggaccagacgaatttatgagcagcttccagaagtgaagaagaagagagaagaggagaagagaaaatcagaatataaatcctactggctacgtgctcaacactataaaatgaaagtgaccaatcatctcctggg

SEQ ID NO: 8603 - DNA, 413 bp, Mus musculus
  misc_feature (220)..(220): n is a, c, g, or t
  misc_feature (228)..(228): n is a, c, g, or t
  misc_feature (242)..(242): n is a, c, g, or t
  misc_feature (248)..(248): n is a, c, g, or t
  misc_feature (262)..(262): n is a, c, g, or t
  misc_feature (289)..(289): n is a, c, g, or t
  misc_feature (291)..(291): n is a, c, g, or t
  misc_feature (293)..(293): n is a, c, g, or t
  misc_feature (295)..(295): n is a, c, g, or t
  misc_feature (297)..(297): n is a, c, g, or t
  misc_feature (307)..(307): n is a, c, g, or t
  misc_feature (311)..(311): n is a, c, g, or t
tcttctggccatctctcttggcagactcagggttggttctggatggtgaagagtgcagacaaagctggtaggttggaagctgcctctcacttctgaaaaccccaagggtccctcacgtgtcctcaccaatactacataatgtctgagaatgggaacattctaactttctgtccaaaagcagtaaaagcaaatgagatgggaaaatgcccaaggctggagntgacagcnttcctggattttgntaccanacaagagagaaggnttttctttttgtttaatttcattccantntnancnaactatgtgncaancagtaaccgcatagatctatagcatggaagactgatgatagtgtttggcatgagattttttttcaaagaaatcatattgtatgttgcagttgatctgttaaa

SEQ ID NO: 8604 - DNA, 359 bp, Mus musculus
  misc_feature (212)..(212): n is a, c, g, or t
  misc_feature (314)..(314): n is a, c, g, or t
  misc_feature (316)..(316): n is a, c, g, or t
  misc_feature (318)..(318): n is a, c, g, or t
tgttgcaaattacaccctaagctgtaatctacgggaagaactggtggccgtctcagagagacaagacatttgcaatgagatagggtctaagctgacctgtgagaagattgctagagaacgctacgacaaccagctgaagcagcagaagctgttgaacatctccaagcagcaagctgagcagatctcaatcctgcaggctgaagttgaaagantcaggatgaagacattccctgctctcatcccaatgtagagcagaaagcacacaatgcccaactaatgtcccttgaatagaatcacttggacagaaacttctntntntcctgatcaggaaatttaagtaggtcacctcttagctgcac

SEQ ID NO: 8605 - DNA, 500 bp, Mus musculus
  misc_feature (328)..(328): n is a, c, g, or t
  misc_feature (331)..(331): n is a, c, g, or t
  misc_feature (350)..(350): n is a, c, g, or t
  misc_feature (353)..(353): n is a, c, g, or t
  misc_feature (371)..(371): n is a, c, g, or t
  misc_feature (379)..(379): n is a, c, g, or t
cagtacctctcagcgtattattcaggtgataagaaactgcccataaattggctcccacatagggaagctctttatcctatgcaatatttctaattatttttcttagttctgagccatcaactttgctacattttgaaaggtgcattaattctgacattgagggttttgtttttccaaataatagctttcaaagtaaaatggtgctgcatgttataactttatatgatggtgtagtgcatataagctatgagaatcagttatacatgtattagagtcagttatacatgtattatctattctaagtctcaacaaaatgttcaaccagacnagnatgtaattttctctttagnatnccaaatgtgctttagacnacaatgcnaaagtttaaaagactatttcacttatgtcatttctgacacaactagaatacttaaactttatcttcttgcaaattgcttgtatgaagatgctctttccagttgattggacctcaggtgttt

SEQ ID NO: 8606 - DNA, 521 bp, Mus musculus
  misc_feature (275)..(275): n is a, c, g, or t
  misc_feature (282)..(282): n is a, c, g, or t
  misc_feature (301)..(302): n is a, c, g, or t
  misc_feature (386)..(386): n is a, c, g, or t
  misc_feature (397)..(398): n is a, c, g, or t
  misc_feature (430)..(430): n is a, c, g, or t
  misc_feature (441)..(441): n is a, c, g, or t
  misc_feature (443)..(443): n is a, c, g, or t
  misc_feature (445)..(445): n is a, c, g, or t
  misc_feature (453)..(453): n is a, c, g, or t
  misc_feature (469)..(469): n is a, c, g, or t
  misc_feature (471)..(471): n is a, c, g, or t
gcttccaggatggtgaaatgctaccatggagccccagttgggagctgccgaacccaaacctggggacccacattgaaagccagccccaaggtcctgtttctagcacccctgcctcagtgtctcaggtcatccctcacactcagtcttgccctgctggctcatcaagtcatggggccctttccaaagaagccatacaggggctggagaagaagctgcagagagagatggctaccctccaggccctcggtgcgtgcatgaagagctcgcttgggatnccagatncaccagaccccacccgtgnntccctttggcaggaagagatgccagaagtaaaaaaggaaggcttggtaacgccctggaccacccggagctgcggtaagggcgancctgcagatannccctgggctggctggtcaggtggccagggggncctcccgtggncntnttccaccncctagcttgagcttgntnttgcagaggagacctatttctatgtggatggcagccacacatcagtatta

SEQ ID NO: 8607 - DNA, 305 bp, Mus musculus
  misc_feature (130)..(130): n is a, c, g, or t
  misc_feature (264)..(264): n is a, c, g, or t
aagtgtgtctctagcctgggtggctggagccatctcatctgtggccatcttcaaacagaccaaaacacagctgcccatcttcttctgttgtctgtgctgcgtattggccttgtgcttctcctccctggtnccagaaacgggaagccagtctctccgtgacagcatagagtacaatataagagattctattgagcccaaggatagaaataaggatgttcccatggtgatagctgaggagtcgatgtctgacattgtggctgattntgaagtgacaaataccacgctcaatgccgtgactttcaagc

SEQ ID NO: 8608 - DNA, 502 bp, Mus musculus
  misc_feature (158)..(158): n is a, c, g, or t
  misc_feature (289)..(289): n is a, c, g, or t
  misc_feature (348)..(348): n is a, c, g, or t
  misc_feature (355)..(357): n is a, c, g, or t
agagaaaacgcagtcacctctctgtcaacgatggcggagccttcaagaccccatcacttcctaaaggcccagccttcaaaaatcattccccagaggtgggcatttcagaaagagcagtgcgaggacaaacaggaaccaccaggaggaagacattattnctgctcttccctgattctggattatcagtgatgtggaggcaaacaaatccttggttctattatcatgtttgtttagtttgaatctctgtcataaaggtttacagctgataccaaacacactcaatgccctntgcatcctatgactcaggaggtcatgttttttggtttttgggtttttttgtttgtttgntttgggnnnttttttttttttttggctgtttactgtaaattaaaggagaaaagttactccatgagtataccctaccttttcattgtgaaaattttcagacatgaatatgtattgaactaatctgcccaagtacacatcattgaaatccagcatg

SEQ ID NO: 8609 - DNA, 457 bp, Mus musculus
  misc_feature (310)..(310): n is a, c, g, or t
  misc_feature (322)..(322): n is a, c, g, or t
  misc_feature (330)..(330): n is a, c, g, or t
  misc_feature (333)..(333): n is a, c, g, or t
  misc_feature (357)..(357): n is a, c, g, or t
  misc_feature (385)..(385): n is a, c, g, or t
  misc_feature (417)..(417): n is a, c, g, or t
gggactctgggctacatgaagtttgggacagacactcaggccagcatcaccctcaacttgcccatttgctggctgtaccagtcagtcaagctgatgtactctgtgggcatcttcttcacctatgccctccagttccacgtcccagctgagatcatcgtcccctatgtcgtctcaagagtgtctgagaactgggctctgttcgtagacctgactgtccgcacagccttggtctgcctgacctgtttctcagccgtcctcatcccccgcctggacctggtcatctccctggtgggctctgtgagcagtagcnccctggccatcntcatcccnccnctgctggagattgccacattttantctgagaacataagctgtgccaccattntcaaggacatcatgatcagcatcctgggcctnttagggtgtgtacttgggacataccaagccctgtacgaga

SEQ ID NO: 8610 - DNA, 423 bp, Mus musculus
  misc_feature (306)..(306): n is a, c, g, or t
  misc_feature (398)..(398): n is a, c, g, or t
aggacttgtgaaccttggcccacagcatcttatgacagcttctgaagggggattgacctccgacccctaaacctatgtcctggtttatagggatgctccctaagtccattacctcatagttttgactgagtttgcaggacattggccatacctgagagagctcctggtcagttctaactcctaaacacaccatgcacttccagaacttggcaagcctctggataactgctaactcctgctcttccagctgaggttgcattggtcactactgttgagtttctgcaagctaaattcagctgaggctgntcagcactgatctcccatgctcaaggccaactctagaggaagcagaacactcacactctcctccccctctgccatttcttgcaaaataaatntctgactcttgaccgctagattact

SEQ ID NO: 8611 - DNA, 466 bp, Mus musculus
  misc_feature (260)..(261): n is a, c, g, or t
  misc_feature (276)..(277): n is a, c, g, or t
  misc_feature (279)..(280): n is a, c, g, or t
  misc_feature (283)..(283): n is a, c, g, or t
  misc_feature (286)..(286): n is a, c, g, or t
  misc_feature (309)..(309): n is a, c, g, or t
  misc_feature (317)..(317): n is a, c, g, or t
  misc_feature (321)..(321): n is a, c, g, or t
  misc_feature (348)..(348): n is a, c, g, or t
  misc_feature (353)..(353): n is a, c, g, or t
  misc_feature (364)..(364): n is a, c, g, or t
  misc_feature (406)..(406): n is a, c, g, or t
  misc_feature (416)..(416): n is a, c, g, or t
  misc_feature (432)..(432): n is a, c, g, or t
gggctgttttgcactcagagggtaaatatagtactcctgagacctccactatgttaagggcagcaggagcgctgggaattctgggcaggggtggggtgaggatacacccccgttaaggggaagggatacctaaagagcatgctggtggggattctcttatccggagaacggagaactggctgccactcccttattcatagcaaatggaattcttgggccggcaccttgcccggaaactcaacatcaactactttgactanntggcctcctcctatnntnnatntantccgccactggccactgggggcntcctttancccnggcattgtgcagcgaaaaacacaagtntacantaagtcaagtntcaacgacctggatgtgtaaccctggggcctgagccctggcntccttttgcntaccctgtgtcccttntccccatcctggagggactaacagccagccccgc

SEQ ID NO: 8612 - DNA, 289 bp, Mus musculus
  misc_feature (69)..(69): n is a, c, g, or t
  misc_feature (203)..(203): n is a, c, g, or t
tagatgcagtctgtgtccagtccacgtgaactagcagcccactctgcactggccagtaaaccatgcccnagacaccatggaccacgaacctaatgcgcttgtttcaaccctacatgaggaccctgtctaggggaggctgggttctccagcaagaaggcggatcctccacaccagcccttgtgagctacatgaggagggagggnagacagcaggaacttccttgaggctggaaatggagcctaacaaatgagagatttcagcagtgagagccctactcagccacctgggt

SEQ ID NO: 8613 - DNA, 339 bp, Mus musculus
  misc_feature (29)..(29): n is a, c, g, or t
  misc_feature (145)..(145): n is a, c, g, or t
  misc_feature (148)..(148): n is a, c, g, or t
  misc_feature (160)..(160): n is a, c, g, or t
  misc_feature (166)..(166): n is a, c, g, or t
  misc_feature (177)..(185): n is a, c, g, or t
  misc_feature (187)..(187): n is a, c, g, or t
  misc_feature (190)..(190): n is a, c, g, or t
  misc_feature (211)..(211): n is a, c, g, or t
  misc_feature (215)..(215): n is a, c, g, or t
  misc_feature (219)..(219): n is a, c, g, or t
  misc_feature (224)..(224): n is a, c, g, or t
  misc_feature (230)..(230): n is a, c, g, or t
  misc_feature (245)..(245): n is a, c, g, or t
  misc_feature (247)..(247): n is a, c, g, or t
  misc_feature (288)..(288): n is a, c, g, or t
gatggatgggtttcctacagttactaaanttcacttcctaccactttgctgaagaagctcaaacagaaagtcaaactttgtgcggttggaaacagcgactctgccttacactggggcttgtggcgtgtgaactatgatggagctnttnaaactgttagtnccattnctggagtcagnnnnnnnnntnatnggggcagggatgctgagcccnttcnatgnttctntttatnctccaatgattattntntttggacaacttgacgctggttaacttaacagcaacaagtnttgaagaagccactggaggatcccaagtagttccccttagaggcctgctaa

SEQ ID NO: 8614 - DNA, 313 bp, Mus musculus
  misc_feature (63)..(63): n is a, c, g, or t
  misc_feature (75)..(75): n is a, c, g, or t
  misc_feature (83)..(84): n is a, c, g, or t
  misc_feature (86)..(88): n is a, c, g, or t
  misc_feature (105)..(105): n is a, c, g, or t
  misc_feature (107)..(107): n is a, c, g, or t
  misc_feature (144)..(145): n is a, c, g, or t
  misc_feature (157)..(157): n is a, c, g, or t
  misc_feature (184)..(184): n is a, c, g, or t
  misc_feature (288)..(288): n is a, c, g, or t
acaaaggtgggtgaagaaagcacaaaatgctacctctataatagctgctatttattggaccgncatttatatgtntgattggnntnnnatctctctctctctctntntctctctctctctctctctctctccctctctcaggcnnagtttcacatancccaggctgacctggaattttcacaangtgaccgagaataaccttgagcttttgatcctcctgtttctaatcccaagtgctgggatcacaggtgtgtgcggagacacttgatttacttggtgctgggaatnaaacccaaggcttcttgcacactat

SEQ ID NO: 8615 - DNA, 44 bp, Mus musculus
atgtattggtttccacagaaccattgttacgctttgtaaagcat

SEQ ID NO: 8616 - DNA, 227 bp, Mus musculus
  misc_feature (59)..(60): n is a, c, g, or t
  misc_feature (62)..(65): n is a, c, g, or t
  misc_feature (68)..(68): n is a, c, g, or t
  misc_feature (73)..(73): n is a, c, g, or t
  misc_feature (80)..(80): n is a, c, g, or t
  misc_feature (82)..(82): n is a, c, g, or t
  misc_feature (85)..(85): n is a, c, g, or t
  misc_feature (88)..(88): n is a, c, g, or t
  misc_feature (100)..(100): n is a, c, g, or t
  misc_feature (105)..(105): n is a, c, g, or t
  misc_feature (109)..(109): n is a, c, g, or t
  misc_feature (111)..(111): n is a, c, g, or t
  misc_feature (113)..(113): n is a, c, g, or t
  misc_feature (115)..(115): n is a, c, g, or t
  misc_feature (117)..(117): n is a, c, g, or t
  misc_feature (121)..(122): n is a, c, g, or t
  misc_feature (127)..(128): n is a, c, g, or t
ataatattatttctcttactaatacaaaaacatccaccattgcatgaaaaacggtattnnannnnganccagnccggggngnggngcnaagttcccgcantgctngcancngntntntgcnnacgtnntgacccaacgcgatgcctgtggtgaaggcgacccccgcgaggagcagccgcgcaagcggcgccgctgccttcgcccgcggccctgagtgcctggcacga

SEQ ID NO: 8617 - DNA, 90 bp, Mus musculus
  misc_feature (30)..(30): n is a, c, g, or t
ggtgtatgtaaatgagtagcttgtttgaantttctgtacaggccgacatgcgtgtggccgacatgcctactgctttcattttctgtgggt

SEQ ID NO: 8618 - DNA, 42 bp, Mus musculus
acccattctcttcaacacactgggactcatttgtggagacgg

SEQ ID NO: 8619 - DNA, 538 bp, Mus musculus
  misc_feature (43)..(43): n is a, c, g, or t
  misc_feature (119)..(119): n is a, c, g, or t
  misc_feature (167)..(167): n is a, c, g, or t
  misc_feature (181)..(181): n is a, c, g, or t
  misc_feature (197)..(197): n is a, c, g, or t
  misc_feature (272)..(272): n is a, c, g, or t
  misc_feature (325)..(325): n is a, c, g, or t
  misc_feature (331)..(331): n is a, c, g, or t
  misc_feature (350)..(350): n is a, c, g, or t
  misc_feature (356)..(356): n is a, c, g, or t
  misc_feature (360)..(360): n is a, c, g, or t
  misc_feature (381)..(381): n is a, c, g, or t
  misc_feature (399)..(399): n is a, c, g, or t
  misc_feature (411)..(411): n is a, c, g, or t
  misc_feature (415)..(415): n is a, c, g, or t
  misc_feature (472)..(472): n is a, c, g, or t
acatcctggaactcaagaactcggggcggccgccaagcgaccntacggccagcggtgcggcggacctggacttccccagcttttctccaatggcttcgcaggaaaactgcctagaaaanttcatcccggaccacagtgaaggcgttgtagaaacggactccattttnagaagcagctgtanatagtattctagagtnttaatagcagccgtcctcctccagaccctgccccggaccagttacactctctcccagcaaagcaaatggaaacgnctcccgtctgtctccagcctgcttggtcctccatcacaggttatcctttctantctcancctgttcttttgaagagcnatacangtcntcatggctgcggggagacccntcagtacacccacctctntctagaaagcantccnataggccctccacatttcaagtgttacgaaagtgcttacggccattgttgttcgttnatttgttttgtggtttgtttcttagcactgtcgctcaagaccacagtacacttggccctgggtaaa

SEQ ID NO: 8620 - DNA, 412 bp, Mus musculus
  misc_feature (183)..(183): n is a, c, g, or t
  misc_feature (207)..(207): n is a, c, g, or t
  misc_feature (221)..(221): n is a, c, g, or t
  misc_feature (260)..(260): n is a, c, g, or t
  misc_feature (262)..(262): n is a, c, g, or t
  misc_feature (277)..(277): n is a, c, g, or t
  misc_feature (279)..(279): n is a, c, g, or t
  misc_feature (285)..(285): n is a, c, g, or t
  misc_feature (335)..(335): n is a, c, g, or t
accagagaggaggtggccttccatgcctcaccggctgaggcagccgcgaacctggcgtgtcctggtctgcccggggctccagcctccgacccgccatgcacatggacatccaagccgtgtcctgcggcctcccgtgggattcttcctccagaatgaggtttttttttttttttagcataaaantataagtattgtgtatgtatgatntgcgtgcatgcatnttcagaagacgacttttataaagggtccggggatggaantntagcttgcaggatcntntgattncaggtaccatacaaagatgtttacaagaaatgcagaggtaaaacagctgntccgaaagccaaccttttgtgtccttaacggcagagtgtcagttaaatcgccccagcgcccggaagtttttattcat

SEQ ID NO: 8621 - DNA, 342 bp, Mus musculus
  misc_feature (107)..(118): n is a, c, g, or t
gggctactgtcgagtttccacaggttcccgtccacgcgacgctccgagtctccagcactccgggtgggaaccggacctctgcgcaatttagagatgcgccccagcgnnnnnnnnnnnnccctgtgtgtcaaagatgtgaccccgaacctgcagagctgccagcggcaactcaacagccgagggactttccagtgtaaagcggacgtcttcttgtcgctgcacgagactgattgccagagcacctgagccctgaaccccaaccctgcggccggtgactctccccaacccccatatgcccagtcttgcttgaagtagcacagaccctgtgtgggtttggcccct

SEQ ID NO: 8622 - DNA, 330 bp, Mus musculus
  misc_feature (29)..(29): n is a, c, g, or t
  misc_feature (139)..(139): n is a, c, g, or t
  misc_feature (193)..(193): n is a, c, g, or t
  misc_feature (239)..(239): n is a, c, g, or t
  misc_feature (297)..(297): n is a, c, g, or t
  misc_feature (301)..(301): n is a, c, g, or t
gctcccagcctttgtggagtaaggtgatncgagctgtggatatcacgagtaagattcgcgtcctgaaacgtcagagcatggctggtgagactgtgtggcgcgcgctttatgcggaatttgaatgacttgtggcgggccncgggcactgccaaaaggatgccaacagcctgacgctaggggctcaggggagccnaggcccggatactacttcctcttgtccattgtccgttaggattttntttcatggaaatgaaggcacctccgtgagcataatgtcaaaggtgtatttaaatgttntccntcccccgttttcggcgagacgtagctgta

SEQ ID NO: 8623 - DNA, 409 bp, Mus musculus
  misc_feature (40)..(40): n is a, c, g, or t
  misc_feature (62)..(62): n is a, c, g, or t
  misc_feature (123)..(123): n is a, c, g, or t
  misc_feature (155)..(155): n is a, c, g, or t
  misc_feature (162)..(162): n is a, c, g, or t
  misc_feature (167)..(167): n is a, c, g, or t
  misc_feature (171)..(171): n is a, c, g, or t
  misc_feature (174)..(174): n is a, c, g, or t
  misc_feature (183)..(184): n is a, c, g, or t
  misc_feature (186)..(187): n is a, c, g, or t
  misc_feature (193)..(193): n is a, c, g, or t
  misc_feature (196)..(196): n is a, c, g, or t
  misc_feature (203)..(203): n is a, c, g, or t
  misc_feature (207)..(207): n is a, c, g, or t
  misc_feature (307)..(307): n is a, c, g, or t
  misc_feature (319)..(319): n is a, c, g, or t
tgccttcaactactggagcatctcctcccgccacgttctncttcaggaggaggtggccgagnctgcagggccaggtccagcgcaccgaggtggcccgcgggcgcttggagaagcgcaattcgnacctcttgctcttggtggacacgcataagaancagatcnaccanaagnagnccgattacnntnncctcancanccggctncagnccaaggaaggcctggggaagagatgcgaggatgacaaggttaagctacaaaacaacatatcatatcagatggcagacatacatcatttaaaggagcaacnggctgagcttcntcaggagtttcttcgacaggaagatcagcttcaagactacaggaaaaataatacctaccttgtcaagcggctagaatacgagagttttca

SEQ ID NO: 8624 - DNA, 513 bp, Mus musculus
  misc_feature (106)..(106): n is a, c, g, or t
  misc_feature (161)..(162): n is a, c, g, or t
gagccttctccggacgctttagggaggacctttgcagtcggccctgggggcgcgggctgctggcgtcctcctcgtcctccccccgccctcctcctcctcctcctcntcttcccttggcctgaaatagagaagtttctgagagaggaccgtttggaccgcgnngttggcgggatgcagtgaggcacgcaatggccggcctcacaatgttgctctgactggctgaagcaacgtatgcgagaagctgggatctttcttaacccacaccagagacaagtgctcgcaaagacatacctgaaatcattcaccaacaaaactcggaagcatgtaaaaacaaagcagttgctgtttctaaataccagaatgcaatcctttcaagcatctagatggagcccatgagctccaagcagagcagtaaatgacacaacctcggggttcgacgtgtgataaggtatcctgtaactactctttgtaccgctgggatctaccctgcttcactggatgacatgcagcctt

SEQ ID NO: 8625 - DNA, 284 bp, Mus musculus
  misc_feature (47)..(48): n is a, c, g, or t
  misc_feature (52)..(54): n is a, c, g, or t
  misc_feature (56)..(56): n is a, c, g, or t
  misc_feature (58)..(60): n is a, c, g, or t
  misc_feature (62)..(64): n is a, c, g, or t
  misc_feature (119)..(119): n is a, c, g, or t
  misc_feature (126)..(126): n is a, c, g, or t
  misc_feature (178)..(178): n is a, c, g, or t
  misc_feature (185)..(185): n is a, c, g, or t
  misc_feature (193)..(193): n is a, c, g, or t
  misc_feature (202)..(202): n is a, c, g, or t
  misc_feature (206)..(206): n is a, c, g, or t
  misc_feature (223)..(223): n is a, c, g, or t
  misc_feature (226)..(226): n is a, c, g, or t
gggcttgacttctccctaccgaaggccagggatggggggcccaggcnncggnnncncnnnannntactgggacaccgcaggacataccggcagaaaccccgaggcccaactgccaccantcctgcntctgaggccacaaacatcagtgacacggacactaccaccagtgtattgattntgtcacntcgagttntcagatttntctntcaacctgggggctttntgntcctctagaaatgcccagaagctcggcctgcacttgacctgctgctccagaggctgtt

SEQ ID NO: 8626 - DNA, 547 bp, Mus musculus
  misc_feature (49)..(49): n is a, c, g, or t
  misc_feature (52)..(52): n is a, c, g, or t
  misc_feature (79)..(79): n is a, c, g, or t
  misc_feature (248)..(248): n is a, c, g, or t
  misc_feature (320)..(320): n is a, c, g, or t
  misc_feature (370)..(370): n is a, c, g, or t
  misc_feature (372)..(372): n is a, c, g, or t
  misc_feature (383)..(383): n is a, c, g, or t
  misc_feature (445)..(445): n is a, c, g, or t
  misc_feature (463)..(463): n is a, c, g, or t
aagagatgctgcaccacctttctcactgcctgtgctgctaggatttagntantaaggatccagtactccagggccaggnccagtgtacagaggaagtacactgtgcgtagttatattttcttaagaaataaaatatgtgccctggatgcatttttctaacatatgtagtctcactttaaaattccatgcattctccaatatcgtagactttatttaataataaataaaaagatcaaaattaggaaacngaaatgtagagaaaattgttattctcaattgcaagcctttgagtatgagtgtgtatgtatttgttttctttntttgtgtgtgtgtgtgtatgtgtgtgacagagagtgacagagagagagancnacagagagggnatatatgtacatgtgtccttttattttgatgctatttgattatatttattaacagttaattntacagctgtggaatatantcccaactgtagtataaagttatatgataaatgttgatatttattagtctctggtttatttgcatatgccctagaacagtcttt

SEQ ID NO: 8627 - DNA, 492 bp, Mus musculus
  misc_feature (201)..(201): n is a, c, g, or t
  misc_feature (204)..(204): n is a, c, g, or t
  misc_feature (242)..(242): n is a, c, g, or t
  misc_feature (244)..(244): n is a, c, g, or t
  misc_feature (250)..(250): n is a, c, g, or t
  misc_feature (279)..(279): n is a, c, g, or t
  misc_feature (307)..(307): n is a, c, g, or t
  misc_feature (354)..(354): n is a, c, g, or t
  misc_feature (398)..(398): n is a, c, g, or t
gcactgcttcttactagatacggtagatatagtgttctgaggagcatacttgaacatccccctgaggtagatcgtgtcagtgccctgaggaaggcatcctgaatacagaaggcccttttatgccaccggttgatgatcctgcaacgcgactctttccatagtctgggtactaaagcatgctgcgtctttttcaaaagcaanaanacaaaacctatttttagaaatgtaaatatttattaccnancaactnggaaaatggaatgtattttattgtcatgnttgaatttagactgtaaactggtatttngtttaggattgaaacataatgacacccgccagtaacaaaaaggaatntagactctcatgtcatttgtatacctgtggatctgccctgtatngttaattctattttacaaaatagaggaagtgtctaatatatgtgcatagtcagttgtcctttttgaaaaataggttgaaattcctctggtcagg

SEQ ID NO: 8628 - DNA, 524 bp, Mus musculus
  misc_feature (492)..(492): n is a, c, g, or t
tagagcaccatgtcccataggcaaagaatacctctggtcaagtcgctacttgtctacgccgacttctggagagcacatggcaccttctgtggaaccagatgatgctttcttaacttctaccttatttaaagatgatgatcaggaaacatatctacctaaacctgaagccaccaggacaaggaagccttctaaaggagaaagagatgaaaacagagctgcgatcccctcagagcatctgcctttctctcagaaggccaggaagccgttaacagaacaagaactgcacgccatgtcagagaaactctctcagcggctctctgaactagactggatgttaaaaactgccctgggtgatcgaggaacgggcgaaactgatggtaatgatggtgatggcggaggtgaggaggtgcgcagtgggaacgaggagatgctctcgcagcacagtgacagcgtcatggagtacggaccaaagaagccgaggccaggattttntacgtgcagaaaggcaccttacaggtcccatt

SEQ ID NO: 8629 - DNA, 271 bp, Mus musculus
gattgagagcttaggaatgattcccagatcaagtgtctacctggtagctgccttcatttttgtcctgatgctcacattcatcagcattctagttctgagctacttctggtactcgaagatttacaggcagttcattattgagccacttcacaagcctcctgaaaaacagaagaaaaattaggaaactggagattaactctgaatacatatatgtatttagataatatacatttaagtaattatattaagaatgtatacttgcctaagaagc

SEQ ID NO: 8630 - DNA, 423 bp, Mus musculus
  misc_feature (279)..(279): n is a, c, g, or t
  misc_feature (295)..(295): n is a, c, g, or t
  misc_feature (303)..(304): n is a, c, g, or t
  misc_feature (307)..(307): n is a, c, g, or t
  misc_feature (311)..(311): n is a, c, g, or t
  misc_feature (322)..(322): n is a, c, g, or t
  misc_feature (331)..(332): n is a, c, g, or t
  misc_feature (334)..(334): n is a, c, g, or t
  misc_feature (342)..(342): n is a, c, g, or t
  misc_feature (350)..(350): n is a, c, g, or t
  misc_feature (353)..(353): n is a, c, g, or t
  misc_feature (358)..(358): n is a, c, g, or t
  misc_feature (382)..(382): n is a, c, g, or t
  misc_feature (385)..(385): n is a, c, g, or t
  misc_feature (391)..(391): n is a, c, g, or t
  misc_feature (398)..(398): n is a, c, g, or t
ggctcccagaaggtagtcactcaggacaaggacatcaacatcgtgcagttctacacaccgttcggtgagcatctgggtactttgaaagttccaggaaagcagatgtgttcgctgtcttgggaaggaggcggactgaagattgctctagctgttgactcctttatatattttgcaaatattcgacctgattataagtggggctactgttccaacacagtggtttatgcgtacaccagacccgatcgtcccgaatactgtgttgtgttctgggacacaaanaacagtgagaaatacnttaaatanntgnagancctcatttctntcaccacgnntngagatttntgcatttnggntacanaagctgatgagaatcaccctcagnttntgcttntcctttncaattctattggcacacccttggac

SEQ ID NO: 8631 - DNA, 536 bp, Mus musculus
  misc_feature (44)..(45): n is a, c, g, or t
  misc_feature (47)..(48): n is a, c, g, or t
  misc_feature (50)..(50): n is a, c, g, or t
  misc_feature (52)..(56): n is a, c, g, or t
  misc_feature (59)..(65): n is a, c, g, or t
  misc_feature (68)..(71): n is a, c, g, or t
  misc_feature (73)..(79): n is a, c, g, or t
  misc_feature (81)..(89): n is a, c, g, or t
  misc_feature (93)..(96): n is a, c, g, or t
  misc_feature (98)..(98): n is a, c, g, or t
  misc_feature (101)..(101): n is a, c, g, or t
  misc_feature (103)..(103): n is a, c, g, or t
  misc_feature (105)..(105): n is a, c, g, or t
  misc_feature (347)..(347): n is a, c, g, or t
  misc_feature (349)..(349): n is a, c, g, or t
  misc_feature (355)..(355): n is a, c, g, or t
  misc_feature (396)..(396): n is a, c, g, or t
  misc_feature (399)..(399): n is a, c, g, or t
  misc_feature (423)..(423): n is a, c, g, or t
  misc_feature (433)..(433): n is a, c, g, or t
  misc_feature (436)..(436): n is a, c, g, or t
  misc_feature (486)..(486): n is a, c, g, or t
  misc_feature (510)..(510): n is a, c, g, or t
ataccaacaaagatgccacctcagcctcttctatttgtagactnncnngngnnnnntcnnnnnnnctnnnntnnnnnnnannnnnnnnntttnnnncnttngncnagggtgtcaagaaaaattgtaaccagatgaaatctggtcagttattacctgagacaccttttcagttcatacccccaaatacattgaaccttcgtagtttcaccaagatcatgaagagactggctgaactgcacccagacatcagcagagatcacattatagaggctcttcaggaagtgaggataaatcataaaggttttctgaacggtttgtccatcaataccattgtaaaaatggcttcntnttttcngagaaactctgctttgaaataaatgaagcaatacagagaangtntttggaaagtatgaggacccttcntcagaggaanttntacagcaatttggaaaaagctgagggtaatacaatcagacagctttgtanttggacctaaccctttaagtattntgatagtcctttaaaagctggtgaca

SEQ ID NO: 8632 - DNA, 312 bp, Mus musculus
  misc_feature (27)..(27): n is a, c, g, or t
  misc_feature (97)..(97): n is a, c, g, or t
  misc_feature (99)..(99): n is a, c, g, or t
  misc_feature (111)..(111): n is a, c, g, or t
agaggatgcacaggaacggccatgtgntgagcagtgggcctccaaaattgctctctgtgggcacttcccatcactgccctccagacaatgtgaaccntntgctgcagcttntgcagcaaggtcctcacgagctgctgggacaccacagttctactttcacacaagaaagctccttactcacagggttcatcttctactagtgtttatctgttcagagtggatgaccagctcttacagaagaaccgacaggccccagcccaccgccagctgtccacaggtacccttcagcattcaagtccttataaagagcag

SEQ ID NO: 8633 - DNA, 469 bp, Mus musculus
  misc_feature (168)..(168): n is a, c, g, or t
  misc_feature (204)..(204): n is a, c, g, or t
  misc_feature (212)..(212): n is a, c, g, or t
  misc_feature (264)..(264): n is a, c, g, or t
  misc_feature (304)..(304): n is a, c, g, or t
  misc_feature (321)..(321): n is a, c, g, or t
  misc_feature (327)..(327): n is a, c, g, or t
  misc_feature (353)..(353): n is a, c, g, or t
  misc_feature (357)..(357): n is a, c, g, or t
gacactgttcatgtgtaaccccagcatctgggatgctgaggactaaattcaaaggaattagccgggcagcagaggattatggtctaaacctggactatagtgaggtctggctctataaaagagctgaaaggcttgtctggcagccacgggcagtgcttgaactgaccnccagatggcagcctgttcctagcttaaggcctctcncataaccnctaaaaatcagaggccattcccaaccaagaacaccaaaaggatgtgggattntactaaagataagtactagaaattttaaggatgaactgtnagctataggagcaccantgaganccggggaagcactttaaccttgcctntgantggtagtagtcacaagcaaagggacttgacttgtcatattttaaaggatacctcaaaacctgtataccccttctccactttagcaagaaagcatatacccttgttccacagg

SEQ ID NO: 8634 - DNA, 433 bp, Mus musculus
  misc_feature (26)..(26): n is a, c, g, or t
  misc_feature (41)..(41): n is a, c, g, or t
cagacttttcccagattaggccacantacctagttgttggnagagggggagttaagaaatgtatggttgtggtactgcagatgcctttccaaaaaggaagatcggaaatggcttgtgtttacttcatggcacaatatcatgtacttccctgatgtgagggagtctcaggcagacatagtgcaggtttcagcttgcatgtatccatcacagagcaagggaatggccatccattctaaggaaaagtattctgtcccctatggtgctgtaccgtcatgctaattgttcacacactgtaacatcacacctccaaatgcaaaatcgaagcacgggattcatgtaaaaacagagagtgccaaactgctgttaaaacatttaaaaatatgtttattgtaaatctttattgcacaaaagagcctgataatccttcatgtat

SEQ ID NO: 8635 - DNA, 432 bp, Mus musculus
  misc_feature (32)..(32): n is a, c, g, or t
  misc_feature (73)..(73): n is a, c, g, or t
  misc_feature (77)..(77): n is a, c, g, or t
  misc_feature (112)..(112): n is a, c, g, or t
  misc_feature (119)..(119): n is a, c, g, or t
  misc_feature (139)..(139): n is a, c, g, or t
  misc_feature (173)..(173): n is a, c, g, or t
  misc_feature (214)..(214): n is a, c, g, or t
  misc_feature (224)..(224): n is a, c, g, or t
  misc_feature (243)..(243): n is a, c, g, or t
  misc_feature (251)..(251): n is a, c, g, or t
  misc_feature (276)..(276): n is a, c, g, or t
  misc_feature (292)..(292): n is a, c, g, or t
  misc_feature (306)..(306): n is a, c, g, or t
  misc_feature (311)..(311): n is a, c, g, or t
  misc_feature (313)..(313): n is a, c, g, or t
  misc_feature (319)..(319): n is a, c, g, or t
  misc_feature (352)..(352): n is a, c, g, or t
  misc_feature (354)..(354): n is a, c, g, or t
  misc_feature (381)..(381): n is a, c, g, or t
tttggcgactttcttgacgacataggcaaggnggcctccatgtttccacgcgagtcggtggagttaccctacnacangcctgacccgcgcacctggtcacaggcattaaatntaccatntgagcatcaaaatcggtttntgggccttattaaggccgcggaagcccggggccnagtccataccctgcggttgcgctacacccgaatgcgggcanaggaaatctntttgctgatccagaagcanagctccgngcgcgctgccatccgactggaactnttcctaccaccccaantgaagcccacaaanatccntnatcctntggaccgacacgagcggaggcgtgttgagacantnctggaagaggaggtagatggcaacatnttcccccgatgactgagaccttggcgttcagagaccctacggttacagcag

SEQ ID NO: 8636 - DNA, 193 bp, Mus musculus
ctgcatgtcaagcaccgcctggtatctgacattggagccaccaaaatcccacacatccggcttatgctgagcacgaagatgccagttatgttcgaccggaaggagtcagtggcgcatcaggactgggtcagcctgcgctggtttgtaaccatccagccggcagcaccagagcagtatgaactgcgcttcaagc

SEQ ID NO: 8637 - DNA, 423 bp, Mus musculus
agcatacagagcagggtttcccagtggcatcttcatacacatggtattctctgttcccattcactctcctcaccacagtaagcttgttcctggaggagccataaggagtgaatgtcaggtcctaaaactaaagagattaaaaaaaaagtctgaatataggatatttgatgaactttataaagctacttatttcagtatgcaatgtttaaatgcctatggtctagtcttcaaaagaaactttattgtgttataaactgtgcgggtaatacttgttatttaaatgtcagaaaattaattgcttttccacttatagaacatttcaagtgttttgatatgttagtacgagaagaactttaatacttgacttcagaggacagagaaatacacagtgccacaaaggcctgttcaggcttcaaacaaaac

SEQ ID NO: 8638 - DNA, 414 bp, Mus musculus
  misc_feature (44)..(44): n is a, c, g, or t
aatgaccctgcgtatagtgcggttagacactataactccggttntgcagcatctcaccacacaggaaacatgtctccactggcaaccacgtgagctggggattgtttatttactgcgtctgtctgctgagaataaactacgcctcagggactcctgtgttccaggctaccttgtagttcatcagccacaggcatgagcccgaactgaactttaagaaataagtttgatcagcaccttgcttccctttggcttggcttctgtgataacccacgaggccaagactcagcctaaagccagtgagatgagaagaattgctctgtcacattttggagaagggtgtctgctgcttccagccagaccacgcccccaacctccaacccctgcaagacagacatctatacactgccagcatta

SEQ ID NO: 8639 - DNA, 474 bp, Mus musculus
  misc_feature (145)..(145): n is a, c, g, or t
  misc_feature (350)..(350): n is a, c, g, or t
  misc_feature (409)..(409): n is a, c, g, or t
gtatgggatcgttcctatgggtagaaatcatcagaaatcaagtacattgaagcctggcatttttacataacaactcaccattttatttctgtcgccactggcttcttaggtaagtttgtttcctttccacagctagaaagtcgtncatattccattgcttttcctccatctatcttaggtcttaatcatttttcttcgtaagagggatcagcatagtgatagggactcataggtaacctgcagcagagacagggcgggcctactgcctccttccagctggggaacgcagactgggtggccagcggagttccagatgcagggggcactgtggtgtgagccgcacgcatggncagtcaacactggactggtgctgttgtagcctgggaggcagatgctgcactttcagatnccatagacactgttcaccaaccctaaaagatgtaagaaatgtctgcatgcggttttaatctcata

SEQ ID NO: 8640 - DNA, 465 bp, Mus musculus
  misc_feature (28)..(28): n is a, c, g, or t
atggagctcaaccttcgacctgttgatntgtcttcttccaaagccatggagtccttcctgtttggctcatcagtgcagaaagagcaagagaggtctgtgtcaggaggctctatgggtaagtccaacgtgtcaggcctcactccatcccattggctgggtcagccagggcctggtagtaaatgagacaagcatgaatctttgtaacatatttggaatttttgagaaaaaattctctgcatagaaagaaaataaactagagggcaaagtcctggtctagtttcagttaagccaggaagagaggatacagcttttgccagaggaagccaagagaacaactgctgagcaagaaatgctgaaataacttaggcgtgccaacagttcaagagacgtcactcttaatgtctcagtgatctgtggtgagagcaagatgcttgcatgtcgcttttgattaaacctatgcctgtt

SEQ ID NO: 8641 - DNA, 490 bp, Mus musculus
  misc_feature (224)..(228): n is a, c, g, or t
  misc_feature (230)..(231): n is a, c, g, or t
  misc_feature (240)..(241): n is a, c, g, or t
  misc_feature (248)..(248): n is a, c, g, or t
  misc_feature (251)..(251): n is a, c, g, or t
  misc_feature (253)..(253): n is a, c, g, or t
  misc_feature (256)..(256): n is a, c, g, or t
  misc_feature (274)..(274): n is a, c, g, or t
  misc_feature (278)..(278): n is a, c, g, or t
  misc_feature (328)..(328): n is a, c, g, or t
  misc_feature (349)..(349): n is a, c, g, or t
  misc_feature (365)..(365): n is a, c, g, or t
  misc_feature (385)..(385): n is a, c, g, or t
  misc_feature (393)..(394): n is a, c, g, or t
  misc_feature (426)..(426): n is a, c, g, or t
  misc_feature (442)..(442): n is a, c, g, or t
tgccgacaacagtcttaccacagttatctttgcccactgtccaaaggcaggagagaaaagatggtaaataggacagggggatgtggacctgttcacaagtagttctttggggtcatctccatttgtcaggatactggcagtccagttcagtagtgacagggtaccaaacaggaatcagcagcaatggcatgatccaaagaaactgccagatctctgttgaatgnnnnncnntcagcaggnntaccagnatnanccnggaggccaggagaagttntcgnctgtgcctctctcaatgaatggaagatcaatgaagatgcaagaccaaggnagaggtgcaaagttagctatncaagcatcattacctnccattgaatctaatttatantctctccnnacatcacatgtcctaccacaggacttgcctcncaaaacaccacatgantctgtatcacctgacatatccagaaatttccacttcagcagttttcaa

SEQ ID NO: 8642 - DNA, 442 bp, Mus musculus
  misc_feature (231)..(231): n is a, c, g, or t
  misc_feature (237)..(237): n is a, c, g, or t
  misc_feature (248)..(248): n is a, c, g, or t
  misc_feature (271)..(271): n is a, c, g, or t
  misc_feature (295)..(295): n is a, c, g, or t
  misc_feature (345)..(345): n is a, c, g, or t
  misc_feature (383)..(383): n is a, c, g, or t
  misc_feature (386)..(386): n is a, c, g, or t
  misc_feature (393)..(393): n is a, c, g, or t
  misc_feature (395)..(395): n is a, c, g, or t
  misc_feature (411)..(411): n is a, c, g, or t
gcaggcttctcttggtctgtagcctcgcctttatgcccttctctacagacccctgggaaattacgatgaacgagatagaggagaaggaagtggatgaattcaactccagcggtctcaagtgtcccacatgcttcaccgtgaaggggagagagtgcagtccagagctcaagtggtgttccacggacaagataaagtgtgtggagctctccggcatcataaacacaggtgtcnacaacntccccattcanctgatgaaatgcataaccatagnacagtgcaaagacacagcgacggnttatatgggttttacaatcagtaacaaaagtgaaatctgtaagtcagccntcagaaacggggccagagtcagacccccaacccccatnttntttgttntnttcctgaagaaactgnttcactgagcagctgcagaggctcagccacc

SEQ ID NO: 8643 - DNA, 391 bp, Mus musculus
  misc_feature (73)..(73): n is a, c, g, or t
  misc_feature (76)..(76): n is a, c, g, or t
  misc_feature (85)..(85): n is a, c, g, or t
  misc_feature (87)..(87): n is a, c, g, or t
  misc_feature (101)..(101): n is a, c, g, or t
  misc_feature (139)..(139): n is a, c, g, or t
tgtgctgcactattgccgggcaaagagagatctttcctctcctgcagcctgtgccctcagttatcaagtgtgnagnaagatgccnantgtgcctctagggncctcctgccccaagagagaggggctctgcactctaggnaggttgctcagggcctctgtactgcctgcactctccatttccttacatgggcacagccagggtggctggcacggcatggggcactggacaggcaccatgtgcctctactccgtcaccagggacagcctctgaagggctgaggagacaagctctgctattcccagggccagatccaagcaataataggaggtgagggccagaggacactcagggacactgtcaggggctggagccccagaaggtagtgttttc

SEQ ID NO: 8644 - DNA, 121 bp, Mus musculus
  misc_feature (45)..(45): n is a, c, g, or t
acagtctgtcaactgaaagtttcatgagttcgctcctttgccaanatcttggcgaacagtcccttaccgtgtgattgaggctcagaaattatttttcttttggtgatgatcgtgctgggct

SEQ ID NO: 8645 - DNA, 144 bp, Mus musculus
  misc_feature (46)..(46): n is a, c, g, or t
  misc_feature (52)..(52): n is a, c, g, or t
  misc_feature (54)..(54): n is a, c, g, or t
  misc_feature (77)..(77): n is a, c, g, or t
  misc_feature (83)..(83): n is a, c, g, or t
gaagtcgtttatccgttccgaggatacaatatgggagacatacctntccaantntcaggaacaaattactatctgtntccttntgatggtgggcagattgaagtggaaaagaccaggtttgaacgagggtcaactttcatcaaa

SEQ ID NO: 8646 - DNA, 450 bp, Mus musculus
  misc_feature (318)..(318): n is a, c, g, or t
  misc_feature (367)..(368): n is a, c, g, or t
  misc_feature (414)..(414): n is a, c, g, or t
  misc_feature (421)..(421): n is a, c, g, or t
caacgggtggcatcatagacatggccagcagtacctttcagggaatcaaaagagctacagagacttctgaagtagagagtttacgacctcccagattctttaatgaagatggagtcatcagaccttacaggttgcgcgatggttcaggaaatcaaatgttacaggcatcaaaaagtttgatatgaaaactgttaatgcatgactttgcaagtgaaagccaacagtagattttagtgttaaacttttacaaactctgtgcagctgtttcagtattttgaatataaagaaaagattttgtgttatgaacatcagtcagtntaatctttccatagactattcctggttctgggtgttctagatctggccnnagccaaggtgccttataagccctttaaacctggtagcacatacttntcttatnttcttaggttgtttctgtctgaggttctt

SEQ ID NO: 8647 - DNA, 450 bp, Mus musculus
  misc_feature (283)..(283): n is a, c, g, or t
  misc_feature (316)..(316): n is a, c, g, or t
gtggttgcttcaagtattattccaaacgagctgggcattctttaaataattgaaaaatatatttgaaatatgtgtatttctgtggagagctactaatctcgtacacggttgccatggaacccagtgagctctcaataggctaattgtaacagactacaaacaaattacgagcatcgtaaaacccgttgactcttggagtttccaggtgtctttgaagagtgtagaagccatttgagcagcacttaggtttaaaattgggatttggacctttaatgggaagacnccaaactggtgttaacacgcttgaggcatcatncctgtcttagtgtaatttttttgttgttttaaaatacttctgtgcatttgtgaatttggacaaactcaaagtaaaggaaaatcatcccccaagtggataattccacgttgaaccagcccgaacatgttggctta

SEQ ID NO: 8648 - DNA, 266 bp, Mus musculus
tgctgagtgttttcagccatgatctgaggagtcaggaccaagtgccgttcatgtcttcccaagttctcttagtgaccctggactcccgatgcctcagcgtagggatcttaaaatccaaagtagttactttcatggctgaaatttgcaccaacatgtgatagcattacgttatcttggaaaattcaaaattcagaaagctcctgtggcatatgaggacacatgtgagtatatcatctgcacagcaagtgtgatatctcagggtacat

SEQ ID NO: 8649 - DNA, 433 bp, Mus musculus
  misc_feature (344)..(344): n is a, c, g, or t
  misc_feature (350)..(350): n is a, c, g, or t
  misc_feature (354)..(354): n is a, c, g, or t
  misc_feature (370)..(371): n is a, c, g, or t
  misc_feature (373)..(373): n is a, c, g, or t
  misc_feature (375)..(375): n is a, c, g, or t
  misc_feature (377)..(377): n is a, c, g, or t
  misc_feature (381)..(381): n is a, c, g, or t
  misc_feature (389)..(389): n is a, c, g, or t
  misc_feature (407)..(407): n is a, c, g, or t
caaaggcagtttctccatcatacggatataattcctggaatcatgaactggaagaagttccagcccctggtgttttcctccatgtctgacccctctatggtggaagccactcagagaagtgactggtacagttccgtgatgctgcccatagatgtccctgccccactggaggacttaccagaagaagacagactggaaactactgagcgagatctctgtgatcagggcatagaagtcatgctgacgccagaaatggtccaagtggaattccccatgctgattcacagggactccaagaaggagaaggatttcaaagactccacccagttaccagaaaaggtggnagaaanggtncaggaggagatgaagnntntncngaancaaagctntcaacacgtacctgattntagactaaaacccactggtgtgcccg

SEQ ID NO: 8650 - DNA, 541 bp, Mus musculus
  misc_feature (148)..(148): n is a, c, g, or t
  misc_feature (151)..(154): n is a, c, g, or t
  misc_feature (156)..(158): n is a, c, g, or t
  misc_feature (160)..(163): n is a, c, g, or t
  misc_feature (165)..(166): n is a, c, g, or t
  misc_feature (168)..(173): n is a, c, g, or t
  misc_feature (175)..(178): n is a, c, g, or t
  misc_feature (180)..(181): n is a, c, g, or t
  misc_feature (203)..(203): n is a, c, g, or t
  misc_feature (237)..(237): n is a, c, g, or t
  misc_feature (283)..(283): n is a, c, g, or t
  misc_feature (299)..(299): n is a, c, g, or t
  misc_feature (301)..(301): n is a, c, g, or t
  misc_feature (332)..(332): n is a, c, g, or t
  misc_feature (339)..(339): n is a, c, g, or t
  misc_feature (353)..(353): n is a, c, g, or t
  misc_feature (384)..(384): n is a, c, g, or t
  misc_feature (397)..(397): n is a, c, g, or t
  misc_feature (401)..(401): n is a, c, g, or t
  misc_feature (457)..(457): n is a, c, g, or t
  misc_feature (459)..(459): n is a, c, g, or t
tggaggaatcacacgaatggaagctaggttccagcaaggacccattcttggagtccagacagcccgatgttaccttctcctctgatgttggtattcatatgctcagctaaatgtacataactgtgaatcaacactaagagcaccgganggnnnngnnnannnngnntnnnnnnannnntnnagagaccctgggagaaggacancaacaagaatgagtgtgtgtctggtaaatacacnacagggtctgttaaccttcaaggacgtggccttggatttctcactngaggaatgggaatctntnagttttgctcagaggacattgtacatggatntgatgtnggagaattacaatnatctgttgtttgtggaaaatcattgcatatntggaaagtatganaagntcttggatcaagacagccagtacattgtccatgaacacatgaatattcaagagaantnttctaaatgggacaaacttagcaatgtgatacttgaagcctcccaatgtacaccttacaaaactaatcacacctctgatgct

SEQ ID NO: 8651 - DNA, 406 bp, Mus musculus
  misc_feature (169)..(170): n is a, c, g, or t
  misc_feature (172)..(172): n is a, c, g, or t
  misc_feature (177)..(177): n is a, c, g, or t
  misc_feature (185)..(185): n is a, c, g, or t
  misc_feature (187)..(188): n is a, c, g, or t
  misc_feature (219)..(219): n is a, c, g, or t
  misc_feature (240)..(240): n is a, c, g, or t
  misc_feature (360)..(360): n is a, c, g, or t
  misc_feature (375)..(375): n is a, c, g, or t
ttaaaactagagttcctgctttggggtgtgtgtgtgtgtgtgtgtgtgtgtgtgtgtttcaagactctatgtgtatgagtattttgcatgcatatatatgtgtgtatcatttgcatgtctgataaccccagagtcagaagagagtgtcagagtccctgaaactgaaatnntngacanttgggaananncatatgggttctgggaaatgaacccaggtcntcttccagcaagaagagtgantcctgctgttaaccatggagccagctttccagccttttggagtttttatttaattttcgttttatttatcaccatgtgcccacttaacaccctttaccaggcctcattcaggacgttcantcaaagtctgggatntacgatgctggtcaaccattttgctgtaatt

SEQ ID NO: 8652 - DNA, 393 bp, Mus musculus
  misc_feature (280)..(280): n is a, c, g, or t
  misc_feature (317)..(317): n is a, c, g, or t
  misc_feature (337)..(337): n is a, c, g, or t
aaaggccagacagcgacagcgacagtagctcagaagacaagagaggaaacgaaggaagccaaaagtgccgcaagtgtaaaaagaagaaaagatactagcgaactgtatctgcactgctctcaaacctctctagaaaaaaaaaaatctgttgcaccaaatgatccatttcttgtccagcttgtcgtttttgaaaacgtatggaaatatgactctgtgatttgctattcagtttactattcatgcttatgaatgacaaaagccttgaaacagtaatatattnttgtgcgtttgcatttgcaagattgccttgggaccanttgtctcacagaaagctttntaccagcgcaggtgggctggcctcagaggggttgcgggcagaactaatgggaataa

SEQ ID NO: 8653 - DNA, 443 bp, Mus musculus
  misc_feature (260)..(260): n is a, c, g, or t
  misc_feature (266)..(266): n is a, c, g, or t
  misc_feature (273)..(273): n is a, c, g, or t
  misc_feature (279)..(279): n is a, c, g, or t
  misc_feature (281)..(281): n is a, c, g, or t
  misc_feature (286)..(286): n is a, c, g, or t
  misc_feature (309)..(309): n is a, c, g, or t
  misc_feature (318)..(319): n is a, c, g, or t
  misc_feature (322)..(322): n is a, c, g, or t
  misc_feature (343)..(343): n is a, c, g, or t
  misc_feature (345)..(345): n is a, c, g, or t
  misc_feature (395)..(395): n is a, c, g, or t
  misc_feature (397)..(397): n is a, c, g, or t
  misc_feature (404)..(404): n is a, c, g, or t
ggaggaaaaccttgttctgtcagaaaaaattcagcagttggagggaaccgctgccacctcgattgtgagtgggcacccatcacacacacacgatgagcttctgcgcaaaaaccaacagctgaccatacaggtggcttgcctgacccaggagctgactcagctgaaaagactggaggagacagttgctcttctccatgagagtcagaggtccctggtggtaactaatgagtatctgctgcagcagctgcataaagagcagnaaggtnattccgngaaatntntcctncctcccgagaagagtcatccttnggggagatnntcnccctttgggaaaagcacgctntnttcctcctcaccaatggtacacgacacgggtcagtacctaatacagagtntntcagaanccgacccagagcctagtttgtggagctagcaccgcagcc

SEQ ID NO: 8654 - DNA, 502 bp, Mus musculus
  misc_feature (165)..(165): n is a, c, g, or t
  misc_feature (309)..(309): n is a, c, g, or t
  misc_feature (313)..(313): n is a, c, g, or t
  misc_feature (322)..(322): n is a, c, g, or t
  misc_feature (324)..(324): n is a, c, g, or t
  misc_feature (330)..(330): n is a, c, g, or t
  misc_feature (332)..(332): n is a, c, g, or t
  misc_feature (342)..(342): n is a, c, g, or t
  misc_feature (349)..(349): n is a, c, g, or t
  misc_feature (406)..(406): n is a, c, g, or t
  misc_feature (419)..(419): n is a, c, g, or t
gtatctgcaccccacgggcggaaaaagtggaagtgtgagaccctcagaggacagaaaacgagccagctctgcacatacatccagcttgaaagggagtatccactccgcggcagccagactgagcatgaccgtctggagcaagatggcttggtcgacacagctggntaagccccagcactcaaccccctttctcaccccgaggaatcctaccccacttaacaaagtgggggctccacatacagacgtgaactgcagccgattccccactgctttagagaaggacctggggccaccaggagtaactgtttntagnatagagagntnccaggnanatgagacccntggaaantcaatggggacaccccacaatccagccatctcacaaaagtttggttttatgaggcanttgagatattttntcagacagtatggccttaaaaagtaggccacaggctcagagtccttaggacacgtcagagaaggcatgcgacggacctgctta

SEQ ID NO: 8655 - DNA, 514 bp, Mus musculus
  misc_feature (257)..(257): n is a, c, g, or t
  misc_feature (268)..(268): n is a, c, g, or t
  misc_feature (279)..(279): n is a, c, g, or t
  misc_feature (286)..(286): n is a, c, g, or t
  misc_feature (290)..(290): n is a, c, g, or t
  misc_feature (296)..(297): n is a, c, g, or t
  misc_feature (303)..(303): n is a, c, g, or t
  misc_feature (305)..(305): n is a, c, g, or t
  misc_feature (314)..(314): n is a, c, g, or t
  misc_feature (318)..(318): n is a, c, g, or t
  misc_feature (320)..(320): n is a, c, g, or t
  misc_feature (328)..(329): n is a, c, g, or t
  misc_feature (378)..(378): n is a, c, g, or t
  misc_feature (395)..(395): n is a, c, g, or t
  misc_feature (470)..(470): n is a, c, g, or t
gtaagctctggtaactcaatggattgggcttataaaaatggaataccctatgcatttgcttttgaactgcgagacactgggcattttggatttctactgccagagatgctcattaaacccacctgcacagagaccatgctggctgtgaagaatatcacaatgcacctgctaaagaaatgtccttgagaggaacagtcatctagtctaccaacacagagaaagcagattctgatcaaaaggcaccttggcaaacatanctgtttagacnggaaggatccnatggacntaanaggatnnttcatncnattcgacantttncnaagactgnnaagtagggcacagcctactttggtatgagaagaaagtccactttatatntctttagagtcctattngattacaagggggagggaatgttttcaaattcctttgtctcaaaaggtgtacaaattaattgaggatttttcttntctcaaccactccatccttgattaagacctatgctaccaacgac

SEQ ID NO: 8656 - DNA, 522 bp, Mus musculus
  misc_feature (305)..(305): n is a, c, g, or t
  misc_feature (326)..(326): n is a, c, g, or t
  misc_feature (347)..(347): n is a, c, g, or t
  misc_feature (369)..(369): n is a, c, g, or t
  misc_feature (392)..(392): n is a, c, g, or t
  misc_feature (394)..(394): n is a, c, g, or t
  misc_feature (404)..(404): n is a, c, g, or t
  misc_feature (410)..(410): n is a, c, g, or t
ggagaagtcaagtcccttattttcagggtgtttcatccatcgatctgcaagaactgcaaaaggagactagctggcacggtggtagagtacttggctagcacgaggaaagccctaaattcagttcccccagatccagcagagtgaaagagaaaaagccagatcgcatttaatgcacacatttgttcttgattcaactgactgccaatgaagtgtcttctgaaaatttgtgttaaatacatgcaaggtatttttcttgtcattctctacacatttcagctatgtcgttaacgtcatatttagtgctntaagtactccagagataattnaagtatctgaagtcagtcagntcatgggcattttcaactaaantcacagttactggaaggctgagncnagaggatcancccagnccagccagagtaacaagaagatcctcattaatacagaccagacccacaatcacagctattcagacagttgaggcaggagaatcaaaactttaaggcctattctgggccacag

SEQ ID NO: 8657 - DNA, 550 bp, Mus musculus
  misc_feature (177)..(177): n is a, c, g, or t
  misc_feature (186)..(186): n is a, c, g, or t
  misc_feature (192)..(192): n is a, c, g, or t
  misc_feature (235)..(235): n is a, c, g, or t
  misc_feature (253)..(253): n is a, c, g, or t
  misc_feature (337)..(337): n is a, c, g, or t
  misc_feature (366)..(366): n is a, c, g, or t
  misc_feature (374)..(374): n is a, c, g, or t
  misc_feature (377)..(377): n is a, c, g, or t
  misc_feature (391)..(391): n is a, c, g, or t
  misc_feature (451)..(451): n is a, c, g, or t
  misc_feature (453)..(453): n is a, c, g, or t
  misc_feature (494)..(494): n is a, c, g, or t
  misc_feature (503)..(503): n is a, c, g, or t
ggaagatcaacaaacgccgtgggaagaagaggacatagagaaaacatctgcagagacacatgtttccttagaagaagtgtatgagtttgacaagtactacacagaatactacgccactccggagagcgctgtactatatgagacagtttaccagaaccttgatgatgacgaggagantatggtggnaatcanggcttccagcaaagaccgtaacctcaagaacctttctgcaatnatggacggcatcggctgnaaccctgagctcaaattgctgaggattcttcaggccactgaggaggaagatgaggaaggccataattctagggcacagagtaanacgtctctagaagcttagctcaaatcatnactttggncanctttagccagaganttcttggtattctgaggacaacaaccttggacacagggaagaaaagagagaatgttgttntntggatcctccagcaggaccaggccctagataccctgtattnttcatttantctttacctccaaaacgagtaagaaaaagccctaatcctatggaata

SEQ ID NO: 8658 - DNA, 414 bp, Mus musculus
  misc_feature (204)..(204): n is a, c, g, or t
ctccaggagcatgtggaacccgttagggtgaagtggcctgtgaagccctaccccctgaaggaggaagaggaggaggaagaagaggagctgggggccgacatgggccccttgcagtggtgacttcttgctagaatttggtctgcaaggagaggggaattcagctctgaaccagtgccctgggcctctcagaagtgtttggggccntcttatcctctctgtcctctcacttccagccttgctagcatttggacatgaacaggcagaagccctccaggtagctctgcagtcatgtgggtcatcagaagctccattatctcctggttaatagttgcttacttgccgtcccagtcacttggaggggaccctgggaggcagaaggtttggtctaagtggcatttagatctgagctggcat

SEQ ID NO: 8659 - DNA, 141 bp, Mus musculus
gcacttggaatctcctcacgaagagcgggtgtccagtgccttacactctgtggagatggagcttcagaagttaacggagattccctggctttattacatcctccgccccagtgaggacgaggagcctcctctggattgtac

SEQ ID NO: 8660 - DNA, 456 bp, Mus musculus
  misc_feature (263)..(263): n is a, c, g, or t
  misc_feature (295)..(295): n is a, c, g, or t
  misc_feature (325)..(325): n is a, c, g, or t
  misc_feature (387)..(387): n is a, c, g, or t
  misc_feature (423)..(423): n is a, c, g, or t
catgggagtccccaaaggactttctttccaaaatcaactattaccattatacttggtagtcttttaccctttggctgtatttttctgcaactttcttatattctaaaccgtatttggtctcctcatatgtactacctgtttgccttccttctcttactcttcttaatttttatgatttcctgttcagaagttacagttctgctatgctattttcggctgtgcgctgaggatcgtggttggtggtggagagcctttttgaccancagttttacatctgcttatatttttatatatntaattcattacttttttaccaaacttcaantcactagcattggaagtacttttatgtactttgggtatgcatttatcctagtgctagctttntttcttttcacagggacaattggatttttttcttgnttcttctttgttactacaatctacggtgtgata

SEQ ID NO: 8661 - DNA, 511 bp, Mus musculus
  misc_feature (48)..(48): n is a, c, g, or t
  misc_feature (74)..(74): n is a, c, g, or t
  misc_feature (89)..(89): n is a, c, g, or t
  misc_feature (92)..(92): n is a, c, g, or t
  misc_feature (103)..(103): n is a, c, g, or t
  misc_feature (136)..(136): n is a, c, g, or t
  misc_feature (242)..(242): n is a, c, g, or t
  misc_feature (340)..(340): n is a, c, g, or t
  misc_feature (392)..(392): n is a, c, g, or t
  misc_feature (454)..(454): n is a, c, g, or t
  misc_feature (468)..(468): n is a, c, g, or t
gtagcgaatgaaaccgtcaacatcttattgatacttttgagagcttcngcaggctgctggaatagcaactttgnccgcagttcttcgcnccnctttatcgtgnctagcatgaccagacaagcaggagacatgctgngggagactagagtcagtcgcctcttgacctctaagctcagaaaagctgagatcttagatgatttttttctaacatcacccacagaggaaaggaaattggaaacccnaactttccccaaagattataattctcaaatgctttagaacaatatttctatttctggtcagttttttctctctctctctcatttagcacaaagagttnaagggagagttaaaatataactcaggacagcgggtctgatctggggccattngtttagttgcacagatctccccatccccacacaaaaacaccagaaactttggcttcttcttnttcttttttttttnaaagtgaaaaatgtttatgaagacttggacacttttatcctga

SEQ ID NO: 8662 - DNA, 380 bp, Mus musculus
ccctaatgtgtgttttcatcagcataggataatccaattacctttatttagtcaaaccttgctattttcgtttgagcaacagttcttattcttaactcctatatttttatctcaaaaatgaaagaaatgtctatctagagctattttgggcaaaagtatctggagagggacagagtgggacaatggctttcaaaggtacaagcacctttcccctgactgcacttcctcctctcaggagcctgcggaggagacagcttccctgggttctttctagtgtcagccttcagggtgatctaggaaaaaataacacttcggaatgtggcttatacttttagagatttagaaagaaaatatgttactaaggcttacaatcagatttt

SEQ ID NO: 8663 - DNA, 266 bp, Mus musculus
  misc_feature (183)..(183): n is a, c, g, or t
  misc_feature (202)..(202): n is a, c, g, or t
  misc_feature (215)..(215): n is a, c, g, or t
  misc_feature (223)..(223): n is a, c, g, or t
  misc_feature (229)..(229): n is a, c, g, or t
ggccctacggggtgctagacaataccagagtgccccacttcatgaaggactttgaaccttaccgccaccagctggaacacatcatgaccaccaaccggctggatgaaacggagctgggcccccttctgcctgactgattttgactaagggttataaacagacgctcttgacacgaggtcacanatcggaatatgaagttctntatggttccatancctaggtntttctngggggcatttgggaggccaggagcatcgtgggcagat

SEQ ID NO: 8664 - DNA, 358 bp, Mus musculus
  misc_feature (93)..(93): n is a, c, g, or t
  misc_feature (95)..(95): n is a, c, g, or t
  misc_feature (101)..(102): n is a, c, g, or t
  misc_feature (111)..(112): n is a, c, g, or t
  misc_feature (115)..(115): n is a, c, g, or t
  misc_feature (117)..(118): n is a, c, g, or t
  misc_feature (124)..(124): n is a, c, g, or t
  misc_feature (129)..(130): n is a, c, g, or t
  misc_feature (133)..(134): n is a, c, g, or t
  misc_feature (137)..(137): n is a, c, g, or t
  misc_feature (141)..(141): n is a, c, g, or t
  misc_feature (145)..(145): n is a, c, g, or t
  misc_feature (152)..(152): n is a, c, g, or t
  misc_feature (158)..(158): n is a, c, g, or t
  misc_feature (161)..(161): n is a, c, g, or t
  misc_feature (165)..(165): n is a, c, g, or t
  misc_feature (175)..(177): n is a, c, g, or t
  misc_feature (184)..(184): n is a, c, g, or t
  misc_feature (186)..(186): n is a, c, g, or t
  misc_feature (199)..(199): n is a, c, g, or t
  misc_feature (202)..(202): n is a, c, g, or t
  misc_feature (205)..(205): n is a, c, g, or t
  misc_feature (241)..(241): n is a, c, g, or t
  misc_feature (258)..(258): n is a, c, g, or t
  misc_feature (265)..(265): n is a, c, g, or t
  misc_feature (293)..(293): n is a, c, g, or t
  misc_feature (301)..(301): n is a, c, g, or t
  misc_feature (309)..(309): n is a, c, g, or t
gttttcaacactcaacattggcagccttgctagaatgccagtttagatgcccagagggactgctgtccagtagctgtgcatgtattccctaantnggtgannttcatgggnnccntnncacctnagaanngcnnccngacntttngttacangaaaanacnctgngatgaggccnnncccacantnatgacaggacagnttnaanagagcaaggctataatagttaaggttagaaaccaanatttgaaacatgaacantgctttnttgggggcaaagtgctaagctccacccnggaggaantcaggttntggcatcctggagctcagagtccagcacacggtcattgaggtagcaagt

SEQ ID NO: 8665 - DNA, 318 bp, Mus musculus
  misc_feature (126)..(126): n is a, c, g, or t
  misc_feature (130)..(130): n is a, c, g, or t
  misc_feature (133)..(135): n is a, c, g, or t
  misc_feature (137)..(143): n is a, c, g, or t
  misc_feature (146)..(146): n is a, c, g, or t
  misc_feature (158)..(158): n is a, c, g, or t
  misc_feature (161)..(161): n is a, c, g, or t
  misc_feature (163)..(163): n is a, c, g, or t
gaaagcgagctatgaatgaatgtgagtgtgtgtgtgtgtgtgtgtgagagagagagcgagctatgaatgaatgtgagtgtgtgtgtgtgtgtgtgtgtgtgagagagagagagagagagcgagctntgantgnnngnnnnnnngtntgtgtgtgtgtntgngngagagagagagagagagagagctgtgagtacacatgggtgctggtgtgggacaggagcagatcttggtggagtgggtctacacttgagatttgtactcgtttgagaggctgggcaatactcaatgcactttggcatttgcatggtgtcttcacaa

SEQ ID NO: 8666 - DNA, 104 bp, Mus musculus
  misc_feature (28)..(28): n is a, c, g, or t
  misc_feature (46)..(46): n is a, c, g, or t
tcctaatatgaacaacggatgggacttntcagaggaaaaggtgaantcaaacagatcagcaagacagatccaaactaccagacgctgacatcacctctaatgtt

SEQ ID NO: 8667 - DNA, 225 bp, Mus musculus
  misc_feature (30)..(30): n is a, c, g, or t
  misc_feature (44)..(44): n is a, c, g, or t
  misc_feature (48)..(48): n is a, c, g, or t
  misc_feature (55)..(55): n is a, c, g, or t
  misc_feature (120)..(120): n is a, c, g, or t
  misc_feature (122)..(122): n is a, c, g, or t
  misc_feature (147)..(147): n is a, c, g, or t
gaagagttcctccaaagggatagttaactntcccaaaggatacnaaangcatttntaaaatggatgacaaacattgtaaggaatatactttcctccaaatgaatataaattctatgaaantntccaaagacctttgaaaggaaatgntccgcccctttcctttaccagcaatatctgttgaagcagtatgaaggggagaggtgaacactggattgttttagctct

SEQ ID NO: 8668 - DNA, 239 bp, Mus musculus
  misc_feature (44)..(44): n is a, c, g, or t
  misc_feature (58)..(58): n is a, c, g, or t
  misc_feature (62)..(62): n is a, c, g, or t
  misc_feature (69)..(69): n is a, c, g, or t
  misc_feature (134)..(134): n is a, c, g, or t
  misc_feature (136)..(136): n is a, c, g, or t
  misc_feature (161)..(161): n is a, c, g, or t
aacctcaacggcaagaagagttcctccaaagggatagttaactntcccaaaggatacnaaangcatttntaaaatggatgacaaacattgtaaggaatatactttcctccaaatgaatataaattctatgaaantntccaaagacctttgaaaggaaatgntccgcccctttcctttaccagcaatatctgttgaagcagtatgaaggggagaggtgaacactggattgttttagctct

SEQ ID NO: 8669 - DNA, 108 bp, Mus musculus
  misc_feature (34)..(34): n is a, c, g, or t
  misc_feature (67)..(67): n is a, c, g, or t
gcattgaacccaaaaaaattctgtaatctgattnttggaataatggttgaattttgtgataatcccnaaacttctgctcatgtcaatgcttggcgtgggaagaaagac

SEQ ID NO: 8670 - DNA, 139 bp, Mus musculus
  misc_feature (56)..(56): n is a, c, g, or t
  misc_feature (65)..(65): n is a, c, g, or t
aggtcgaacggaaatgccctgacatgattttaaatagtatttttttatttttcttntcacgtttntgctttttctagtggcatgatgtaatggcaagaataagaactttgacattagatttcctgtatttagattcctg

SEQ ID NO: 8671 - DNA, 199 bp, Mus musculus
  misc_feature (29)..(29): n is a, c, g, or t
  misc_feature (33)..(33): n is a, c, g, or t
  misc_feature (40)..(40): n is a, c, g, or t
  misc_feature (43)..(43): n is a, c, g, or t
  misc_feature (49)..(49): n is a, c, g, or t
  misc_feature (59)..(59): n is a, c, g, or t
  misc_feature (67)..(67): n is a, c, g, or t
  misc_feature (112)..(112): n is a, c, g, or t
  misc_feature (115)..(115): n is a, c, g, or t
tctttagcacaattcttgcttttagattntggntttgagnttngattanttttgttctntggttttntttagtttcaatagaagtttttttgtttgtttgtttgtttgtttnttnggtgttgtttggtttttgtaattgatttaatattttgataaggctatacactgtacatattgactgcccacttttagttactat

SEQ ID NO: 8672 - DNA, 88 bp, Mus musculus
  misc_feature (46)..(46): n is a, c, g, or t
ttgagcagcagtatttacaataaccgagctttcacggctaattttngcatttcaggaaacacagaccttagcgattttccataaaatg

SEQ ID NO: 8673 - DNA, 85 bp, Mus musculus
  misc_feature (26)..(26): n is a, c, g, or t
cccacatcagggttcacttccacatntgaaatgtgatgaactccaatcttttccagaaaagcactgcttccctcatgtgtgcagt

SEQ ID NO: 8674 - DNA, 145 bp, Mus musculus
  misc_feature (39)..(39): n is a, c, g, or t
  misc_feature (60)..(60): n is a, c, g, or t
  misc_feature (111)..(111): n is a, c, g, or t
  misc_feature (114)..(114): n is a, c, g, or t
tatccctgtggaagccgattttcctgtaggaagatgatnttataaggtgtatgtaagaanttattttttagcagaagtcagtattccagccaggcagtttttcagcatttnttntccccttcccagagcccgtgtagttccagtg

SEQ ID NO: 8675 - DNA, 148 bp, Mus musculus
  misc_feature (37)..(37): n is a, c, g, or t
  misc_feature (51)..(51): n is a, c, g, or t
  misc_feature (56)..(56): n is a, c, g, or t
  misc_feature (121)..(121): n is a, c, g, or t
actgataagggccaacagactgtggtgagccgagganttgaagaagccctntccgnttcatccttcccagtggccaagcacattaattttttcatacactgactgttattttaactgttanttttatatagttgggacatcagctgac

SEQ ID NO: 8676 - DNA, 135 bp, Mus musculus
  misc_feature (76)..(76): n is a, c, g, or t
ccacttccgcaatttttgaaatgcctgatgcctggggatgaaagacgaccagaacaactaatcggatggtgccagntacagggaacgagatgccctggaccaatggggcacgggtggagcgtataaaaacacatc

SEQ ID NO: 8677 - DNA, 111 bp, Mus musculus
  misc_feature (28)..(28): n is a, c, g, or t
ctgcctgcacaggtttttctgaggtttntcatgttcgcaccccagggttccctccttccccctgttttgaatcagggtgttaatatattgcccaatcgggacccaaatgac

SEQ ID NO: 8678 - DNA, 477 bp, Mus musculus
  misc_feature (28)..(28): n is a, c, g, or t
  misc_feature (31)..(31): n is a, c, g, or t
  misc_feature (36)..(36): n is a, c, g, or t
  misc_feature (64)..(64): n is a, c, g, or t
  misc_feature (73)..(73): n is a, c, g, or t
  misc_feature (77)..(77): n is a, c, g, or t
  misc_feature (160)..(160): n is a, c, g, or t
  misc_feature (246)..(246): n is a, c, g, or t
  misc_feature (269)..(269): n is a, c, g, or t
  misc_feature (301)..(301): n is a, c, g, or t
  misc_feature (410)..(410): n is a, c, g, or t
taatgaagtttttccacgtaattgccanaanaaaantagttgcacaaaaggctaactgcatggnttgagaacncgancgtgtaattaagtgtggagaggggtacagaactgaatatgaaatgtggccttttcctcagatcttataaccagtttaaaggcncaatagcaattaagaaacaggtattttagtcgcagcgtgcgttgggccatgaatgaacatttatctaggtttaatgaagattaggnatagttgaccttttccaaagatnaccaagctggagtttgaacctggttatctttnagagttacatatgctttaataaccattccattctgtttattgaattcatggacacacaaacccaaaaggtattttattcaattgaccagaattatttcacaagtgcctntcacatgctaactacaatgtttttacattctggaaatagattggcaattgtgtactaattagcttta

SEQ ID NO: 8679 - DNA, 498 bp, Mus musculus
  misc_feature (79)..(79): n is a, c, g, or t
atgcgtgagtcaactcctcagggttccgcccaaccaccccgcatcttccccgcctagtgggcaaaatgcgcaggcgtancacgagctagaggccctagattagctctgcagaagtgcgggactatccggatcccgcaagcccgagccatggagtcccagcgcaccccggcgtttccccatacagccctccaccccgctggtccctggttgctgccaacagcgaccaggatggcccgagctcccagaaccctccgcccttgatgctgtctaaggctcacccgccgctcctgcagtgcaccgtgccgaaggccaggagttgtttcccaggaggtacgcgaggccacggatggaccaggagcaggactgcagtttgcgcatgcgcagaggaaggggcggtgcgcccaacggtgctcgtagtggggtctccacgtccagtgttggaagaaggactgttgcctggaaaacggagtcagctcctgtctcactctgtattgtaaa

SEQ ID NO: 8680 - DNA, 385 bp, Mus musculus
  misc_feature (236)..(236): n is a, c, g, or t
aatccaagctggcatatgacgtcttaagtgaccctcaggaaagagcgtggtacaataaccaccgagaggccttacttaaaggagggctcgatggggaatatcaagatgacagcttagatctgcttcattatttcacggttacctgttattctggttatggggacgatgaaagggggttctatgcagtgtatcgtgttgtctttgagctgattgcaaaagaagaactggagtgtatntcagagggagatgttgaggattttccaaccttcggcgactcccagagcgactatgacacggtggtccaccctttctacgctcactggcagagtttctgcacacaaaagaatttttcctggaaggaagagtatgatacccggcaagcctc

SEQ ID NO: 8681 - DNA, 537 bp, Mus musculus
  misc_feature (341)..(341): n is a, c, g, or t
  misc_feature (441)..(441): n is a, c, g, or t
gggtcaacttcagtaagcttcctctgaagcaactgaaggccgagcctttagagcaaccattgtcaacctttgtgggtcgcctaagagcatcgcaaaccagatatttacattatgattcataacagtgacaatcacagttatgaggtagaaaggaaagggattttatggttgggggttagtccaacaagagggacagtgttaatgcttctgaagcatcaggaaggttgaaagccactgctctagagccaagtgagtgcatgtctagggttcccatgtttacagtaaggaccggctcaggcactgaccctctgagtcacgtgaatgaggacgaagaatttggnataggtttggttacatctatttctcatccccttattttccaccatttaaaaataataaacatgtttcttaccaccgtatgttcatatggataagactaantccaaaaaggtgactacatccaaatttatatttcggggaaataccatgagataattatagcatactgggcatgtgtccacacacggattggtttca

SEQ ID NO: 8682 - DNA, 373 bp, Mus musculus
  misc_feature (233)..(233): n is a, c, g, or t
gtctatggagacctattgtcctaattacttctcagttgtcctgacaaagcaccatggccaaggcaactcaatagaaggaaaagttttctgcttccagtttcagaggaccatgaccatcgtaacgcggagcatgacagcaggcaaaccgggatggcgctggagcagcagctgagagcttacattgtggctcataagctgaaagagactacagggtattgtgtgggcttttgaanccttaaagtccacaccactgtcacccctgccccaagaaaacttatctcctaatccttgccaaacagttctaccaaatggggaccaagcattcaaatacatgaaactgtaggggtcattccgattcaaccatacacaagac

SEQ ID NO: 8683 - DNA, 494 bp, Mus musculus
tagacgacgactcgctggccaagctggccgagcaggtgggcaaacaggcaggggacctgcgctccgtcatccgctcccccctggccaacgaggtctcaccagagactgtcctgagactctactcgcagtcctcagatggtgccatgcgggtggcccgtgcctttgagaggggcatccctgttttcggcacgctggtggccgggggtatcagcttcggcacggtctacaccatgctccagggctgtctcaatgagatggctgaggacgcccaacgcgtccgcatcaaagccctggaggaagatgagccccaggggggtgaggtgagcttggaggcggctggtgacaatttagtggaaaagcggagcactggggaaggaaccagcgaggaagccccgctgtccacccgcaggaagctcggcctcctcctcaagtatattcttgacagctggaagaggcgcgacttgtcagaagacaaataaaacgcagccctgccc

SEQ ID NO: 8684 - DNA, 403 bp, Mus musculus
  misc_feature (53)..(53): n is a, c, g, or t
  misc_feature (171)..(171): n is a, c, g, or t
  misc_feature (186)..(187): n is a, c, g, or t
  misc_feature (266)..(266): n is a, c, g, or t
gtcagggtcttggagcaccatcccaatcgcggcagagcaactgctgatgcctnggagtggagcttgttccgagacatacacttgaacttcgtatcccgagctcgcttgctgataaactccaccgggtctgatggctgtccgctctctctctccgggaccgctgagctgctngcttcttgagaaccnntccccggttgtaaaacgatgctagggacgtctggtcctcagggccactaccttgagcagaagcgggcactgaagcgacnctcgagcctcagcctctactgaggagcgagggcccctttccgctcgctggttctgcaggctacctcaggctcccttctcagcagcgtgtttgcacacgcttccccagtttctagctctgcctttacaacctatttta

SEQ ID NO: 8685 - DNA, 438 bp, Mus musculus
  misc_feature (36)..(36): n is a, c, g, or t
  misc_feature (65)..(65): n is a, c, g, or t
  misc_feature (73)..(73): n is a, c, g, or t
  misc_feature (90)..(90): n is a, c, g, or t
  misc_feature (120)..(120): n is a, c, g, or t
  misc_feature (130)..(130): n is a, c, g, or t
  misc_feature (135)..(135): n is a, c, g, or t
  misc_feature (146)..(146): n is a, c, g, or t
  misc_feature (262)..(262): n is a, c, g, or t
  misc_feature (279)..(279): n is a, c, g, or t
  misc_feature (311)..(311): n is a, c, g, or t
  misc_feature (342)..(342): n is a, c, g, or t
  misc_feature (363)..(363): n is a, c, g, or t
  misc_feature (392)..(392): n is a, c, g, or t
attgtagtgctcagcccatatgttccaaaactatanacatgacaagttagctgctttgacagtcnctcagaantcctgtataatggtggnacttcagtcttcagccctctggcaccgtanaactgacagnctttnctgtgcagcangaatgatgaaggacttagctatcttgttcttgcaaagcttggcagttgagttccctgcatcccagtttgtccattccggacagcattcagtcagcatttgaagcacggacagtttnttgcacagtggcagtgnccacatttgaaacaaactccatagggagattntttgatgctcaactttctttgaagtagaaanacgggtcctgttgccaaaaanccttttaataataaaacatctttaaatgncatattctgtagatctctgatgtttccaaaaaccatctataactga

SEQ ID NO: 8686 - DNA, 541 bp, Mus musculus
  misc_feature (26)..(26): n is a, c, g, or t
  misc_feature (109)..(109): n is a, c, g, or t
  misc_feature (159)..(159): n is a, c, g, or t
  misc_feature (163)..(163): n is a, c, g, or t
  misc_feature (183)..(183): n is a, c, g, or t
  misc_feature (197)..(197): n is a, c, g, or t
  misc_feature (249)..(249): n is a, c, g, or t
  misc_feature (256)..(257): n is a, c, g, or t
  misc_feature (281)..(281): n is a, c, g, or t
  misc_feature (286)..(286): n is a, c, g, or t
  misc_feature (348)..(348): n is a, c, g, or t
  misc_feature (351)..(351): n is a, c, g, or t
  misc_feature (353)..(353): n is a, c, g, or t
  misc_feature (355)..(355): n is a, c, g, or t
  misc_feature (358)..(359): n is a, c, g, or t
  misc_feature (388)..(388): n is a, c, g, or t
  misc_feature (401)..(401): n is a, c, g, or t
  misc_feature (404)..(404): n is a, c, g, or t
  misc_feature (416)..(416): n is a, c, g, or t
  misc_feature (440)..(440): n is a, c, g, or t
  misc_feature (442)..(442): n is a, c, g, or t
  misc_feature (444)..(444): n is a, c, g, or t
  misc_feature (452)..(452): n is a, c, g, or t
  misc_feature (505)..(505): n is a, c, g, or t
gaaggcctaatgaagtggagttgatnccttgtatcagaaacagatgtgaatggtacctgggtcatctcatccatcctttaaatgactaactttataaaatagaaatccncctcagaaatttgaaagtgaagttcttattggttgatgaagtttttaccngatngcttaatcaggtaagaaggnctgtgctgcaaacncgacttcattttgaatttgaaaagcttacactattatggaagaggaaagacnccttttnngggcagctgctgaagtagtccttnctccnagacccagacttccttcaggcctatgcttgcctttgttctgtgatttgttctgtattcctanttntntnatnnttgaagaccaaaagtcaagaatctcattntgctgactcctgncanacaaaagccacngagaagactaaactgactgtgccntntntcaatttnatttaaacattacccagggctgatgggaaagaagaacgttcaaagatggacanaccccaatgatcaaagtccaaattgtgctacccaga

SEQ ID NO: 8687 - DNA, 523 bp, Mus musculus
  misc_feature (222)..(222): n is a, c, g, or t
  misc_feature (224)..(226): n is a, c, g, or t
  misc_feature (230)..(231): n is a, c, g, or t
  misc_feature (233)..(233): n is a, c, g, or t
  misc_feature (243)..(243): n is a, c, g, or t
  misc_feature (370)..(370): n is a, c, g, or t
tgattctccgacacatatcagtggagtctctgcacggcaacagagaacagagtgaccgagagaaagcgttagagaactttaagacaggtaaagtgagaatacttattgctactgacttggcatctcgaggtcttgatgtccatgatatcactcatgtctacaattatgattttccacggaacattgaagaatatgtacacagagtagggcgcactgggagancnnngcgnncnggaatgtcanattacccttatcacaagaaatgattggagggttgccactgaattgattaatattctagaaagagcaaatcagaatatcccagaggaacttgtcttaatggctgagagatacaaagcaaataaactanaaagagagatggaaaaaaaaatgggaagacctcaaggaaagccccagaagttttactaatgttgcgtggagcactaggtgccgcaggattcaagattgtagtcaaagtggaagtgttgaaacatacgtcactatggagagacttggctgattc

SEQ ID NO: 8688 - DNA, 386 bp, Mus musculus
  misc_feature (124)..(124): n is a, c, g, or t
  misc_feature (190)..(190): n is a, c, g, or t
  misc_feature (192)..(192): n is a, c, g, or t
  misc_feature (204)..(204): n is a, c, g, or t
  misc_feature (275)..(275): n is a, c, g, or t
  misc_feature (281)..(281): n is a, c, g, or t
gagtcctgggctcattctggacaaaaaatggggcagagactaaaggaaaggccatccagagactgccctaccttggaatctatcccatctgaagacaccaaactccagcactattgcggatgcnaagagaccagggcttggacttggctgtgttcctctgctgaaggttacagctactgctgcacagctntntttgtacagatntccccagataaagccacaatgtaaggttccaggtggccacacttatttggagacaccatttaacacggttntgcttntacttccatgagaacctagtgaagaagacacagccagagctttgatcaaagattccaaatgcaaatacaactaaccacccaactggtcccatcagccaatgtatt

SEQ ID NO: 8689 - DNA, 385 bp, Mus musculus
  misc_feature (186)..(186): n is a, c, g, or t
  misc_feature (209)..(209): n is a, c, g, or t
  misc_feature (215)..(215): n is a, c, g, or t
  misc_feature (234)..(234): n is a, c, g, or t
  misc_feature (321)..(321): n is a, c, g, or t
  misc_feature (333)..(333): n is a, c, g, or t
atgtgcaatggaacgttgtccccactgggctgcactgtattttaatagagcaagtttctatgtctacttaaagaagtataagcttgctgaagaggaccttggtataggcctgtccttgaagcctgatgaagctataatgtataatctcagagcacaagtccgtggcaaaatgggactgatagcggnagctatgagtgactacaaccaancccttnatcttgaagaatgctccanagctatgtgaatacagacttgtggtttgtgcagtaggttaagtacgttttcttcctgaagctgaaatatatttgttgtgtagaaatnccaccattgttnttgtatttatcacacttattaagtggttattctttagaaccacttaacatat

SEQ ID NO: 8690 - DNA, 310 bp, Mus musculus
  misc_feature (127)..(127): n is a, c, g, or t
  misc_feature (134)..(134): n is a, c, g, or t
gagccagaccccagcaagttgtaaacaggcttttctttgattatccagactcagaccgagctagccttcttgctgtggcccggtttattggagagaagcctataacgttcgttaagacagattccantcctggnctcttccagaacatcctggtggggacattagtggtggccttcttcttcctgcttttccagttctgcttgcatgtgaacttccagaaaggggcctaatgagatatccagccagagccagctgaggtgagcaggtgagccagagacggagccctggacccagctgtgagccacacaca

SEQ ID NO: 8691 - DNA, 419 bp, Mus musculus
  misc_feature (107)..(107): n is a, c, g, or t
  misc_feature (254)..(255): n is a, c, g, or t
  misc_feature (331)..(331): n is a, c, g, or t
  misc_feature (341)..(341): n is a, c, g, or t
gcaaatgtattttcatgtcccagggtaatgccaatgaagtggattagcacaatggaattcttaatgaaatcaggctgtgagaatacttgggaagcatatgggtaggnagttatacactgctttggaacacctcactgtctgcaaagaggactttctttaatcttgtacacaagcataggaatactttcattaggggtacttgaaaactgaggcctaacccctacatggtgcctcgtatctgtaactctagactnnggggtttaggtctcaggagtcctgtgagtccgaggccattgtgtaccacaaagaacatgtatcaaatcccccaccncccaaaaaanctctcaaaaacatagctttcagacagaacaaacgaacggtagactactttaaagctgtgcttagcatccaagtagagg

SEQ ID NO: 8692 - DNA, 500 bp, Mus musculus
  misc_feature (98)..(98): n is a, c, g, or t
  misc_feature (134)..(134): n is a, c, g, or t
  misc_feature (152)..(153): n is a, c, g, or t
  misc_feature (365)..(365): n is a, c, g, or t
  misc_feature (432)..(432): n is a, c, g, or t
aataccttgatgtgctggcgccttacgtgaaccaagtgaaccttatccgagctggggttccgaaaattaatttttctggtcccgattaccccagcatncgccctcctgtactcatcctcaccgtcaagaggtgncctggggtgagcgagcannaggtctaccgtgagttccagaatctctgcaagttcgatgtcaggcggttcactcgaagccagttcctgctcctgaccaataagtttaaggatgcccgcagtgtcttgaaggagtacaggaaccacccaaccctgcaggtctccttgtaccggtcctggagacattcccccaacatcacctgcctgttacaggtctgcagcatagtcaccacntgggccatgattgcatttctcctgggaagacccatgccctgagagcagtgagccacctcagcttctntcttagtctctggagatggccctcgtggctcgtttgtataaaccagtttgttttcatgcagacccttg

SEQ ID NO: 8693 - DNA, 384 bp, Mus musculus
  misc_feature (89)..(89): n is a, c, g, or t
ctcacaggccctaagatatttctaaatggatccattgtaatgtatgctaattttgaggagacaacggagtgtagtgaaagaaactctgnattcaaatcttgagcactgcactgcgtttggacttggggtctgaggtgagcctcagaaggctgaaatgcaaaatactcaaggaaaaaagaaaataaagttgtgtgtcacccctgcccagctaagattttttttcttttaagatagaagctatttttaattttgttagaagccctactgatagaaaaggtaacctttagcaggtagatcgttgaaatgcaccttgccaacatttagctacatgcttatcaccacacttgaagtgatgatacaagaagcctttcaatagctgatgaa

SEQ ID NO: 8694 - DNA, 460 bp, Mus musculus
  misc_feature (28)..(28): n is a, c, g, or t
  misc_feature (30)..(30): n is a, c, g, or t
  misc_feature (32)..(35): n is a, c, g, or t
  misc_feature (43)..(43): n is a, c, g, or t
  misc_feature (117)..(117): n is a, c, g, or t
  misc_feature (361)..(361): n is a, c, g, or t
ccgggacccttcgaggatattacagggngnannnnaacactantgagaaaagtcctctgaggcttcattttctactaattgaagagaaaggcactggctttgaaaacacaaaccaanaccagttccagtttccggaggggactgtaggcctgcagtatgtggagtttggtggaagatgctaggcaaacggctattttcatctcttgcacgattgcagcgaagcaccaactgatgacaaaaggaagtacttcaaaattttgctagtgaatatgtggattgaatgcccagaagcagttatgaagcatttagtgtgccatctgaactttaactttgatattcctaatgtattgatgtttacatnttcatctatcttcttataaccacttacgtattcatttaactctttatacacttctgacatatgttcgttttatggtagaccgtttgacacatatccatg

SEQ ID NO: 8695 - DNA, 448 bp, Mus musculus
  misc_feature (412)..(412): n is a, c, g, or t
gggtactgactgttgacctagggtcagacatatgtcacacatatggcagaggcggaattcaacttggatgtacctctccctagggcgtgcgatggccacctcatgtctaagctggagctaaggtgtggatgtggcctaacaccccccactcctttgcgatccgatacatgtttgcatccttctctgggaatcagccagtaactgacatggaagacattcagcagaggccgaatgagtgctcccctgggctggctgtgacagagtgaggggctcattagtcctcacctaccattgcggctctctatggtcccttgttccttctgggcgctccgagagcagaccgaactcacacatcacagttgatgccctacctcacagtgtgtgtttgtgtgtgtggttgttgttgttgttntcgttttactttgagattggttctatgtagccctaa

SEQ ID NO: 8696 - DNA, 505 bp, Mus musculus
  misc_feature (42)..(42): n is a, c, g, or t
tgctccaggctgctccatgaaagagcagagaaaccactatgnaggcagggtgtgggtggtgtgggagggtgcttggtatctaacatgttttagcatttggatggaggggtggtgctactgccagctgcccggctgctaaagataagcaagaatctgtgtcaggctttgagccacacaaagatcaggtcctatggcaggtcactggtaggcagcattaagcccacataatcctgtccacaaacccacaggggatgctaccatagttccaatcccaagacatgtcctttagaagccacatgcaagttgggcctctgccaagaccacaggtagcctccctgtacacggactccagcctgccctgcccacgtgctgaggtcccatgcttgaactccagggcagcatgactcctccctctgcccagcagccttcacttcatccacttaactgtcaagagcaaaggcatccactgttcccaagccacactttcccagctcataatgtcaga

SEQ ID NO: 8697 - DNA, 504 bp, Mus musculus
  misc_feature (223)..(225): n is a, c, g, or t
  misc_feature (227)..(228): n is a, c, g, or t
  misc_feature (230)..(234): n is a, c, g, or t
  misc_feature (236)..(236): n is a, c, g, or t
  misc_feature (240)..(240): n is a, c, g, or t
  misc_feature (242)..(242): n is a, c, g, or t
  misc_feature (245)..(248): n is a, c, g, or t
  misc_feature (250)..(251): n is a, c, g, or t
  misc_feature (272)..(272): n is a, c, g, or t
  misc_feature (294)..(294): n is a, c, g, or t
  misc_feature (303)..(303): n is a, c, g, or t
  misc_feature (310)..(310): n is a, c, g, or t
  misc_feature (315)..(315): n is a, c, g, or t
  misc_feature (417)..(417): n is a, c, g, or t
gtaacattcatgagaccctggtttcagcctcaccacatacatgcataaactcaaacctacaaatctccacatcaaataccactctagcatgtgttcatattttctcaaatattgtcctatgcaccttccccactttgtgccagtgcaaataagtatgagtgggaattgctattttaccacccctctagtgtatgatgctaatataaagcctgccaattgatcnnntnnannnnntnttcntntannnncnnacaaatgaagtccctgaattnttcacagctgacacttaaaganccacaagcnacagttnttatntcggcttcagtgctcttggtgagcaacaatttgttgtccacttatttgtgctcccctggtcctacactccatcctccatatgaaagcgttgaacagaagtgntctgttttaacttacctagtttgcactgaacattgctgtgtcaccgacagcctaagtcttttgtcactacacattttgctctagctc

SEQ ID NO: 8698 - DNA, 455 bp, Mus musculus
  misc_feature (175)..(175): n is a, c, g, or t
  misc_feature (218)..(218): n is a, c, g, or t
  misc_feature (263)..(263): n is a, c, g, or t
  misc_feature (275)..(275): n is a, c, g, or t
  misc_feature (277)..(278): n is a, c, g, or t
  misc_feature (311)..(311): n is a, c, g, or t
  misc_feature (333)..(334): n is a, c, g, or t
  misc_feature (382)..(382): n is a, c, g, or t
  misc_feature (395)..(396): n is a, c, g, or t
  misc_feature (400)..(400): n is a, c, g, or t
atttcacttctttcggttaatacaggtggagctgcactgctcggttgtgtcccgctgatggaatagctaatacttagacctttagacaggcattgttcgcccattgcagtccttgagtggacatcctgttctttgtgcacaagtgtatctttacaatagattcctaggaagttgnaccgccggctccagccggttccagcgctcccaatctctgcctnctttgataaggtttggcagcttcccctcatacactctgctcactntattcaccccancnngtgtgggagaatgcctgtttcccacaacccccntcccccgaaacataaacacttnntcgtagttttcaacccacttcttcatgctcagggtaacttgtactttnttttctgtgattnntctntcctaggattgagctcattttcatattgcgttgctcacacccacgtaggatggtt

SEQ ID NO: 8699 - DNA, 469 bp, Mus musculus
  misc_feature (26)..(26): n is a, c, g, or t
  misc_feature (59)..(59): n is a, c, g, or t
  misc_feature (62)..(62): n is a, c, g, or t
  misc_feature (368)..(368): n is a, c, g, or t
  misc_feature (435)..(435): n is a, c, g, or t
ttcccaaatcgttgtatcatgctttnccggtaatgtctagaaaatggtttgtttatagntgntaggatagaaaagaggggtccattttgtacccccaagctatgcttttcaccccttaaattgaacaaccctatgcttctccgtgtttatataatagctagcacaacacatttaggaattctcaggcactgttgaataggatctctcacttttaaggctactgatatattctatttaaagaactacaggcaggcatggtacaatcctacagttacagtcccagcacttggggggtgaggggggacccgagggcagctgcaagcctgaagccagcctggcttgcacagtgagttccaggaccatccagncctgtgtagcgagatgcagcctcaaaacaagagaggggtgagatagcccagcaggtaaaggttcctntcccaactcttgatgacccaattcaaatccctgg

SEQ ID NO: 8700 - DNA, 461 bp, Mus musculus
  misc_feature (26)..(26): n is a, c, g, or t
  misc_feature (40)..(40): n is a, c, g, or t
  misc_feature (83)..(83): n is a, c, g, or t
  misc_feature (88)..(88): n is a, c, g, or t
  misc_feature (160)..(160): n is a, c, g, or t
aaataaatcagcgatggacagagganaagctattgagggnaaatggaagttgaatagagactggaagaaagattctttacagntaggntatggtagcataaatgcacaatcccaatttactggttgaggccaacctgtgctgttgcataagtcaatacanacaaccacacagagcacacacacactaatattctaaagttcaagattatcctgtctaaaaaaaaggatatgcatataatcttatagtaactatgtgttgctttttttcactttagtactttaaaggtgtgtgtgtgtgtttaaataatttacagaggcagagctggagagatgttttaagtggttaagagcactggctgctcttctagagaacacagggtttgattctcagcacccacatggaagcttttaacagtttctaactttagtcttaagggaattgaaaccttctaatacataga

SEQ ID NO: 8701 - DNA, 275 bp, Mus musculus
  misc_feature (48)..(48): n is a, c, g, or t
  misc_feature (73)..(73): n is a, c, g, or t
  misc_feature (137)..(137): n is a, c, g, or t
tagacttgggtatcacaggcccagaaggaatcgagatcagccatccanaggagctggaagcagaagccactcnccgtgtcatcaccattgcaaaccggactcactgtcccatctacctggtcaatgtgtctagtatntcagctggtgatgtcattgcagctgctaagatgcaagggaaggtggtgctagccgagaccaccaacgcacacgccacgctcacgggcttgcactactaccatcaggactggtcgcatgcagccgcctatgtcacggtg

SEQ ID NO: 8702 - DNA, 456 bp, Mus musculus
  misc_feature (268)..(268): n is a, c, g, or t
  misc_feature (270)..(270): n is a, c, g, or t
acacagcgtctcagatgggcaggcaggaatggcatgaccctggggtactgtacttgggtattttatcacagcaattcgaatggaactagaacaggcaacatctctagagcaatacctcctcgcccagatcaataaggacttctcccagagtgcctggtacacagctccaaaagggaaagcggccctgatgaactccacccctggctttgtactagctcatgctatctgttccttttcctgccagtaatctagccttcctaacagcagntntgggttattctttggagaactaccttctccattactttcctagatccctgttgtttgggtagaattgaccatactacctccagttcagaaggcagatcataagatcaaagcttgacttaaaaatgcctttcatttttttctgccaccagaggtttacggatgaacatgtagcccaaaccagacttt

SEQ ID NO: 8703 - DNA, 435 bp, Mus musculus
  misc_feature (328)..(328): n is a, c, g, or t
  misc_feature (340)..(340): n is a, c, g, or t
  misc_feature (368)..(369): n is a, c, g, or t
  misc_feature (374)..(374): n is a, c, g, or t
  misc_feature (379)..(379): n is a, c, g, or t
gtcaagtttattagcaccgcctttcaaactgacaaagccatgtggggttagatttttctaagagaaagaagtcactttctatcattttaggtttagatattggttcctttgaaaccgaagggtatttctgtcattcttcacctttctgagccttatccctagtgaagtaagccttagtgcaagtcttggggagactctaaagtgcaaatagctgttggggggcttttgggtgagcaagtgaaccaagagagaccctggctccccaccccccgcccctccccctccccagggctgatgtggagctgctaacaggcttctgcctgatctntagcctttcaanttgaagccccacaaatcaagggcctganntctcntcaantgcaacagggtcaggagtgaggctgaggcaggtaggatgacgagtgcacatttttt

SEQ ID NO: 8704 - DNA, 406 bp, Mus musculus
  misc_feature (79)..(79): n is a, c, g, or t
  misc_feature (99)..(99): n is a, c, g, or t
  misc_feature (111)..(111): n is a, c, g, or t
  misc_feature (113)..(113): n is a, c, g, or t
  misc_feature (122)..(122): n is a, c, g, or t
  misc_feature (135)..(135): n is a, c, g, or t
  misc_feature (142)..(142): n is a, c, g, or t
  misc_feature (164)..(164): n is a, c, g, or t
  misc_feature (166)..(166): n is a, c, g, or t
  misc_feature (171)..(171): n is a, c, g, or t
  misc_feature (190)..(190): n is a, c, g, or t
  misc_feature (208)..(208): n is a, c, g, or t
  misc_feature (211)..(211): n is a, c, g, or t
  misc_feature (316)..(316): n is a, c, g, or t
ggactacgaactgcttgtgctccagcacgcctgctgcccttactgcgaaggcgttatcgacgacactgccccttgagcnagcgacagcctctgggaccncggctcccatgntntccttgctntccccagactgtngggaganggaattaaaccctcagaacacntntcctncccagatgaagtttgtatnttgcaaaggggggggggnctnccttgtgtaaccacagatttcctatttatggcatttcattccttgtaaatagcaccaggagacggggaagagaacacacacatattttctaagaaaaaaaaaaantctgttacttttagaagggctcatgtgttcatagcagcctgctggagtccgtagatccgtcagaccattaccgtgcacacgttgccaaca

SEQ ID NO: 8705 - DNA, 484 bp, Mus musculus
  misc_feature (220)..(220): n is a, c, g, or t
  misc_feature (241)..(241): n is a, c, g, or t
  misc_feature (262)..(262): n is a, c, g, or t
  misc_feature (266)..(266): n is a, c, g, or t
  misc_feature (271)..(271): n is a, c, g, or t
  misc_feature (286)..(286): n is a, c, g, or t
  misc_feature (340)..(340): n is a, c, g, or t
  misc_feature (363)..(363): n is a, c, g, or t
  misc_feature (450)..(450): n is a, c, g, or t
  misc_feature (459)..(459): n is a, c, g, or t
aatgactaaacaaagcgagcagccactgatcttcaaagatgaacatcaaagaaaacactagaagattttgtcctccacgccccgccccccaggggtggatgaggttgcatcagttcacactaacaacggctttgtaaacccaaatgctgacaaaggggagcggaagaacgagacaagaaagtaattagaaaaagatagaaaaaccatctggcaaactttnatagagaaaacacgaggaagncaacgatcccacagatcccantttntaaantccgacgatgctttntgagcgagcaacctacaaagaggctatggcataagggaaggcgagcagaaagcntaatggtgagaccctgaagtgcnttcaaagcagaagccattaaagatgagaaggagaccacttaaaatgggcaaaatgtggcctgtgaagaacatttaatgggagtaagntcttacgtntcaacccagaaatgcacgtgtacac

SEQ ID NO: 8706 - DNA, 115 bp, Mus musculus
agatgaactgagactgttctggagaaggcccagggggacatacaagtcaactacccaagatcaattctgtaattctacaaccagtttagttcaagcttcaattgcccccaaactg

SEQ ID NO: 8707 - DNA, 287 bp, Mus musculus
  misc_feature (61)..(61): n is a, c, g, or t
  misc_feature (64)..(64): n is a, c, g, or t
  misc_feature (81)..(81): n is a, c, g, or t
  misc_feature (91)..(91): n is a, c, g, or t
  misc_feature (95)..(95): n is a, c, g, or t
  misc_feature (133)..(133): n is a, c, g, or t
  misc_feature (227)..(227): n is a, c, g, or t
  misc_feature (246)..(246): n is a, c, g, or t
agttacgctgggtgtttatctccaacctctgatgtgacccgatggcctcgtgactaatgtnaantccttctggaatggacnaacatacctntgcntcccaccggttcaaaggctaagagtgtcatcagataangtctgtggcctaaaacagagatttcccttcttcactggagtcaatcgacctgatgcccccaccagtgtatttggatggaaggtcccttggtgtntcattttcatgaaactgtnaccgcattggatcatggtgtttgagataacctgagtccatt

SEQ ID NO: 8708 - DNA, 261 bp, Mus musculus
  misc_feature (51)..(51): n is a, c, g, or t
  misc_feature (98)..(98): n is a, c, g, or t
  misc_feature (107)..(107): n is a, c, g, or t
  misc_feature (123)..(123): n is a, c, g, or t
  misc_feature (127)..(127): n is a, c, g, or t
  misc_feature (148)..(148): n is a, c, g, or t
  misc_feature (154)..(154): n is a, c, g, or t
  misc_feature (166)..(166): n is a, c, g, or t
  misc_feature (169)..(169): n is a, c, g, or t
  misc_feature (197)..(197): n is a, c, g, or t
  misc_feature (219)..(219): n is a, c, g, or t
  misc_feature (224)..(224): n is a, c, g, or t
gctgttcatgctagcccccagactagagatgaacctactacattgtgaatnctggcaaatactctacaactgtattacatcccagggctggaacccanctcatcttntgcaacaattacaggncagnctggatgaagacactcaaccnacaatntggccatctcangantggttcatgagaatggcttccaaaatgntttcaagactgggaatgtttanctatntgggagagaaaataaggagactcagtctacactgtac

SEQ ID NO: 8709 - DNA, 156 bp, Mus musculus
gaaatcggtctttcaagtgctttaatacttcaccagcagccacgaaacagctctgttctgcatggaactctgcaagatggcagcaagcgaaggcaaaggactcagtattgttctgatgcacgcctgcattcagcaactccaggctgttcatgctag

SEQ ID NO: 8710 - DNA, 263 bp, Mus musculus
gagctttccatggagacttctcatgggaggagatgcttgggggtcccagttgttgcagtcacggcgatttcaatatccacaatattgtcactatacactgcgttgacaacgccttggtgacatcctcggtcccagctgctgctgactgacagacctagagaggcccatctactggggttcgatctgaagaaatcgatggccgaaaaatcacgcaaggatgaggatgtagacaaagaagactcaatatcgaagcaagggcaggc

SEQ ID NO: 8711 - DNA, 368 bp, Mus musculus
  misc_feature (160)..(160): n is a, c, g, or t
ctaattgggatcttgctttcagcaggggtccatgatcatcatagtaaggagtgtggctgcaggaggaggcatggtggtagaacagtagctatgagcttgcatccttgtgtgaaagcatgaggcagaggggaagagaggaagagcagacagagaaatgacnttgaggctcatccccaatgacaccccttccaacaaggccacacccttccaaaacagttctgataactcaggaccaagtaccacactgctcttgctcagaacccaagttttggtttccagcacccatatcaggtagctcataactgcctataattccaattcctgggaatctgacacccttttggggatttatgcaccatgtgtataaa

SEQ ID NO: 8712 - DNA, 365 bp, Mus musculus
  misc_feature (184)..(184): n is a, c, g, or t
  misc_feature (189)..(189): n is a, c, g, or t
  misc_feature (217)..(217): n is a, c, g, or t
  misc_feature (223)..(223): n is a, c, g, or t
  misc_feature (247)..(247): n is a, c, g, or t
  misc_feature (266)..(266): n is a, c, g, or t
  misc_feature (268)..(268): n is a, c, g, or t
  misc_feature (288)..(288): n is a, c, g, or t
  misc_feature (315)..(315): n is a, c, g, or t
ggcaggtttgtctgtgctcgccgatctcggttcgtgtaaacggcgtgttctgaggacctgcgtggagtcacaggaccgtgctttccaacctcagttctgccaatgaagaacagtgttgcaaatttcccaggaagcagaggagaaagtatttgtcccagcagctgctgcagggaaggaactgctntcttnacctgaagagaagtggagaactgaaatncctcanccgaggagaaagcctaattttctntgccagattccagcacctntntgctaactgcaaccattagnccccaggggtgacagtacagaaacacnaaagtatctgttgtgtttaggacactatgtgggtagaaccccaaactcag

SEQ ID NO: 8713 - DNA, 292 bp, Mus musculus
  misc_feature (91)..(91): n is a, c, g, or t
  misc_feature (143)..(143): n is a, c, g, or t
  misc_feature (146)..(146): n is a, c, g, or t
  misc_feature (153)..(153): n is a, c, g, or t
  misc_feature (202)..(202): n is a, c, g, or t
  misc_feature (230)..(230): n is a, c, g, or t
  misc_feature (232)..(232): n is a, c, g, or t
  misc_feature (243)..(243): n is a, c, g, or t
atgtgtgcagagctctggaacccgagagaggccgtttataaggatgttctgcttcagagacccaagtgcaccccagacatggctgttgagntcaacattcctgtgcaggagccattccccttctagatgcagtgttgcccctnttntccctcntcccttcccagcaccaggggttccggctggtgacttacaagatggtatntctgttatgaatctgacccacagcgccntnttctacccctntcccttgctgtttggactaggcaggagttcctagtccagcctgcttgtt

SEQ ID NO: 8714 - DNA, 455 bp, Mus musculus
  misc_feature (290)..(290): n is a, c, g, or t
  misc_feature (350)..(350): n is a, c, g, or t
  misc_feature (370)..(370): n is a, c, g, or t
  misc_feature (382)..(382): n is a, c, g, or t
  misc_feature (416)..(416): n is a, c, g, or t
ttagtactcgtcaggcctctggaggtcagggaattgtgaaaacatcccgccactctactgaagtagatgaccttggccagccttcaccccctcccaagtttgggaagcaagccctagttgggagtccagctactgttgtagagagagaccagcaaggagctcagtttaatggttctgggcagaagccccttgctctgggaatggcccagctcccacagcctcggaaaaggcggcgtgacggttttgtcaccagcaaaaggaagaaacgacgtcgtagccagtaggaagcngagggccaccctgctccacctagcagcacccaaagtctattttagtgctgctgctccccntaccccgtggagaagcagtntcagcccaatgntgtttttgttttgttgtgccagaagctggagatnctggggcaggtcagactggctaggttgcagaggtcctgt

SEQ ID NO: 8715 - DNA, 462 bp, Mus musculus
  misc_feature (372)..(372): n is a, c, g, or t
  misc_feature (411)..(411): n is a, c, g, or t
ggatctttgataactcaggtcgtgaagtcataactctacgaagaccactacgatgtgattgttgttgctgcccctgctgcctccagcagatagaaatacaagctcctcctggtgtgccagtgggttatgttattcaaacctggcacccatgtcggccaaagtttacagttcaaaatgaggagaaacaggatgttctaaaaattattggtccaatctgcgtgtgcaacattggaggaagcatagattttgagatcaaatctcttgatgaagaattcgtggttggcaggatttccaagcactggtctggtattctgaaggagatactgacagatgtagacacttttgggatccagttccctttagacctcgatntaaagatgaaggcggtgatgcttggtgcttgttttctcntagacttcatgttttttgaaagtggtggaggccagagaccaaaacttttct

SEQ ID NO: 8716 - DNA, 490 bp, Mus musculus
  misc_feature (184)..(184): n is a, c, g, or t
  misc_feature (309)..(309): n is a, c, g, or t
  misc_feature (332)..(332): n is a, c, g, or t
  misc_feature (343)..(343): n is a, c, g, or t
  misc_feature (358)..(358): n is a, c, g, or t
  misc_feature (362)..(362): n is a, c, g, or t
  misc_feature (369)..(369): n is a, c, g, or t
  misc_feature (372)..(372): n is a, c, g, or t
  misc_feature (378)..(378): n is a, c, g, or t
  misc_feature (392)..(392): n is a, c, g, or t
tttacagagaaccagccaccactctgctccaggggtggaaggtctctaagaactcaactgggagatttgaatttcgagtggtcaccccacgcctgcactactccacacctgcgctacctcacacctaagctgccccacagctgggtcactccacacccaagccactctccacctgtgcaagtcnccccacacctgcactacttcccacctgagctgccccacacctgagcccacacctggatttgggggtttttcaagtcatataaaatggtttatctgccctgctaacacctcttagggaaggaatcnccttaacagcacatgaggggacnttacacattcnttacccacgagtggnagtnaggggantcntggcangagtcagttctctnttcctaagacataggttctctactgccaccggtgagagttccagggacctcaggcttagcagaaaatgcctttgcctgcgaaccatcttcaacaggtt

SEQ ID NO: 8717 - DNA, 327 bp, Mus musculus
  misc_feature (57)..(57): n is a, c, g, or t
  misc_feature (125)..(125): n is a, c, g, or t
  misc_feature (150)..(150): n is a, c, g, or t
  misc_feature (155)..(155): n is a, c, g, or t
  misc_feature (206)..(206): n is a, c, g, or t
ggaaaaagattctcaggaactacacagtgcattctcagtggacacggcaggtgaccntcctcatacctattctcaaggtatggcttaatggcaggtagactaatgcatgctctctacctactagnccttacaggcagggatgcatagttnacatnactgcgttgcatttgtattgaagttttcccccttcaagttaccactttttntcctatctatacccatgttgtgctagcctacacacactaaaaaggattgtaacatatattaaacttcacctcactatgctacgaggtccaactattaaggcttgaagggtttttatgacat

SEQ ID NO: 8718 - DNA, 167 bp, Mus musculus
tttcattatgggagaatgtgcctaaattaaacttccacagcgctcagagttctgacacggtaaacactgcaatgtgtatgaatatacgtaggtttcagagagttaaaagcacacagccttctctggtttcagataaaccaaaatatgttcccggcaaaggaaagaag

SEQ ID NO: 8719 - DNA, 520 bp, Mus musculus
  misc_feature (317)..(317): n is a, c, g, or t
  misc_feature (326)..(326): n is a, c, g, or t
  misc_feature (329)..(329): n is a, c, g, or t
  misc_feature (339)..(339): n is a, c, g, or t
  misc_feature (354)..(354): n is a, c, g, or t
  misc_feature (378)..(378): n is a, c, g, or t
  misc_feature (407)..(407): n is a, c, g, or t
aatgtccatgtggaagttgtccccaaagataagaaggacagtccgatcagaacagtggtccaggacaacaaggatgggtcgtaccgcgtttcctacacccccaaggagcctggcatctacaccgtgtgggtctgcatcagagagcagcacgtgcagggctcaccattcaacgtgaccgtgaggaggaagcatcggccacatccgggtgtgtttcactgctgcaccttctgctccagtggaggacagaaagctgcccgctgtgcctgcggaggcaccatgccgggtggataccttggctgtggccacggacacaaagnccacccggnccntccacactgntcttgctgtgggaanttcattgagaagtccgagtgctcnttcacgagtgggcagggcgccccgaggantctgcttaggaccgtggcgctctgatgcttcctggggacaagtcgggccaggtaaccctgaagctagcataacttcagctatgcagagaacccagagcttgagtagttccaaa

SEQ ID NO: 8720 - DNA, 542 bp, Mus musculus
  misc_feature (267)..(267): n is a, c, g, or t
  misc_feature (405)..(405): n is a, c, g, or t
  misc_feature (411)..(411): n is a, c, g, or t
  misc_feature (427)..(427): n is a, c, g, or t
  misc_feature (466)..(466): n is a, c, g, or t
taagacccagatgagtgcccagcaggtcaagcagtggtttgctgagaagatgggtgaagagacccgggctgtggcagatataagcagtgaggatcagggccctagaaatggagagcctgtggcagttcacaaggtgctgggtgatgcctattcggagctgtctgagaacagcgaatcatgggagccaagtgctcctgaggccagctcagagccttttgacacttcaagtccccagtctggacgtcaactcgaagcagactgaatttnatcttgattactgtgaaggaccggccagtctgggatgctgtatgccatgtggaagggccaaaactgccacatatcatcttgatggccagctgccaggcaccaggagagcctctggagcctcgctgaacccagaacctnccaccnccccaaccaccttccncctgacatttctgagcaaatagcaatggtttctcatcancccatcttcccacagagcaggacctttccatggcctcccagggacaattcagattgcatatacctagacccagaat

SEQ ID NO: 8721 - DNA, 508 bp, Mus musculus
  misc_feature (120)..(120): n is a, c, g, or t
  misc_feature (127)..(127): n is a, c, g, or t
  misc_feature (135)..(135): n is a, c, g, or t
  misc_feature (160)..(160): n is a, c, g, or t
  misc_feature (171)..(171): n is a, c, g, or t
  misc_feature (192)..(192): n is a, c, g, or t
  misc_feature (195)..(195): n is a, c, g, or t
  misc_feature (218)..(218): n is a, c, g, or t
  misc_feature (222)..(222): n is a, c, g, or t
  misc_feature (269)..(270): n is a, c, g, or t
  misc_feature (279)..(279): n is a, c, g, or t
  misc_feature (434)..(434): n is a, c, g, or t
ggagccaaaagacccaaacacataaaaatcctctttgttgttgttttatgagttagggtttctctgtgtagccctggctgtccaggaactctgtagatcaggctgtccttgaactcagangccaccngcctctgnttcttgaactgctgggattaaagangtacaccagcnaagcccagcataaaaatacanatntaaataattttttaaataatccntagntccttcacaactctaagccccttcactttctagttaccatgaaattnngagcacctntatccatttggatcattagggctcaattgcacatggttcaattacagtggggtttccccagattttagagttagaggcagcaggatcagaaaattaaatccatttgcactaggtaataaatttgatcccaccctatctcaaaaacaaaacactanccacacgtggcagcacacaccttttacaacaggactcaggagcctggcatgatgggacagacctttactccctg

SEQ ID NO: 8722 - DNA, 422 bp, Mus musculus
  misc_feature (314)..(314): n is a, c, g, or t
  misc_feature (318)..(318): n is a, c, g, or t
  misc_feature (346)..(346): n is a, c, g, or t
  misc_feature (356)..(356): n is a, c, g, or t
  misc_feature (381)..(381): n is a, c, g, or t
  misc_feature (388)..(388): n is a, c, g, or t
  misc_feature (397)..(397): n is a, c, g, or t
atgcacacgcacatgttcttgatctttttgtaaatcatgtaacttactttcacacatttaaagcatagcagttctcaaaagattctaagacaagtatattgtattaatactcagctatagttagcaacatttagcttttaacttaatgtcccagaggaacaatgaagttggaaggtgaattagtccagaggtcagagaagttactagcttgggcatcagtacttgagtcatcctgatatcatgttatttgaagccataggataatctgagaatgagtgtcaagaaggtctgagggctaggttctgtgagagganttanctctggccagagtggctttaaggactanctctccttanccaagggacactctggtcctgtaancactttntccctatgncactctcaactctttttcttttgtc

SEQ ID NO: 8723 - DNA, 521 bp, Mus musculus
  misc_feature (382)..(382): n is a, c, g, or t
ggatggatgttcttgctcggcagattgctaaccagtgtccagatccaccgtgcaaacaggacttgctggcttacctggaacagattaaattctactcccaccagctgaaaatctgcagtcaagttaaagcagagatccaaaatctggggggagaactcatcgtatcagctttggacagtgtcacctccctgatccaggcagccaagaatttaatgaatgctgtagtgcaaacagtgaaaatgtcatacattgcctccaccaagatcatccgcatccagagttctgcaggaccccggcacccagtagtcatgtggaggatgaaggctccggctaagaagcccttgattaaaagagagaagccagaagaaacatgggcagctgncagaagaggctctgccaagaaaaagatccacccagttcaagtcatgagtgaattcagagggagacaagtctactgaataccctcatccactctagtgcccatttctacaccccaggctaaccacactgctttatttcat

SEQ ID NO: 8724 - DNA, 494 bp, Mus musculus
acaagatgctcttactctgcttgcactttcccctactagcccttctcagtttagccttcagagtcagaaacagtacagaagctagtttctacatatggaagttctctgtcttgtaccatgttttcaagtagctaggacattcactgttgaaagatacactagtctgacatatttggaactttattttataatttaaaacttttagtagaaacatggatcattactgttttgtaattgctaatcacattgtataacttttgatataaggtaaaaatataaggtgaaaattggtgctaataatattgattacttattgaaaatagtaatgaaatgttcaccaggaataagaatttaggttctctcttttgaaaaagaactctactagttatagtagttgaaaggattgatttatttgtattaatgcatgtgtgataagatgttctaacttcatacttttcaaatcatataaagatgctatgcacagttgaatatga

SEQ ID NO: 8725 - DNA, 498 bp, Mus musculus
  misc_feature (251)..(254): n is a, c, g, or t
  misc_feature (258)..(260): n is a, c, g, or t
  misc_feature (262)..(262): n is a, c, g, or t
  misc_feature (277)..(277): n is a, c, g, or t
  misc_feature (283)..(284): n is a, c, g, or t
  misc_feature (288)..(288): n is a, c, g, or t
  misc_feature (290)..(290): n is a, c, g, or t
  misc_feature (304)..(304): n is a, c, g, or t
  misc_feature (306)..(306): n is a, c, g, or t
  misc_feature (309)..(309): n is a, c, g, or t
  misc_feature (316)..(318): n is a, c, g, or t
  misc_feature (320)..(320): n is a, c, g, or t
  misc_feature (353)..(353): n is a, c, g, or t
  misc_feature (392)..(392): n is a, c, g, or t
  misc_feature (461)..(461): n is a, c, g, or t
attttagcattgttggattcttcacaaggttaacataataatgtggacctatgaactgtgtggtgatggcacacacctttaatcccagcactcaaaaggcagaggcaaaggagtgaaaggccaatctgctctataaaatgagcttcagaacaatcatggctatacgaagaaaccctgtcttaaaaacaaaacaaaacaaaacaaataaaaacaaaccccaaaatatgtggatacattattttaataatctnnnnattnnntnaatttttatgatgcnttatgnngtcnanataattcacaagantnttnatacctnnnanaacttgatgaaataggagattcttccaactacnagctagacatcgaggaaactgaggctgagatgtgtatanccagttccaagggtaataatagtatgtgttaccaggaagggttccttactctagtaacttcagactgtnaggtatgagaaaggattatccctgcttgtttctttac

SEQ ID NO: 8726 - DNA, 537 bp, Mus musculus
gatgaagggtatttcttcctctcctgtttcccccgataccatcagctctagctctggatacctgcttttcaagttctaaatgaagactgtcatcaatagtttcatttggctgttcggcccttttcttcaagaccattttcttcaacaaatcagaaggcttcatctgcacaagatatcgatgcaggaccgagatctgtcaagagaagagagactggtcaagtctgagcagtgcattccttgagctaattccagtgtgcccatccccatcccccagttctctgctacccatttttctgtttcctccaaagtcctcaaatgcttcagatccaacaaaaggcagtcctataagtgctaccactgtttacaaagtcaccagaactcatcgtggtgttcctatatatgcatattcatatgtctctactgacaagaattggaggcaaaccacattaagttctattatctataaagaccacgtgtattaaaataagtataagatgtggttaatagctctgaaacttctaatcctatcatcacact

SEQ ID NO: 8727 - DNA, 525 bp, Mus musculus
  misc_feature (299)..(299): n is a, c, g, or t
  misc_feature (356)..(356): n is a, c, g, or t
  misc_feature (361)..(361): n is a, c, g, or t
  misc_feature (363)..(363): n is a, c, g, or t
  misc_feature (405)..(405): n is a, c, g, or t
  misc_feature (416)..(416): n is a, c, g, or t
  misc_feature (483)..(483): n is a, c, g, or t
tgtgccaagctcatctccagaacaggcctcctgatgaagctcctcagcgagcagcaagatttcaagctgtccagggccgactgggatacagaccagtggaaaactgagaactacatcaccgaaaatacagaaacccaaagcaaactgaagagtttgggacgaagtcagtttggaaaagaagtctcagagttcagctacaataacaaagtcaccttggcgatatctgtgaccgtcgtagtgatagttttgattatcattttctgtctcattgagatttgttcccacagaacaaaaaaggnagacaaagaaaagcacaaatggagaaagaaatacaaggaaagaaagaataaggaaanatatntntggataaggttgccacctcggcttagaaatatactcaaactngacaagaaatntgggcatgatttacgggccaatactcaggataaattatgggaggtcaagaaaagatcctcggtgaantcgtccgcagaatcgagtgaagtagccgaaaccccacggtga

SEQ ID NO: 8728 - DNA, 408 bp, Mus musculus
gggcatcaacaggactactacagtgactgggatcactacagctcgttttcaatatttaacaaagttgctcagagtctgtctggcaatggatgctggaagttggctgagtcactggggctgtctgccgcaccaactgcacagaacatgctatgtatcggcttggcttctcccagcatactgaatggacataagtcagaacgtttcaagagacaagagaacgcctcacattccttaaactgtggaccaggaagtggggagagggtcacttcaatcatactctattgcagccacaatgactttcaacaaatcggcgtagagggcatgtttaaaagctaccacaatattggacccaatgtttaagcattttatttcaaatcatttatatgcattggctcttcataattagta

SEQ ID NO: 8729 - DNA, 287 bp, Mus musculus
ttccattaagttatcaacccagagtgttggttatatagagctaacttgtttttataatgccctcattgtgtcctgaagatttttcacacttttaaaatgactttccttagattcaccatcacaatggaatatgacaagaattaaaaacaaacaaacaaataaaaaccttgtgctatgtgaatcaggagagtcagacactgaggagtgtggcttgctattgtgaaatagctccggttcagatacagcttagacaacgactaactgaaaacaagttgccaaaattctct

SEQ ID NO: 8730 - DNA, 335 bp, Mus musculus
  misc_feature (26)..(26): n is a, c, g, or t
  misc_feature (130)..(130): n is a, c, g, or t
  misc_feature (186)..(186): n is a, c, g, or t
  misc_feature (220)..(220): n is a, c, g, or t
  misc_feature (248)..(248): n is a, c, g, or t
tcagggagagagaaagcacagaaccncaagacaagggcacaagatggcattggagagctatatagatcctgaggtcagaagaaaggtgcagcctccagttgtcgaagaatccttttttaaaatccctccnatggtttgtgagatgtctcagcaggatccagagggacagaagagaacatcagagtnctctagaattagagttacaggtggatggaagccnccatgcagcgccaggacttgaacttggntcctctagaagagcaactagtgcgcttaactactgagacaagtttccatcctcatcctccatgatgctgcttcaaatttcagcctga

SEQ ID NO: 8731 - DNA, 157 bp, Mus musculus
  misc_feature (41)..(41): n is a, c, g, or t
  misc_feature (44)..(44): n is a, c, g, or t
  misc_feature (53)..(53): n is a, c, g, or t
  misc_feature (58)..(58): n is a, c, g, or t
  misc_feature (74)..(74): n is a, c, g, or t
  misc_feature (101)..(101): n is a, c, g, or t
  misc_feature (110)..(110): n is a, c, g, or t
ccttgaacagcagctccttggcaggggatgagaaacactcnttntgccttagntcctntcaacactggtggganccctggtgtccgtgagggttgatattntggaagaanccctgggtgtgctgttaagttgtgctatatttgccacagaaacagta

SEQ ID NO: 8732 - DNA, 106 bp, Mus musculus
ggttttgacagccacatatcctgattcttgatctgtgcaagggcactgaagatggatgctttagaggaagttacctgctgggaggaatccttttgagagggacaaa

SEQ ID NO: 8733 - DNA, 136 bp, Mus musculus
  misc_feature (84)..(84): n is a, c, g, or t
caaaggttaatgacagggccacttaaaatcacattatactgaacctggggacatggacgcacgttggcccaaaaacagacttgntcattacaaaccctgaagatcctaacaaggtgcaaaatgtgcttacagcaag

SEQ ID NO: 8734 - DNA, 152 bp, Mus musculus
aaagatgcagaagcagagcctcttgagagccgctatcctaagctccctgaagctgtgatcagtttagcaaagaaatgcttgcacattgacccagacaaaaggcccttctgtgctgaccttctgcgccatgacttctttcaaatggatggatt

SEQ ID NO: 8735 - DNA, 253 bp, Mus musculus
  misc_feature (69)..(69): n is a, c, g, or t
  misc_feature (71)..(72): n is a, c, g, or t
  misc_feature (75)..(76): n is a, c, g, or t
  misc_feature (78)..(79): n is a, c, g, or t
  misc_feature (81)..(81): n is a, c, g, or t
  misc_feature (86)..(86): n is a, c, g, or t
  misc_feature (95)..(95): n is a, c, g, or t
  misc_feature (108)..(108): n is a, c, g, or t
  misc_feature (141)..(141): n is a, c, g, or t
  misc_feature (203)..(203): n is a, c, g, or t
attgaacccaaccttatatccacctcactaccaccctcttagccaatctaacaagaccccatctcaaancnnaanntnntncggantcagaaatnatcagaaggacanttctctaaatgtgggacttagaggaagattgtntcatccatccgtatcaggcaggttttggtatttggtcgtgtaatacctcacagccaatattntataccaccatactgtgcagaagtctgaagaagaccccactaccaatttt

SEQ ID NO: 8736 - DNA, 268 bp, Mus musculus
  misc_feature (31)..(31): n is a, c, g, or t
  misc_feature (51)..(51): n is a, c, g, or t
  misc_feature (66)..(66): n is a, c, g, or t
  misc_feature (69)..(69): n is a, c, g, or t
  misc_feature (94)..(94): n is a, c, g, or t
  misc_feature (113)..(113): n is a, c, g, or t
  misc_feature (115)..(115): n is a, c, g, or t
  misc_feature (154)..(154): n is a, c, g, or t
  misc_feature (222)..(222): n is a, c, g, or t
acttctgacccggagggcgggcctgatcgcntcccctttgaaacctttgcntatgtttaccagtanttntttggactggacccagaactcccgnccgtggagaccgagaactntnttaccagtttaagactgatgtcagaatttagaaagaatngcatgataggactttcggatttcttcgttggaaaaaagataatatagaaagccttgaagagaaagttntggaagcagagcattgatacttgtttaatgttgaagccatgcttag

SEQ ID NO: 8737 - DNA, 100 bp, Mus musculus
  misc_feature (39)..(39): n is a, c, g, or t
  misc_feature (56)..(56): n is a, c, g, or t
acacacccccttggatttgatgatgttgtacgattaganattgaatctaatatctncagggaaggtggaccacttcctaattgtttcacaactccattac

SEQ ID NO: 8738 - DNA, 69 bp, Mus musculus
gaacatctttttcaaatgccagactgtggaagattcttgcttattcctgctaccaagggttcttctttt

SEQ ID NO: 8739 - DNA, 142 bp, Mus musculus
  misc_feature (62)..(62): n is a, c, g, or t
acccaggactcgtgcgtttcagacgagcactgccagctgggctacagtgagatactgagctntggaagtgacacacttctgtttttctgtgtgaattcaagccctggacatggggcatgctgggaaagttctgacttcctca

SEQ ID NO: 8740 - DNA, 187 bp, Mus musculus
  misc_feature (27)..(27): n is a, c, g, or t
  misc_feature (35)..(35): n is a, c, g, or t
  misc_feature (63)..(63): n is a, c, g, or t
agggagcctgctccttgcacaagttcntggagganccgcttccagagagctgtggcacgagtntccaagtttttcaggagaagacgccgatcaacctgaagctgagaccagtggaatcctagatactgggccgggccaaggactgtgatcaagatcattggctgcgcagctccttgctttcccaaga

SEQ ID NO: 8741 - DNA, 81 bp, Mus musculus
  misc_feature (40)..(40): n is a, c, g, or t
  misc_feature (43)..(43): n is a, c, g, or t
atcccagccttttcaacatcaatgtgcttttaaaaccttnacnctctttcatgcccatctaccaatgaatgctgaataatg

SEQ ID NO: 8742 - DNA, 60 bp, Mus musculus
ggagcctttgggaagactgtatctgtaagatccataagccgtttgctaaccgtcctcaca

SEQ ID NO: 8743 - DNA, 177 bp, Mus musculus
  misc_feature (34)..(34): n is a, c, g, or t
  misc_feature (93)..(93): n is a, c, g, or t
  misc_feature (100)..(100): n is a, c, g, or t
  misc_feature (110)..(110): n is a, c, g, or t
  misc_feature (117)..(117): n is a, c, g, or t
cctgcggcccctgcgacccttgcaacccctgctnttccctgtggaagccgattttcctgtaggaagatgattttataaggtgtatgtaagaanttatttnttagcagaantcagtantccagccaggcagtttttcagcattttttttccccttcccagagcccgtgtagttccagt

SEQ ID NO: 8744 - DNA, 155 bp, Mus musculus
  misc_feature (116)..(116): n is a, c, g, or t
gaaatatttttgttggacctcaatccaccaagttccaggcagttgagctgctacagtaatttcctggacactccagatctttggatattgaccacctttacagggaaaaaaaaaangaatgatgtgttctgtaaacaccgagcaaggcatagaaa

SEQ ID NO: 8745 - DNA, 156 bp, Mus musculus
  misc_feature (35)..(35): n is a, c, g, or t
  misc_feature (124)..(124): n is a, c, g, or t
caacatgctggtaaagaactgttaggaactgtgantcccttccagtgacagtcaagacattttttttttcctatatgatagggccagtgggggaaaaggtcaaaaaataattggatgctggatntctgtaactaccaatttcaatttggacagttt

SEQ ID NO: 8746 - DNA, 82 bp, Mus musculus
  misc_feature (31)..(31): n is a, c, g, or t
  misc_feature (47)..(47): n is a, c, g, or t
tggccatggattggacaagtcaccaatgggntccgctgacagcctgnccctgcaccacagagcacgctagtttggacggttt

SEQ ID NO: 8747 - DNA, 126 bp, Mus musculus
  misc_feature (27)..(27): n is a, c, g, or t
  misc_feature (45)..(45): n is a, c, g, or t
acctcccaggatcgacctcgaagagtntagaccctttttctttcnttttccagggtggcagtccctggctgggactgggggacagaggatcaagcctagccaggacctttgtatttcatttcacaa

SEQ ID NO: 8748 - DNA, 44 bp, Mus musculus
gagatggcccctgatcgatttttattggtccactgaaactataa

SEQ ID NO: 8749 - DNA, 120 bp, Mus musculus
  misc_feature (27)..(27): n is a, c, g, or t
  misc_feature (37)..(37): n is a, c, g, or t
gtgaaaggaatcagtttgtttgtgagnacaactcacntcctccccaaatatcagatgttttttaccacgttttttggagatggcccctgatcgatttttattggtccactgaaactataa

SEQ ID NO: 8750 - DNA, 171 bp, Mus musculus
  misc_feature (35)..(35): n is a, c, g, or t
  misc_feature (45)..(45): n is a, c, g, or t
  misc_feature (78)..(78): n is a, c, g, or t
  misc_feature (93)..(93): n is a, c, g, or t
  misc_feature (136)..(136): n is a, c, g, or t
gaggccagtaaaacagaccatccagaaaccagctntggacaacgntcccagcatacaaggaaaagcatgcacaaattnttttaccaaaagtgntcagcctggggacactgattttccttaatgccagagctgttcntttgggtacggttgcttttccatatgggctccaag

SEQ ID NO: 8751 - DNA, 87 bp, Mus musculus
  misc_feature (46)..(46): n is a, c, g, or t
tgagctctggaagtgacacacctttgtttttttgtgtgaattcaanccctggacatggggcatgctgggaaagctttgacctcctca

SEQ ID NO: 8752 - DNA, 42 bp, Mus musculus
cagatgtacctgagcttttttatgtctgtacccaatccttaa

SEQ ID NO: 8753 - DNA, 518 bp, Mus musculus
  misc_feature (44)..(44): n is a, c, g, or t
  misc_feature (179)..(179): n is a, c, g, or t
  misc_feature (269)..(269): n is a, c, g, or t
  misc_feature (271)..(271): n is a, c, g, or t
  misc_feature (394)..(394): n is a, c, g, or t
  misc_feature (482)..(482): n is a, c, g, or t
ggaagtttacagctttgaatatacatttttaaaatgtattattnttaaaacaactggacaggtttaaagcttaaaaactaatagactacggtctcagaacaatcatggggctggttttctttcacattaagctctgaaaaccttatcagaaaactttcaagtgaacaaaatcatacatnttcagcctaaatatcaatttgtattgtattttatctccataattatttcaattttcatgttttgacttagctataatatacattatttantntatgtcaatatagaaataatgatttattaatacaatatatattaatactaagaaaatgtttaactttatggatgttacaagtggtttggaaaccttaaacaacactgctgcttttatgaggtntcagttaaaccagcggtgggattacaaaaaaaaaaaaagagtcccttgaataaaactgagaggcttttaaaactttagttctaagaanttatccatccattgtttcaacatttgcgctttgcat

SEQ ID NO: 8754 - DNA, 114 bp, Mus musculus
  misc_feature (43)..(43): n is a, c, g, or t
  misc_feature (57)..(57): n is a, c, g, or t
  misc_feature (69)..(69): n is a, c, g, or t
  misc_feature (83)..(83): n is a, c, g, or t
  misc_feature (87)..(87): n is a, c, g, or t
  misc_feature (89)..(89): n is a, c, g, or t
ccatttaccactctaagaactactggcccatgaaagacttttnttatatgacccatncctattatgatncaaacaaggtgtantccntnaactagagtggattgcaggatgctg

SEQ ID NO: 8755 - DNA, 518 bp, Mus musculus
  misc_feature (303)..(303): n is a, c, g, or t
  misc_feature (320)..(320): n is a, c, g, or t
  misc_feature (344)..(344): n is a, c, g, or t
  misc_feature (359)..(359): n is a, c, g, or t
  misc_feature (361)..(361): n is a, c, g, or t
  misc_feature (424)..(424): n is a, c, g, or t
  misc_feature (426)..(426): n is a, c, g, or t
  misc_feature (428)..(428): n is a, c, g, or t
  misc_feature (430)..(430): n is a, c, g, or t
  misc_feature (433)..(433): n is a, c, g, or t
  misc_feature (459)..(459): n is a, c, g, or t
  misc_feature (475)..(475): n is a, c, g, or t
  misc_feature (477)..(477): n is a, c, g, or t
tagcttctctgttatgattttatcatattagatagctgtacttaagaaagggcgacagtctagcttataaggacctatgactagtttgcatatgtttaaactgttcaagtatttgctacaacatagaaaaaaaagccaattttctaagtgtggcagcccatatctctaatctcagcacttgagaaaattaggcagaatggttcataaattcaagatcagcctgggttacatagcagcttccaggacacactggtttatatagatctgccgcaaaacaaagaattaatactagattctgtcaangtaaaggctactttccngatcagggattttttttttctttnttctttgcttgcatntnactgatttttgttcattaattagcagttgcagcataggtgttatccttattattgtaagtctntntntnttnatcccattggaaaagattaggaaaancctgatacctgtaatntntacgaagactttcttatcaaccctgggctgcggagaagtgt

SEQ ID NO: 8756 - DNA, 481 bp, Mus musculus
  misc_feature (212)..(212): n is a, c, g, or t
  misc_feature (219)..(219): n is a, c, g, or t
  misc_feature (236)..(236): n is a, c, g, or t
  misc_feature (394)..(394): n is a, c, g, or t
  misc_feature (396)..(397): n is a, c, g, or t
  misc_feature (412)..(412): n is a, c, g, or t
acaaatgctttaccgggagcgtgcacctgactgaacatcggagtactcacactggagagaaaccttacaactctgagtgcccacagactttcagccagagcacatacctcactcagcatcagaagattcattcaggagagaagcttttggggtgtgaggactgtgaaaaagccttccagtgtcactctgctctcaccaaacaccagagattncaccctnctgtggctgctgtaggnacatcattaacatagttgctctgctaactttggttttatagaaatgaatcagagtgggaggaggaactccttaaagtaaatttttctctgtcacatggtgggatggagagcccattgggctgttctgatccaagtatgttattaaaacaacattgtgncnngctgctttaagtttnttctgtaaatgaggtgaaatgaaagattcagagatgatctgaaaggtagcttggagttttatactcagt

SEQ ID NO: 8757 - DNA, 92 bp, Mus musculus
  misc_feature (58)..(58): n is a, c, g, or t
ccacttatatccgtaaatgagtataatcaccaacgtgtgcatgctttcggtttcaccntcgggtaaaatatatgcctggtgggtttgcctgc

SEQ ID NO: 8758 - DNA, 380 bp, Mus musculus
gtgggtttgcctgcagctcatgagctttactttcgaggccactttgccatgggacactagctccactgtctccttctgaaagtcatgacctaagttcattagaggctaatgtatttccgatgtcgggttcacgcccagtcacgcacccctcataaatcagagcggctctagcaccaaaagactgtttccctgagtagctcccggcaccacacaggaatcctctgattttgtttctcttggacctctgtgcttggaccacagatgctctgcctagccaccaacatgcaccaagccttgtctgcagagatacttccatcttagcttccaacattgattacctgtgcctgtattgatacttctatcttagcttctgacacttg

SEQ ID NO: 8759 - DNA, 556 bp, Mus musculus
  misc_feature (63)..(64): n is a, c, g, or t
  misc_feature (272)..(272): n is a, c, g, or t
  misc_feature (336)..(336): n is a, c, g, or t
  misc_feature (366)..(366): n is a, c, g, or t
  misc_feature (391)..(391): n is a, c, g, or t
  misc_feature (403)..(403): n is a, c, g, or t
  misc_feature (480)..(480): n is a, c, g, or t
  misc_feature (484)..(484): n is a, c, g, or t
  misc_feature (486)..(486): n is a, c, g, or t
  misc_feature (489)..(489): n is a, c, g, or t
  misc_feature (494)..(497): n is a, c, g, or t
  misc_feature (516)..(516): n is a, c, g, or t
  misc_feature (518)..(518): n is a, c, g, or t
acttcattcatggtaacagtttccatggtacaggcggccgtggaaacaagttcgcccagatgnnttacactctacggctcctcagagccatggtttatctggaagatgagactgtgaacaaggacctttgtgagagaggggttattcatcaactgatagaaatttttaaaactatgatgagcagacctgctgagaaggaagaggccattgccttagaaatccagtctgacacattacttattctgtcaggtctttgtgaaaattatatccanaggaaggaaatgtttggtactgaaggagttgacatagttcttcatgtaatgaaaacagaccccnagaatttacagaggggtttaggctacaatntccttcttttcagtacgttagacancatttggtgctncattttgggatgttatgattctgaagattattttcttgaaaaggaagggatttttctccttttggatatactagcantaantnatntccannnnctgtaacccgagttagtantntaacacaaaacataaatgcatccatactaacctttccc

SEQ ID NO: 8760 - DNA, 538 bp, Mus musculus
  misc_feature (316)..(316): n is a, c, g, or t
  misc_feature (339)..(339): n is a, c, g, or t
  misc_feature (475)..(475): n is a, c, g, or t
  misc_feature (512)..(512): n is a, c, g, or t
gatccatttacattgtgtttagacataatagatagagaagttggtattcaagcaactgacagctgttccagaatgttaaaatatacgtgctcaggttgcatagtagcaagaaaactcctcaacagccgaaattttagcaagtttttgcactcatgtgcataccagtgtgttcaccataaagtcattatggaagctgaagacaaatataaaaatgaactaaggaaaacatttatctgtgcaaaaaaaattttgctgactccctgtagaagaagacaactttgtaaagaatctactgcctctgaagaactaaaaattnttcatcaaaaaccagatagtaanaaacttccaggtttggaggcacaggccttaaataccagcattccagaggctatggaaagaagatcaccagttccaggccagagtggactacatagtgagtttgaggcaaccccaggctacataggaaaagcccatntcaaaaaaagaaaaagaaagaaaaaagaaaacctacnaacttcctttagcatgatgtgacctg

SEQ ID NO: 8761 - DNA, 445 bp, Mus musculus
  misc_feature (314)..(314): n is a, c, g, or t
  misc_feature (351)..(351): n is a, c, g, or t
  misc_feature (355)..(355): n is a, c, g, or t
  misc_feature (358)..(358): n is a, c, g, or t
  misc_feature (362)..(362): n is a, c, g, or t
  misc_feature (364)..(364): n is a, c, g, or t
  misc_feature (366)..(366): n is a, c, g, or t
  misc_feature (372)..(372): n is a, c, g, or t
  misc_feature (386)..(386): n is a, c, g, or t
  misc_feature (416)..(416): n is a, c, g, or t
agtcagattaccctggccctgcggattctgattcctaggcccagctcacagaaacttggacctaagactcaccactggggttgtatcctctggctttccctctgcctatgcccaagttagcttctaaatggaggatttagaagccggagtctgaggttgcagtcctgaatcttcaacatcctttcccaagacccacagctccatgaaaggacagttcaagctctcaggatttaggctgtttgctttgttgttttgtaaacctgggcccttgcaagccccttccttcttggtcaccgtccctttgctgagttttntcaattttaagagtgagagtaaaagcaagaggatccnaacnccntccntntnatccgntcctagatttggancccaaggtggggaggtgggcctcttgacantcgggaagcaactgggacatacttatttg

SEQ ID NO: 8762 - DNA, 423 bp, Mus musculus
  misc_feature (371)..(371): n is a, c, g, or t
gagaagaggaccactctggtgctgtggggaggcctggcctacatggccacccagtttggcattctggcccggctcacctggtgggagtactcgtgggacatcatggagcccgtcacctacttcatcacgtacggaagcgccatggccatgtatgcgtattttgtaatgacgcgccaggaatatgtttatccagaagccagagacagacaatacttattatttttccataaaggagccaaaaagtcacgtttcgacctagagaaatacaatcagctcaaggatgcaattgctcaggcagaaatggatcttaagagactgagagacccattacaagtacacctgcccctccgacagatcggagaaaaggaatnatccgagatgaccgtgaatcccggcagagagtgcgcctgtttgtaactcacg

SEQ ID NO: 8763 - DNA, 491 bp, Mus musculus
  misc_feature (77)..(77): n is a, c, g, or t
  misc_feature (440)..(440): n is a, c, g, or t
tcactcaaccactgatggccaatgggttacaagcatcaagctcatctctccctctgacaactgcatctgttcccaanccaactgtggcacccattaacactgtgtgttcaaattcggcatcagctgtgaaagttgtcaatgcagcccagtcactcctcacagcatgccccagcataacttcccaagctttccttgatgcaaacatctacaaaaataagaagtctcatgaacagctctcggctctgaaaggaagcttctgtcggaaccagtttcctgggcagagtgaagtagagcatctgaccaaagtgacaggcctcagtaccagagaggtgcggaagtggttcagtgaccggagatatcactgccggaatctgaagggctccagggccatgatgcccggagagcatggctctgttctcattgactctgtgccagaggtnccctttcccctggcatctaaagttccagaggtgacctgtatcccaacagca

SEQ ID NO: 8764 - DNA, 441 bp, Mus musculus
tggtcaatacgacccttttcaaggcttgacctctgctgccctagttgcctctcagcaggtggctgcccaggcatctgcttctggaatgtttcctgcacagagaagagaataacagaatcggaagtgtccggtgccatgtgactggatcacatggggaagcgctttatatagacatcagttccatggtgttaatttgaaatgccttaatggcaggcaaaaaaccagtcatttcattttgtaaattacagattttatcacagagtaacaaatgttgctgtaattaaacttctgttttatatatatgtatatatatacgtatacatatctgtatatatacatatatatatatacatatatatatatatattctttacttttttgtaacagtaaccaggctcgcacacacagggtctgctgccaagttgcaaaccactcagtaaa

SEQ ID NO: 8765 - DNA, 154 bp, Mus musculus
  misc_feature (26)..(26): n is a, c, g, or t
  misc_feature (37)..(37): n is a, c, g, or t
  misc_feature (43)..(43): n is a, c, g, or t
  misc_feature (46)..(46): n is a, c, g, or t
  misc_feature (116)..(116): n is a, c, g, or t
  misc_feature (121)..(121): n is a, c, g, or t
cctgcgctggccaccttacttagtgncctttttattnttgctnttntccacctttgagcagtggacggagcacaaagccatagtgttagatagaggctggtgatcagaaaggacgntcatntccgttttgtacaggcctcaacaaggacttaaa

SEQ ID NO: 8766 - DNA, 293 bp, Mus musculus
  misc_feature (255)..(255): n is a, c, g, or t
tttcttctattgatacgcaggatttatttttcacataagtgctagagattgagctagaggttggtcctggtgcttccacagaacaatctcaacagcaccttcaggacttccttctaagcagctgtcatagtttgcaggttctttaacttgtgtgtcattgataacaacatactttactaaagacagttgagggaaaggcccaaaattataaaattcgttgcttataagctttttcatattcttatgcaaagtgantggaagaacaaataacatctagatctctttactaaaga

SEQ ID NO: 8767 - DNA, 492 bp, Mus musculus
  misc_feature (94)..(94): n is a, c, g, or t
  misc_feature (216)..(217): n is a, c, g, or t
  misc_feature (349)..(349): n is a, c, g, or t
  misc_feature (393)..(393): n is a, c, g, or t
  misc_feature (395)..(395): n is a, c, g, or t
  misc_feature (397)..(397): n is a, c, g, or t
  misc_feature (437)..(437): n is a, c, g, or t
  misc_feature (441)..(441): n is a, c, g, or t
acacacaaacatttgcacacactcacacatgcacatgcacacacatgcacacatgggacttcggaaaactgtgtcttacgggtgggggtggggnaggggaagtttttccattatctttcctgttttgagtcttctcttccttttccttcttctctctctttattttcttcctttttaaaaaatatatatataaaagtgaaaatctttaaaaaaaanntaaaagagagagaaagaagaaagaactaaatcacctagcgtggggcatgtgaccaagtctagccagcttcatggcaccccctaaatatgatctcccaggctgtggagtgcagaggggtggagcatctggagnctgtgagactctagtggggaggtgaagactgtgcctggggaccnantnagggtggcaagaggggtgcaggctgggaaacattgtgtgntccntccacctcgaccccatctttattgtacactgtagctgttctattgtacaga

SEQ ID NO: 8768 - DNA, 300 bp, Mus musculus
tgaaaggcaagactccacggtgatggagcagcagttgctatatccaggaaagtctgtgtgccctgtgttttctgtggactgtctccttgcgtctgcacccagccccatggaggggacagacagtcctgactgaacagatgaggactctaactacggagaggtggctaactggtgaggagaaagcaagacgtaccagactctccatcgctgaatttcccagtaacacgtcttgtccttccacctgaatctggtttacaatttcgtcctgcaagtcagctacaactcagctgaactcagtac

SEQ ID NO: 8769 - DNA, 253 bp, Mus musculus
cggagaacctgagcctgctcaagagcctgctgacccaggtgcgcgccgaggacctcaacatcgcgccgcgcaaggcgctgccgcagccgctgccccgcaacctcccgccggtcacctacatgcacatctacgagacggagggcttcagcctgggcgtgttcctgctcaagagcggcacgtgcatcccgctgcacgaccacccgggcatgcacggtatgctcaaggtgctgtacggcacggtccgcatcagctg

SEQ ID NO: 8770 - DNA, 212 bp, Mus musculus
  misc_feature (41)..(41): n is a, c, g, or t
  misc_feature (83)..(83): n is a, c, g, or t
  misc_feature (106)..(106): n is a, c, g, or t
  misc_feature (139)..(139): n is a, c, g, or t
gaaaactacctgattggtttgctgctaaaggcaggagattnaacacacgacccccaaagggccctttggtttcaccccagaantgacacgaggaagggactgtggntcaactagggactgtggattcagactggggttntttggggtttcagtttcatcccttccctggaagttttgttaccccaacactagtattactgcacagctttctg

SEQ ID NO: 8771 - DNA, 465 bp, Mus musculus
  misc_feature (46)..(46): n is a, c, g, or t
  misc_feature (82)..(82): n is a, c, g, or t
  misc_feature (122)..(122): n is a, c, g, or t
  misc_feature (131)..(131): n is a, c, g, or t
  misc_feature (133)..(133): n is a, c, g, or t
  misc_feature (261)..(261): n is a, c, g, or t
  misc_feature (264)..(265): n is a, c, g, or t
  misc_feature (267)..(268): n is a, c, g, or t
  misc_feature (273)..(273): n is a, c, g, or t
  misc_feature (276)..(276): n is a, c, g, or t
  misc_feature (280)..(281): n is a, c, g, or t
  misc_feature (287)..(288): n is a, c, g, or t
  misc_feature (291)..(291): n is a, c, g, or t
  misc_feature (318)..(318): n is a, c, g, or t
  misc_feature (358)..(359): n is a, c, g, or t
  misc_feature (370)..(370): n is a, c, g, or t
  misc_feature (389)..(389): n is a, c, g, or t
  misc_feature (432)..(432): n is a, c, g, or t
  misc_feature (435)..(435): n is a, c, g, or t
gtccgccatcctgtatgcagaacgacggcgtcaatgaatgagtttnattccattgctcagagaatatgcaaatagctaaatngtagcttgagacccttaagaaatgagagttactaaaaaantgtgcttananttgtgccacgtaattctccaacagatactagaggtgactgccccgtgctgtaaaactgccaagtataatcattcttaaagaattgtgaagcataagcaagacacttgaggaaatagctattttccatncanntnnatccncanggannttcacnnacnaagttgttccattcatatttacctatntccttaaagtgacacatgatgttatatttaagagattgannttggcataaantcggggactttatagcttntaaactttataaagttgaaatacttttgatgtgaactagtgantanatataagtgataattgcagtaacttggcta

SEQ ID NO: 8772 - DNA, 335 bp, Mus musculus
cctagaggagattcttaagctcactgcccatctctcctcggaggttatacatcactactaaaatctgacagccataaaaactgagccaggattttcacaatgccctaaaggtcaaagtcctttgactgtgtatctaggctgggtggttcttgtctttcctaaaatggctgagaagaccttcataaaggatctagaagggtcaccttctaactcagcaattacgaatgtttgctttcaaacatccttaagaacaggatgtcctaacgagcagacgagctcacctggctgattctcagccttcttcccaccctccctgtccgactttcacaaaatat

SEQ ID NO: 8773 - DNA, 460 bp, Mus musculus
  misc_feature (135)..(135): n is a, c, g, or t
  misc_feature (385)..(387): n is a, c, g, or t
aaggtgacctaagccaccacagcttatctcagaatcattattgtatatatttctttttgtaaaaagattgcagataaagctgatggaaatactatacgttgccagagtgaaatcactccatacacaagcagaagntgaattaagaaaagttgctttagtgactgtgtgctttcatgacaggctaattatcagactcatcagcctagcataaatttgaattcaatatatgctgtcactcttaagtttcttttaggttgagttcacagattatgctttgaacaagttaaatatggactggagactgcatatctaggctcttaggcagatggaaaatttacgtagtacagatattgtaagagtcgtttcttacataaccattttcctnnnaaaaaaaaaacccacaaagatagcagtatataattttcatttgcacataatttttattattcagccgggcgtg

SEQ ID NO: 8774 - DNA, 445 bp, Mus musculus
  misc_feature (138)..(138): n is a, c, g, or t
  misc_feature (176)..(176): n is a, c, g, or t
  misc_feature (184)..(184): n is a, c, g, or t
  misc_feature (240)..(240): n is a, c, g, or t
  misc_feature (299)..(299): n is a, c, g, or t
  misc_feature (341)..(341): n is a, c, g, or t
  misc_feature (363)..(363): n is a, c, g, or t
  misc_feature (399)..(399): n is a, c, g, or t
  misc_feature (408)..(408): n is a, c, g, or t
tggtccaccttgtttaacctgtggaggaaactgagactagcatacactctacagggctcacaggccatgaatggcaagggctgggacaaaggcagagattttcctacttcaaaatggttacagtctatgattgaattntgcacagatgaacaaatgacatccaagttttccccctntgggtccnaacacagttgtgactgacgctgagcaccattaggcgaggaacccatatagtggaancaactgtcttctagtcagaaccaagcctgtaagcactgctgaaggtgggcaggacgaangtagacttcaggttttacagtgttaaatgaggggcaaccgtncctacagtagctcccttccctnccttcaacctccaacaagctccacatctagctcctntaccttcanaacttgatgggtggtggtgttggctattgctagacat

SEQ ID NO: 8775 - DNA, 341 bp, Mus musculus
gttgaatctaacaggcactcttccactgagctgtatctcaggttaaagatacttcttaagctaggtatagcagaacaagccagtaatcaattaattcttgtgaaattgtttataaaatgcatcttacaatcaaatacaatctataacctaatatttcatgtgtacttaatacttgtgagaatgcattgtagcgttataaagcataatcagtcagagctttgtgctttatgtacttaaccctcatggaatatttttaatatataacataatcactcaaagccaacttaaacatatattcagtgtaaatgtcaaaatttatgttctaagttctataggctgat

SEQ ID NO: 8776 - DNA, 550 bp, Mus musculus
  misc_feature (191)..(191): n is a, c, g, or t
  misc_feature (194)..(194): n is a, c, g, or t
  misc_feature (197)..(197): n is a, c, g, or t
  misc_feature (230)..(230): n is a, c, g, or t
  misc_feature (238)..(238): n is a, c, g, or t
  misc_feature (241)..(241): n is a, c, g, or t
  misc_feature (271)..(271): n is a, c, g, or t
  misc_feature (291)..(291): n is a, c, g, or t
  misc_feature (326)..(326): n is a, c, g, or t
  misc_feature (353)..(353): n is a, c, g, or t
  misc_feature (372)..(373): n is a, c, g, or t
  misc_feature (377)..(377): n is a, c, g, or t
  misc_feature (379)..(379): n is a, c, g, or t
  misc_feature (381)..(381): n is a, c, g, or t
  misc_feature (384)..(384): n is a, c, g, or t
  misc_feature (386)..(386): n is a, c, g, or t
  misc_feature (388)..(389): n is a, c, g, or t
  misc_feature (391)..(391): n is a, c, g, or t
  misc_feature (396)..(397): n is a, c, g, or t
  misc_feature (399)..(399): n is a, c, g, or t
  misc_feature (403)..(405): n is a, c, g, or t
  misc_feature (407)..(408): n is a, c, g, or t
  misc_feature (412)..(412): n is a, c, g, or t
  misc_feature (419)..(419): n is a, c, g, or t
  misc_feature (426)..(426): n is a, c, g, or t
  misc_feature (433)..(433): n is a, c, g, or t
  misc_feature (447)..(447): n is a, c, g, or t
  misc_feature (451)..(451): n is a, c, g, or t
  misc_feature (454)..(454): n is a, c, g, or t
  misc_feature (456)..(456): n is a, c, g, or t
  misc_feature (461)..(461): n is a, c, g, or t
  misc_feature (473)..(473): n is a, c, g, or t
  misc_feature (482)..(482): n is a, c, g, or t
  misc_feature (503)..(504): n is a, c, g, or t
atgggcaaacaaggctcccgacaacaactatgacggcaagctgaagagccttatggagaagggcatggatcccaagatggagatcagcaagatgctgaagccagaggaggtgctgagctgccgatacctgcgtttgtccaagaacaacatcaagaccttgatcaagctgtgcaaggatgcagggatggatntgnacntccacccccacatggtggaggccgagatagacncaaagaanatnttcggacagcgattaagcgtagcactctanccgctctgcccactggagantcatcccttggcgactaagcaccctgttaactagnttctgtagaccgcaccaggcgaataantcaaatgcatcacactagnngatntnanccntntnntnagctnnantttnnntnnaccnaggagtnaccgggnagagagnttccttaggggaantttncananatttncctgtattccantgcagatanagacggggggggggggggggnnctcaagggttcaagttcaatgccagcttgggactgtatgaggccct

SEQ ID NO: 8777 - DNA, 469 bp, Mus musculus
  misc_feature (115)..(121): n is a, c, g, or t
  misc_feature (270)..(270): n is a, c, g, or t
  misc_feature (287)..(287): n is a, c, g, or t
  misc_feature (305)..(305): n is a, c, g, or t
  misc_feature (317)..(317): n is a, c, g, or t
  misc_feature (326)..(326): n is a, c, g, or t
  misc_feature (330)..(331): n is a, c, g, or t
  misc_feature (346)..(346): n is a, c, g, or t
  misc_feature (348)..(348): n is a, c, g, or t
  misc_feature (350)..(350): n is a, c, g, or t
  misc_feature (361)..(361): n is a, c, g, or t
  misc_feature (392)..(392): n is a, c, g, or t
  misc_feature (427)..(427): n is a, c, g, or t
tatgtgaataccttctaacgttgtaaatgaatatatagcaatagtaattctgggtaatagtcaaaattataggaagttatctttttattttttacatcagtcacctcattatacnnnnnnnttttattttaatgttaagtagaaaattaagctataactagaaataacttgaggaaaactttagtattctaagaaatgtttaatgtttacacttttaaagtgtaatcttttatgttagcatttagaagcatacaaccttgaatttagtancatttccaaagcatatntagaattcatgttttttngaatttccaggncacttaagntagnnaaatgaagagaattnantngtgaaatgctnttatgtccccagtatgagaaccagcatggantcacagcgccaccttgtggtctccacgccactccnttggcttttaataaaacaaatgaatcctcataaaactccaga

SEQ ID NO: 8778 - DNA, 189 bp, Mus musculus
  misc_feature (33)..(33): n is a, c, g, or t
  misc_feature (35)..(35): n is a, c, g, or t
  misc_feature (40)..(40): n is a, c, g, or t
  misc_feature (42)..(42): n is a, c, g, or t
  misc_feature (69)..(69): n is a, c, g, or t
  misc_feature (75)..(75): n is a, c, g, or t
tcatgctttccttgtttctattgacacatattntnttggntntctcaaggacctgtatgtttttcaagntcaggnaagacaatttgaaagattcccctattgatgtaaaaaattattcagatgttaagtcatttcatcaggaatgaccaataggctggggaatttgcatggatgtttaccgaattcaat

SEQ ID NO: 8779 - DNA, 501 bp, Mus musculus
  misc_feature (101)..(101): n is a, c, g, or t
  misc_feature (105)..(105): n is a, c, g, or t
  misc_feature (112)..(112): n is a, c, g, or t
  misc_feature (225)..(225): n is a, c, g, or t
  misc_feature (283)..(283): n is a, c, g, or t
  misc_feature (357)..(357): n is a, c, g, or t
  misc_feature (393)..(393): n is a, c, g, or t
  misc_feature (395)..(395): n is a, c, g, or t
  misc_feature (403)..(403): n is a, c, g, or t
  misc_feature (423)..(423): n is a, c, g, or t
  misc_feature (435)..(435): n is a, c, g, or t
  misc_feature (447)..(447): n is a, c, g, or t
ttcagttaactacaggacgcttcattcaggccgggcaccatgtgcacagtcttaagaagcagcaggaactgcatttgcaaacacgtgttgtaaaaaattantttnaaaaaangctacctgtataaatataaatatatatatttaaagacaaggttttgatactttttttttaaaaaacaaaaactacaagagaagactgtacaaaccacgggcttttaaaatagnattttgctctctacaagctgttaatgtcaggggtgaggggtgagggactggtttgcanacacactatccaaatggatttgcttgttttgtcaagccaccctccaaattaccatatttggtgtaatagtaggncatgtaaagttattgggtcccattaaccatttctgntnttgtcatntcattccgggttccgttagntcccgtactcgncaatccagcttnttccagaggcagaggggctgaaggaagtgtgctccatttcactagctgtactga

SEQ ID NO: 8780 - DNA, 386 bp, Mus musculus
aagatctaactgtggcgaactggaagaatctggactattccagctttctagtgtctttgttttgttgcttaatgtttgcatgtacaatgttttaaatttgtgacacatatgatacttatgtcaatctaagagtccaccacaacagaagaaaataggaccaagttgaaggatgcattgggggcaaattaaccctcaccgggaccgcactgatattaaagttgaaggatggggggcgggggaggggactaatcctcatggggaccactcatccacaccgattatttctgcagtttatttacctcataattattacatgtttacttatttatgtgtttaatttaggctttccttatttatttaatttttgggtcacttgcttttgatat

SEQ ID NO: 8781 - DNA, 355 bp, Mus musculus
  misc_feature (127)..(127): n is a, c, g, or t
  misc_feature (131)..(131): n is a, c, g, or t
  misc_feature (197)..(197): n is a, c, g, or t
ggcttgacctgggacttgtgttaaagctgttttaactcttggctgcagattgactctgcatggacatttgactaaactcaggagcttgcagtggtaatgtctgagcaaccgagttttatttttatantttntcaatacaagggtttactctgtagctcaagctgacttggaactcctagatagcccaggctgcactnagattgatgcaatcctcctctatcaacccctcagtactgggacagcaggcgtgaggagccatgcaaacatcactacaaactcctggctgtggatgtgccgtggctgacaggtcactaaactaaaaccctgtgggggacacatgacatctatgcaactg

SEQ ID NO: 8782 - DNA, 546 bp, Mus musculus
  misc_feature (413)..(413): n is a, c, g, or t
  misc_feature (422)..(422): n is a, c, g, or t
  misc_feature (426)..(426): n is a, c, g, or t
  misc_feature (430)..(431): n is a, c, g, or t
  misc_feature (439)..(439): n is a, c, g, or t
  misc_feature (445)..(446): n is a, c, g, or t
  misc_feature (450)..(450): n is a, c, g, or t
  misc_feature (466)..(466): n is a, c, g, or t
ttgtgacaccggttttttatagattttctagcatatattttagatctatttatcatctatctatctatctatctatctatctttctatcatctatcttatataaaataaagtctgacctaaatatgagaccctgtatggttgtctaaaaacatactgttagctccttcagtcacacctgtttggggctggctggtgaatcagaaggaaccttgttgggtctgctgctcaccacctatggggctgtgggcatggtggcagcagcagttgttgccacttctgctttggccaagcacagtaggtgatcctgatagtcagcagcacagattcccattgattctagtctatgtatttgcttatggttggtacaatatttaatgtatataggcagaagtattatagggtctttaaatangtgaacatntgtngcanngcttttanacttannacgnatatgatatttttcanatgtcaagacacactggtaaatttctgttacatattgttttcaagttttctgttagtcttgtttctatgaggtactttta

SEQ ID NO: 8783 - DNA, 528 bp, Mus musculus
  misc_feature (377)..(377): n is a, c, g, or t
  misc_feature (398)..(398): n is a, c, g, or t
  misc_feature (410)..(410): n is a, c, g, or t
  misc_feature (413)..(413): n is a, c, g, or t
  misc_feature (415)..(415): n is a, c, g, or t
  misc_feature (419)..(419): n is a, c, g, or t
  misc_feature (433)..(433): n is a, c, g, or t
  misc_feature (485)..(485): n is a, c, g, or t
  misc_feature (492)..(492): n is a, c, g, or t
  misc_feature (503)..(503): n is a, c, g, or t
ggcacaacagtggtttctacgggcactaccgaggtcaagtcaagagtgagagtgctggagaataccgtcttgctgccaaacccccgcctccagcagtgttcctacagagatgtgaggagcctacaaaacaacactacttctccaagcatgacaaccgcacttccttcgacaaaggtccctactgcctgctgcagggaatcgggagacggaaagacctggaacgcctgtggaagagacacaccttcctgcgctgggcaccctgtgagctggaattgagccaacagccgcctctggaatcgtcctaccagactgacttccggtcaggcacaggactcgctaggctcccccagcgccttgtccagtttgtgcaggtccanccttcctatgccaataccacntaccaacacaanttntnccanccatcccggggtgntcattgtggtagcgccaaggtaaggccccttgagccagttactgaaacactncctgacntcccggggatnacaaaacccaagttgctgcagcact

SEQ ID NO: 8784 - DNA, 189 bp, Mus musculus
agagaggctgtgactcggttcctcatgagctgcacggaatgccagaagaggatgcactttaactccagcggcccggagcccaaagagaatgagcctccatcccctctggtgtctggcattattgattacaacatgcccctcacctctacctacttgaagcagatgaagctgcgagtgatgaactctcag

SEQ ID NO: 8785 - DNA, 370 bp, Mus musculus
  misc_feature (205)..(205): n is a, c, g, or t
  misc_feature (209)..(210): n is a, c, g, or t
  misc_feature (215)..(215): n is a, c, g, or t
  misc_feature (217)..(217): n is a, c, g, or t
  misc_feature (220)..(220): n is a, c, g, or t
  misc_feature (222)..(222): n is a, c, g, or t
  misc_feature (229)..(229): n is a, c, g, or t
  misc_feature (234)..(234): n is a, c, g, or t
  misc_feature (236)..(237): n is a, c, g, or t
  misc_feature (239)..(239): n is a, c, g, or t
  misc_feature (243)..(243): n is a, c, g, or t
  misc_feature (254)..(255): n is a, c, g, or t
  misc_feature (264)..(265): n is a, c, g, or t
tttggagaaaatgggctgctgtgcttgcagaggggactcaattgaagggctctgggatcacctggtcagcatccagcagcagctggaggataaggagcaagcactagccattctgcaggagacggtcaagattttgcagttgaaggtgatgaggttggaacacctggtacagctgaaggaccagcggatctgggagctgatgagnactnnacccnangancntcagagntggangnngncccnacccagagtcnntcagacctnnatcctgagcccaaccggagctcctcactggtcatgcagcctccatgtgagacgtgaggtgtggaggccagagcacgctggggccgcagacgagtttggacagatt

SEQ ID NO: 8786 - DNA, 474 bp, Mus musculus
  misc_feature (147)..(150): n is a, c, g, or t
  misc_feature (153)..(153): n is a, c, g, or t
  misc_feature (155)..(155): n is a, c, g, or t
  misc_feature (160)..(160): n is a, c, g, or t
  misc_feature (164)..(164): n is a, c, g, or t
  misc_feature (166)..(166): n is a, c, g, or t
  misc_feature (169)..(169): n is a, c, g, or t
  misc_feature (174)..(174): n is a, c, g, or t
  misc_feature (194)..(194): n is a, c, g, or t
  misc_feature (211)..(211): n is a, c, g, or t
  misc_feature (218)..(218): n is a, c, g, or t
  misc_feature (220)..(220): n is a, c, g, or t
  misc_feature (242)..(242): n is a, c, g, or t
  misc_feature (289)..(289): n is a, c, g, or t
  misc_feature (332)..(332): n is a, c, g, or t
gtatagagtctcaacactgattacaaataaactgctttgttgtaacacagagtactgcctggttcctgatgcagtcactgattggtagctgagtgatatgtgcttactccagggcacttgaatttgggctgtagttatttttttttnnnnatncngtagnaacntntcnatttnaactttaactttgtaaatancgaagtgtgtaattaangccaatnanatatgggtttgaatattgtttnatcttattatttttgatatgttttggtatcaaatttcaaggaattgnaaactagtaataacttggccctagaaacccatttatttgtaancaagctgctaaaacaaagcaaagatgatttctcaatctattcattttgtaagctctttgtactccatttgtacaagagcatccccatgataaggttacattctgttattccagcattgcttattaaaatgatggcaccatcc

SEQ ID NO: 8787 - DNA, 417 bp, Mus musculus
  misc_feature (79)..(79): n is a, c, g, or t
  misc_feature (224)..(224): n is a, c, g, or t
  misc_feature (233)..(233): n is a, c, g, or t
  misc_feature (240)..(240): n is a, c, g, or t
  misc_feature (247)..(247): n is a, c, g, or t
  misc_feature (252)..(252): n is a, c, g, or t
  misc_feature (287)..(287): n is a, c, g, or t
  misc_feature (296)..(296): n is a, c, g, or t
  misc_feature (316)..(316): n is a, c, g, or t
  misc_feature (321)..(321): n is a, c, g, or t
  misc_feature (324)..(324): n is a, c, g, or t
  misc_feature (329)..(329): n is a, c, g, or t
  misc_feature (331)..(331): n is a, c, g, or t
  misc_feature (352)..(352): n is a, c, g, or t
  misc_feature (354)..(354): n is a, c, g, or t
  misc_feature (362)..(363): n is a, c, g, or t
  misc_feature (376)..(376): n is a, c, g, or t
  misc_feature (380)..(381): n is a, c, g, or t
  misc_feature (383)..(383): n is a, c, g, or t
  misc_feature (385)..(386): n is a, c, g, or t
  misc_feature (390)..(390): n is a, c, g, or t
tggaccacaccggtttgggacaagccagattaccaccgagccccatcctccccctatacacaaccacgctttggctttngtaaaagatattggccaacctgctcaccttccaggctcccacttaatgcctaagggggcagacacagtggtccacgttcaggtggctaatgatccttttaactgggtttctgcttctcgggatggaattgtgggtcaccccagcntcagggganggaactntgatatntggangcccgaggtctcactgtgtgctcttcccaagtgcntgccctttntggatctcagtgccccactnttcancanagaantnagaccagacctgggcagggcntnttgactcnntggagcacgtgcntagnntncnngaanccctgggtttgacccacagcatcactt

SEQ ID NO: 8788 - DNA, 445 bp, Mus musculus
  misc_feature (336)..(336): n is a, c, g, or t
  misc_feature (339)..(339): n is a, c, g, or t
aaatcatttaagtcccagtgccagacctcctgacccaaacacagggtcagccactgaggttcctgacttatcagtgcccatcactatctggcgttctgaaagtcccatagaaaagtgtcaggaaagcaacgtcatcaaggatataaagagaaaggagaaagagcaagatgaggaggagatggtggatgaaaaggcaaacttgaagaaaaaagccaagggcaagttaactaagaagaaaaccccagtgaagtcggagtcttcccctgctgatctgagccaatccgtaagaggacccgtgaggacaccagagtctagcccagaaagcccgggagggcnggngagcgagtacagttgtgaacggggtaaagaaaggccctctagtgaagatgttgtagagtcattgtcccccagaaagaaagagaagacatcatctggccaggccaaa

SEQ ID NO: 8789 - DNA, 466 bp, Mus musculus
  misc_feature (295)..(295): n is a, c, g, or t
  misc_feature (327)..(327): n is a, c, g, or t
  misc_feature (368)..(368): n is a, c, g, or t
  misc_feature (404)..(404): n is a, c, g, or t
tacagatggaatcaacttggcaaccaaaaatacccatcacagataatacccctgacatttatcctggaaatccacatgaacatgtcctcacccaacctgcaacatgggttcgaagtcttatgatttttcaaacatctgaaatgacaagaccacagtcagaagtataatacctaacatcctaaggactagagagaaccaagagagatggaactgggatcagttaaagtgcttccctgatggataactgtccactgttcttctaagaagggggatgctgaacatctctgaatataancatggaaaccttccataacatctgctgctaanttctgccagctgaaaagtgataatgatgatgaatacttttnttgatgatgtggatacattggtctaactaaattaanttgcagactcagggcatataattgaaaacacatgatttgtggtatcacctggttggctttat

SEQ ID NO: 8790 - DNA, 511 bp, Mus musculus
  misc_feature (312)..(312): n is a, c, g, or t
  misc_feature (321)..(321): n is a, c, g, or t
  misc_feature (327)..(327): n is a, c, g, or t
  misc_feature (336)..(336): n is a, c, g, or t
  misc_feature (338)..(338): n is a, c, g, or t
  misc_feature (349)..(349): n is a, c, g, or t
  misc_feature (392)..(392): n is a, c, g, or t
  misc_feature (410)..(410): n is a, c, g, or t
  misc_feature (420)..(420): n is a, c, g, or t
  misc_feature (443)..(443): n is a, c, g, or t
aaggtattgtccagggctttctcacagctcctagagacggacctcagacgtgcatcacgtggacctctgaaaaaaccatggagctcattgctccaaagccaactggagagcttctcccaatcctgctgctgctgctgttacagctgcttacaacagccattgtcgtggctagagtcttatattcactgtgacaccataggagaaatgattccacttttgctgtcttacatgacctaataaaaggaggcacatcccattatactctcaaaccctgtctgcactcagggagaggttataacctcattaaggatntttggagcnattttntaggtcttngnaaccatggttnttgaatgggtaactgctggcagaacatgaaatccttcctaaantgattgtccacttttttntttgacattntcttgagaacagccactagtttntcagtgtgcttagcaaatatgaatttacaatataaatcaatatggacattcatgtttcacagacttca

SEQ ID NO: 8791 - DNA, 422 bp, Mus musculus
aaagtgtactactcatccagtccagaaaaaattcaaaccacagaatacacttctgataccactccagtatttgatcaaggaaggagttctcaaagatccagtcagagttccagatggcggttccctccaatcgtttttgaagacccctatcatgttgcacttcgctatgtggagaaacacaacatcctgcatatattccagcagatcactgaaaacctagtctatgaaaggccagatgacccactgtatttcatgctagaccaggtacagaacatgatcaaacacagagacgaaaggcagagcgactgaagacagacgtcccaagcactgcttactgtcatccatggcccgactgtactcaacctgctcccacttgaaaaatgtgttttcagtaggcatcggtggtaactctgcctaaatgt

SEQ ID NO: 8792 - DNA, 410 bp, Mus musculus
  misc_feature (158)..(158): n is a, c, g, or t
  misc_feature (163)..(163): n is a, c, g, or t
  misc_feature (171)..(172): n is a, c, g, or t
  misc_feature (182)..(182): n is a, c, g, or t
  misc_feature (184)..(184): n is a, c, g, or t
  misc_feature (196)..(196): n is a, c, g, or t
  misc_feature (199)..(199): n is a, c, g, or t
  misc_feature (211)..(211): n is a, c, g, or t
  misc_feature (219)..(219): n is a, c, g, or t
  misc_feature (228)..(228): n is a, c, g, or t
  misc_feature (236)..(236): n is a, c, g, or t
  misc_feature (255)..(255): n is a, c, g, or t
  misc_feature (259)..(259): n is a, c, g, or t
  misc_feature (280)..(280): n is a, c, g, or t
  misc_feature (285)..(285): n is a, c, g, or t
  misc_feature (346)..(346): n is a, c, g, or t
agctaacggatatccccaaacacttgccaccgggcagggagtgatcttaaaacccactcgggtcctatggtgaaagcaaagcctggctaaaacggttgacatcatcgccacatacaggaaggaaggaagatgtgggagcagagaggaagaggacctanagggngaagcatnnatggagagcngnctcccaaagcantancggggaacgcanccatgccngtaggcttngtgctccnaaatggaccgagacaaaangatncggagacaaaagctcagatcntgtgnttgtcactgatgctaaatgcttacgacggtaacagagagcctgcagcagcgatgtggattnatagaaaccagagcccctccgttggcagaaggctatgaggaaatgcattgcttacacatgaagt

SEQ ID NO: 8793 - DNA, 406 bp, Mus musculus
  misc_feature (127)..(127): n is a, c, g, or t
gaaattgcctcaaaacgggtgcctttgttagaggaaacattggatgcactccgagcgccgggaagccttccagcccctacgctttcgggggtgcagtcgttcagtcagtcgcgctggccctggtagntctgcctggcagggtttgcgtttattgcagagagagacttaagcattctgtcaacacatatggcttagaaagcttcaaccataacattgccgtttttacagttactgctttaagtatgttagcagacagaacatccttgttttacccgagggaatggaatagattctgggcaaaccatcgtccacccccactctgctgtattaactatgcacagggatggtaattagcctctgggtccttcaagccactggttcagttcttccgtctgtagcccagaga

SEQ ID NO: 8794 - DNA, 417 bp, Mus musculus
  misc_feature (376)..(376): n is a, c, g, or t
ctctccatggtttccgtgggacaatcaccctccaactggtctacctccctgaagcccctttcctccacctccttcctcaggccttcatcagcctctccggcccattctggttcttctacgccaccgcatatcctgggcctgccccgaagaggtcagagaccccaaggccagatgttatctccttcttgcagcacccgaagcccgggggagccaccctcgtgtcccctgtgaggtggagctcccacctcatgtgttgaggtgttcattattttctctgttctgtagcaggggacctatagggtcttgcacgtccctggctcgctctctgccaggctgggaggatgcagccccttccttcccatactgcttctctctngataactccagctgtcttgtggctctgcacagttctggaga

SEQ ID NO: 8795 - DNA, 254 bp, Mus musculus
tataagcagactggcgccaactactacgttctatactacccacttccggaccaagtcagatatcttgactttctaattccttttgctttgccctgccctctctgtggtgcagggtacagttctgcccttattctacaggcccaggctgggcttttgactctccagactttaacttggatagatgatgtgggtctgattggtggaattaaaggcctgagatgtttctggggtggtggtcagttctatgtgagcca

SEQ ID NO: 8796 - DNA, 75 bp, Mus musculus
tttggccatggctatgcccgcctcaccctcagcctgtataaccctcattccagtgacctcagtggtcatttgacc

SEQ ID NO: 8797 - DNA, 120 bp, Mus musculus
  misc_feature (51)..(51): n is a, c, g, or t
cccctgtacacgctgctgaaggagagcaccgtgtggaccatggagcacctncaaccgatacatcaatgacaaatttaggaagaccaagggcctccccagagattgggtcttcaccacctt

SEQ ID NO: 8798 - DNA, 314 bp, Mus musculus
  misc_feature (41)..(41): n is a, c, g, or t
  misc_feature (52)..(52): n is a, c, g, or t
  misc_feature (61)..(61): n is a, c, g, or t
  misc_feature (88)..(88): n is a, c, g, or t
  misc_feature (136)..(136): n is a, c, g, or t
  misc_feature (144)..(144): n is a, c, g, or t
  misc_feature (223)..(223): n is a, c, g, or t
gaaggtggcagccatcatttctgctgagggggacgctaagncggcagagctnatcgccaantcgctggccacagcaggcgatggcctnatcgagctgcgcaagctggaggctgctgaggacattgcgtaccaattntcccgctntcagaatgtcacctacctgccagtggggcagactgtgcccctcaagcttccctagtgaggcctcccctgcttcaccttntccggccaatcagcccatattttccaacattttgaacaatgccttccttctaccccaccccggaaagcactgtgaaatttaatgataggct

SEQ ID NO: 8799 - DNA, 184 bp, Mus musculus
  misc_feature (65)..(65): n is a, c, g, or t
  misc_feature (136)..(136): n is a, c, g, or t
aacggacagcatcaaatgctgagcagtacaaatatgggaagaaccgggtagaagcagatgccaancggttacagtccaaagaggaagagctgctgaagaggaaagaggccctacggaacaggctggcacagctgcnggaaagagaggaaggacctgagggccgccatcgaagtgaatgcaggca

SEQ ID NO: 8800 - DNA, 95 bp, Mus musculus
  misc_feature (57)..(57): n is a, c, g, or t
tgggtgacagatgttcactccagcagagtggggtttatgagttttactcggaaaacntttgagccacatttcagcttaggaaacaccaaaatggc

SEQ ID NO: 8801 - DNA, 80 bp, Mus musculus
ttactctttctaccagtaggtatggctgacctttttcttaactataaatgttatgaaatataatctggtggccggccggg

SEQ ID NO: 8802 - DNA, 405 bp, Mus musculus
  misc_feature (264)..(264): n is a, c, g, or t
  misc_feature (286)..(293): n is a, c, g, or t
atggcatagctgtgcgttgtcactccgtctgagcatttctcaaagtgtgggaagagccatccagaggaggggaaaagccacatcagtgagaagcaaggagggtacagagtgatgactgacacccaggtcctaagaaagcagttgttctcaaccttcccagagctgtgacccctgaatacagttcctcatgttgtgctgaccccccagccacagaattattttcgttgctacttcattaactgacattttgctactctcgaaaancataatgcaaatatctgtgttnnnnnnnngtcttcggcaacccgtgacagggtcattcgactcgctaaggggtggagacccacaggttgagaactgttgtgctaaagcgggtggctggctcctctctgctgagtactgcaa

SEQ ID NO: 8803 - DNA, 524 bp, Mus musculus
  misc_feature (278)..(278): n is a, c, g, or t
  misc_feature (287)..(287): n is a, c, g, or t
  misc_feature (293)..(293): n is a, c, g, or t
  misc_feature (303)..(303): n is a, c, g, or t
  misc_feature (305)..(305): n is a, c, g, or t
  misc_feature (320)..(320): n is a, c, g, or t
  misc_feature (348)..(348): n is a, c, g, or t
  misc_feature (350)..(350): n is a, c, g, or t
  misc_feature (353)..(353): n is a, c, g, or t
  misc_feature (355)..(355): n is a, c, g, or t
  misc_feature (385)..(385): n is a, c, g, or t
  misc_feature (387)..(387): n is a, c, g, or t
  misc_feature (389)..(389): n is a, c, g, or t
  misc_feature (392)..(392): n is a, c, g, or t
  misc_feature (395)..(395): n is a, c, g, or t
  misc_feature (403)..(404): n is a, c, g, or t
  misc_feature (406)..(406): n is a, c, g, or t
  misc_feature (410)..(410): n is a, c, g, or t
  misc_feature (415)..(415): n is a, c, g, or t
  misc_feature (456)..(456): n is a, c, g, or t
  misc_feature (465)..(466): n is a, c, g, or t
  misc_feature (472)..(472): n is a, c, g, or t
  misc_feature (489)..(489): n is a, c, g, or t
ggtgctgtctgtttaaaccactcaaagagattctgatgagttgatgtggccatgtagcagctggactcaaaggaaaagcctgacaattgtgagaatccaaccaaccccgccaagaaccctcttagttaaggcaaacgtaaaaggtacacttaggacaaggacttactaacattaacagacttaagctgagggcaggttttagccatatatgcttggggagagtcaggtcgttctcggtattaccactgtaaatctgaaaacttgtaagaggaaccatnatacacaanagaccntcggcaattntntaagccagtcatgtnaatgctattcacaagcacatactgcctntnttntnttcagccaaaacagcctagctgccttgacntntncantgntccccttnnanccanttccnacccagctaaggagactttaaaacagaaaatgaaacaagcntcagacttnntttgtntgagaagcatgttcaantcctgacccttttgcttccactttggtgagctgga

SEQ ID NO: 8804 - DNA, 350 bp, Mus musculus
  misc_feature (30)..(30): n is a, c, g, or t
  misc_feature (76)..(76): n is a, c, g, or t
  misc_feature (93)..(93): n is a, c, g, or t
  misc_feature (322)..(323): n is a, c, g, or t
agatgggatgctgtgtttctctcatgagtntagaacacccagggcttgaaatcagacaatgccctggcttagattnaaaagccttttaaaaantggagtctgactctcagttcctcctgttccactgaaatgccctgtcattcacacagacagctgtggtggactgtgcttctcagacccttggtgggtgaaaaacagtcgatgttgcctgctgctgtaagaccccaatgcaatgtgtttcttaggcccctagaaacaaagcccaggatggagttctttgttcttttgccatcagccctaaagaaaggtgagatgggtgacnnacctaggcatctgacccattgtgtaag

SEQ ID NO: 8805 - DNA, 505 bp, Mus musculus
  misc_feature (42)..(42): n is a, c, g, or t
  misc_feature (190)..(190): n is a, c, g, or t
  misc_feature (319)..(319): n is a, c, g, or t
  misc_feature (335)..(335): n is a, c, g, or t
  misc_feature (337)..(337): n is a, c, g, or t
  misc_feature (345)..(345): n is a, c, g, or t
  misc_feature (358)..(359): n is a, c, g, or t
  misc_feature (361)..(361): n is a, c, g, or t
  misc_feature (377)..(378): n is a, c, g, or t
  misc_feature (384)..(384): n is a, c, g, or t
  misc_feature (404)..(404): n is a, c, g, or t
  misc_feature (406)..(406): n is a, c, g, or t
  misc_feature (424)..(424): n is a, c, g, or t
  misc_feature (429)..(429): n is a, c, g, or t
  misc_feature (441)..(441): n is a, c, g, or t
  misc_feature (446)..(446): n is a, c, g, or t
  misc_feature (450)..(450): n is a, c, g, or t
  misc_feature (452)..(452): n is a, c, g, or t
  misc_feature (455)..(455): n is a, c, g, or t
  misc_feature (468)..(468): n is a, c, g, or t
  misc_feature (470)..(470): n is a, c, g, or t
  misc_feature (474)..(474): n is a, c, g, or t
gtacgattagtaagcccagccggaacgtccaatcgtgtccanaatggagcacgaagcccccagacagtaagaggcacatcagataatcttggctctgtgctttaaaaatccgggcagcttctctccagctcagttccttatctaaacagacataataatgtccatcttacaagactgttgtgaagcttanatcagataatgtatttaacgtgcttggagcaatgtctggaccattcagtaagtgtcagcttgtattattaggagtgacattagctaagtgagcagtcaccatgccttttctgcagtctttgcactgtangcatgcatacccagcntnatgatggnccctaggaggggnntntggaacccatccccgnnatcagnttggggtgatagacgcagangngacaaatgacaacagaanccatntgagactgtgtntcagntctntntcnccacggctgctcntntttntacacacagactttgcgtcactttgagggca

SEQ ID NO: 8806 - DNA, 542 bp, Mus musculus
  misc_feature (125)..(125): n is a, c, g, or t
  misc_feature (157)..(157): n is a, c, g, or t
  misc_feature (263)..(263): n is a, c, g, or t
  misc_feature (290)..(290): n is a, c, g, or t
  misc_feature (305)..(305): n is a, c, g, or t
  misc_feature (336)..(340): n is a, c, g, or t
  misc_feature (342)..(342): n is a, c, g, or t
  misc_feature (482)..(482): n is a, c, g, or t
  misc_feature (484)..(484): n is a, c, g, or t
atttgcctatagacgagctgagtttcaagtataacatgatcccagtctaccgagaccaagctgcagtgatagaatcagccaaggacattcaatttggaacagaactgcccatggacaaggagttnccctctcctgaagatggggttcttgttcatgnaatgttcatggatgcttctcggtgggatgataaagacatggtcatagaagacgcattgccaggacagatgaaccccatgctgcctgtagttcactttgaaccaaancaaaactatgagccagtccacacactntaccactccccactntacaaaacaggagcccgggcaggaacacttnnnnncncaggccattcaaccaactttgtggtgactgtcctcttaccctccaagaggatcagtgattactggatctccaaggggtcagcgttgctctgccagctgagtgagtaagtgggagcctcgccgatccagaagtcttccctnangaggaggaagtgacctctgagtcgacttaaggatggcagctgtggctgttatttctcc

SEQ ID NO: 8807 - DNA, 552 bp, Mus musculus
  misc_feature (306)..(306): n is a, c, g, or t
  misc_feature (314)..(314): n is a, c, g, or t
  misc_feature (341)..(341): n is a, c, g, or t
  misc_feature (397)..(397): n is a, c, g, or t
  misc_feature (437)..(437): n is a, c, g, or t
  misc_feature (443)..(443): n is a, c, g, or t
  misc_feature (465)..(465): n is a, c, g, or t
  misc_feature (496)..(496): n is a, c, g, or t
atgagcaactaccaaggctcctctgggcttcacactcatgtacacacacatgcactcacatacaaagggacactggttatcttggcacatgcttacactcacagctgccaggacatgaaagcaggagaatcgggacttcacattagcttcaactatttaacaatttcaaggctagcctgggctacatgagacactggaagtttctaaacaagcaaacaaaacaaaacaaaagccaatacttatgagatccactggtgaaactactgtgacaaagttcccaagactgggctctgcattccctgcagntagtggtnttgtaacttgttggactgtcattaacngtaacaagcaaggctggtaagatggctcagcaggggatggtgtgtgctggcaagcntgacagcctgagtgtcaggaaagagctagctcctgcaaantatccnccaatcccccacacgcacaccntcagctcaggaaagagctagctcctgcaaantgtcctccgatcccccacacgcacacactcagcatgttcacaagtgtgcgcggaca

SEQ ID NO: 8808 - DNA, 457 bp, Mus musculus
  misc_feature (160)..(160): n is a, c, g, or t
  misc_feature (186)..(186): n is a, c, g, or t
  misc_feature (203)..(204): n is a, c, g, or t
  misc_feature (207)..(208): n is a, c, g, or t
  misc_feature (241)..(241): n is a, c, g, or t
  misc_feature (277)..(277): n is a, c, g, or t
  misc_feature (286)..(286): n is a, c, g, or t
  misc_feature (316)..(316): n is a, c, g, or t
  misc_feature (325)..(325): n is a, c, g, or t
  misc_feature (344)..(344): n is a, c, g, or t
  misc_feature (347)..(347): n is a, c, g, or t
  misc_feature (411)..(411): n is a, c, g, or t
ggagatccagatcgccatgaagcatgatgaggttgacatcctgggcctcgacggacacatctacaagggacggatggatacacggttgccaggcatcctagggaaagatgccccaggagtgacaaaacacaacaaggctaagctccagcagctccaacanactgcagcagctgcagcagctccaancaactgcagcagctgcnncanncccagcatgcccggcccacgcacacaggcagcnaagcctgggcaacatgatctcgccaccctctcggcntcagagtgnacagatgatagcggacagcaaagcagttcnttcagggcnaaagaaagacagaccagtntcntctgaggggcgtctcctgcagtcgaatgtgagccattcatccatccctacagacatagccagtntgcagggtagccaacaggggctgaacatgcacattgacgtgcctcc

SEQ ID NO: 8809 - DNA, 354 bp, Mus musculus
tgagccatcccattttattccctacgttcgaacaaatgagatctattatcttgatccagacgcacccttgtctaggccttcaacccaggacaaccaataccaaaaatctcatgattgtgcccgagaacaagagctatttgactctgaccatatcagggatccacttcttaatcctaaattagtgaaaaacagggaccgacagcaagctatccttaaggggctttcagaactaagacagggtcttctccagaaacaaaaggagttggaaacgaatctcatacccttaactgcaaaccaagaagataattttagttcttcgttttaaatatgcttaccacgcaacagcatttttca

SEQ ID NO: 8810 - DNA, 284 bp, Mus musculus
agaacccaattcctgagtcaattcccaaaatccacatctggctgttcacatgcacctgtatctaaagctccatgggatctaatacctctggtcttcacaatcgcctgtacacacacacacacacacacacacacacacagaggcataatttttaagaaaattttccaggaggataattccacgactatgattgtggaatgttgcagattcagagccaagttatcctgggtcatactttgttccattagtagccattcattgcccatctcttgtgtctgatttta

SEQ ID NO: 8811 - DNA, 345 bp, Mus musculus
gaagtcttttttgagcccagccatttgggtgagattaaaggcatcctgtgcctatcgtcactcataggtggggaatatatcatcccactctttggaattgctctgccccccaaaccccaaggtcccttcctaatcagagccggatacaacatcatcatccccttcaagaatgtcttcttgcatgcaacaagcttctccttcattgtggagaacccagccttcagcatccgggctgcagagaccgtgcggcccaagaagatcaacaacatcacagtctactttgaggggaacccgtcgggcagtaaaaccccgatcacctctaagttgattgtcacctgccctcag

SEQ ID NO: 8812 - DNA, 522 bp, Mus musculus
  misc_feature (328)..(328): n is a, c, g, or t
  misc_feature (338)..(338): n is a, c, g, or t
  misc_feature (345)..(345): n is a, c, g, or t
  misc_feature (355)..(355): n is a, c, g, or t
  misc_feature (363)..(363): n is a, c, g, or t
  misc_feature (383)..(383): n is a, c, g, or t
  misc_feature (392)..(392): n is a, c, g, or t
  misc_feature (397)..(397): n is a, c, g, or t
  misc_feature (400)..(400): n is a, c, g, or t
  misc_feature (419)..(419): n is a, c, g, or t
  misc_feature (425)..(425): n is a, c, g, or t
  misc_feature (438)..(438): n is a, c, g, or t
  misc_feature (481)..(481): n is a, c, g, or t
  misc_feature (492)..(492): n is a, c, g, or t
gggtgatacctgctttcaagaacattaaggacaaatggagactgtgaagccttttgaacatttgagaaaagacgctgtctagttattgagccaatatgattgttttcctggcaaaatttttctcctttctaaaattaactttccctaaggaggaatagtgcagatgcgcatgattcagcccagccaactcccgagaatcctgtaaagtgtaaaagtgaccttccttcatgcctgtggatcctggggtgagatctgatggcagcacatgccgacaagccccccgcctgctggccttggccaggtgccccttcgatggcatgggcagagntacagtattncactacnggttctatcngtgaggcnaaagtattattatttcccanagatttcangtatnttntactcactggatctgaganttccanaattatatatgtnacacatggttttaataggaaccaaaaaccacaatatttttctntgtggtggganagttaagcattaggttttgatcactttttc

SEQ ID NO: 8813 - DNA, 180 bp, Mus musculus
  misc_feature (112)..(112): n is a, c, g, or t
  misc_feature (129)..(129): n is a, c, g, or t
  misc_feature (132)..(132): n is a, c, g, or t
  misc_feature (135)..(135): n is a, c, g, or t
ggtaaacctgaaagtgatggtgcttgtggtccctatatttcttgtcgttttaatgtgctgtctaatggtgatcgcccacctttggttttaagtacaaaaagtagtatctccnccgagttcatcagagtnttngtnttcatcatcctggtcagactctgactctcagtgaagttttattta

SEQ ID NO: 8814 - DNA, 442 bp, Mus musculus
  misc_feature (52)..(52): n is a, c, g, or t
  misc_feature (58)..(58): n is a, c, g, or t
  misc_feature (237)..(237): n is a, c, g, or t
  misc_feature (257)..(257): n is a, c, g, or t
  misc_feature (260)..(260): n is a, c, g, or t
  misc_feature (264)..(264): n is a, c, g, or t
  misc_feature (266)..(266): n is a, c, g, or t
  misc_feature (271)..(271): n is a, c, g, or t
  misc_feature (282)..(282): n is a, c, g, or t
  misc_feature (294)..(295): n is a, c, g, or t
  misc_feature (304)..(304): n is a, c, g, or t
  misc_feature (312)..(312): n is a, c, g, or t
  misc_feature (316)..(316): n is a, c, g, or t
  misc_feature (322)..(322): n is a, c, g, or t
  misc_feature (327)..(327): n is a, c, g, or t
  misc_feature (335)..(335): n is a, c, g, or t
  misc_feature (345)..(345): n is a, c, g, or t
  misc_feature (353)..(353): n is a, c, g, or t
  misc_feature (356)..(356): n is a, c, g, or t
  misc_feature (358)..(358): n is a, c, g, or t
  misc_feature (362)..(362): n is a, c, g, or t
  misc_feature (393)..(393): n is a, c, g, or t
ttaagtttatcctccatgtgttgtagacctcatagtgaatgttattggaggntgaaangcttgacctgtatagtaaatgatcttattcaattttttccatttcaacaatagcacaacttttaaaaatgatcattttatagacacagtcaaccactttgacttatgctatagtaaagagcatagttgagtttttggaaagtccaggatctacaaatttggtcaataaaacacacaccnacagaattactacaattaanganacangnaattnattggtgcatnagatgaacgttnntttgaaatnaatatttnaaanataatngtttnaataattnggttaatttnggataatnttntntacnattaagttgataatggtttttgacgttcttntggtagagatgattcattttactgttttgtggtaactgtgagactctaa

SEQ ID NO: 8815 - DNA, 477 bp, Mus musculus
  misc_feature (65)..(65): n is a, c, g, or t
  misc_feature (93)..(93): n is a, c, g, or t
  misc_feature (108)..(108): n is a, c, g, or t
  misc_feature (269)..(269): n is a, c, g, or t
  misc_feature (373)..(373): n is a, c, g, or t
tgctgccctttccttgaggatcatccgtcccctgtcctaggcccttcaggttccgttccctcctntccgagagcggcacagtaccactggctnttatgacccccatcntgactgcctctgtcactggctcagatgtggggactgctcaccttaatgcgccttcccgccccagccgtactgtgtgcagagggtgcaggagaagggtcctgccccaggcacatggctctttggcgtctcagctcctccccaggggactggctcgctcagtnttctgagccccttgggcaggtgttggggggcagggagttgccctccccctccctgggaagcaaccgaagaatgtttacatgccacacagaatgtaacagccctngcccaccccttccagtcactgcatggcctctgcccaccctgtgcctgcccactcccctgacaccaacaccttgcaagtcgctgtcacaactagatcgggtctca

SEQ ID NO: 8816 - DNA, 274 bp, Mus musculus
tcatatcaaatttggcctccttcacagagaggtttctgatgcagctggatgaagtgattaccatagatgacatccaggtcccacggtctgagcccccaaagcagaaagtctcaatcctcatacggaggaagctggccatgctctctctggaggaagagagcgagaagcccctgattgaacgtgggagcaggaagtggccaggcatcaagcccaacgaaatcaccattcagaacaagatactgactcggaggacaccatcaataaccaccaataa

SEQ ID NO: 8817 - DNA, 303 bp, Mus musculus
  misc_feature (228)..(228): n is a, c, g, or t
  misc_feature (247)..(247): n is a, c, g, or t
  misc_feature (259)..(259): n is a, c, g, or t
  misc_feature (266)..(266): n is a, c, g, or t
  misc_feature (270)..(270): n is a, c, g, or t
gcaaatggactgatcgtgccaccaaacagaagaactggtcaaggctatgtatgtatcttctctggagtatggagctcaactttgaaaatgaatgagaaggaaaaccaagacactcaagtaactaaagaggaaaaagaaagtgacgtcttaccctaatatgagtttatgaagaaggaaactcttttctcataaagaaggtgtgagaccacatgtcctattcatactgcntgcaaatgaatgaagaatnatctcccacccntacatantgantgcaaatgaatgaagaatactggtgctctccca

SEQ ID NO: 8818 - DNA, 339 bp, Mus musculus
  misc_feature (145)..(145): n is a, c, g, or t
  misc_feature (160)..(160): n is a, c, g, or t
  misc_feature (166)..(166): n is a, c, g, or t
  misc_feature (178)..(179): n is a, c, g, or t
  misc_feature (189)..(189): n is a, c, g, or t
  misc_feature (278)..(278): n is a, c, g, or t
aatgaactccgcacagaacaccggccttgcacctaccagttgtgcgcttgcaacaggcacctggaggaatgccctctggactcgagcctctgttctgaccatagctgcagctctcgtgctccctttcagagcagcaccacttctntggttcctgtccacntgagangcagacccatcnntgccacccantagcccgagccccagcccagctcttgccttttggaaacgtgtcaggattggcctggaggatatctggaacagcctttcttcagtgttcncagagactcaaccagtagaaagaatccagaggtaatggccatgtctccctcaagagaagat

SEQ ID NO: 8819 - DNA, 322 bp, Mus musculus
  misc_feature (104)..(104): n is a, c, g, or t
tcacttcctcctgggcagtatctagccataacatatcagtggataagagttacattagtgacatcttagctccacttcaacaggacaatctgagactgaccagngacaatccttgggaataggccttgacatctatgattacaggacctgtaactgtgataaaattggagaatgttcatctttgtcctcatcccatctggcagggcatcatgcatctggcccaggattcatgttgagcactggtgacatgggactgatatcagctgcgactgtatatggaaaaggcactcccattcaggattttcaaggcactcgtatctta

SEQ ID NO: 8820 - DNA, 352 bp, Mus musculus
  misc_feature (129)..(129): n is a, c, g, or t
  misc_feature (131)..(131): n is a, c, g, or t
  misc_feature (157)..(157): n is a, c, g, or t
  misc_feature (211)..(211): n is a, c, g, or t
  misc_feature (220)..(220): n is a, c, g, or t
  misc_feature (226)..(226): n is a, c, g, or t
  misc_feature (228)..(228): n is a, c, g, or t
  misc_feature (231)..(231): n is a, c, g, or t
  misc_feature (284)..(284): n is a, c, g, or t
  misc_feature (326)..(326): n is a, c, g, or t
gatctacaagactcgagccccgcagttcacgatgctggggaggactctgccaccccgagagaacaccaagaagccaggacctgcatcctacagcgtggacaaggtggtctggagtcgagggtcaagggncnggggatgagggactgaggtctaaggnatgggtcaaagtccccagggaaatggcatccctgtatgaagccgaacagctggntcggtaagntcagcntngtntccccgacccgcagcaccggaagccttgtggctggagcttcgggatcagacantcagactacctagcccccatgatacagtaccacgtggacgantgatgcctgcaagcacgcgcgcacag

SEQ ID NO: 8821 - DNA, 244 bp, Mus musculus
  misc_feature (27)..(27): n is a, c, g, or t
tccgaggctgaccttagctttcgaccntccggactcagccctgggacacctaggtcagacactacaagtgaagtgttagtaccagtacactccatcctggcctaactatataacccttgacctgcgttgccaggacaacgaccctcaatcccacaatccacttggctcagttcccaccctcactggtgtgacgtcattttccgtataaatggggggggggaaggaattaccaccacccttctct

SEQ ID NO: 8822 - DNA, 110 bp, Mus musculus
  misc_feature (26)..(26): n is a, c, g, or t
  misc_feature (33)..(33): n is a, c, g, or t
  misc_feature (35)..(35): n is a, c, g, or t
  misc_feature (40)..(40): n is a, c, g, or t
gtggttcctgagtggagacgaccttntgctgtngnccaanttaataaagatccggcgattgttcaataagctggaaggatgcatgaatttccccataagtcaggcttggg

SEQ ID NO: 8823 - DNA, 103 bp, Mus musculus
  misc_feature (26)..(27): n is a, c, g, or t
  misc_feature (36)..(36): n is a, c, g, or t
  misc_feature (45)..(45): n is a, c, g, or t
  misc_feature (49)..(49): n is a, c, g, or t
cagctcacccgacccttgttgtaatnntaggcatcnagatttttntccntgaacctccggaattcattacgcgttgatttttcagctgctacagtataaggtg

SEQ ID NO: 8824 - DNA, 148 bp, Mus musculus
  misc_feature (43)..(43): n is a, c, g, or t
  misc_feature (51)..(51): n is a, c, g, or t
  misc_feature (54)..(54): n is a, c, g, or t
  misc_feature (64)..(64): n is a, c, g, or t
  misc_feature (70)..(71): n is a, c, g, or t
  misc_feature (79)..(79): n is a, c, g, or t
  misc_feature (89)..(89): n is a, c, g, or t
  misc_feature (93)..(93): n is a, c, g, or t
  misc_feature (113)..(113): n is a, c, g, or t
  misc_feature (123)..(123): n is a, c, g, or t
ttcttggaatactacctcatgcagataaagcactcaatgtttngttttctntantagttcagtntaaatnnttgtaccnttatatattntgantattatgtttatgcttcatntccttgtagntttttcccagacacaacttccaggt

SEQ ID NO: 8825 - DNA, 203 bp, Mus musculus
  misc_feature (30)..(30): n is a, c, g, or t
  misc_feature (37)..(37): n is a, c, g, or t
  misc_feature (39)..(39): n is a, c, g, or t
  misc_feature (45)..(45): n is a, c, g, or t
  misc_feature (49)..(49): n is a, c, g, or t
  misc_feature (52)..(52): n is a, c, g, or t
  misc_feature (59)..(60): n is a, c, g, or t
  misc_feature (62)..(62): n is a, c, g, or t
  misc_feature (65)..(65): n is a, c, g, or t
  misc_feature (67)..(67): n is a, c, g, or t
  misc_feature (74)..(76): n is a, c, g, or t
  misc_feature (135)..(135): n is a, c, g, or t
  misc_feature (137)..(137): n is a, c, g, or t
aatccacagtattgcttggtttatttgacntttcagntnttgctnaagntgnttctccnnanttntnttaatgnnnatgtacacaccgagatccctgattcctattccctaaagcatagtctacaaggagtggtntntttaaagccatgtatgacattgaagattcgtggtagaaattgtgtttatatagcattggtgtcgac

SEQ ID NO: 8826 - DNA, 141 bp, Mus musculus
  misc_feature (26)..(26): n is a, c, g, or t
  misc_feature (30)..(30): n is a, c, g, or t
  misc_feature (39)..(39): n is a, c, g, or t
  misc_feature (45)..(45): n is a, c, g, or t
  misc_feature (48)..(48): n is a, c, g, or t
  misc_feature (52)..(53): n is a, c, g, or t
  misc_feature (57)..(57): n is a, c, g, or t
  misc_feature (59)..(59): n is a, c, g, or t
  misc_feature (62)..(62): n is a, c, g, or t
  misc_feature (72)..(72): n is a, c, g, or t
  misc_feature (80)..(80): n is a, c, g, or t
  misc_feature (82)..(82): n is a, c, g, or t
  misc_feature (111)..(111): n is a, c, g, or t
taggaagaaatggacgttccaatctnttcnagagaatangaatgnttntttnntgtntntangggagggcgntattcaancnttcaaatgtgcttcagatgagcttttcanggtcaaatggcctcgattttatgacacttt

SEQ ID NO: 8827 - DNA, 45 bp, Mus musculus
aggcaggcctgctgggacttaagctatggaccatcgtgcatgatt

SEQ ID NO: 8828 - DNA, 72 bp, Mus musculus
agatcccctataacgagaattacagacacttgtgagccaccgtgttggtggtgtgaactgaacccagatact

SEQ ID NO: 8829 - DNA, 64 bp, Mus musculus
tgaccagtcacagtgacctcagacaccagaaggtgaggtggcttattatgcccacactttgtgt

SEQ ID NO: 8830 - DNA, 98 bp, Mus musculus
  misc_feature (37)..(37): n is a, c, g, or t
  misc_feature (40)..(40): n is a, c, g, or t
  misc_feature (51)..(51): n is a, c, g, or t
  misc_feature (53)..(53): n is a, c, g, or t
tttaccccagcatggttgtaattttttccccagctantcnaaaatcagtantnagtttccagaaaactggacattttgcaacgccaaaggggcagatt

SEQ ID NO: 8831 - DNA, 60 bp, Mus musculus
agtttagagagaatggcacaatcctggcctgggcctgaacccaggaacagtaagaaacgg

SEQ ID NO: 8832 - DNA, 63 bp, Mus musculus
taacacaaggcacagagaatttacttgatgaagcatttctggcatgagcgaggttccgcatcc

SEQ ID NO: 8833 - DNA, 101 bp, Mus musculus
  misc_feature (29)..(29): n is a, c, g, or t
  misc_feature (32)..(32): n is a, c, g, or t
ttcattttcataaccgattttgaagagcnttnttaatgtgccatatttggtcagtagacaaagggcaaattggcaacctctgtgcccaatgccaagcttaa

SEQ ID NO: 8834 - DNA, 68 bp, Mus musculus
gcaaatgtaccccattgttttgggtggggcgtggaacccttttggaatcatgatttgtattttatggt

SEQ ID NO: 8835 - DNA, 468 bp, Mus musculus
agatgtagtcacagtttatgggcctgtggatgataagggattctactatggtgagtatggtggacacaggggcctggtcccagcccacctgctggatgacttgcctgtccatggagagtaagcacgactcccttggagggtagtggcatccggtggcccaacaccccttggaaacagaagcaagcacatgaattttcacacagtatccctcctccctagccaccgtaagcaacactggctccaggcaacatcacctgaaactgacaacagtcctcagatgttgtcctagtaaccaacagcagcaggacttaaatctgagttgttccccaaagaaaagtaaaccagccaacccctgagagtttgataggctatttcaaagacacggataaccatgatgggtattagagatgcctttttctgtggtcagtatgttttcgttagcaggttaacattatccatccattgcct

SEQ ID NO: 8836 - DNA, 542 bp, Mus musculus
  misc_feature (36)..(36): n is a, c, g, or t
  misc_feature (155)..(155): n is a, c, g, or t
  misc_feature (324)..(324): n is a, c, g, or t
  misc_feature (444)..(444): n is a, c, g, or t
aagtggataagtcgcagccccatgctacagagaagngtctaccactccatggctgctgtccaaaggaagctttatgtgcttggaggcaatgacctggattacaataatgaccggattctcgtgcgtcatatagattcttacaacattgacactgntcagtggacgcgctgtaatttcaacttgttgactggccagaatgaatctggagtcgctgtccataatgggagaatatatttagttggtggatattcaatttggacaaatgagcctctggcttgtatccaggtattggatgtgagcagagaaggcaaagaggaagtgttntacggacctacactgccctttgcttccaacggcatagcggcgtgcttccttccggctccgtatttcacatgccccaacctgcagactctgcaagtgcctcaccacaggatcggcactgtntgataagccagcatccacaggagaccgaatgagaccttgacatctggacacagggcatggacatcctcagtgcttccctatcgtgtcttacaggtcta

SEQ ID NO: 8837 - DNA, 528 bp, Mus musculus
  misc_feature (245)..(245): n is a, c, g, or t
  misc_feature (357)..(357): n is a, c, g, or t
acaggaatcccttgcagtttctcaagttcgagaagaaatcctacagaaacagattacaaaactcttggaagaattgaaagaagccaaagaaaaccacacaccagagatgaagcatttcatgggcttagaaaggaagatcaagcagatggagatgaggcataggcagagagagcaggagctccaacagataatacagcaaacacgccaagtagtagaaacagagcaaaacaaggaagttgagaaanggaaaagacttgcacagttaaagaatcgggagctggacaagttccgcacagagctggactccatactggacgttctgagggagctgcaccgacaaggggttgtggtccccanggctctcgcaggcgaagagaacacagcagagttttagtcggaacttggatctgagtgaccacattgtaagacagatgaaaacctgctgctgttgggacaggcaccacacagccatgcgtgaccaccaccagagtaacatatcagaataaactgccatgagccaacaggaga

SEQ ID NO: 8838 - DNA, 417 bp, Mus musculus
  misc_feature (322)..(322): n is a, c, g, or t
  misc_feature (366)..(367): n is a, c, g, or t
  misc_feature (376)..(376): n is a, c, g, or t
acattgtgtttcttcccactataatttaagatttaaggttgagatttgtagtctagacccctcagcaggtagagtggatacagtgactggtcagaaagtgcagttgcaggtctgtcatgctcaatcacttaacgctataatgtgtttcctgcgaatatcaagcatgtagaccaagtgcagcatgggagccactcaggaagtttatgaaattaaactttcatgcataatttaccatgaaatatgtagatttcagccaattctcaatacttaacatttagttatatatgtgaactctcctttcttaattcgggaatgtagcatnatatagaatgctgttaaacttaattttaaccctttttaactttnnttttttttntggtaagccaagtgatctacctttcagcagttgtctggttt

SEQ ID NO: 8839 - DNA, 489 bp, Mus musculus
  misc_feature (93)..(93): n is a, c, g, or t
  misc_feature (99)..(99): n is a, c, g, or t
  misc_feature (139)..(139): n is a, c, g, or t
  misc_feature (175)..(175): n is a, c, g, or t
  misc_feature (327)..(327): n is a, c, g, or t
tgtaatacaaacatggaccaccaggcctggcctttgagaagctaattgtctctggattagaatagaaacattaaacatctccaccaccagccnattaangtgaattaatatgactatttgacttcagttcatgtaattncatttttataattgcagaaaggtttatgtcttgttnggcgtgatactcgagggaatagcagcggttctctatgagttcaaggccagcctggtctacagagcaagttctaggatagtcagggctacacagagaaaccctgtcttgaaaagtaaaaaaggtttatatctctacagataggataaacatangaattcttttgctttatttttccacttaaaatcgtcagttaaaaatagttgtaaactctttgggctacagaaatggctctgtggttaagagcactgactgctcctccaggcaactccagttcagttcccagtacccataaggcaatgcacaactgtctgtaa

SEQ ID NO: 8840 - DNA, 571 bp, Mus musculus
  misc_feature (40)..(40): n is a, c, g, or t
  misc_feature (146)..(146): n is a, c, g, or t
  misc_feature (296)..(296): n is a, c, g, or t
  misc_feature (357)..(357): n is a, c, g, or t
  misc_feature (362)..(362): n is a, c, g, or t
  misc_feature (366)..(366): n is a, c, g, or t
  misc_feature (374)..(374): n is a, c, g, or t
  misc_feature (385)..(385): n is a, c, g, or t
  misc_feature (390)..(390): n is a, c, g, or t
  misc_feature (394)..(394): n is a, c, g, or t
  misc_feature (408)..(408): n is a, c, g, or t
  misc_feature (416)..(416): n is a, c, g, or t
  misc_feature (425)..(425): n is a, c, g, or t
  misc_feature (449)..(449): n is a, c, g, or t
  misc_feature (453)..(453): n is a, c, g, or t
  misc_feature (455)..(455): n is a, c, g, or t
  misc_feature (467)..(467): n is a, c, g, or t
  misc_feature (493)..(493): n is a, c, g, or t
  misc_feature (495)..(495): n is a, c, g, or t
  misc_feature (517)..(517): n is a, c, g, or t
actgcaggagtccacttccaccagacagaagttggaaagnaagctcgtggatattcaagcctaccagtcagccgcggaggagaagttcctgaaagaaatcaagagtgcaaagtcggagacaagcatctacaaaaacaacttggccnaaatcagcaaggagtgtgagatcttgtccaaaatggtcatggagattaaggcggataaccagattctgaaagaagaactcaagaaacacagtcaagaaaacaccaagttcgaaaatagcatcagtcggctcaccgaagacaagatacttntggaaaactacgtgagaagcatagaaaatgagaaagacaccctggaatttgagatgcggantcttnagcngagactanttgagtttaantgatnaaantctccagtcagaancaacagcngcatcaaantcaacctatatttcaagacgaganaaantntacttcgataantacgatgcctatgaagatgcttccantnttaggaatcggcctgtggcttntgacttgaaaggaataccacataaactgtatcaacggcttccatccaagatatg

SEQ ID NO: 8841 - DNA, 550 bp, Mus musculus
  misc_feature (54)..(55): n is a, c, g, or t
  misc_feature (64)..(66): n is a, c, g, or t
  misc_feature (74)..(75): n is a, c, g, or t
  misc_feature (79)..(79): n is a, c, g, or t
  misc_feature (83)..(83): n is a, c, g, or t
  misc_feature (87)..(88): n is a, c, g, or t
  misc_feature (90)..(90): n is a, c, g, or t
  misc_feature (93)..(93): n is a, c, g, or t
  misc_feature (97)..(97): n is a, c, g, or t
  misc_feature (101)..(101): n is a, c, g, or t
  misc_feature (122)..(122): n is a, c, g, or t
  misc_feature (134)..(134): n is a, c, g, or t
  misc_feature (144)..(144): n is a, c, g, or t
  misc_feature (151)..(151): n is a, c, g, or t
  misc_feature (160)..(160): n is a, c, g, or t
  misc_feature (172)..(172): n is a, c, g, or t
  misc_feature (201)..(201): n is a, c, g, or t
  misc_feature (210)..(210): n is a, c, g, or t
  misc_feature (246)..(246): n is a, c, g, or t
  misc_feature (248)..(248): n is a, c, g, or t
  misc_feature (277)..(277): n is a, c, g, or t
  misc_feature (322)..(322): n is a, c, g, or t
  misc_feature (335)..(335): n is a, c, g, or t
  misc_feature (337)..(337): n is a, c, g, or t
  misc_feature (347)..(347): n is a, c, g, or t
  misc_feature (350)..(350): n is a, c, g, or t
  misc_feature (356)..(356): n is a, c, g, or t
  misc_feature (391)..(391): n is a, c, g, or t
  misc_feature (408)..(408): n is a, c, g, or t
  misc_feature (417)..(417): n is a, c, g, or t
  misc_feature (421)..(421): n is a, c, g, or t
gtgggcatcccttctctggtggcaatgatttcctttccccagtggcacactacnncacacatgnnnttgtgacnntttnttantgtnncnaanttangttngtgcatttgtgtcagaatgtntagtttacaaantcgggggctntaattgnataatttgntttgaggagatntattaggttttcttgtttgtttaaagctncatccaatntcaaaattaccttgagtaacttctgataatttactntntgtggacaaagctaagttttttttcttanacagcaccttgcttgaagatgactttaaagaaattaatatattgnaaacttatttgantntttattttantcntcccantaaaacatgacaaattatttgaccattccagtcantgtactgctttaatttntcccatttncctntcaagagcccacatgccttgttcattggtctttctctgcagtaactaaaggcaagactagatagacacacaattggagactgaacttattaagcttaaaataatttgggaacttaaaatcacttgcatt

SEQ ID NO: 8842 - DNA, 416 bp, Mus musculus
  misc_feature (73)..(76): n is a, c, g, or t
  misc_feature (78)..(78): n is a, c, g, or t
  misc_feature (80)..(81): n is a, c, g, or t
  misc_feature (84)..(84): n is a, c, g, or t
  misc_feature (87)..(87): n is a, c, g, or t
  misc_feature (98)..(98): n is a, c, g, or t
  misc_feature (120)..(120): n is a, c, g, or t
  misc_feature (135)..(135): n is a, c, g, or t
  misc_feature (146)..(146): n is a, c, g, or t
  misc_feature (186)..(186): n is a, c, g, or t
  misc_feature (213)..(213): n is a, c, g, or t
  misc_feature (233)..(233): n is a, c, g, or t
  misc_feature (240)..(240): n is a, c, g, or t
  misc_feature (244)..(244): n is a, c, g, or t
  misc_feature (247)..(247): n is a, c, g, or t
  misc_feature (283)..(283): n is a, c, g, or t
  misc_feature (386)..(386): n is a, c, g, or t
ggtactgtctccctaatagcaatgtcaagtcctggatagtgtccagagacctggccaggcttcatctctccannnnananntcngcnaaggaaagaancgcagcctccaagaaggaggtncacaacccccttacnccgaggctganttcaccaagatgctccctagaagaagatggagacactgtntcctaagaggatcctgtaccccaggcnagggtaattctcccccaggngcctaancctnttntgggacatcaataagtgtgtaaactccaccctgtanctccccttgtccaaaacaagtccacttctatgtgctagatgccagctaatagtagaaattacaatcgccagcttatatctgatatactgtggtttactcagcnccatccctaacatggtcacacaggccctga

SEQ ID NO: 8843 - DNA, 452 bp, Mus musculus
  misc_feature (100)..(101): n is a, c, g, or t
  misc_feature (103)..(106): n is a, c, g, or t
  misc_feature (109)..(113): n is a, c, g, or t
  misc_feature (116)..(119): n is a, c, g, or t
  misc_feature (121)..(122): n is a, c, g, or t
  misc_feature (126)..(131): n is a, c, g, or t
  misc_feature (133)..(134): n is a, c, g, or t
  misc_feature (136)..(140): n is a, c, g, or t
  misc_feature (142)..(144): n is a, c, g, or t
  misc_feature (146)..(155): n is a, c, g, or t
agtaagaagcctgctactgcctgaccaagtgcaccggggtctgctgacagacaggacccttgaaaaccagctttcagatccgtcttttctccaaggcatnncnnnncgnnnnngannnnannaagnnnnnngnnannnnntnnncnnnnnnnnnngaagatggacgacatgtcgcccaggctgagagcctttctctctgaacccattggggaaaaggatgtggcctgggtggatggcatcagccgtgaacttgccatcaatttggtcaccaaaggtttcaacaaggcctatgtcctgctgggacagtttcttctgatgcacaagaatgaagcagagttccagaggtggatcatctgctgctgtggagctacggagtgtgaggcccgccagagctccacctgcctgaaggagtggtgctcctgtttcctatagatatctctggcctggcagct

SEQ ID NO: 8844 - DNA, 73 bp, Mus musculus
ggctagggcttcagaggacaccgcagtggtcaccagctgttttgatgctgcactgtggcctcactttttataa

SEQ ID NO: 8845 - DNA, 518 bp, Mus musculus
  misc_feature (366)..(366): n is a, c, g, or t
aactttcacgtccagcaagattcacccctgacgccttcatctcaggactgggaacaggaaaagccgacgcgtgcactccccttccccaaacgagtgagagggtaccgtggggcaagcccgcccacccgcttgggcagcgatggtagcaagggaccacccgcgttagtggaccggggactggggagacgcagaccacatcaacgactctccatcgccgcctctttcagaaaccaagagaaaatggtgggaggcgaaaagaaaaactaaataaaaagcaacttgtcttaggacctcagctaagcaaatgaagccttcttgcgtgtgctgagcctgcagttctcaaccttctaggaaagatgggaggantgggcgacagaaggcacagcaggaatgccccgcagtgagtgcaaccggagctctgcccgctgcccagcagaggcctaaatccaactcggcaggaagcgcccgcggcgccgggagccacgcaccctcgccagcgaccacgtgatcactttttt

SEQ ID NO: 8846 - DNA, 468 bp, Mus musculus
  misc_feature (36)..(36): n is a, c, g, or t
tttcccctccagatacactgtggaactattcgagcnaggtggggcgagctatggccatcgcagctctggacatggcagagtgtaatccgtggccccgaattgtgctgtcggaacacagcagcctcaccaacctgcgagcctggatgctgaggcacgtgcgcaacagcagagggctgaccagtgctgggaacatgggcgcgagcaagaagcgaggggctcgaacccctcccaaaagcaacaacagcttgcctgtttcctgctctgaaaatgctctgagccgggttcgcagttttagcaccggcacgagtactggtggcagcagcagcagccaacaaaactctccacagatgaagaactctcccagcttcccttttcatggcagtcggactgcggggctaccaggcctgggctctagcacccaaaaggtcagccatcgggtgctgggccctgtcagaggtaagccagtct

SEQ ID NO: 8847 - DNA, 491 bp, Mus musculus
  misc_feature (203)..(203): n is a, c, g, or t
  misc_feature (205)..(205): n is a, c, g, or t
  misc_feature (211)..(211): n is a, c, g, or t
  misc_feature (358)..(358): n is a, c, g, or t
  misc_feature (405)..(405): n is a, c, g, or t
  misc_feature (408)..(408): n is a, c, g, or t
  misc_feature (411)..(411): n is a, c, g, or t
  misc_feature (418)..(418): n is a, c, g, or t
  misc_feature (421)..(421): n is a, c, g, or t
  misc_feature (423)..(423): n is a, c, g, or t
  misc_feature (427)..(427): n is a, c, g, or t
  misc_feature (429)..(429): n is a, c, g, or t
  misc_feature (431)..(432): n is a, c, g, or t
gtccatcaaaagaacgtgtctcctggaaagagtcttgcacacagttgtgacaacttatcagcccacatcacagggctgcgtgaaatctcaaggacagcacagtggtaagcagggtcccacctggactgggactgcagatgcccgggcctcctatgtctcagtttcccacctggacaccagcatgactttcagacagcagtcantntgactntggagcccaactgagactgatcagatcaatcggctttcagaaatggggatgtgacaagtgacgccagctaaacctcctctagcgactgcgccacgcgcatggaaagatacactgtagagcgagggggacagagttacgcccgggctntttggatggcagctttggaaagttgacgatttatcacctaccccaantcnttntcaagtntgntntggnantnnttgctcatccgtgtgattttgccaagtggtgtttggacttggcgttgggagttcacact

SEQ ID NO: 8848 - DNA, 430 bp, Mus musculus
  misc_feature (250)..(250): n is a, c, g, or t
  misc_feature (330)..(330): n is a, c, g, or t
gatgagggcatatcaccgatgtgagcgagagaggtttcgtgttttgaaaacttcactggataaaagttttcttgtctataattctgtttatgaagagtctgtttttacatctgagatgtgtttgatgaaagcaaacatgaaaatgctacaagacaagctacttaaggagatgcatgaagaggaagttctcaacatacgcagaggactacagtcattattcaaggctcatgaaggaaatgatgcatgaaanctggctgctgtcaatgaattttatgattagttttttgtgtataaataaagcactaataaagtagctttgcaaagatgcancatctaagcacctctattcttgtgtgcaagaacctcccgactcaaatgttagagatgaaaaacatgactccaaatgcagcttgtatgtcctatgagcaaa

SEQ ID NO: 8849 - DNA, 456 bp, Mus musculus
  misc_feature (311)..(311): n is a, c, g, or t
  misc_feature (345)..(345): n is a, c, g, or t
  misc_feature (355)..(355): n is a, c, g, or t
  misc_feature (366)..(366): n is a, c, g, or t
  misc_feature (368)..(368): n is a, c, g, or t
  misc_feature (410)..(410): n is a, c, g, or t
  misc_feature (420)..(420): n is a, c, g, or t
ctcctgttgctacattacatccgaaagaaaatgaaattacggaaaacagacaccattgatttgtgtgatgaatcgggaaccatgaagttactcttcctgtcaaagacacctggagactctgccagcaaattccttacagctcgaaatacctactatgtttgtaaagtggaacgtggggcaccaggtaccagaattgagaattcctacaaagctattgtgcccatgctgaagaatccagaacctgaactagttgactcgctgcgcacacaatgtgacttcctggagaggagcagaataaagatgcttagaantctagaagccaagagactggcagccatggaatcntctgtaaatntcccagcaagntntcccaagggtggtggagcccagcagactactagcacaagcantcaactgaantctaaaggtgggcgatcagatgaagacggaccacct

SEQ ID NO: 8850 - DNA, 479 bp, Mus musculus
  misc_feature (307)..(307): n is a, c, g, or t
  misc_feature (334)..(334): n is a, c, g, or t
  misc_feature (354)..(354): n is a, c, g, or t
  misc_feature (400)..(400): n is a, c, g, or t
  misc_feature (424)..(424): n is a, c, g, or t
gtcagcaccgactttccataaaaagaggtgaacttgaatcagcccaagagcaaattaaaatgctggagcaaaaactagagaatctcagccacaggatgacggtgcagagcgaagagactcacgccatgaagaagaccattggagtgatggacaaagaaaaggactttctccaggagactgtggatgagaagacagaaaagatcgccaacctgcaggaaagcctccttagtaaagaaaaagtcattgcccagttgaaggtcacagttgcagagtatgaaacatcacttaaccagctacaagaaacttngactactcgagaccgagagataaacancctccggcgccagcttgatncatctcacaaggagcttgatgatgttgggaaatctagagagatctnttttaaggaaaatagaaggttacnagatgacctggccacaatggcgagagaaaatcaggagatctcactggagctggaa

SEQ ID NO: 8851 - DNA, 259 bp, Mus musculus
tcaagacggtgcctccaaggtcctgctggctgcagatatccctgcctccaggtcctcaggatctagcttcaagactgtgttctctaccagaaaattatctttccaagacaggtgttctttcttgtcaagagcagggaatgttgacaagactcccagaccccaggagcctttgactttccatttccacacattggactgtccatgtcccaggcaggacatattttcctgacagagatgagacctgcccaagcctacaggt

SEQ ID NO: 8852 - DNA, 558 bp, Mus musculus
  misc_feature (84)..(84): n is a, c, g, or t
  misc_feature (86)..(86): n is a, c, g, or t
  misc_feature (97)..(97): n is a, c, g, or t
  misc_feature (115)..(115): n is a, c, g, or t
  misc_feature (122)..(122): n is a, c, g, or t
ccatgcagaagggaccgccaggaatgcctggagtctcattccagccatttggaagggaaagttaagagaaaatgaggcagaagnangtgttagccangagcttccaaggtccagntgctgtntgcaggactccaaacagccacgtttacatgttcaacaatggcagcggggactctggggactcctctgaggaagagtcacatcaggtggtgttacgaccccggggcaaggagcaccagaagaacagcagccaacggccaggagcaggcaccatggttctgctgcagcgggagctggctcaggaagacagcctcaacaagctggctctccagtatggctgcaaacactcagagtgattaacagtggcaaagtaagttggaaagcgtttctggaatcgctcttttctcccgcattgaaacagtctgtttcccgctgttgactccatgctatatacatgctatatacatgctgtatacatgctatatacatgctatatagtacatgctataatcatgctatatactggcagaagctttcaccaagcttgcatcagctaca

SEQ ID NO: 8853 - DNA, 543 bp, Mus musculus
  misc_feature (342)..(342): n is a, c, g, or t
  misc_feature (352)..(352): n is a, c, g, or t
  misc_feature (360)..(360): n is a, c, g, or t
  misc_feature (372)..(372): n is a, c, g, or t
  misc_feature (407)..(407): n is a, c, g, or t
  misc_feature (418)..(418): n is a, c, g, or t
  misc_feature (423)..(423): n is a, c, g, or t
  misc_feature (429)..(429): n is a, c, g, or t
  misc_feature (496)..(496): n is a, c, g, or t
  misc_feature (499)..(499): n is a, c, g, or t
  misc_feature (501)..(501): n is a, c, g, or t
  misc_feature (518)..(518): n is a, c, g, or t
gctttatgaagccatccgggattttccctttcaggacaatctgtttcaatctatgtactaccctctgcagctgaagtttttggagacggtgcacaccctgtgtggacggatcccccaggtttttctcaagcaaattgagaagacgatgcgaagggcttacgagaagcacgtcatcatccacatgggccccaaccccatgagctgagccagtgtctgggaccgaggacgtggatccttacgctgcctggatatttgtgtgtgtgtgtgtgaatatttaatggtgctctgtgactgttgcggttcaaaagcctgattgtattttcctaagttaattatccctanaagggaatangcttttcnttattttctccngatatctcctgaatctttttatttttaaagttatnttatgaatctnatatngtcccnatgggctgagagagaaaaggggaactttttctagccctcaaatatgagcccctgttgatatatgcanctntngtgataatctggatttnttgagaatcttcctatgcaacttgc

SEQ ID NO: 8854 - DNA, 498 bp, Mus musculus
  misc_feature (398)..(398): n is a, c, g, or t
  misc_feature (402)..(404): n is a, c, g, or t
  misc_feature (408)..(409): n is a, c, g, or t
  misc_feature (417)..(417): n is a, c, g, or t
  misc_feature (456)..(456): n is a, c, g, or t
  misc_feature (459)..(459): n is a, c, g, or t
  misc_feature (465)..(465): n is a, c, g, or t
tacatcccatagcagagacgagcaggagatctagcagtgagaggtgcctgcaggccacaaagcctcacagcagcggtcagagcctgcctgcctgggaagagtaggcagcatgaaagtcccaggaagacaatatgactatttcagcttccaagagaagtgaatgatgcagggaagagccaattcagccaggtggcagcaatctggctctgggcttcctggcctctgacagggacgtgcaggacgacccttggagagaaatgggtcacttctgcgtcttgttagatggaccgttacacagactgagaggacgctgattgctgaaggaggcagccagccaagtctgtagctacccacctctgaatttattgaagacagggaagaaaagaaccccaagagangaannngaannccatattntaaaaggaagttctaattggcaatgagcatggaaaactnacntggaantacaatcaagctgggcacaagagtactactgtc

SEQ ID NO: 8855 - DNA, 438 bp, Mus musculus
  misc_feature (47)..(47): n is a, c, g, or t
  misc_feature (148)..(149): n is a, c, g, or t
  misc_feature (159)..(159): n is a, c, g, or t
  misc_feature (176)..(176): n is a, c, g, or t
  misc_feature (197)..(197): n is a, c, g, or t
ttctgtgtctgctaatctcttgggagtagaaagcacacagagtaganaaggtgctctgtagatgcccctggaaactgtgcaagcctgcattctttgcctccagctatgttcctggactcctctgtgttgtctgggcttttactgtacnngtctgttccnctgttaaataatttttnctttgtgcccttgggtatggnggagctgtttctaccagtatgaggaacatgcctggccgggatgctgtgaagaccccataggtgatcctgtgtctagctgtcagaaagattatagaactccctgcgacatcatatccgcaaattccagtaaagggtgtcccacactccaaagcacgaagtcctgctgctctcctctctgggaaatggaggtcagctctccttaggagaggaagaaaaggacttccagaaactcttgattctt

SEQ ID NO: 8856 - DNA, 325 bp, Mus musculus
  misc_feature (71)..(71): n is a, c, g, or t
  misc_feature (86)..(86): n is a, c, g, or t
  misc_feature (108)..(108): n is a, c, g, or t
  misc_feature (110)..(110): n is a, c, g, or t
  misc_feature (115)..(115): n is a, c, g, or t
  misc_feature (125)..(125): n is a, c, g, or t
  misc_feature (140)..(140): n is a, c, g, or t
  misc_feature (153)..(153): n is a, c, g, or t
tcgacttccggaacccggagcaggaaggaaaagcccgtagggactccaacaccgaccggcgtcccaggagntgtagattccgtatntgtggtcacacctgataaactngntgatntccgcagatntccaagccgaaggancagatgttcacanttccaggagcggccaggaccaattcctacatcgcacctgccctgttaccttcaaatgctgtcttttgtctttggagatcacaaagccttattgcatctgatcagattaaagttaaaattctgtagattggacatttacggataatatgacgtgcttttatatctttaacaaa

SEQ ID NO: 8857 - DNA, 481 bp, Mus musculus
  misc_feature (195)..(195): n is a, c, g, or t
  misc_feature (204)..(204): n is a, c, g, or t
  misc_feature (216)..(216): n is a, c, g, or t
  misc_feature (219)..(219): n is a, c, g, or t
  misc_feature (233)..(233): n is a, c, g, or t
  misc_feature (237)..(237): n is a, c, g, or t
  misc_feature (254)..(254): n is a, c, g, or t
gaaccgtctcactgggaggtgctgcttccacaccggaggataagggaactcggcgacttcgggtgacaaacgcaattacgaaggtcgccacatctcgctgccggtgcccgcaccccaggacaaccccacatgggaccccgcggatcctccccgcgtggggacggcggcctcgctcaccatggcgcggattccaanttcgcctcnctctccgctcanctnccggcagatggtcnatantgctttcctcagattcncaacaaagcgggtaatatggcggacaggaagtgcccgcccactatgactgaaggctcgtctcgaagttctgattggctactgaggcctgagtgacaggagcagtgtccctaagagacatcgtgtttcccatctccggcttccactacaggccaagagcgggcctagatcataaggcaggcattgctgtagaacttgttcctggactgcaaagtggtccctgcacttt

SEQ ID NO: 8858 - DNA, 515 bp, Mus musculus
  misc_feature (26)..(26): n is a, c, g, or t
  misc_feature (117)..(117): n is a, c, g, or t
  misc_feature (291)..(291): n is a, c, g, or t
  misc_feature (299)..(299): n is a, c, g, or t
  misc_feature (307)..(307): n is a, c, g, or t
  misc_feature (323)..(323): n is a, c, g, or t
  misc_feature (326)..(326): n is a, c, g, or t
  misc_feature (380)..(380): n is a, c, g, or t
  misc_feature (394)..(394): n is a, c, g, or t
  misc_feature (435)..(435): n is a, c, g, or t
tattacggtcaactccagacaaggcnccaaaggaaacttgataggagagaaagaactatgttcgttgttgtttggctttggtgctggggtttgaacctcatgtgtgctgagtaagcnccctactactgagctacatccttgtccctcggttttcacattttatttggacatggggccttactaaattatcggtgctgactttgaactcattctgtagcttgggttggccttgaacttgcagtgctccagcctcagcctcccaattagctgggattacaggacttgtagcanaggcccanctaaaaanaccctattcaaaaaanggngctgggccagccaagtatctatgtgcaaaagagtgaagttgactctcttcagcnccgtactcctcccncctcatccaggtggatacagtgtatgtgtatggagatgtcncagtgaaactcattgttttgtactctaatttaaaaattcataaaataccaagtcaagatgaatcactgacctaaatgtaa

SEQ ID NO: 8859 - DNA, 400 bp, Mus musculus
ttatctctttaacaaccacagctggactcagcatcatcctgacacccctcctggacacattcctaaaatgccctctgccagataaatcacttcataatctttcaatttagcttcactcagattctcaggacatggtcagaatgaagccggatcctttttccaaataacacataaatggtccccagctcagttcctgatccagtccttgtttccctttgaaaccccagcaactgggcatttctctcagcattcttctctatgatcccaccagaattgcccactaaactccattttctaaccccaggttccaaactctttcacattccattcacagaacagtctcaaaggaagaagagccacctggtgaggttcattatagcagtgacctcacttcttggaa

SEQ ID NO: 8860 - DNA, 361 bp, Mus musculus
gccttatatggtacttgcttcagaggggttctcagcagagaattattgtactagctttggaatcttgtagatctgggtctatgttggaacttcaccacctgcttgctccatatctttaaagaattagcttcaattcttatgcttttgcttcttcatctatagagtgggatatgagtatctatttcataaactgctggtatgtactaaagtgagtgaagtagaaaaatgaggtgtgcatctcaggcctgatgaagtaagagagcatggagtgacatttgattggtaactggagagggagcaggctttttgactgttcacctagcatctaaccatgccatatgctaatccttcctaggctctg

SEQ ID NO: 8861 - DNA, 461 bp, Mus musculus
tcggacttgatagcgctggtctagcgttccggaagattctcggagctgaggacggtgggattctggagggtttacataggcgaaggtggctgaatagggcgggaagcgtccccttgcgcaagctctgtgcctggagggctctaaagcctgaggcgactgtagccgaaccaaggagcctgcgtttgcccggaagcaggctgggaggaaggacgctcacagcctctgacacagtggattcggagataaggacctgatagcgtagtatgactcacactcctatggacttggagaattgtggtcccgaggttcggccgacccaacaagcaggcccgacttagagtgaaccgtgagaggcctcatcattaccaactcgcagtgctgaatccagggtctagatttcaaacacggttattttaaagatgtatttactttttgtatgtgaatgtactgtcttcggacac

SEQ ID NO: 8862 - DNA, 424 bp, Mus musculus
  misc_feature (58)..(58): n is a, c, g, or t
  misc_feature (238)..(240): n is a, c, g, or t
  misc_feature (274)..(274): n is a, c, g, or t
  misc_feature (382)..(382): n is a, c, g, or t
aagctgaagttctccaaggcaaatgttgacaagaacttgcctatcaaccacggaatanagaccagcttgagactcaagagaccttccactccgatattcttaactggccttcagactctatcatccagtgagtacaagagagacttcagtctgtctcaggtgctctcagttgtgctgtgtgtggtttatcagtcatggatgaacgtcaacatgaggccgttcccagaccagcgagacnnngcaccagcaggaaggcagatgaatacttaaagcntagcctaggcaagaaaaatctgatgagctttttactaggcagacagctgggaaggcagaagagtgattcagaaatgtcaaagtggctgtggatggtgacccgaggaantccagggtggagttggcctttgccaaatcaccacattactta

SEQ ID NO: 8863 - DNA, 336 bp, Mus musculus
  misc_feature (53)..(53): n is a, c, g, or t
  misc_feature (56)..(59): n is a, c, g, or t
  misc_feature (61)..(65): n is a, c, g, or t
  misc_feature (68)..(68): n is a, c, g, or t
  misc_feature (71)..(76): n is a, c, g, or t
  misc_feature (78)..(83): n is a, c, g, or t
  misc_feature (85)..(86): n is a, c, g, or t
  misc_feature (88)..(93): n is a, c, g, or t
  misc_feature (97)..(97): n is a, c, g, or t
  misc_feature (102)..(105): n is a, c, g, or t
  misc_feature (107)..(114): n is a, c, g, or t
  misc_feature (117)..(117): n is a, c, g, or t
  misc_feature (120)..(120): n is a, c, g, or t
gatcctgggactgtcagggaagtcaaggaaacaagtttaattcaacggaggtnctnnnnannnnnttnagnnnnnngnnnnnngnngnnnnnnactncctgnnnnannnnnnnncgntgntgctatggagtctttaaagaggtagtgatgccatcagcagaggccctacatcagcagtgctagtgtccatgcaagaagaggacacaggggcacacatgctcacactggtgagtctatgggaaggcacgaggagaggacagccatctagacaccaaggagagtgagcaggaagaccccactgacagctggatctcagacttctgatctccaagtttt

SEQ ID NO: 8864 - DNA, 384 bp, Mus musculus
  misc_feature (157)..(157): n is a, c, g, or t
  misc_feature (187)..(187): n is a, c, g, or t
  misc_feature (251)..(251): n is a, c, g, or t
  misc_feature (346)..(346): n is a, c, g, or t
tattcacatcataaccaccatttcccaaaagccagcttccggtacgtgacacagtctttcttctcttcagcttttagtgttggactttgctgtagtggtagacatgagataagtggtgcaaagtttgtaacaggacactattaccgtgggtgtgcanttaaggctgtctgtcctcaggagacagctntaccttgcctggctctgtagtagacagttcacttacacaggacagcgcttgctggaagatcaanttttatatggattttaaagaaaatattgaagacaaaaaattctattttacttgtaattttattttttaaaaagaagattatactatttgcctctntccttactaccataattgaccagtttcattcagtaaaa

SEQ ID NO: 8865 - DNA, 129 bp, Mus musculus
  misc_feature (38)..(38): n is a, c, g, or t
cgcagccgcgtgtcctggttgctgagggaaggcagccntcgggtgtgctgggaccgcgagggctacacctagtaacacagatgactcttctggtgacagcgtgactactgtaaaaactgagtctccgtt

SEQ ID NO: 8866 - DNA, 238 bp, Mus musculus
tgctttctgtcaggattgcacaactgaacagcagaagtttgtggtagtgatgaagagcatgagtctcagagtctctcattaggaaaaactagagagccgaatgggagaaatgccaatgtttggagtgtttcagataaagctataaagtgcagacatttctctgaagtttatctgcgttcatctgaacaacccaagtctagagatcagcttgcagatctaccacagtaatttctctggc

SEQ ID NO: 8867 - DNA, 178 bp, Mus musculus
  misc_feature (28)..(28): n is a, c, g, or t
  misc_feature (42)..(42): n is a, c, g, or t
  misc_feature (59)..(59): n is a, c, g, or t
  misc_feature (69)..(69): n is a, c, g, or t
  misc_feature (112)..(112): n is a, c, g, or t
  misc_feature (117)..(117): n is a, c, g, or t
gaggaatcggctaaaacatgagcttccntcccggttctggantcccagggcacagccantccaccagtntgggccagctggtgtgaagtgcctccacggtgtggttccgttntgaantccacttatatccgtaaatgagtataatcaccaacgtgtgcatgctttcggtttcaccgtc

SEQ ID NO: 8868 - DNA, 137 bp, Mus musculus
aaacaaaaatgttgtcacactggaaattgtacatttttttaaagaaaaggtatagttttataactgagatgtacctaaattatgaccatttggtttatgaatattctactgtgacatgaaaagttcctgtattttca

SEQ ID NO: 8869 - DNA, 551 bp, Mus musculus
  misc_feature (192)..(192): n is a, c, g, or t
  misc_feature (250)..(250): n is a, c, g, or t
  misc_feature (262)..(262): n is a, c, g, or t
cggactgtagcaacttcattaaattcctgactcaaaaacacccagagaaaaacaacctcccagaaagagcacagcctggaacagagagacatctgatgaaactgctcctcggattatttttttttcctctgttctccagttttgtgtcttactcattacttaacatatatttacatgcctgctttctaaaantagctctagttctaattactctgcttagtaatttccaggaccatttgggctgaagatnaaatgccagatnttccttgaaaaactacttttaaggcatgtagagagaggcacaaaattatacttcttgacaattctgatgtgtgcccggggaagcagccccttccacacaaacaccaccgctcccaatctggcagggaaggccacagctgccagcgtcacgtgtaggcagatgcagaggataaaggaggcaaagaggacagttgcaactgccaatttccccaatccttcggaaatatacctcatttacctcaagagacaggacaggacatttacagtcccagaaatgtactcatatgccc

SEQ ID NO: 8870 - DNA, 416 bp, Mus musculus
  misc_feature (71)..(71): n is a, c, g, or t
  misc_feature (125)..(125): n is a, c, g, or t
  misc_feature (127)..(127): n is a, c, g, or t
  misc_feature (332)..(332): n is a, c, g, or t
  misc_feature (335)..(338): n is a, c, g, or t
  misc_feature (340)..(341): n is a, c, g, or t
gaagtggccttggacattaagttgaactacatctacaagttcctgaccctgtgtctcctagtccggccagngtcctacacggatgccagcatcttggatctgatggagctgctgtgccgcgcagncntggatgtagggttgtgcctgctgcccaagactgacctccagcaactcctgctcctgctgctggagagaatccaagagtggcctggaaagctccagcccctttgctgtgccctgagctgggtgtccgaccaccaccacaacctgctggccctcgtgcagttcttcctggatgtgacgcctcggggcaggtgggtgcttctcaaccncannnnanngggatctttcaaggatctagaatcttccataccaaccccaacaaacaaactgtctgcctggtttctaaagtctca

SEQ ID NO: 8871 - DNA, 537 bp, Mus musculus
  misc_feature (354)..(354): n is a, c, g, or t
  misc_feature (412)..(412): n is a, c, g, or t
  misc_feature (416)..(416): n is a, c, g, or t
  misc_feature (434)..(434): n is a, c, g, or t
  misc_feature (453)..(453): n is a, c, g, or t
gaaatgggaactgctttaacctagaattatctagagttaagtcagcaaacgtagagttaaggtatatattttatcattgaaaggagctgttaatgcaagtttttatttgagaaaaacattttgttactaaagagtattttgcaattctctttctggatggctgtagatcttcatagtcagcctgtgtggtagctgccattgaaccataccttatttaaacataaatgtttgggctggagagacagctgagtggttaagaggcctgactggtcttcccgaggacacagattcagttcccagcacatacacagcacctacaaaccatccgcacctccagctccctcccgagtgganggacgggtaatctagtgccctcttctgcctctgcaggctctgtgtgtacacatgtggntgtncatgaatacatgcaagcnaaacacctatacacataanctaacagtaataagtcttaaatgtaaatgatttataatttttagcaataaacatctttatatatgtaccttttctgcatgtaat

SEQ ID NO: 8872 - DNA, 534 bp, Mus musculus
  misc_feature (275)..(275): n is a, c, g, or t
attagactatttgtgctccttcctgggcacctaatcatctttactagggaggcttgaaagatacccagacgattgagacgtctacatctatctgtgccaaatgtcttggcaaaatatgtgaaaaggagaccggcttctaatgaaggacctttgccttttctctgtcacattgaagagctggtaagctgtgtaggtgatagttcttcccctcgagatgcctttcttagccttgtggctatggaaagaggtaatacctttagaggaacgtgtgtcangcagagccttggcacagacatggtttcagtggtcttcaggcttgatcgatgagatgccttgatctgctctccaaacgtttttacagacgagcataccagatagaggagctggatctcctgctctgctcactgcctggagcccatctcctaaagccatcgtcagtgacttgtgcaaatagcaagcagtcaagtggaatgtgcatgtgaacaagccagcagggcctgacacacacttgagttcctgtctagcatattcgcg

SEQ ID NO: 8873 - DNA, 442 bp, Mus musculus
  misc_feature (231)..(231): n is a, c, g, or t
  misc_feature (238)..(238): n is a, c, g, or t
  misc_feature (244)..(244): n is a, c, g, or t
  misc_feature (253)..(253): n is a, c, g, or t
  misc_feature (256)..(256): n is a, c, g, or t
  misc_feature (271)..(271): n is a, c, g, or t
  misc_feature (273)..(273): n is a, c, g, or t
  misc_feature (287)..(287): n is a, c, g, or t
  misc_feature (295)..(295): n is a, c, g, or t
  misc_feature (300)..(300): n is a, c, g, or t
  misc_feature (302)..(302): n is a, c, g, or t
  misc_feature (326)..(326): n is a, c, g, or t
  misc_feature (354)..(354): n is a, c, g, or t
  misc_feature (400)..(400): n is a, c, g, or t
tgtttttatgagcacagtaccatgtgcgttatatctgtaatgtgatctcatatttaaaatgtctctacttactctagggcatagttgttgagtttattgttcttactttggtaaaaggtctcactaaaattcttttatgtgtctagttaacgaagtatttccccttgatttattttggttctctttgactacagaacattttcttgcttacagtgaaacattgtttattgntatactntccaanttctttttntgntttgacggcagaagntnaaactgatatgctntcaaaatntaagntntcaaacagctgaagcacttacacngcagaagaggaagaggtatactttgtgncagcattggaggctgctgtgactagggaaggtaaccccatttcctntagcaaacaagggttcagtaccatgcgaggtgactttgtaaa

SEQ ID NO: 8874 - DNA, 396 bp, Mus musculus
  misc_feature (271)..(271): n is a, c, g, or t
  misc_feature (277)..(277): n is a, c, g, or t
  misc_feature (293)..(293): n is a, c, g, or t
  misc_feature (302)..(302): n is a, c, g, or t
  misc_feature (314)..(314): n is a, c, g, or t
  misc_feature (323)..(323): n is a, c, g, or t
  misc_feature (325)..(325): n is a, c, g, or t
  misc_feature (331)..(331): n is a, c, g, or t
  misc_feature (337)..(337): n is a, c, g, or t
  misc_feature (340)..(340): n is a, c, g, or t
  misc_feature (342)..(342): n is a, c, g, or t
  misc_feature (349)..(349): n is a, c, g, or t
  misc_feature (356)..(356): n is a, c, g, or t
  misc_feature (358)..(359): n is a, c, g, or t
ttgtctaccctcaaattctccattacacggatgttggctggccgccctgccttcaaactatggatgtgaggaggacgcgggcggcggcagctgaacccgcctgacaggccgagccagtgacaaagagctggcggcctaggctgaaaccgcggaaacaatccttcctggaggagaacacagtccctttaaagataggaaagatgctactcacgttgtcgatcacaacaggctggttggcgatcacatcgtaggactccatggcagaggaatntttccntccgaggaaggaactnccagcccgntccgcagcaaangccactganangcatgngcagtntantngccggtnctgggcntnnagggagccgcccgacctcgcctcggaggaactacaat

SEQ ID NO: 8875 - DNA, 448 bp, Mus musculus
  misc_feature (303)..(303): n is a, c, g, or t
  misc_feature (325)..(325): n is a, c, g, or t
  misc_feature (329)..(329): n is a, c, g, or t
  misc_feature (377)..(377): n is a, c, g, or t
  misc_feature (390)..(390): n is a, c, g, or t
gatatggctctgtggctaatagcacgagttgttcttccagaagacccaggcttgatccccagctcaactgttggtggccaataaccttctgctaaccgggtcccaggggatctgatgctatcttctggctttctctggtactggacacataagtggtatacacttgtaaattctacaaaacagacacaaacacacacacacaatggaagaccaatatgatttgtagatgctgtctcaaaataggttgttttgcagagctattctaagatcagaaaactgttttgccttaggctgggcttgganaagtccttgactgcatcctagntaanaccagaatagaccttaacaagctctgtctgaaatcttagggtatcagnatactatttcagntggttccactctttaatgagcagactctggtattcaggatacttcttgtaactcaaca

SEQ ID NO: 8876 - DNA, 476 bp, Mus musculus
  misc_feature (191)..(191): n is a, c, g, or t
  misc_feature (198)..(198): n is a, c, g, or t
  misc_feature (233)..(233): n is a, c, g, or t
  misc_feature (245)..(245): n is a, c, g, or t
  misc_feature (264)..(264): n is a, c, g, or t
  misc_feature (269)..(269): n is a, c, g, or t
  misc_feature (282)..(282): n is a, c, g, or t
  misc_feature (296)..(296): n is a, c, g, or t
  misc_feature (303)..(303): n is a, c, g, or t
  misc_feature (328)..(328): n is a, c, g, or t
  misc_feature (335)..(335): n is a, c, g, or t
  misc_feature (356)..(356): n is a, c, g, or t
  misc_feature (367)..(367): n is a, c, g, or t
  misc_feature (369)..(369): n is a, c, g, or t
  misc_feature (401)..(401): n is a, c, g, or t
  misc_feature (404)..(404): n is a, c, g, or t
  misc_feature (406)..(406): n is a, c, g, or t
  misc_feature (442)..(442): n is a, c, g, or t
gaggcttttctagtcaagttcttcaacaccacatattctcccaaggtctagactgccatgcttcatttgtctgctcaggtcttggccatcaggaatacagaagcaattaagatacgtggagtcctgtcctgcctgtggggccttggcctcccacgttagcaagcagcctcctgcctctgtgtgagaccacnagtgggncccgtgcacctgtcctttcctgttctttctcagtntccggcagacanaccctccgtatcaactttnacctnaacaattaattgnattcaagagtattntgagaantgccccagagctttcaagggagttntggccanagaaagattggagccagctgntctgggcacantnttcctgacccacacctgcaggttccagaatgnttntntgatacagtgactgttccaccatgactgtgtgtttntgatagtgaagagacttgaggacagggaccaaat

SEQ ID NO: 8877 - DNA, 327 bp, Mus musculus
  misc_feature (57)..(57): n is a, c, g, or t
  misc_feature (64)..(64): n is a, c, g, or t
  misc_feature (67)..(67): n is a, c, g, or t
  misc_feature (69)..(69): n is a, c, g, or t
  misc_feature (79)..(79): n is a, c, g, or t
  misc_feature (82)..(82): n is a, c, g, or t
  misc_feature (85)..(85): n is a, c, g, or t
  misc_feature (87)..(87): n is a, c, g, or t
  misc_feature (90)..(90): n is a, c, g, or t
  misc_feature (113)..(113): n is a, c, g, or t
  misc_feature (123)..(123): n is a, c, g, or t
  misc_feature (126)..(126): n is a, c, g, or t
  misc_feature (134)..(134): n is a, c, g, or t
  misc_feature (137)..(137): n is a, c, g, or t
  misc_feature (140)..(140): n is a, c, g, or t
  misc_feature (165)..(165): n is a, c, g, or t
  misc_feature (167)..(167): n is a, c, g, or t
  misc_feature (171)..(171): n is a, c, g, or t
  misc_feature (187)..(187): n is a, c, g, or t
  misc_feature (209)..(209): n is a, c, g, or t
  misc_feature (220)..(220): n is a, c, g, or t
  misc_feature (242)..(242): n is a, c, g, or t
  misc_feature (244)..(244): n is a, c, g, or t
gtggccagctctaagcgcgacacttgctgggtccacctaagacccaggaccccggantgttaanctngngtggatgganacncgnangcnggaagttccctgtggggacttgntgcagaacgnggntgagaatntanttntagaggttgaagaacatttccaagntntgantacaacattaaacctnagaatggaagagatgggaagtngcatcgagganttacagagaaacgtggatgacntnatgactcaggccgggatcgagaattctatcaaagaaccagcgacctgaagatgttaaacgagtcacgtgggattgctaaaaca

SEQ ID NO: 8878 - DNA, 544 bp, Mus musculus
  misc_feature (36)..(36): n is a, c, g, or t
  misc_feature (42)..(42): n is a, c, g, or t
  misc_feature (74)..(74): n is a, c, g, or t
taactcaccgagagatcctggtctgcaggcccaagntccacnacacagggcagagcagccttccgtgtgcatgnatcgtggagaaatgagcaggggagacttcaacatcagagcccctcaagttccagcaaacccgcagttcttctccttgagccagagatgtgccagacccagagcaccacctgcacctgctggtgaacagaatcaacttatggatcccatattccctaatgaagaaagtcagcaagtaatacatgggacaccaggttgtgcacagtgtgagatgttacagaaggaaatagatgaactcaaggaacaactcgggctggcactgctgtgacccagcgtttgaggactgcctatccatgctgttctcctcggtcatgcaggccctcagtgaaacgttccaggatccttgaagttggactcaagagtttctccccacagaagaggccaaactaccacctgtggatcctgcttccttccagttttcttcgacagcagtggttcccaccttcctaatgctatggcctgctcatgggct

SEQ ID NO: 8879 - DNA, 506 bp, Mus musculus
  misc_feature (98)..(98): n is a, c, g, or t
  misc_feature (122)..(125): n is a, c, g, or t
  misc_feature (127)..(128): n is a, c, g, or t
  misc_feature (130)..(137): n is a, c, g, or t
  misc_feature (139)..(140): n is a, c, g, or t
  misc_feature (142)..(142): n is a, c, g, or t
  misc_feature (146)..(147): n is a, c, g, or t
  misc_feature (149)..(149): n is a, c, g, or t
  misc_feature (161)..(161): n is a, c, g, or t
  misc_feature (204)..(204): n is a, c, g, or t
  misc_feature (216)..(217): n is a, c, g, or t
  misc_feature (222)..(222): n is a, c, g, or t
  misc_feature (276)..(276): n is a, c, g, or t
  misc_feature (284)..(284): n is a, c, g, or t
  misc_feature (305)..(312): n is a, c, g, or t
  misc_feature (391)..(391): n is a, c, g, or t
  misc_feature (401)..(401): n is a, c, g, or t
ttcagccgctccaggaggactgagaaggaagctgtttagaccatgccatatttcttaggccccaagaatcttacagatggacagatcttctcttcaantcctgccgttgcagcccagagaannnnanngnnnnnnnngnnanacanncncctgagggaaanttcagaagacaaatactcccttcaacaaacaagtcagatgacncgtaagtgaggnnaactncaaggctaaggtggatccaggggcaggacaaactgttcgcacgcctagcatctntggactcnaccctccaagcgcttccccgnnnnnnnngtcttgtcgcgagaaccagaaccgtcgctttcaggaactctccatactacagagtgcttctgaacgtgtacaacactantaacggaagnaggtcaaagttcagaaagagaggaatttcccaaatgatccaaatccaagcttagagaagccaaagtcatagccactgggcaggacctctcttggcaagtcatcta

SEQ ID NO: 8880 - DNA, 439 bp, Mus musculus
  misc_feature (251)..(251): n is a, c, g, or t
  misc_feature (259)..(259): n is a, c, g, or t
  misc_feature (267)..(267): n is a, c, g, or t
  misc_feature (270)..(270): n is a, c, g, or t
  misc_feature (273)..(273): n is a, c, g, or t
  misc_feature (277)..(277): n is a, c, g, or t
  misc_feature (287)..(287): n is a, c, g, or t
  misc_feature (292)..(293): n is a, c, g, or t
  misc_feature (311)..(311): n is a, c, g, or t
  misc_feature (324)..(324): n is a, c, g, or t
  misc_feature (328)..(328): n is a, c, g, or t
  misc_feature (330)..(330): n is a, c, g, or t
  misc_feature (340)..(340): n is a, c, g, or t
  misc_feature (349)..(349): n is a, c, g, or t
  misc_feature (368)..(368): n is a, c, g, or t
  misc_feature (377)..(377): n is a, c, g, or t
  misc_feature (394)..(394): n is a, c, g, or t
  misc_feature (412)..(412): n is a, c, g, or t
atactgcaagttaggcatccattgtattactttctgtaaatgtggaatgttttgtaatttgtttctcaatgttgataaacctaaggccttccaggcgtcaggcaagcgctgttacggtaagctttatctctagcacctacgttctttccgtatatttggagatttagatccatgttcggctgaaggttgaggctttgctggaattttatcgcagctgccccccacctttagttgtttggttttgttctganacagggtntctggtanccnagnctgnccttggactnggtgnntagtagatggtgactttnaactgatcctttncttntncctcataagngcctggatnatatgggagtacaggtgtncaccctgangtccagacgctcctccntcttttgaggatgggttnttttgttttagttctttgagctctcat

SEQ ID NO: 8881 - DNA, 502 bp, Mus musculus
  misc_feature (73)..(73): n is a, c, g, or t
  misc_feature (77)..(77): n is a, c, g, or t
  misc_feature (127)..(127): n is a, c, g, or t
ttattcagtgtcttagagtgccatttgaaagcttttgtatcagctaccacattttcattactaaaggtctttnagcnaaccgtatcttctttcttgtaggagtagatgacctgaaccatgaagagcnaaaaatggttttaaatgtattaaaaaagaagtagaaagcttcttcagttggtcatctaaatggtttatttcaggtgctggatatcacatcgtcatggagaagcaacaatattgtgatgttgataatatcattgcaatgattcagcagcatgttccaggtgctgtgttggaaaataatatagaaaatgaattatcatttatcctacccaaaaagtatgtatcaagatttgaaactttgtttacagagttagaaatgagacaaaaagcactaggcattgccagctttggagcttcgatcactacaatggaagaggtttttgttaagtgagttataataaccaggaaaaaaattctacccctaaactcctatgttaat

SEQ ID NO: 8882 - DNA, 410 bp, Mus musculus
  misc_feature (57)..(57): n is a, c, g, or t
  misc_feature (75)..(75): n is a, c, g, or t
aatcaagttctcgttttcccagatgggtatgttcagggttccatgccagcctcctcngtggtcacagcagctgtnggccacgccagaccgtgtgatctcgtgtggtcctgttatccatcctatggagccatcaattaccccttcacatacagtttttgtcatattccagaggtaacttggaagacatagaaaattacctggcaggagttcaactgatggaataccaggtcacttgcctatcagctgtcctgagatgctcctggccttgagctccagttcctgcagtctctagcattccagattccaagctcaataaataaaggtgtttgccattggtgatttaagttcagctccccagacctatatggtggaaaggatcaactccagaaagttctctgatggccacacag

SEQ ID NO: 8883 - DNA, 512 bp, Mus musculus
  misc_feature (178)..(178): n is a, c, g, or t
  misc_feature (188)..(188): n is a, c, g, or t
  misc_feature (206)..(206): n is a, c, g, or t
  misc_feature (216)..(216): n is a, c, g, or t
  misc_feature (256)..(256): n is a, c, g, or t
  misc_feature (290)..(290): n is a, c, g, or t
  misc_feature (313)..(313): n is a, c, g, or t
gcgatgattcagagaggctccttgtggaactctattgatttttccacagttaaaaacattgcagataaatgtgtggtgaccactttacaaaagtggcggctaaacgtgctgcgtttaaacttccgaggctgcgacttccgaacaaaaaccttgaaagctgtcaaatcccacacaatgnaacgtagagnccaactgatattgatacnagctgctcgncctagattggacaaatttctctacaatactctattattantctatgatattcataactacctgtggctatttcnagccacttggatctgattcgtcnttcttcctccatcttctctgtctctctctgtctgtcctctctctctgaaactctcagccctgtcttccttcttcattgcccaatcacaaactctattcttatatttcacctgacctcacctgtgtattgaccgcagtccacagggaaacaccagcattgccacgttgcgtgcttcaggaattggtcctttgtgcatact

SEQ ID NO: 8884 - DNA, 358 bp, Mus musculus
tgaaccttagcagtccttttgtggaatgtttacactggagactgaacctcagcgttccaaggccgggatcggagatggcggggagctcagcggccgaaacccgaggctttgagatttgaaaaggaaaaggcagtagtattacccgccgtggagaattaaccaaaacaatgacagaaagccttgtccttcctacccacttatttttacactttcacggtcttctaaacacagccatctggagcactcagcagctactttcagcaagccgactccaaaattaaggtctggagctctaatctgatccaaaagcccagatattactagctggtcactagggctgactgaatactgtgacact

SEQ ID NO: 8885 - DNA, 514 bp, Mus musculus
  misc_feature (242)..(245): n is a, c, g, or t
  misc_feature (247)..(247): n is a, c, g, or t
  misc_feature (250)..(254): n is a, c, g, or t
  misc_feature (256)..(260): n is a, c, g, or t
  misc_feature (262)..(268): n is a, c, g, or t
  misc_feature (272)..(272): n is a, c, g, or t
  misc_feature (274)..(274): n is a, c, g, or t
  misc_feature (276)..(277): n is a, c, g, or t
  misc_feature (280)..(286): n is a, c, g, or t
  misc_feature (289)..(289): n is a, c, g, or t
  misc_feature (295)..(296): n is a, c, g, or t
  misc_feature (313)..(313): n is a, c, g, or t
  misc_feature (337)..(337): n is a, c, g, or t
  misc_feature (345)..(345): n is a, c, g, or t
  misc_feature (365)..(365): n is a, c, g, or t
  misc_feature (368)..(368): n is a, c, g, or t
  misc_feature (370)..(370): n is a, c, g, or t
  misc_feature (379)..(379): n is a, c, g, or t
  misc_feature (392)..(393): n is a, c, g, or t
  misc_feature (396)..(397): n is a, c, g, or t
  misc_feature (399)..(399): n is a, c, g, or t
  misc_feature (448)..(448): n is a, c, g, or t
  misc_feature (465)..(465): n is a, c, g, or t
  misc_feature (487)..(487): n is a, c, g, or t
acaagaagctgtcattgtctctggtactggcagatcctgagtgcctttcagtaactgcgactcaggagttccttcttaatcgcaacactctgctcaccaaggtgaggacgccagagagaggtacagggtcttggctgctgtccctctggtcctctgcacagtaagtggaaatccacagatcttcttaccccactctgagtcccagttatccagcctttgagtatctctggattaggacagannnngntannnnntnnnnncnnnnnnncctntntnnctnnnnnnnatnaaagtnntagataaaaagagatgntccgaacagggcatggttggacgnaacatcangaagacttccatgttgatcnagntnttgggcgcncctgggaattgcnnccnncncacgtaccttggggaccacattcaaggtatcaggctggtaccaatattnattggctttcctcctgncaagcgcttgccctttgatttntcctacacgattaagcattctgaggag

SEQ ID NO: 8886 - DNA, 434 bp, Mus musculus
  misc_feature (47)..(47): n is a, c, g, or t
  misc_feature (148)..(148): n is a, c, g, or t
agaagatcctgaagtcactccatcacctcgatgaaaggctatactangtacaagaagcaattcgcaaaaacccttccatcaaaaatactttacaattaataccacttctgagcagccagccaagggcaagtctgtctcctgatgttgnatccacagtgcaaagaaaatactgatgagctgtgatagtcactacttagtggaatcattatttttgagaattcctgtaaataagttctgtaattctgcatttattaatgatttaaaatactagacttttatgtttataaaagtaaatcataatgtacttaatgaaaatgaatttactagcttatatttatgctacaaattatactttattatgtattttcttgatacatttttaatgaatgaaatatttcattgttttcaataagcatgctactggatataaattt

SEQ ID NO: 8887 - DNA, 522 bp, Mus musculus
  misc_feature (187)..(187): n is a, c, g, or t
  misc_feature (193)..(193): n is a, c, g, or t
  misc_feature (205)..(205): n is a, c, g, or t
  misc_feature (221)..(221): n is a, c, g, or t
  misc_feature (332)..(332): n is a, c, g, or t
  misc_feature (348)..(348): n is a, c, g, or t
  misc_feature (486)..(486): n is a, c, g, or t
gccaaaagagcttgcacagtcagaagatgctgcctctgctgtcacagcgtcgctttgtgctcctttacaacggcgagactacggacttgtggccgcgcttggcgagctcgcgcccacttaaccgcttgcctaaccctaaccctaaccctaaccctaacgctaaccctcaccctcaccctcaccctanaccctnaccctcaccctnaccctcaccctaacgntaaccctcaccctccccggcccacctgtgaagccgcatcctctgcgctttcctccgcacgggccgctatctcagaacggcctggtgcacgcaagtcgatgccctccagggnagctcccgtgtgcacnccccgcaaatcgcggctgtctgactcgagcggtagctccatagcggagtctgagccctctctctgttctgggtccctggaaggcagcagggacacagcccgggaaccctccctgggtccgcccgaggaggagcgcganggaggaacagagaagtacgagccatcgaggctccta

SEQ ID NO: 8888 - DNA, 535 bp, Mus musculus
  misc_feature (30)..(30): n is a, c, g, or t
  misc_feature (43)..(43): n is a, c, g, or t
  misc_feature (229)..(229): n is a, c, g, or t
  misc_feature (241)..(241): n is a, c, g, or t
  misc_feature (244)..(244): n is a, c, g, or t
  misc_feature (405)..(405): n is a, c, g, or t
  misc_feature (487)..(487): n is a, c, g, or t
  misc_feature (507)..(507): n is a, c, g, or t
aacttttgattgtaatccctggtgagtgtntcagtaaaagtangtgtaggcaaagggctttgacttccccagaaaagtcacagatatatggacttagaacaaggtaatgtttttatattctccgaacattaattaccaaaatgtccaacatgttcatgtttacatttttatgaaaactggagtatatggatttcaatctaagccctgacattaagcagctgatgaccanagatgagtgtgntcntgtaatccatcatcagccctgctaagtacttcttacaaatcggccccagtgtgtggagaacgcctggctaagggtaaaggcttgcctgaggcacacatataactttcttttttctccgtagaaggatttgccattttgtgtggcaacctagtcctcggtcnttccaatttccttttttttttctttacaattttctcccttatctctgaaatggttttattctttccccacaagcatatgatnatctctttatttttaaatantacagctttctaacatctgtctccaggg

SEQ ID NO: 8889 - DNA, 500 bp, Mus musculus
  misc_feature (436)..(437): n is a, c, g, or t
  misc_feature (447)..(447): n is a, c, g, or t
tgtggctgtgggaactcacatcttccgccaggttgaaactccgatgctgatggcagaaaagacctccatctccactgtgagtcccattgaggaattccctgagactgaggaaagtagtgcaaaagaggaccgggaactgaaggaggagaaagatgtccaaaaggaagaagaaattcccgaaaatgcaaacactgaaaagatttccatggaaacactgctcaaagtgtttggaggaggaaatgaagtactggatgccaacagatttgccagctacctaaaatcagagaatatttatgcagagaatttcatcaagacttttcaggacctgggtgccaggaacctggagccaattgcagttaatattctcttgaagcatccttacattcaggacctgattgcaaattatgtagactataaatttcctgacattaaaatnnttcttcaaangagtgagcatgcacaaggcagtgatggagaaaggtcaccctcaagacttacag

SEQ ID NO: 8890 - DNA, 540 bp, Mus musculus
  misc_feature (267)..(267): n is a, c, g, or t
  misc_feature (277)..(277): n is a, c, g, or t
  misc_feature (281)..(281): n is a, c, g, or t
  misc_feature (285)..(285): n is a, c, g, or t
  misc_feature (288)..(288): n is a, c, g, or t
  misc_feature (301)..(303): n is a, c, g, or t
  misc_feature (306)..(307): n is a, c, g, or t
  misc_feature (309)..(310): n is a, c, g, or t
  misc_feature (312)..(314): n is a, c, g, or t
  misc_feature (316)..(319): n is a, c, g, or t
  misc_feature (323)..(323): n is a, c, g, or t
  misc_feature (326)..(327): n is a, c, g, or t
  misc_feature (332)..(333): n is a, c, g, or t
  misc_feature (338)..(339): n is a, c, g, or t
  misc_feature (352)..(353): n is a, c, g, or t
  misc_feature (357)..(357): n is a, c, g, or t
  misc_feature (359)..(359): n is a, c, g, or t
  misc_feature (361)..(361): n is a, c, g, or t
  misc_feature (363)..(364): n is a, c, g, or t
  misc_feature (368)..(368): n is a, c, g, or t
  misc_feature (371)..(371): n is a, c, g, or t
  misc_feature (374)..(374): n is a, c, g, or t
  misc_feature (388)..(388): n is a, c, g, or t
  misc_feature (393)..(393): n is a, c, g, or t
  misc_feature (400)..(400): n is a, c, g, or t
  misc_feature (408)..(408): n is a, c, g, or t
  misc_feature (424)..(424): n is a, c, g, or t
  misc_feature (427)..(427): n is a, c, g, or t
  misc_feature (432)..(432): n is a, c, g, or t
  misc_feature (435)..(435): n is a, c, g, or t
  misc_feature (439)..(440): n is a, c, g, or t
  misc_feature (442)..(442): n is a, c, g, or t
  misc_feature (444)..(444): n is a, c, g, or t
  misc_feature (448)..(448): n is a, c, g, or t
  misc_feature (476)..(476): n is a, c, g, or t
  misc_feature (494)..(494): n is a, c, g, or t
  misc_feature (509)..(509): n is a, c, g, or t
  misc_feature (515)..(515): n is a, c, g, or t
aaaggagggctaatcccacttcacaacgctgcgtcttatgggcatgttgacatagcagcgttactgataaaatacaacacgtgtgtaaacgcaacggataagtgggcctttactccccttcacgaagctgcccagaaaggaaggacgcagttatgtgccctgctcctagcacatggcgcagacccaaccatgaagaaccaggaaggtcagacacctttagatctggcgacggctgatgacatccgggctctgctgatagatgccatnccccctgagncctnaccnacntgttttaaacctnnngcnncnntnnntnnnncctntcnnatctnnccagnntccaccccctccnncctntntncnnccancancanagataacctcactngcccnttaacgnatctggcngtaggaggggcctccnatncaggnganggcnntncnggtncagaaaggaaggaaggagaagttgcggntcttgacatgaacatcanccagttccttaaganccttgnccttgagcacctgagggacattttt

SEQ ID NO: 8891 - DNA, 507 bp, Mus musculus
  misc_feature (123)..(125): n is a, c, g, or t
  misc_feature (127)..(128): n is a, c, g, or t
  misc_feature (130)..(131): n is a, c, g, or t
  misc_feature (133)..(134): n is a, c, g, or t
  misc_feature (136)..(142): n is a, c, g, or t
  misc_feature (169)..(169): n is a, c, g, or t
  misc_feature (187)..(187): n is a, c, g, or t
  misc_feature (236)..(236): n is a, c, g, or t
  misc_feature (242)..(242): n is a, c, g, or t
  misc_feature (265)..(265): n is a, c, g, or t
  misc_feature (299)..(299): n is a, c, g, or t
  misc_feature (309)..(312): n is a, c, g, or t
  misc_feature (386)..(386): n is a, c, g, or t
  misc_feature (394)..(394): n is a, c, g, or t
  misc_feature (464)..(464): n is a, c, g, or t
tgcccaggagttgctagaccacagtctccagcatcagaagcccacgagccattgctacatgccaccaactccagagctgggttttaataaggaggcactggtccaaaataccttttctttctnnncnncnncnnannnnnnnggcttagaaggactgaaggatgagggnatcgctgcttttgtgcanggaaggacattccaaaggaagtacagcggagcagaaccttctctgtggntgtttncttgttcacacaatcctggagangccagtgccgcccaacttcacaagtatccataanggatccagannnngtcacccattgccggtgtgaggctcctggtggctgggtcccgggccctgttcacgagatggtcaggagcccctntagccctntgaactgtggctccagtcctaaggcgcagttcccacacggacaggaaacccaagacagcacagacctgtntgaggcagtgccgcatgctggtctgcagcctgaactgagtgct

SEQ ID NO: 8892 - DNA, 465 bp, Mus musculus
  misc_feature (49)..(49): n is a, c, g, or t
  misc_feature (154)..(154): n is a, c, g, or t
  misc_feature (324)..(325): n is a, c, g, or t
  misc_feature (328)..(329): n is a, c, g, or t
  misc_feature (332)..(333): n is a, c, g, or t
  misc_feature (335)..(335): n is a, c, g, or t
  misc_feature (337)..(340): n is a, c, g, or t
  misc_feature (379)..(379): n is a, c, g, or t
  misc_feature (419)..(419): n is a, c, g, or t
gcaaagggtgtgttgagtgttcccccactgagaagggaggtttgggcanaaaaaaatcagagaggcttctttcaagatacttcaggagagacatgtcacctctttccaccccaaacttaggtcaagaaataccagtggaatccccctgcttatntgagaaatggtatagatcttgtttttcgtgtaatattgctggaggaaacagatggacacctgaacaacaaaagccttgagctctgaatacaacacacacaatcctagaacaagggtgggttttttggcaatgtagtagatgaattaaaggatttgccatataatggcccnnaanntannanannnncaaatagaaattttaaatccaggaattattctagcaaanctcctaagatgtttatggggaaatgatatttattaaaggncaaaagaagaactaaacaaatggaaatttgtgtttgctcactattg

SEQ ID NO: 8893 - DNA, 550 bp, Mus musculus
  misc_feature (138)..(138): n is a, c, g, or t
  misc_feature (148)..(148): n is a, c, g, or t
  misc_feature (174)..(174): n is a, c, g, or t
  misc_feature (184)..(184): n is a, c, g, or t
  misc_feature (194)..(194): n is a, c, g, or t
  misc_feature (196)..(196): n is a, c, g, or t
  misc_feature (208)..(208): n is a, c, g, or t
  misc_feature (248)..(248): n is a, c, g, or t
  misc_feature (250)..(250): n is a, c, g, or t
  misc_feature (254)..(254): n is a, c, g, or t
  misc_feature (302)..(302): n is a, c, g, or t
  misc_feature (324)..(324): n is a, c, g, or t
  misc_feature (375)..(375): n is a, c, g, or t
  misc_feature (404)..(404): n is a, c, g, or t
  misc_feature (443)..(443): n is a, c, g, or t
  misc_feature (447)..(447): n is a, c, g, or t
  misc_feature (457)..(457): n is a, c, g, or t
  misc_feature (486)..(486): n is a, c, g, or t
  misc_feature (518)..(518): n is a, c, g, or t
cagcagattccagaatatggcccagactcacttccagcccgtagattgatagcgccctccagtggccaattgcagagcattgccgataaaacagaggcccgtccctttacacactctcagagtccagtaccacaccanttccagcctntgagaagtataggaccgcttcagggngtcaagcctntcaaactgtntngcagagaattangtcagatttctgccatggagctgtcattgcggcgatgcantnttgnagctgggggccggtcaatgactgctgattcccttgaagaccccgaagnaaactagtgatttcaaagcccnggcactgaacaataaaacttctaatttagtaaatgtgtggaaagatgcctnttctgacttacagaattaaacctcggggnagcgagctctttcctgggacacaggaaagggggttggcnccantcctatgtangacagtgtatgtgggggctttgttatttnataaatgcatttttgagtgcttgtacattgancgatttctacttgtgtgtataagttcctttcc

SEQ ID NO: 8894 - DNA, 396 bp, Mus musculus
  misc_feature (223)..(223): n is a, c, g, or t
  misc_feature (245)..(245): n is a, c, g, or t
  misc_feature (274)..(274): n is a, c, g, or t
  misc_feature (278)..(278): n is a, c, g, or t
  misc_feature (284)..(284): n is a, c, g, or t
  misc_feature (302)..(302): n is a, c, g, or t
ggaaacagtttcaccatctctgttactgggaattaatgtggattcatatataccaacagaattggatgcaggcgtattactattcagacctactttgcaaagagagtaaatggtccaaggcaacatatgtgttcttgaaagctgctattttgagcatgcttccagaggaagaagtggcagcgactaaggagaatgtggtgtctctgtttagacaggtggatgntctgaagcagagaatcgcgggnaaatctctcccaacagagaagttcgctgngagnaaggcncggaggtactcacccccntcaggcgtccccggaaagctggtgatgccagccctggtactgcttttactcactgtttacctaccagagataaggtcactgttgggagcatcga

SEQ ID NO: 8895 - DNA, 400 bp, Mus musculus
  misc_feature (231)..(231): n is a, c, g, or t
  misc_feature (335)..(335): n is a, c, g, or t
  misc_feature (346)..(346): n is a, c, g, or t
  misc_feature (365)..(366): n is a, c, g, or t
  misc_feature (369)..(369): n is a, c, g, or t
gggtcactatcaccaaatccagttgcaaatacatcaaggatttttactacccaatcaccaagatctacaagggtaccttgttgtttttcttcagtacctgcctcacagagtcccaaaccacaaataactttaaatccattaccagagcattcagtgagtcacttaataaaacttattgaggcacagtcaaagttacccatgacactttcaaaaagacaattacatccaccncaagcaaaactatcaagtttcaccttgagtgaagtttccactctacagtcatcgttgtcttctatgaaatcatctatttcaggccagagagctctaaaaataangcagtatacantagagtcagcatatgccannatnatgcaaaccccttcaagcctgccaataatga

SEQ ID NO: 8896 - DNA, 506 bp, Mus musculus
  misc_feature (58)..(58): n is a, c, g, or t
  misc_feature (158)..(158): n is a, c, g, or t
  misc_feature (335)..(335): n is a, c, g, or t
  misc_feature (365)..(365): n is a, c, g, or t
  misc_feature (395)..(395): n is a, c, g, or t
  misc_feature (429)..(429): n is a, c, g, or t
  misc_feature (431)..(431): n is a, c, g, or t
  misc_feature (454)..(454): n is a, c, g, or t
  misc_feature (463)..(463): n is a, c, g, or t
  misc_feature (474)..(474): n is a, c, g, or t
ggctttgggaagtcttcgcaacccgtttcctccccaggcttccccactgtatgttttncccaccagtgttcacctcatcccttctcagcagaccatctttcatcctgctgttcaagtcaaccctctttctgttttctaccctaccacattcccttctntgaggaacacttcctacttccccactttcatgatggccatgcccagctcctcctgtctatccaaaatttcctccaactgccctgttctctctgcatccccttcacatttgtctaccctcatgactacctctcccaagaaagcaccgatggatagatacctcctttctgtttcgcgtntgaggccttcagccagccaggccaaccagnggaacctgaaatgctaagactacaagattntcaagtaactccaagacccaaagttacaacactntntacaaaacctaaaatatgacatntaggacaanatgattattanagaggtagcatacttacatgtagccatcctgt

SEQ ID NO: 8897 - DNA, 365 bp, Mus musculus
  misc_feature (32)..(32): n is a, c, g, or t
  misc_feature (324)..(324): n is a, c, g, or t
gtttcttcaaacctttcttgatggttgagttntgcaacaagcttgtcgtatgaaagccagccacctaagttcatgcccaagtgtctgtcttccgtgtgcaaagggagcgtgggaaacggggggtctggatgagagtgcctgtggtgttgagcaggcaggtgagcctgaaccgtactcctcccactccgctagggaagaggactctcctagagagacaaatcctgtacttagaaacatcagctttcaaggagcttgacaagaattcctctttggtttttgtttagtttttcacttgtttagttttggttgtctgagcctccctangtagcccaggctggcctggaactcactgtgacatttccaca

SEQ ID NO: 8898 - DNA, 377 bp, Mus musculus
  misc_feature (337)..(337): n is a, c, g, or t
gccttccgtgtcaggatctttagtagctaagccagggagaacagagatgggtctccctttccatttatccaccaacgcctgcagtctatgagggttggcccagcgataaagagatacgaccctggggcacggagaccactgcagacagacttcaagacagggaagcgagcatagcagaggccatcaacctcgggccaccaacatcctgcgggccatcaactcagccgctgaaggaacaggaaccactgagggtcagggagccaccaactcatctgctgactggaagtggggtacctagctaaccactgatgatcaggggaccagcaattctttcacnggagaggaaggggcccactgactcaatcctgatggccagg

SEQ ID NO: 8899 - DNA, 447 bp, Mus musculus
  misc_feature (265)..(275): n is a, c, g, or t
  misc_feature (277)..(283): n is a, c, g, or t
  misc_feature (286)..(288): n is a, c, g, or t
  misc_feature (312)..(312): n is a, c, g, or t
  misc_feature (315)..(315): n is a, c, g, or t
  misc_feature (323)..(323): n is a, c, g, or t
ctaacagctagaggcctgtgcggacggtccggggactcgggagatgtccgctggaggagcatggcgactcctggattaagaatgagagcgagcgctgggcactatgggagcatagccgccgccaaactcagactggtttcgcgcaggcacggatcgcttccggaaatgccttctgctttgggtctccggtcaaaaagtggggagcgctgctgctgtgcagagctcatttagttccacagctgtctatcgcccgtcccatggagtnnnnnnnnnnnannnnnnnagnnngggcaagcgggcgcagcgctgttnttncagggcgntcagacacagctgaggatcccattttagtgttataaagagaaaacaaatggatggaagaaaatcaaatagaggagtaaagaaaattagcaaagaaaattaacctgtgctttgaaatgatctcaa

SEQ ID NO: 8900 - DNA, 440 bp, Mus musculus
  misc_feature (235)..(235): n is a, c, g, or t
  misc_feature (242)..(242): n is a, c, g, or t
  misc_feature (245)..(245): n is a, c, g, or t
  misc_feature (247)..(247): n is a, c, g, or t
  misc_feature (259)..(259): n is a, c, g, or t
  misc_feature (261)..(261): n is a, c, g, or t
  misc_feature (264)..(264): n is a, c, g, or t
  misc_feature (266)..(266): n is a, c, g, or t
  misc_feature (269)..(269): n is a, c, g, or t
  misc_feature (304)..(304): n is a, c, g, or t
  misc_feature (306)..(306): n is a, c, g, or t
  misc_feature (324)..(324): n is a, c, g, or t
  misc_feature (326)..(326): n is a, c, g, or t
  misc_feature (331)..(331): n is a, c, g, or t
  misc_feature (334)..(334): n is a, c, g, or t
  misc_feature (337)..(337): n is a, c, g, or t
  misc_feature (354)..(354): n is a, c, g, or t
  misc_feature (394)..(394): n is a, c, g, or t
  misc_feature (410)..(410): n is a, c, g, or t
  misc_feature (412)..(412): n is a, c, g, or t
  misc_feature (414)..(414): n is a, c, g, or t
gttggcaagcctggagggttctccaggactgaactacaacatcctggtgtctgcttgcctagaggactggtcagcttcttaaaggagtctaaaacctactgatgtagccaccttagggtccttcatgattgctttttacttcaaagaactgtgtaaaaagaccagacacagcagggagtcttcggacttttcacatgaatgctttcaagcatctgtggcaatatcttagtttacntatgcantcnantggacagcagananaantnttnatggatgggcagcacccctgaactacatgctgtantntcagccatgatgctattntnttcanatnttnttagatgaatggaaggntcaaccaaggaagcaagggcatcccacagcatgaacagantcatgttttcactttntntntgtatacagttttgagagccaggaat

SEQ ID NO: 8901 - DNA, 407 bp, Mus musculus
  misc_feature (167)..(167): n is a, c, g, or t
  misc_feature (172)..(172): n is a, c, g, or t
  misc_feature (182)..(182): n is a, c, g, or t
  misc_feature (187)..(187): n is a, c, g, or t
  misc_feature (190)..(190): n is a, c, g, or t
  misc_feature (203)..(203): n is a, c, g, or t
  misc_feature (224)..(224): n is a, c, g, or t
  misc_feature (249)..(249): n is a, c, g, or t
ttgataatgggcaggcttggcttgagaggagctgctgctaaacatagcactgagaaggttcctggaggggatgggggtgctgctttgtctgagtgccccccaggtcctccgagaactattcttgacgcctctgaaaaacaggttccctttgaggaaaaaaatgtctnatctntaagcattancctcnaanctcccctctcctntttgctttgcttcctaccccngcttctcatttctttttccttttanaaaaaaaaaaaaaagaaaagaaagaaaacaactacctttctgaatgtattgtatccaaggcctttgcaatgttgggagcagagtgagcaggtgtggggagtcctgaaagactggttacattacggaggtcatctggcatccagagaaagctactgctt

SEQ ID NO: 8902 - DNA, 367 bp, Mus musculus
  misc_feature (185)..(185): n is a, c, g, or t
tgggtgaacaacctctatgtcttctttgtaagtgtgctcttcagtgcctacaaacgtgaagagatgctcaaggagaaagtgaaggaaaatcagctccaggaagcagagctggctcagcagaggcagatagagaacgaagagctagaagccaggctgaacatcctacgggaagaggaggccagganacaagacttcgaacttgacatcactgtgctcaaggagccatcggagatcccagcctctcagcctctcacgcccagcccccctaaagaggacctggcttccatccagactagcaaggccagccctggcaagaagaagaagaagtgaaggcacgcagtgtcatggtcgagctgcaaggacaagt

SEQ ID NO: 8903 - DNA, 397 bp, Mus musculus
  misc_feature (53)..(53): n is a, c, g, or t
  misc_feature (82)..(82): n is a, c, g, or t
  misc_feature (344)..(344): n is a, c, g, or t
ctgggtttgatgtaaacagcactgaaaaccgaaaaacagaagtaaatttcgcnaggctttggtggcacatacctataatgcnaggaggctgaggcagggggctggacagcctgagctctatgagactgtgtcctcagaaacaaaaacaaaacgtaaccagccaaactacacagatgtacccggctggaaaatgactgcagttcttgcaggatcacaaacaaatttctcccgggggctagccagacaccataggtacaaagaaaaccaagtctatatataatctctctcttacagtaagatctactttatgagctattctttgctgggtaaaaatttatcccccngacttaactgccttgatgtaataaaggttaatttacatagagcctgagggaca

SEQ ID NO: 8904 - DNA, 281 bp, Mus musculus
  misc_feature (35)..(35): n is a, c, g, or t
  misc_feature (46)..(46): n is a, c, g, or t
  misc_feature (58)..(58): n is a, c, g, or t
  misc_feature (72)..(72): n is a, c, g, or t
  misc_feature (74)..(77): n is a, c, g, or t
  misc_feature (79)..(79): n is a, c, g, or t
  misc_feature (126)..(126): n is a, c, g, or t
  misc_feature (196)..(196): n is a, c, g, or t
  misc_feature (207)..(207): n is a, c, g, or t
  misc_feature (230)..(230): n is a, c, g, or t
aagttacaactagattgcctttataagagtcaatntaagtttgatnatgtaatacttncaaatattttttgntnnnntnttcactttcttgctatctttccaacacacaaaaatatcaaactcagntcatcagggcccctttacccaatgagctattttacaggttctgaaagcaggtttcactcactcaggctgnccttgactttncagtagtgctcctgctctgcagntctaggatcacgggcttacgacatcatgcatcatcacttttttattaggat

SEQ ID NO: 8905 - DNA, 368 bp, Mus musculus
  misc_feature (57)..(57): n is a, c, g, or t
  misc_feature (63)..(63): n is a, c, g, or t
  misc_feature (68)..(68): n is a, c, g, or t
  misc_feature (81)..(81): n is a, c, g, or t
  misc_feature (85)..(85): n is a, c, g, or t
  misc_feature (118)..(118): n is a, c, g, or t
  misc_feature (126)..(127): n is a, c, g, or t
  misc_feature (154)..(154): n is a, c, g, or t
  misc_feature (160)..(160): n is a, c, g, or t
  misc_feature (170)..(170): n is a, c, g, or t
  misc_feature (183)..(183): n is a, c, g, or t
  misc_feature (187)..(187): n is a, c, g, or t
  misc_feature (197)..(197): n is a, c, g, or t
  misc_feature (223)..(223): n is a, c, g, or t
  misc_feature (226)..(226): n is a, c, g, or t
  misc_feature (247)..(247): n is a, c, g, or t
gcatcctcagcatcagagacattgatcaagaagaacggtttaagcaaaaggatgagnttctgnaaatntatggagagatgncggnactctgtagatgaagcccggcagaagatccttnatatccgnnaagtgtaccgaaacaagttgctggagncagagncgcttgaggnatggaggccttgncagnctcaggaagnctgcagtgaagatagagatagagaanaantcaccagcttctgactcacanaagaagaagaaagtaggaaagaaaaagtaacgcccccatggtgcactatgccacagaggagggagtgttggacgcactatcaatcactttcctcttgatcaagcattaggtcaatagaaac

SEQ ID NO: 8906 - DNA, 359 bp, Mus musculus
  misc_feature (124)..(124): n is a, c, g, or t
  misc_feature (149)..(149): n is a, c, g, or t
  misc_feature (216)..(216): n is a, c, g, or t
  misc_feature (218)..(218): n is a, c, g, or t
  misc_feature (223)..(223): n is a, c, g, or t
  misc_feature (225)..(225): n is a, c, g, or t
  misc_feature (258)..(258): n is a, c, g, or t
  misc_feature (260)..(260): n is a, c, g, or t
  misc_feature (275)..(275): n is a, c, g, or t
tagcggtatatgctgtgtcccgacctttaacaggaaccttagagttgtgcagaaggtccatggctacaaccaggcaacttttccccgccctatactggctttttctggctgtttctgggttcanccgggtggaggagcaagggcagaancaggcagcatggtggtgcatgatggtctgtaagccaaggaagccatcattaaagatgctaatacatnancacgntnttctgtaagggaaactgcctgagcctcctaccntntgccctccggtttcntcctgtccgttttcttccccagccgaaaaggcttcacattcttacgactgagactacttgcatactacagagcatagaaacaag

SEQ ID NO: 8907 - DNA, 340 bp, Mus musculus
  misc_feature (172)..(172): n is a, c, g, or t
  misc_feature (175)..(175): n is a, c, g, or t
  misc_feature (185)..(185): n is a, c, g, or t
  misc_feature (187)..(187): n is a, c, g, or t
  misc_feature (190)..(190): n is a, c, g, or t
  misc_feature (195)..(195): n is a, c, g, or t
  misc_feature (201)..(201): n is a, c, g, or t
  misc_feature (212)..(212): n is a, c, g, or t
  misc_feature (232)..(232): n is a, c, g, or t
  misc_feature (249)..(249): n is a, c, g, or t
  misc_feature (253)..(253): n is a, c, g, or t
  misc_feature (269)..(269): n is a, c, g, or t
  misc_feature (300)..(300): n is a, c, g, or t
agtatccatgcagagcaagctcgacctacaagcttcaagggacaaggaaggggtttccagtggccatgatgacccatgactgaccagggacaggctcttatctggatgtcctaaagaccattcctctgatggagagaaggaatagaaatgctgtctggctcaaggaacctgntgntggctgggantnatnactgntccttngcatggaatgntccgaggacagaagcccagntgagagctagttatgcnttcntaatttatggtgggtnacagagggaatgaggctagcattcctaagtntccctgtgccaagtgacaagcactggcctcacgtgtggca

SEQ ID NO: 8908 - DNA, 270 bp, Mus musculus
  misc_feature (27)..(27): n is a, c, g, or t
  misc_feature (42)..(42): n is a, c, g, or t
  misc_feature (50)..(50): n is a, c, g, or t
  misc_feature (57)..(57): n is a, c, g, or t
  misc_feature (76)..(76): n is a, c, g, or t
  misc_feature (117)..(117): n is a, c, g, or t
  misc_feature (139)..(139): n is a, c, g, or t
  misc_feature (143)..(143): n is a, c, g, or t
  misc_feature (203)..(203): n is a, c, g, or t
  misc_feature (210)..(210): n is a, c, g, or t
  misc_feature (216)..(216): n is a, c, g, or t
  misc_feature (234)..(234): n is a, c, g, or t
  misc_feature (241)..(241): n is a, c, g, or t
agcccaccagctggccactaaaagctncccggttgccaaggncttccttnttaaggntttgatcaagttagacgcnctgctcagaagacaaatggcatcacaggacagatttgaaanaagttttgagaaaacagctgcnttanaagaccaagggagttccaggaacaagatgagaagagtattttactgtatggaacatgttnttcattncgactntggcaactaaaacagtcnctatggntggttatcaattaagtccctatcaaaaaa

SEQ ID NO: 8909 - DNA, 244 bp, Mus musculus
tttgagcgtctgtcgtttggacgaagcagctgggtgtggtctgtactgctccctgaacaacgtacgcgcacactctggttgaaaaagatccaccaccaagaaaaacctgggctctttactgaaagaactcggccacggactggtggctcagcacttgctaccaaccctgaagattgaatttgatccccaggacgcaacctgctggaaggagagaaccaacgtccagtaattgtcctttgatccc

SEQ ID NO: 8910 - DNA, 238 bp, Mus musculus
gccccaggcacagtgtttactctggtcccctgatccgggctgaccggaacaccaacacccccctcccccacccccaccacgccccgagcactctcacgccgtatttagactaaaaatgaggtggattctccgccagtttttctctggcgaaggcaatcttcagcttaagtgttcccgcgtgctgtcaactcacacccgcctcctagcccgccctcttgtcaggaattccatcgcctcc

SEQ ID NO: 8911 - DNA, 514 bp, Mus musculus
  misc_feature (119)..(120): n is a, c, g, or t
  misc_feature (175)..(175): n is a, c, g, or t
  misc_feature (207)..(207): n is a, c, g, or t
  misc_feature (250)..(250): n is a, c, g, or t
  misc_feature (257)..(257): n is a, c, g, or t
  misc_feature (267)..(267): n is a, c, g, or t
  misc_feature (308)..(308): n is a, c, g, or t
gcaggcgcgcccttctacaaggttttgctgaccggccatcactaccttctccttaaaggtgtttttctatgtaactattgcagcacagtctttgaaatattttatagaagttcgttgtnnggatgtcttataatttatatcaccatttccttattgaatactttctaatcttganttattacaaataacgtgataaataaacgtgtntgcaccccatttggaccacaaattctcagtagacagccttggntaaggtnacgtggtttntattattttgagactggtctcttgttcaaactggccttcanctggctgtgtgaaggaggatgaccttgaagctccggatccaccttgcttccacctccctccaagcgtcggagactacagtcacatgccaccacatccaggctgttacttgtgttttaattgtcccccataaaggttgtgaaactaaaaatttttaccaacagtcatactgtctgcaaaatagtaacatgtctcatagagtcctgag

SEQ ID NO: 8912 - DNA, 482 bp, Mus musculus
  misc_feature (89)..(89): n is a, c, g, or t
  misc_feature (146)..(146): n is a, c, g, or t
  misc_feature (308)..(308): n is a, c, g, or t
  misc_feature (321)..(321): n is a, c, g, or t
  misc_feature (329)..(329): n is a, c, g, or t
  misc_feature (339)..(339): n is a, c, g, or t
  misc_feature (346)..(346): n is a, c, g, or t
  misc_feature (351)..(351): n is a, c, g, or t
  misc_feature (355)..(355): n is a, c, g, or t
  misc_feature (360)..(360): n is a, c, g, or t
  misc_feature (372)..(372): n is a, c, g, or t
  misc_feature (439)..(439): n is a, c, g, or t
  misc_feature (447)..(447): n is a, c, g, or t
  misc_feature (455)..(455): n is a, c, g, or t
gcgaccgggctgttgaagtttttgacctcaatgctggctgcagcgctgcagtgcttgctgaagtccattccaggcctgttcatcgaatntgtcaaaataaaggatcatcctttgtagcccagcattccctggcatataatcttttnctgacggcagctgttggtgatgggattcgactgtgggacttgaggaacttgaggcttatgtgtatgaaatgggctccagcagctttctgcaccgtcttgcaggacacacagatacgattactgaagtggccttcaacccagcagctcctcagcttgtcacanccaccttagacgngaaacttnagctatttgnggctgantgatnaccntcatnctggtaagaatncaagaagagaggagagaaagcatccatggcttagctattgaagtcgatgggcagtttccataggagnccttgctncacccctnttctgtaggactgaccctcatctgaga

SEQ ID NO: 8913 - DNA, 389 bp, Mus musculus
  misc_feature (240)..(240): n is a, c, g, or t
  misc_feature (253)..(253): n is a, c, g, or t
tgtgacctgtcagcctgcagaatcacatgagccaatgaactcctcagcaaaaaccttgaatctcattggttttgtttctccggagatcctggatgtatctgctgctatgcgtatgtatatgtatatgctgctatgtgctatcatctacaggggcgtaacgcctctactggtctcaggagacaagaccttcaagtaacacatggtacccttgtaggttttcttcggttactgctaaccctnaaagcaaacagtntaagaagagctttctttctcagaaaagctatccttagtatctcttagaagggctctgcgctgaacaataaccatgtagtgatcatcctcccggcaagtatccaggtctcataaacagggtggctagacgctattct

SEQ ID NO: 8914 - DNA, 512 bp, Mus musculus
  misc_feature (316)..(316): n is a, c, g, or t
  misc_feature (318)..(318): n is a, c, g, or t
  misc_feature (346)..(346): n is a, c, g, or t
  misc_feature (365)..(365): n is a, c, g, or t
  misc_feature (374)..(374): n is a, c, g, or t
  misc_feature (378)..(378): n is a, c, g, or t
  misc_feature (380)..(380): n is a, c, g, or t
  misc_feature (389)..(389): n is a, c, g, or t
  misc_feature (403)..(403): n is a, c, g, or t
  misc_feature (434)..(434): n is a, c, g, or t
  misc_feature (436)..(436): n is a, c, g, or t
  misc_feature (440)..(440): n is a, c, g, or t
  misc_feature (442)..(442): n is a, c, g, or t
  misc_feature (449)..(449): n is a, c, g, or t
ggaacgctactctagaaaggtgtttgttggaggccttcctcctgacatcgatgaagatgagatcactgccagctttcgcaggtttggaccccttgtggtggactggcctcataaagccgagagcaaatcgtacttccctcctaaaggctatgctttcctgctgttccaggaggagagctcagtgcaagctctgatagatgcctgcctggaggaggatgggaaactgtacctgtgtgtgtccagcccaaccatcaaggataaaccggtgcaaatccgaccgtggaacctaagtgacagtgactttgtaatggatggntntcagcctttggaccccagaaaaactatntttgttgggggagttccangaccccttngagntngtgagtggnaatagaaacagcanagcaaaagcgctgagtccccaatgccttagntntggntntccagtnagccaccctcagcctcaaagggaagcctgccatggcagttcactgagcgacggcctaatggtt

SEQ ID NO: 8915 - DNA, 483 bp, Mus musculus
  misc_feature (35)..(35): n is a, c, g, or t
  misc_feature (289)..(289): n is a, c, g, or t
  misc_feature (292)..(292): n is a, c, g, or t
  misc_feature (303)..(303): n is a, c, g, or t
  misc_feature (321)..(321): n is a, c, g, or t
  misc_feature (348)..(348): n is a, c, g, or t
gagatcaaagatgacgcagccacaaaggatgattntcctgaaaaaaaacccaagaagatggtggtggaagccgacatagaggacattaaaaaaacgcaacagcgcagtttaatggactggagctttactgaatattttcagccaaaagtcctgcttcaggttcttcaggaggctcaccagcaataccgatgtgttgactcttactaccacacgcaggataactctttacttctggtttttcataatccaatgaatctacagcgtctgcaatgtgaacattggaatattnctnttcactccaangtcggattcaggtgactnagataattctgctaaattttggctgantttgccacataggttttggttccttgatctggtctttatggctcaactcaatgaaagcatttatattgtggcatagattcaactgagctccctaaattaatatgtatcatgtgctatggttgtacattgtgctta

SEQ ID NO: 8916 - DNA, 474 bp, Mus musculus
ttggcactgcagacacctgcgttcatccagcagcaccaaggtcaagcagttgtcacctgggtgtgccctcgcatcctgtgcctttgctggctttcagcctaaggtaccctgtcatgcccattccctccagaacacctcagcctttacattctaaacatgaaggaactcagatctggcagagctcctcccggctaccaggggcatcactcagcacctcatggtctcctgaggtcttagctcgctctctctctgccactgatctggcaccttgctgtggtctgaatgggttcccagaaatccatgcattgagaccccaccactgatggggtgttgccagaatgtgggtcttgtgggtggggaggagttaggttgtgatgatggagccctaaagattggggtctgtggctttgaaggcacttcagcccacccatgtatgagtactgagtcggggagtgccacctacaaaccaggctg

SEQ ID NO: 8917 - DNA, 173 bp, Mus musculus
  misc_feature (58)..(58): n is a, c, g, or t
  misc_feature (63)..(63): n is a, c, g, or t
gttctgccagaaagtagtccagccaaaccagactacattaatttagctagcagtatgnagtcntattctgttttcatgggcagccatcctattttctgaaagactcaatgaagccatagtcacattaataataggtttagggatagcattacacaatgaacttttcctcttac

SEQ ID NO: 8918 - DNA, 451 bp, Mus musculus
  misc_feature (267)..(267): n is a, c, g, or t
  misc_feature (286)..(286): n is a, c, g, or t
  misc_feature (288)..(288): n is a, c, g, or t
  misc_feature (295)..(295): n is a, c, g, or t
  misc_feature (297)..(297): n is a, c, g, or t
  misc_feature (331)..(331): n is a, c, g, or t
  misc_feature (372)..(372): n is a, c, g, or t
  misc_feature (390)..(390): n is a, c, g, or t
  misc_feature (398)..(398): n is a, c, g, or t
aagtatttacttccctatcgtggagtcctctcaaaacaggaaattctactcaaatgaacaatctaatcaacccgatagccaacttgcaacagcatcaacttattccaactgcttgcataaatagaagaagatacagcataccttggacaccaaccagaaatctcccttttaaagcccaaaggaatcttatgacagacacctccgaatggctccagtctgtgccccttgggtcatttgaaagtttgttacctctctgcaatcttcagnagaagacaaaacattttgnantctgggncnaaaaggctaaggatgtgcagcttgccaccagccnatgggaggctgtgcccttgagttctaacatggatgcaagtntcatcaggggtaacagtnttctgcancctaaagaattcaccatgaggagctctaagcagagaattccttacctaaccaa

SEQ ID NO: 8919 - DNA, 470 bp, Mus musculus
aattcggaaggccttctttgcgtcttcatcgctcacagtacgtcaaaggattcacactaagaagaaaaccttgctgctgtaatgtctgtggaaaatctttcagccagtgtgcccactttaatcatcatcaaagaattcaaactggagagggagcctacgcatgcatgcaatgtgggaaaccaaaacttagtgataaaccaaaacttgtgccgtatcaggaaactcaccaatggtgagaagccctacagatgtggcgactgtgggaaaggctttcagaagtaagtactatcttagtgtgcaccagagaacccagaccaatgagaagccatacagacgcaatgagtgtggaaaatcttccaaggataccacaatttttaatgttcttcaaagaatccatacagaagagagaccctgtgaatgctgtgactgtggagaggctgttcgtgtgttctcatccctcattaatacat

SEQ ID NO: 8920 - DNA, 566 bp, Mus musculus
  misc_feature (61)..(61): n is a, c, g, or t
  misc_feature (64)..(64): n is a, c, g, or t
  misc_feature (67)..(67): n is a, c, g, or t
  misc_feature (77)..(77): n is a, c, g, or t
  misc_feature (82)..(82): n is a, c, g, or t
  misc_feature (146)..(146): n is a, c, g, or t
  misc_feature (203)..(203): n is a, c, g, or t
  misc_feature (264)..(264): n is a, c, g, or t
  misc_feature (539)..(539): n is a, c, g, or t
gtgtgcacatgagccttcagagatactgtcagcaggattatgttctgcacgcccaggtttnagngtngtcgtcgcanccgtntgaggcggtgggccccgagtggtggcggctggccgtgcacgtgctggctgtgttcaaacagcgngcgtggcccgtgcgccgcggtggccaggaggcctgggtgccacgtgctgacctaatntgcggctgcctgcgcctgcgccctggcgctgactacctcctgctgggccgtgctgcgcagncccacgacgacgacaactatgaccctgcgcgcctcatcctgaaccgccacggcctcgcgctgccctggagaccacgatgggcccggccgctgcggcgactgcagcagaaggagcgcggaggtgcctgccgaggcctgctgccacccacacggagccctgggcccaggaactaaagtgagctactaatgtaaggtgtgagtccccagagccaatcagaagcttcagtgcccgtgacgccactccgcatgtgacgttgcctacgttgggaccggaantgactgcttggacctgtgagccttata

SEQ ID NO: 8921 - DNA, 432 bp, Mus musculus
  misc_feature (40)..(40): n is a, c, g, or t
  misc_feature (251)..(251): n is a, c, g, or t
  misc_feature (330)..(330): n is a, c, g, or t
attttgtttgtaatgcagtggcctctagtattctcctctntactccttcagcccttccacttctacagatggccctttacgtggagcctcagatacgtacagcctgtctaaagaagccgggttccagaagcctgccttgtgggagttccctgcctcttggactgacactcccctggactccgccccctcacagcatgaagcagctagagcggtcatcgtcccctttcctgacaataattggtgtcaatctntgaagtggggaaggaaggcaggttagatggacataggtagactaggaaagtgagagcagacttcctgacacaaggcttnttattctcagaagacactgtgagacagggtatgaaagctgaaactatagaggaagggaggacaaaggggccctataaaatacctacgccagaagccttttag

SEQ ID NO: 8922 - DNA, 432 bp, Mus musculus
cagaggagctgtttgccgtgcaagtgaagcacattgtctcaccggatgaaactacgtcagattcctgttcagcttatgcagtacccagcccaagccataaaggtgctcttggcagggtttaaacctcccttaagtgactcgggaaaaacaagaataccatactgtcccaaatggagcatggaagccttgtggactatgatagactgtctccaaggaaaacaactttatgcttcttctgtggctcaggcaccagaacaaatagtgacattatatgaagatgaacaatacccagttcacatgtccttggtagaaatggggcttgcagataaagatgaatgatgtgcacaagagctcctgcagctgtccagaaaaaaagttttctgttagatttgtaccacttcaggtttgattttaacttgttctgcagtggta

SEQ ID NO: 8923 - DNA, 369 bp, Mus musculus
  misc_feature (36)..(36): n is a, c, g, or t
  misc_feature (144)..(144): n is a, c, g, or t
accctgactaatacatggtccatcaaaaagacccancaaataaatagtggatagtgtcggaaaagtccaggcaggtaaataaaggttagcaaaagtttgtatcacacaaacaatgtgtgtggaatgcttaggccttgtggtagntggcatgtgagattccagctgtgctcatacaaagacagtagtgtgctactagtaacaaatatgaatagggaggatgagataggatggaaaatactgtaacaccttggtcaaaacaataaatgcaaagatgaattaaagatagaccaattctatcctcaggaaatgatcgattatatgtataaacttttgtataaacatatgtatgtacacacagactaattttgt

SEQ ID NO: 8924 - DNA, 439 bp, Mus musculus
gaaacccagcgtgttttggatctctggtgtctttttcacccaagcctttttaactggagctatgcagaattttgcaagaaaatacaccatccctattgacttactaggctacgaatttgaggtgattcctttcgattactctgacaccccaccagaagatggcgtctacattcatggattgtatcttgatggagcacgctgggacaggttcagtggattgcttgctgaacaatatccaaaactattgtttgacctgatgcccatcatatggataaagccaaatctgaagattgagattgtgaaaatagaggcctatatctgtcccctctacaagacgagcgagcgtaaagggactctttccactacaggacactctaccaactttgtcattgcaatgttgttaaagacagaccagcctactcaacactggatcaagcgt

SEQ ID NO: 8925 - DNA, 497 bp, Mus musculus
  misc_feature (360)..(360): n is a, c, g, or t
  misc_feature (379)..(379): n is a, c, g, or t
  misc_feature (399)..(399): n is a, c, g, or t
  misc_feature (403)..(403): n is a, c, g, or t
aagtgctttcaattgcagagccatctctacacttttagaagcaagtttcaaatcagcctgaactacatagtgagacttgtctcagaaaatcaaaatattttttaaaattaaagatatatacttcagctatctgattttattttatgcaagctgctaaaaaaatagaaacccatttctaatgacagaaaatagatcagtgattgcctagagacagaattgactgttgaggtattgggcattggggcaatggaaacatgatttagccctcagagctcttgttcctcttgcagagaattccatttggttccctccacacatctggcagcttacaatagctctgttttctggaaatctgacacnttcctcttgccactgaagncaccaggtacacatgtggtncatncaagaaatattcatatacataaaataaaaatatttttaaaggtattgggagctttaaggaagtattgagctgggtataatagcacacatcttta

SEQ ID NO: 8926 - DNA, 501 bp, Mus musculus
aagtcccagaggtcaggttatcagagatgacaagaaagaaaactcaacaggagaaacgagactacctatctaactgggacataagtaaatgctctaaaaaccttcttttttataaccagaataaagttactgtgatagatgaagccaatttttatttctatatatttctttttcctaatgtcttaggaatgtcttctttgcagttgtcttcattcctgtttgtgtacatacatgtacatgtgtgtacacgggtgcactgttaggtctcaaacccagaacaaatggctgaggcgctcattaatgtatcaaagcagacagtggccaccatgttctgcctgcatctttcagtccctacctgttatgtgatatggttggcatacccctgcccctaccctaaactccaacctcgaggctgggttgcccttcctccagctgctcttctgcccatataatccagctgttttggttaccaatcctttttggtccacctttactctcttg

SEQ ID NO: 8927 - DNA, 449 bp, Mus musculus
ggaccctgagctgatgaactatgacactgctgaggtggacatcttgggggtagatggagttctgtacaaaggccgaatgagcagccagtttgggactcggactggggagaaggacattgcagctgtgaaagtttcatattacaccattccaaacctgactgatcgtgtgcgcccaggatccttacttgctccgggctatccacccttgagcccccgcaccagtatcacctctgccaccactctacactctgccaccaacaccacgacggcacggccaccatccctgccaccagtgccacagctaccaccactgatccctgtctcaagggatacccaagaggcccctggatctgccaagcgtttgaaatctccacggctgtagcacaccaacccgtgaaacccaagcctgtgactcaactaccattgggtccccttcactcaaagaaaga

SEQ ID NO: 8928 - DNA, 484 bp, Mus musculus
  misc_feature (235)..(235): n is a, c, g, or t
  misc_feature (240)..(240): n is a, c, g, or t
  misc_feature (247)..(247): n is a, c, g, or t
  misc_feature (256)..(256): n is a, c, g, or t
  misc_feature (263)..(263): n is a, c, g, or t
  misc_feature (284)..(284): n is a, c, g, or t
  misc_feature (321)..(321): n is a, c, g, or t
  misc_feature (359)..(359): n is a, c, g, or t
  misc_feature (366)..(366): n is a, c, g, or t
catgttgatggttttaactgccttaaaggatacagctcaggggcactgagagcagcccttatggtcgtcattgtcaccaagacttccttgtcttcccagaccccaactttgtcccttttacaccaagcactgtctcaccagccaccagatgctggcaacctctgttgtctgtctctacctgtctgacccaccttggcacctcatgtcagtggatcatacatccattgatctttcngtgantggtttnttttctggnacatggngtgcacaagtgttaatgaaanggcacacatcagcatgtactccatttttgagactatntaatatttcttttgtgggtttcagttattcatagaganacactanccatctccatccttttgatatagtgaaaatgaatgctatgtattgacatgaatgtacatgtgctgtatctgttggattcttttgattcatacatatatagccacgatgtaccacaatg

SEQ ID NO: 8929 - DNA, 497 bp, Mus musculus
  misc_feature (58)..(58): n is a, c, g, or t
  misc_feature (383)..(383): n is a, c, g, or t
  misc_feature (386)..(386): n is a, c, g, or t
  misc_feature (402)..(402): n is a, c, g, or t
  misc_feature (421)..(421): n is a, c, g, or t
  misc_feature (457)..(457): n is a, c, g, or t
tcatgcgccagtcccagcaggagcgcaggattgctgtgcagctcatgcatgttcgccncgagaaggaagttttgtggcaaaatagaattttccgagagaaacaatttgaagaaagacggcttaaggatttccaggatgctcttgatagagaagcggctcttgccaaacaagccaagattgattttgcagaacaaaccttgagggagaaggaaattcatgaaaagatctctgtggaaagagcccaacagcgttataagaagcattatgggatatgtgcagagattttggatcaaatgctagatttgtgcacgaaggtggcagactataggttgctgacaaataatcttattccacataagatgatgcacgattggaaagaactngtnttttagtggaattccncatatatgaacagacttcntcttacacatggacaaacagaacccactgaggatcnccgtgcagaagtgaagaaaaggaacttactcgatagcaaa

SEQ ID NO: 8930 - DNA, 464 bp, Mus musculus
  misc_feature (246)..(246): n is a, c, g, or t
  misc_feature (405)..(405): n is a, c, g, or t
aagtttgggttctcctggtgtcaggggtgcccctgggaaagatggggagcgtggagagaagggaacagcaggggaagaaggcagcccagggccagctggtccacggggagatcctggtgctcctggtctcccagggccaccaggaaagggcaaggatggggagccgggactacgtggaccacctgggttacctggtcccttaggaatcaagggtgaccgaggaacacctgggattcctggctctcntggcagccgtggtgacccaggcattggggttgctggtccacctggtccctcaggacgaccaggagataaaggacccccgggatctcgaggcttacctggattccccggcccccagggaccagctggccaggatggtgcaccaggaaacccaggagaaanagggcctcctggaaaaccagtatgtcacctgccgggtctggatgaatgctgactgtcag

SEQ ID NO: 8931 - DNA, 456 bp, Mus musculus
  misc_feature (57)..(57): n is a, c, g, or t
  misc_feature (219)..(219): n is a, c, g, or t
  misc_feature (228)..(228): n is a, c, g, or t
  misc_feature (240)..(240): n is a, c, g, or t
  misc_feature (245)..(245): n is a, c, g, or t
  misc_feature (343)..(343): n is a, c, g, or t
  misc_feature (366)..(366): n is a, c, g, or t
  misc_feature (369)..(369): n is a, c, g, or t
  misc_feature (387)..(387): n is a, c, g, or t
gaacttggatttctctatacggcaagtggtcctttggtgcgatcttcatataaagcnggtgatttttcctgaaaaatctagtggctagaagaaaaacaaaagcttctaaagtgtagccaagcccttcaagatcacaggagtgttgcgattttgcttccagttggtgtgaggatggtgtcaccctgtcaggattcctgtgagtgcaaggcagcaccgttntgaagggtntgatggctgatngaagnggaatggtgtatacctgtaattccacccaggaaaaaaaaaaggaaaagaaaaagagaaaagaagaaagaaaagaagcctataaccctgtaaacgacanacatttagtgataattcatgganttnttgctggcctttgtcctnatccttgtcagtgatgacttgatcacagaacagcttggaacggcttgctgttgccattgtaattcaagt

SEQ ID NO: 8932 - DNA, 257 bp, Mus musculus
  misc_feature (34)..(34): n is a, c, g, or t
  misc_feature (45)..(45): n is a, c, g, or t
  misc_feature (53)..(53): n is a, c, g, or t
  misc_feature (58)..(58): n is a, c, g, or t
  misc_feature (62)..(62): n is a, c, g, or t
  misc_feature (86)..(86): n is a, c, g, or t
  misc_feature (115)..(115): n is a, c, g, or t
  misc_feature (132)..(132): n is a, c, g, or t
gttcataattttatagttcttttcaaacaattantctgagatgtnaaacagtncattntctntcatggcacggagttttcctcccnaaagagtaatttctatctatttaaaaaanaaatcaaataatttttntttgatatctgtattgaagagtacaaacttcagaataaaatcacatgtttaaatctagaactcagtagccacttgtaatattctaggattaaagccaattgtccagtcatgtttctaatgtatag

SEQ ID NO: 8933 - DNA, 160 bp, Mus musculus
  misc_feature (51)..(51): n is a, c, g, or t
  misc_feature (55)..(56): n is a, c, g, or t
tgcatcagacgcggttccacctggggataggatatcttgtccgggttctancctnnccgttagtcatgccctcgagtactgctctggggaaaatggctgtaaagccaactagcaggaatgctgtattgtttttccgaacaattgccacttgccggcggcc

SEQ ID NO: 8934 - DNA, 320 bp, Mus musculus
caaggtgtggtgtggatgctacccaccttccttcctttgtgtaaatgacagcagcacattgtggggttccagccattgtgacattgaaagaagccacgaagagaggatagaaagtctgtggagcacgctgtctacctgcagctgttagagatcccatctctctggggctccacagtgacattcatgttgcatgtccctctttaaccagtttatccatcttgctttcatagcctgtgctacattgtcctccttctatattcagcacatgcttaataagctcctgtactattcttggcacccgagggtcactgatggacatg

SEQ ID NO: 8935 - DNA, 415 bp, Mus musculus
  misc_feature (100)..(100): n is a, c, g, or t
  misc_feature (117)..(117): n is a, c, g, or t
  misc_feature (125)..(125): n is a, c, g, or t
tgcatactttgtatactgcctcaccctggggattcccttcagatctacaccatccagtaagctaccactgggcagtggccagctccagtctacaaagganggcctcaaaggatattntacaagantacaaaacagagtcctaatgagcctgtcagcagagcccccaacttccctcattaggccagacatcttgcatctcttacagcagaccaaagaggcagctctgaacagcagcttaaagcgatcaccagcctggattgctcagggcagcagagctgtggggcccgctggctttgcagcacattcctggctgggatcttccattgtcatacagtgcatccccagaccctcgctcagtgcaccgaggttgtcctgccagccctgctcctggtctgagagtctcctgcacggtgac

SEQ ID NO: 8936 - DNA, 400 bp, Mus musculus
  misc_feature (37)..(37): n is a, c, g, or t
  misc_feature (65)..(65): n is a, c, g, or t
  misc_feature (202)..(202): n is a, c, g, or t
  misc_feature (249)..(249): n is a, c, g, or t
  misc_feature (293)..(293): n is a, c, g, or t
  misc_feature (375)..(375): n is a, c, g, or t
acacccagactcaagtaacctacttcttgacttcttntgaacactccactcctgacaccatgtgntactacggaggatattatggaggcctgggctatggctatggtggcctaggctgtggctatggctgtggctatggctgtggctatggtggctatggatatggctgctgccgcccactgtgctgtggaagatactggtnttatggcttctactgaggagattcagcagctgctcactccaactttnttcacttcagatgtccctaaatatcctcatcaatttacaatatntgaggaataatatgtgaaacgcagcatgtccaccctgttctttctctctaatttgatttcataaatacttgtagcaaggttnttcattcttgcgataatgccttgta

SEQ ID NO: 8937 - DNA, 346 bp, Mus musculus
gagtttatgatactgttacaccaaagattgaagcatggcgccgagcattggatgtagtgctcttagtgcttcagacagacagtgaaataattactggacttgtacacacagagatgaattcacaggaattagatggagttttatttttgtagtatgtgtgcgcacacgtgtgggtgtgcatgcatgtgtgtgcatgcacatgtacgtaggtgcctgatgaggccagaagaggggattggatcccctggagctataattataggtaagccacccaacagtgtgtgctggaaacccagctgtataagaacagcaagcacttttgagtcatttctccagacttaataaa

SEQ ID NO: 8938 - DNA, 334 bp, Mus musculus
  misc_feature (51)..(51): n is a, c, g, or t
  misc_feature (81)..(81): n is a, c, g, or t
  misc_feature (85)..(85): n is a, c, g, or t
  misc_feature (152)..(152): n is a, c, g, or t
  misc_feature (238)..(238): n is a, c, g, or t
cagggtctctggatcaagatagctacgctaggctgaaccatggctagacgncccatcctcttaggtgaccagctggtcctngagnaagattctgatgagacctacgttcccagtgagcaagaaatccttgactttgccagagtgattggtanttgaccctatcaaggaaccagaactgatgtggctggcgagagagggtattgaggctccattgcccaagggctggaaaccatgccanaacatcacaggtgatctttactatttcaactttgacacggggcagtccatctgggaccatccatgtgacgagtactatcgaaagttggtcatccag

SEQ ID NO: 8939 - DNA, 327 bp, Mus musculus
  misc_feature (218)..(218): n is a, c, g, or t
  misc_feature (247)..(247): n is a, c, g, or t
  misc_feature (296)..(296): n is a, c, g, or t
gtgtgttcatgtgccacatgcatgcagtgcctgcagaggccagaagaggggtgtcggatcccctggcattatagaagactgtgacccgccatgtgggtgctaggaactgaacctggatcctggggaggagcaggcagtgctctcaacctctgagccacgtctccagctcctgagtgactaccaacctgggatcaggcttcttacttctgtacaagtantccttcatgaggaagagagaccaagtctngaatgcggtgaagtaagcagagaagattttatggcgtttcacaaatttntcttggcctccgagacagcaaaataatcata

SEQ ID NO: 8940 - DNA, 185 bp, Mus musculus
  misc_feature (60)..(61): n is a, c, g, or t
  misc_feature (66)..(67): n is a, c, g, or t
  misc_feature (72)..(72): n is a, c, g, or t
  misc_feature (101)..(101): n is a, c, g, or t
  misc_feature (155)..(155): n is a, c, g, or t
ttctcagtgggtcctttgttttaaggaggctgttggtactgtgtggttgttcttgttgcnngttgnngttgntgttaacgggagaagaaaactttactaanacaaatcttaactaccttatcctgaaggtgtcgcggtgagagcaagctgactcngcatggcccccgcatatccgtggtgtcttt

SEQ ID NO: 8941 - DNA, 361 bp, Mus musculus
  misc_feature (27)..(27): n is a, c, g, or t
  misc_feature (45)..(45): n is a, c, g, or t
  misc_feature (61)..(61): n is a, c, g, or t
  misc_feature (124)..(125): n is a, c, g, or t
  misc_feature (130)..(131): n is a, c, g, or t
  misc_feature (136)..(136): n is a, c, g, or t
  misc_feature (165)..(165): n is a, c, g, or t
  misc_feature (219)..(219): n is a, c, g, or t
  misc_feature (275)..(275): n is a, c, g, or t
  misc_feature (322)..(322): n is a, c, g, or t
ctgcccactgaagtgaagccaagtaanccagggaggttggccggntggcacctgagagtgncctttctcagtgggtcctttgttttaaggaggctgttggtactgtgtggttgttcttgttgcnngttgnngttgntgttaacgggagaagaaaactttactaanacaaatcttaactaccttatcctgaaggtgtcgcggtgagagcaagctgactcngcatggcccccgcatatccgtggtgtctttatcctaccttacttggaagttcgttncaaaacaggcagttttagaatttgagattttgagattgtttaaaaantcctagttttttgatgtactgctcttttgtggtcatttc

SEQ ID NO: 8942 - DNA, 330 bp, Mus musculus
  misc_feature (178)..(178): n is a, c, g, or t
  misc_feature (215)..(215): n is a, c, g, or t
  misc_feature (230)..(230): n is a, c, g, or t
  misc_feature (235)..(235): n is a, c, g, or t
  misc_feature (238)..(238): n is a, c, g, or t
  misc_feature (247)..(247): n is a, c, g, or t
  misc_feature (250)..(250): n is a, c, g, or t
  misc_feature (282)..(282): n is a, c, g, or t
gcaacaggacgctcgacgatcagctaggggtcccgccgacgcacttgcgccctgggctcggcggccgcggggacgagcagggctccggcgccggggatctctatttctctctctgtccccgatgtctgcccggcggtggcagcacgtgcctgcagactcaccaacccggtcagcctgnagagatccagttgtgattccttcatcccagctctccncacccgcccctaaantggcnggngactgccantcngttgcacgtggccggctcactcattcatcccnagaaaggctcgtctgagggcaatgctctgatagttaatgggtactgat

SEQ ID NO: 8943 - DNA, 251 bp, Mus musculus
  misc_feature (75)..(75): n is a, c, g, or t
  misc_feature (78)..(78): n is a, c, g, or t
  misc_feature (80)..(80): n is a, c, g, or t
  misc_feature (89)..(90): n is a, c, g, or t
  misc_feature (104)..(105): n is a, c, g, or t
  misc_feature (116)..(116): n is a, c, g, or t
  misc_feature (123)..(123): n is a, c, g, or t
  misc_feature (141)..(141): n is a, c, g, or t
  misc_feature (166)..(166): n is a, c, g, or t
atccatgggctcctttgtgaacaacatacctttttctccatccttctcactgtggtggcagccttcttcagtgtnccnanccatgtttnntgggacccaaaagnnaatgtgagaancagagtnttcatttttggcagttgnttttgtttatttttcaaccagatanctgttgtgtttttttaaaaatgtaagaaacaggactgaaattgtaaatactttgtaaacacaagcatttgtacttgaataggatt

SEQ ID NO: 8944 - DNA, 317 bp, Mus musculus
accagatctgagttcgtgcttaagcaatcctgagttctagggaccttagaagaggcgcataggctcaggacttgatctttgaaattttccttatgaaattttctttagtgtgaaatcagtgtgaccacattttcacactagtggatgacgtcgggtctgatgttggaggaggtataaggaccagctgaggggtcagtgggctccaggattcagtttgtgtaattgcttcgcaccatgattacatttttatcatgatgggtgtggttgatttttttttaacactcagtggcagaatgcttgccactcacgagggagga

SEQ ID NO: 8945 - DNA, 368 bp, Mus musculus
  misc_feature (113)..(113): n is a, c, g, or t
  misc_feature (116)..(117): n is a, c, g, or t
  misc_feature (119)..(119): n is a, c, g, or t
  misc_feature (122)..(123): n is a, c, g, or t
  misc_feature (128)..(128): n is a, c, g, or t
  misc_feature (131)..(131): n is a, c, g, or t
  misc_feature (140)..(140): n is a, c, g, or t
  misc_feature (143)..(143): n is a, c, g, or t
  misc_feature (146)..(146): n is a, c, g, or t
  misc_feature (152)..(152): n is a, c, g, or t
  misc_feature (301)..(301): n is a, c, g, or t
tggacagagcacaccaggctagcacagccccacgagaagaggtttattgggggaagtggtgaagagaagaagtaagaatgagggggagccaagaagacacccagcaacagcancannancannaacancancagcagcancancancagcancaacaacaacaacaacaggctaacaaaaatagtataaatagctgactgtctagcctcaacattaccagcaaatgatcacctgttttaaaactgtgccctttaatatcaggcgctgaagcaaaattcaaacggcctacgatgcatgaatntgtaaaactcagaatatattctaaagaccaaggactgctttagaggcatcatgcaccaaattgacaa

SEQ ID NO: 8946 - DNA, 245 bp, Mus musculus
  misc_feature (146)..(146): n is a, c, g, or t
  misc_feature (160)..(160): n is a, c, g, or t
cgaaccggaactcctgcctggcaaaaggggttctagaagggcgcctttctttgggggttgggacagaacaacttttctcccacagtcccacgtgcacgacgttacaccgcgacttagttcggagtctttagttctcagccctcccnttccgtcctcgggntctggaacagctgtggggtggatctgccagcattaaaagggcagatgtgcctttaatcccagcacttaggcaggcggatctgtgt

SEQ ID NO: 8947 - DNA, 311 bp, Mus musculus
  misc_feature (134)..(134): n is a, c, g, or t
  misc_feature (140)..(140): n is a, c, g, or t
  misc_feature (143)..(143): n is a, c, g, or t
  misc_feature (172)..(172): n is a, c, g, or t
  misc_feature (176)..(176): n is a, c, g, or t
  misc_feature (270)..(270): n is a, c, g, or t
gtattgtggtctagtcaagccgctgacagtcttcaggattgagattgtttttttttttttgactctggtttcttatctccaaactgtaaaaattctatcgggcaaaatttttgagacaaatccatcttagatantcttgnaanttcattaagagggaagtagaagggaattnaaantgcctgttcaccggggataggcagaggcatacaccaaaatctttcaagtagtgtactcagctataaagaatgctttttattttacatgttcatnaaatatgtgagttttttgccctagctcatgtgaaatttttg

SEQ ID NO: 8948 - DNA, 332 bp, Mus musculus
  misc_feature (42)..(42): n is a, c, g, or t
  misc_feature (49)..(49): n is a, c, g, or t
  misc_feature (67)..(67): n is a, c, g, or t
  misc_feature (97)..(97): n is a, c, g, or t
  misc_feature (114)..(114): n is a, c, g, or t
  misc_feature (136)..(136): n is a, c, g, or t
tttaacttcaaatcccatggctgccagttctgaactttaagncaaagtncgtgttctgtacacatcntggagtgtcagaggctgattttgagagggncggatggagaggcagancacagaagaagcagaagagacntctgcctctctgctgccccacccacagggcctgcctttgttagccagagcacctgtttcagtgggagccaggagaatgactgagtaaagctgacagcatcttcaccacccacgcacagaagttatcttgaccaaatggcctattggtacctactcttaatttattctttcaagcactccccctaaatatgtatttg

SEQ ID NO: 8949 - DNA, 311 bp, Mus musculus
gactctctcgccagctgtaaactgttgaacccggaatccaaacttactgtgctatagggtggtttcttgtctcacgctgtaagaaatagcgaattaatcttttctattaaatactataaaaacttttatttaggacaaggaattaagatcttttttgcctctcccatcttataagacttgcaaatattttaatcctactacctggtaaaactccagtttactcagagtgattccttccccttcctccattgtctgtgcatctgtactttcctgatcagacaacttaatgagactgtgaggtcggaccccag

SEQ ID NO: 8950 - DNA, 59 bp, Mus musculus
cagcctccccagtgattagtgtgttacattgagagtagatacgatttttgaggcaaatc

SEQ ID NO: 8951 - DNA, 268 bp, Mus musculus
  misc_feature (176)..(176): n is a, c, g, or t
  misc_feature (195)..(195): n is a, c, g, or t
  misc_feature (200)..(200): n is a, c, g, or t
  misc_feature (205)..(205): n is a, c, g, or t
gtttgcagtgtttagttgaaggacagggctgcgagggcaggtccatcggttcatgtgtctgcccatgctcacctctgtggtgaaaggacccaggccgtggacagcctccccagtgattagtgtgttacattgagagtagatacgatttttgaggcaaatcttataggttgtagacnaaaaggggttaagacaccnagacngtcanttaagagcccaaagatagaaatgtgggaagttttagctggaccaagcttaaacatcagcagaa

SEQ ID NO: 8952 - DNA, 185 bp, Mus musculus
  misc_feature (38)..(38): n is a, c, g, or t
  misc_feature (75)..(75): n is a, c, g, or t
  misc_feature (82)..(82): n is a, c, g, or t
  misc_feature (104)..(104): n is a, c, g, or t
  misc_feature (141)..(141): n is a, c, g, or t
gcggcctttgaccaaactccacacacgggcggcgcgtngatgagacctgcctggactcgtttgcgttttccattntggaatntgagttccaacagttgtcaaanttcatttctcctgtttatatatatatatttttagagnttttatttattaaaaacaaaagtcccgtcatgcggaggtcctgg

SEQ ID NO: 8953 - DNA, 262 bp, Mus musculus
  misc_feature (86)..(86): n is a, c, g, or t
  misc_feature (90)..(90): n is a, c, g, or t
  misc_feature (93)..(93): n is a, c, g, or t
  misc_feature (102)..(102): n is a, c, g, or t
  misc_feature (112)..(112): n is a, c, g, or t
  misc_feature (115)..(115): n is a, c, g, or t
  misc_feature (142)..(142): n is a, c, g, or t
  misc_feature (154)..(154): n is a, c, g, or t
  misc_feature (156)..(156): n is a, c, g, or t
  misc_feature (195)..(195): n is a, c, g, or t
ttcctcaccggaaggagggagtttgacccactcggaacccgggatgccccctttcggggccctttattatccttaggacgatcaancaanttnaaagaactntagagtgttnttnatagccacacactatgcccacagtttnttgtgaattgancnaaagggaaacttaggatgtgtgctattaaatacatttanttttacagcagtgcctttaatgagcacggttcccagtttgccatgcgttttgatgactgatagacca

SEQ ID NO: 8954 - DNA, 255 bp, Mus musculus
  misc_feature (202)..(202): n is a, c, g, or t
atcaagaaaggtcatgtcagcgggagaggaacagattaaattagcatcaaattagacatggaaagtgagttctgtcaaaatcatcgcagcgctcagcacaattagaatatgttaattatgcatttcattaaggtggatgtgagatgaaatgtcactggggtaggcatccgaaaaagggaagattgccaggcacaactttctntagacaatgtgtgacaccttcattaccatcaagaatcgcgagtctgccgtgac

SEQ ID NO: 8955 - DNA, 180 bp, Mus musculus
  misc_feature (61)..(61): n is a, c, g, or t
  misc_feature (69)..(69): n is a, c, g, or t
  misc_feature (73)..(73): n is a, c, g, or t
  misc_feature (82)..(82): n is a, c, g, or t
gagagaatgtggacagctgccaacacacagttcttccacctcgtcacccctcctaagcaanccttcatncttnaccctgagnttccccaaacacacctggacctggaacttaaatctttttcactattttgtcaacctaaatgttgcctctggacacaagagtgacaccttgtggtcagt

SEQ ID NO: 8956 - DNA, 253 bp, Mus musculus
  misc_feature (87)..(87): n is a, c, g, or t
  misc_feature (100)..(100): n is a, c, g, or t
  misc_feature (115)..(115): n is a, c, g, or t
  misc_feature (122)..(122): n is a, c, g, or t
  misc_feature (187)..(187): n is a, c, g, or t
  misc_feature (209)..(209): n is a, c, g, or t
ttcctatgcagttcttgcggagtgacaggatggggaatttgactgagttttgcctagaaaggagatcctggacccaacctgacccantcctgttcagccnttcaacttccaaccntgggttntgcagacttttgcacattttttgagcagagggtggtaaggagaactagaacccaaccatcccagntccaccctattcccactttcanccccagaatccacccatcaccacaagccatctgttttcacctgg

SEQ ID NO: 8957 - DNA, 129 bp, Mus musculus
  misc_feature (65)..(65): n is a, c, g, or t
agcacagtgatttcccacggtttccggaggcgactgatttgataggcggatttcggaagttgctntcattcggtaatggtgcgcttgcctaacacgcgagacgctcagggtttgaaccccactactact

SEQ ID NO: 8958 - DNA, 223 bp, Mus musculus
  misc_feature (102)..(102): n is a, c, g, or t
  misc_feature (113)..(113): n is a, c, g, or t
  misc_feature (153)..(153): n is a, c, g, or t
  misc_feature (157)..(157): n is a, c, g, or t
  misc_feature (160)..(160): n is a, c, g, or t
  misc_feature (162)..(162): n is a, c, g, or t
  misc_feature (164)..(164): n is a, c, g, or t
  misc_feature (175)..(175): n is a, c, g, or t
  misc_feature (177)..(177): n is a, c, g, or t
tccagtttcacccttaggaccaagaagacttagaaagtgagaagaattctgtgaatggcgggaacagaactgcccagactgtttccagcaagaggcattatntccggaacctntacccacaatccatttcacaggacaaggaaagacatcatntccntcntntntgcttcctcantntccacggcctggcaggctcctataagttcatctccagccttagttt

SEQ ID NO: 8959 - DNA, 107 bp, Mus musculus
  misc_feature (70)..(70): n is a, c, g, or t
  misc_feature (80)..(80): n is a, c, g, or t
acaatataagctgccgctgcaggttttatagttcccagcgatatattcctgaggctttaattagaagctnaaagtgacgntggagtgagggcgcagaggaagtcctg

SEQ ID NO: 8960 - DNA, 199 bp, Mus musculus
  misc_feature (70)..(70): n is a, c, g, or t
  misc_feature (80)..(80): n is a, c, g, or t
  misc_feature (129)..(129): n is a, c, g, or t
  misc_feature (166)..(166): n is a, c, g, or t
acaatataagctgccgctgcaggttttatagttcccagcgatatattcctgaggctttaattagaagctnaaagtgacgntggagtgagggcgcagaggaagtcctggattggaggggggaaaaaagcnttgtccagagatcaaccaagaaagtgagtcggtaatntgtattcctacatggcttttgccttgacttcct

SEQ ID NO: 8961 - DNA, 230 bp, Mus musculus
  misc_feature (63)..(63): n is a, c, g, or t
  misc_feature (82)..(82): n is a, c, g, or t
  misc_feature (104)..(104): n is a, c, g, or t
  misc_feature (118)..(118): n is a, c, g, or t
  misc_feature (146)..(146): n is a, c, g, or t
tttttcccaggtaatcagcatcgggtgggctgccatggggtcactatacgcagagatgaccgntgacaagttttttagatgntttgctttgaccattttgatcntcaatggagccatntttttcaaccgcctgtgcctggagtttntggccatcaattaccgagaggagagacactgaggcctggggattggggacaggactaagacgggagatggaaaaagctgcttca

SEQ ID NO: 8962 - DNA, 155 bp, Mus musculus
  misc_feature (26)..(26): n is a, c, g, or t
  misc_feature (34)..(34): n is a, c, g, or t
tgcgcaggcgctagccgaatttgganccaacccntcccaaaagggtgcatacaaatcaaagtgccggcagactgaccaatcccaggaggacacatagctttccccagtgccagggtgtatataagcattcctccctgggtttccagagttcctgt

SEQ ID NO: 8963 - DNA, 90 bp, Mus musculus
  misc_feature (63)..(63): n is a, c, g, or t
tatgtggatcattagacccaccagggcacgtgagaaagtatcccgttgagtaaggggtttttntagacgctatagactgtggcttttcat

SEQ ID NO: 8964 - DNA, 222 bp, Mus musculus
  misc_feature (104)..(104): n is a, c, g, or t
  misc_feature (134)..(134): n is a, c, g, or t
atcaaattgtccagtagtaaatgtaaagtggacattgcctagaatttggagcaagcttctagaattaatggacttatattgtatatggagaggattcagtgctnctgtccagcatattcattcttgcctaagantccatgacagccatgggaattgatttcttccaaagaaaaagtgtttccttgttgtagctttgagaaatcacttgttccatatcaattt

SEQ ID NO: 8965 - DNA, 225 bp, Mus musculus
  misc_feature (39)..(39): n is a, c, g, or t
  misc_feature (53)..(53): n is a, c, g, or t
  misc_feature (70)..(70): n is a, c, g, or t
  misc_feature (101)..(101): n is a, c, g, or t
  misc_feature (118)..(118): n is a, c, g, or t
  misc_feature (127)..(127): n is a, c, g, or t
  misc_feature (134)..(134): n is a, c, g, or t
cggttgccgcttgccatggaagtcacggatggctgattnacacaggagggggntggggcccactagcaanccctcaagcacactggatgatttcaattacntaaatccctgcagcttntcagaaganatttacntgttttttatgacgtatgaatacctttgactttgatttagaaatcgagatgcatttttaaaaatctgtgacctgtatgagaacattttatt

SEQ ID NO: 8966 - DNA, 185 bp, Mus musculus
  misc_feature (78)..(78): n is a, c, g, or t
  misc_feature (94)..(94): n is a, c, g, or t
  misc_feature (138)..(138): n is a, c, g, or t
  misc_feature (158)..(158): n is a, c, g, or t
gaagaacctacactaacgtgggaaggacaggagtggtggctcagtggttaagaagagagcccaagttcagtttccagnacccacgttgtgactnatgaagtaattccagttccagggaatatgatgcttcttctgacntctgtggacaccagatgtanacatggttacatatacatatgttcagg

SEQ ID NO: 8967 - DNA, 67 bp, Mus musculus
accttttctttctctagatgaaagcttgcggctccagtggactcagaaaaaagaacgtagaccttgg

SEQ ID NO: 8968 - DNA, 150 bp, Mus musculus
  misc_feature (73)..(73): n is a, c, g, or t
  misc_feature (119)..(119): n is a, c, g, or t
tcaatgtttgcttaaatgggaggaaaaaaaattccccaaggcaaccttaggggcgtgtaacattggctttcantcattggaactgattctgaggatgcatcggcaagcggcgtgccgtntcacaacacaacatccggctatttgaaaaac

SEQ ID NO: 8969 - DNA, 195 bp, Mus musculus
  misc_feature (80)..(80): n is a, c, g, or t
  misc_feature (82)..(82): n is a, c, g, or t
  misc_feature (102)..(102): n is a, c, g, or t
  misc_feature (144)..(144): n is a, c, g, or t
  misc_feature (168)..(168): n is a, c, g, or t
aatcatgcaaagacgaggatgtagacaaagaagactcaatatagaagcaaggggaggtttcctcctgccatgatggcttntnccagttccagaagcacaganacctgaccagcaactgaaacctttgagacaaccgggagccanacaatggaaagttcggcttttaantcagacctccaagtcctgatatccact

SEQ ID NO: 8970 - DNA, 197 bp, Mus musculus
  misc_feature (49)..(49): n is a, c, g, or t
  misc_feature (60)..(60): n is a, c, g, or t
  misc_feature (78)..(78): n is a, c, g, or t
  misc_feature (129)..(129): n is a, c, g, or t
tggttcccgtgtttgggaccaggagggaaggagagaagatagatttcgntgagacacttncccgggtccctttgtggntcagaatgggtcccgatgagaacctgagtgtgagagtgaaactacggagtntcatttgtagctttgttcctcaagacttgccatgagatttaagtagagcgcctgtgtggaaattgtta

SEQ ID NO: 8971 - DNA, 203 bp, Mus musculus
  misc_feature (41)..(43): n is a, c, g, or t
  misc_feature (45)..(45): n is a, c, g, or t
  misc_feature (49)..(49): n is a, c, g, or t
  misc_feature (53)..(53): n is a, c, g, or t
  misc_feature (55)..(55): n is a, c, g, or t
  misc_feature (57)..(57): n is a, c, g, or t
  misc_feature (67)..(67): n is a, c, g, or t
  misc_feature (72)..(72): n is a, c, g, or t
  misc_feature (96)..(96): n is a, c, g, or t
  misc_feature (100)..(100): n is a, c, g, or t
  misc_feature (112)..(112): n is a, c, g, or t
  misc_feature (127)..(127): n is a, c, g, or t
  misc_feature (157)..(157): n is a, c, g, or t
atctcagccgaggagaagcagccctagatagcgcctgcctnnntngtgntgcnangngtgggggagngggantgtgtgttgggggggtggctgtgncctnatgatgggaagntgctcacagggcctntggcctgccccccgcccctccccggggacntcctgagggactgtgatcctattagcttgtgatgtatagagctttg

SEQ ID NO: 8972 - DNA, 127 bp, Mus musculus
  misc_feature (26)..(26): n is a, c, g, or t
  misc_feature (30)..(30): n is a, c, g, or t
  misc_feature (61)..(61): n is a, c, g, or t
  misc_feature (64)..(64): n is a, c, g, or t
  misc_feature (77)..(77): n is a, c, g, or t
caggatccagccagttggaagcaggnactntcccacagttgctgctccaagcgccagtctntantcaggtggcattntgacacatcgagggacagactggatgccattatttggcatgcaaatcatt

SEQ ID NO: 8973 - DNA, 129 bp, Mus musculus
  misc_feature (58)..(58): n is a, c, g, or t
  misc_feature (62)..(62): n is a, c, g, or t
  misc_feature (70)..(70): n is a, c, g, or t
  misc_feature (80)..(80): n is a, c, g, or t
tgttcccctgaggatcaacagtgaggcaagcagggctgcttttcaccgcaggaggaancaantgatggtntccatgcccntcctgacagctttttcttgaccagagtgccctggttttccagatgtgga

SEQ ID NO: 8974 - DNA, 187 bp, Mus musculus
  misc_feature (34)..(34): n is a, c, g, or t
  misc_feature (41)..(41): n is a, c, g, or t
  misc_feature (57)..(57): n is a, c, g, or t
  misc_feature (68)..(68): n is a, c, g, or t
  misc_feature (72)..(72): n is a, c, g, or t
  misc_feature (80)..(80): n is a, c, g, or t
  misc_feature (93)..(93): n is a, c, g, or t
  misc_feature (159)..(159): n is a, c, g, or t
ccaaacttgaacaggcggtctctatgccaaccantacacanccaatgacttaaaatnttcacattacntacnagaaggtnaccccttaacctngagccactcccagagcctgtttggtagacatggtgtggtcacaggatttgctgacactgaagtgtngtccaggtgttcttgtaatggcatagaa

SEQ ID NO: 8975 - DNA, 147 bp, Mus musculus
  misc_feature (47)..(48): n is a, c, g, or t
  misc_feature (57)..(57): n is a, c, g, or t
  misc_feature (77)..(77): n is a, c, g, or t
tctgtatgccggatagttgctctgcctggcccggctgtccctccctnnccacccctngaccaaatcagtgttttctnagaagggcacatgccctcaccctttgccctaaaattcctgggcaggcacaggctaccctcactgtacaag

SEQ ID NO: 8976 - DNA, 158 bp, Mus musculus
  misc_feature (105)..(105): n is a, c, g, or t
  misc_feature (133)..(133): n is a, c, g, or t
aaattacatcggtagcaactgataccagcgaaatcccaaatcacacacttgattcgctgacccaagagcatgaaaccagtgttttgagcagctttttagaagtantggattccctggactgcttacttttcanacatttttggcttgttcaagagaca

SEQ ID NO: 8977 - DNA, 51 bp, Mus musculus
aaaccaggcagtgcggtgctttacagaatgctcagactgcaagaaaacttt

SEQ ID NO: 8978 - DNA, 125 bp, Mus musculus
  misc_feature (32)..(32): n is a, c, g, or t
  misc_feature (37)..(37): n is a, c, g, or t
  misc_feature (86)..(86): n is a, c, g, or t
  misc_feature (93)..(93): n is a, c, g, or t
tctgacatggcctaagttggtgtttcacgttntcatnatcattttgggcctggcgaacctgattgttcagtttttcatgtgaaaanttttttntcaagatttctcgtggtattttgaaccttggc

SEQ ID NO: 8979 - DNA, 134 bp, Mus musculus
  misc_feature (34)..(34): n is a, c, g, or t
  misc_feature (36)..(36): n is a, c, g, or t
tggtttaccggcacatttggtaactttacagaantntgctattaaacataccgccccgtcttaggaaggacccagcatccaagccctttgtcctcagcgaggtgatttttgattcccctacatttcatgtttgg

SEQ ID NO: 8980 - DNA, 135 bp, Mus musculus
  misc_feature (88)..(88): n is a, c, g, or t
ggctaccgccggaacactccagccttccgccagcacacatcggtgtttggagaagtcacaccatttcccattttctgaagacattgcntcacaaggcttgacctgctttttcaagacagatgtttagatgaactt

SEQ ID NO: 8981 - DNA, 90 bp, Mus musculus
  misc_feature (54)..(54): n is a, c, g, or t
ccaagtttgggtgggccttctggtggtaaacatgcctttttttcccccttaaantcattgctgtaccttgtatgtaaccccacgtcaata

SEQ ID NO: 8982 - DNA, 71 bp, Mus musculus
  misc_feature (31)..(31): n is a, c, g, or t
  misc_feature (36)..(36): n is a, c, g, or t
acaacacttacagaggagctagggtttgganatcantggctggtcacgtcatggacaattccaattccaga

SEQ ID NO: 8983 - DNA, 120 bp, Mus musculus
  misc_feature (58)..(58): n is a, c, g, or t
taagggttattggagctgattgcaggagctttgtggatccaaaagagagttccaaacnttttcatagatcgaataaatccattcactgcatgtgcattttcaagtgggtagacactgtta

SEQ ID NO: 8984 - DNA, 117 bp, Mus musculus
  misc_feature (29)..(29): n is a, c, g, or t
  misc_feature (34)..(35): n is a, c, g, or t
  misc_feature (41)..(43): n is a, c, g, or t
  misc_feature (48)..(48): n is a, c, g, or t
  misc_feature (50)..(50): n is a, c, g, or t
  misc_feature (55)..(57): n is a, c, g, or t
  misc_feature (91)..(91): n is a, c, g, or t
cctcacattgaacttccaggccagacctnggaanntccctnnnagctntntattnnngtggacacactgttctcacagactacatgcatantgtgctacctttgatgttcgctttct

SEQ ID NO: 8985 - DNA, 95 bp, Mus musculus
tgagcctttccctcctgccaggacctcccccacccctgaaaggctggctccccttttcctgactcggtgtatggatctgtggtcatttcctctgc

SEQ ID NO: 8986 - DNA, 40 bp, Mus musculus
cagatgtacctgagctttcttatttctgtacccaatcctt

SEQ ID NO: 8987 - DNA, 40 bp, Mus musculus
tgtgcgcactcacaggatcttgctatcactgtaaccaact

SEQ ID NO: 8988 - DNA, 234 bp, Mus musculus
aaagggataagacccaagtctgtgttgacatggaagctggagggaaaaggttcaacctagagaaatccaaagtcgtgggggaccttggagaaggggacgcaggtcttgggttttccctggtcagtcaaaagacacgccaggatggagagcaggagaagaggctcctgcacagaccactccagggctcctcacaacagggtcacacctttcatcttgaggatgcctgtccacaca

SEQ ID NO: 8989 - DNA, 486 bp, Mus musculus
  misc_feature (43)..(43): n is a, c, g, or t
  misc_feature (48)..(48): n is a, c, g, or t
  misc_feature (95)..(95): n is a, c, g, or t
  misc_feature (279)..(279): n is a, c, g, or t
  misc_feature (399)..(399): n is a, c, g, or t
aacagggtcacacctttcatcttgaggatgcctgtccacacantcccngggagtcccctgagctccagttcccagacccacctccagaagtcttnatggagacagactctgagcaggacatggaagacagtcaaagcgaggaatccattgtcccagatcgtcctctgagaagtcagtgatggcctccttattaactgctccccatattgtagacagtaagctccggcctcgctcccggcagcttggctctgtctcaatattaggcaactcccgccattnccctcggcactgtcctaggttggcttatgccactcaccacagaaacctaccctagctcccagggtttacttcagaaatgctcttctggtattggagaccgccctgcatggtgacagtttntaggctccccaacctctgtatccctttaagagcacagcattgtcattttctttgatgaacaggtagggactgcactacccaaaatgt

SEQ ID NO: 8990 - DNA, 324 bp, Mus musculus
agatacagcagaatccagggcaggaagaagaacagatgtgaatccattcttggctccccgctcagcagctgtgccccttattaacccagctggacatggacctggtgggcctgggcatcttcttttgaaacccatctcagatgttctacccacgtttacacctttgccagtgtcacctgacaacagtgcaggtgttgtattgaaagaccttctaaagcaataggtagctttcaaggctgagacttagtagcactttaaagaaaccatgaacactgtatgtgtgtgaactttatcacaaagtggccttctagaaagagtcattta

SEQ ID NO: 8991 - DNA, 487 bp, Mus musculus
  misc_feature (208)..(208): n is a, c, g, or t
  misc_feature (226)..(226): n is a, c, g, or t
aaaggattcagcttgctttggattgacaccaaagtcgctgccagaatagtgtggaggctactgcatggtaatgcgctaaccagacgagagaggcgaaggctgttgagaacgtgtgccgatgtcttccgcttggttccatttatggtgttcataattgtaccttttatggagttcttgataccagtgtttctgaagctcttcccagacntgttgccatcaacttttngaaagtgaatccaaaaaggaagaaaaacagaaaaaaacgatggctgccaaactggaaatagcaaaattccttcaagaaacaatgacagagatggcgaggagaaaccgagcgaagctgggagatgcatcttcccagctttcctcctatgtgaaacaggtgatggggctcgtcccaggccagcgacttctgggctggagttacaaaaacatgtcattgtgggctatccagattgttcagaatctctgaaatgccacatcctaa

SEQ ID NO: 8992 - DNA, 391 bp, Mus musculus
  misc_feature (267)..(267): n is a, c, g, or t
agagaggattcctctacagcctcgcttccgaacccctcaccccagtggcctgcagacctcagtctctccctctgaatgacaggtctccaaagaacagttgactgaaggatggggcaggcagggagaggcttgctctcctcattttgctcaggagttgcttgggcatccccatctcctcttcccacgaagaggaccctaatctggctttttcccccaagaagggcatgaggtagtcttcatgtctgtgcccatgaaggatgaaggatnctccttcccaaccctttgtcaccatgattttccagggccagactctgccaaaatgcagagagagccagattctcacccagggagaggcagatcagagagaaccactggtgcgaaagctgcctgt

SEQ ID NO: 8993 - DNA, 505 bp, Mus musculus
  misc_feature (113)..(113): n is a, c, g, or t
  misc_feature (132)..(133): n is a, c, g, or t
  misc_feature (334)..(334): n is a, c, g, or t
  misc_feature (365)..(365): n is a, c, g, or t
cacggttctcctttcattaatgcaattattcataaagggtttgatgagcgacatgcgtacattggagggatgtttggagctggaatttactttgctgaaaactcctcaaaaancaatcagtatgtttatggnnattggaggaggaacaggctgtcccacacacaaagacagatcatgttatatatgtcacagacaaatgcttttctgtagagtgacccttggaaagtccttcctgcaattcagcaccatgaaaatggcccatgcacccccaggccatcactcagtcatcggtagaccaagtgtcaatgggctggcatatgctgaatatgtcatntacagaggggaacaggcatatccagaatatntcatcacctaccagatcatgaagccagaagccccttcacagaccgcaacggcagcagagcagaagacctagtgaccacccctggtaaaggccagagtgattcaaacctgcaactggagtacagtggattgcttccaacaa

SEQ ID NO: 8994 - DNA, 331 bp, Mus musculus
gccaaccatcatcgaggcattcgttcattcattaatcctccccttaacagacctgtgtgtagtacctgctgtgctaagtcctgtttgggacaccaacacaagagggtgcaatgacattattgacactttgccctgccaccaccaccaccaggaaagaactactgaattccccaccttctcagcctgtgaatgtcgaaggccctaaaacagaacacacatttgtatcaagatttttgactctgttcctgtgacctgcctgtcaccttgccctcaagtttgcaactgcctttttcaggccctctctattttcgcaagaagagtgagtcctgct

SEQ ID NO: 8995 - DNA, 368 bp, Mus musculus
cctctctgtctggattttgcggatagctacattgactccttgtgtaatctgtgggctacttgtgtcttgaaatgtagaatcatttcattcaggattgttactatttgttgggaagaaaaaatgaaatagaagcaacctagtcttacatcgtgtcttgttaccatttaagattgacatttaatttttcaagtcattgttggtgcctaatcacttaagttattaatttattctgttttcaaaaaattgtaacatatttatcttgtgaagtctgggggtggggtgggaaatgtgttcaagtgagtcctgtttcacagtggtaacaaatggtacaggcctggagcttgcaggtccctttttattatggtgta

SEQ ID NO: 8996 - DNA, 360 bp, Mus musculus
  misc_feature (333)..(333): n is a, c, g, or t
atcttttacaaaggctgctaatgggttgtgagagcgtttgtcagcattcatcattgattgtcttggctaaaattccttatctaaaaaagctgttctttttcagcagtactggggattaaacccagggcctgtgtatgctaagcaagtgctctaatactgagctatgtcctcagtcacctacccacttttcccctttaagttcttggtgccgattccagaccagcccttgactctactacttaaactgacatgatctggctctaaactctgacctctcttaagaatggagataaggacttgttttagagtctctttgggcaaatatagctggantcattccatctagggtctcaacttaat

SEQ ID NO: 8997 - DNA, 215 bp, Mus musculus
ctctcttattgaactccagccagagcagtattcaatgtatgtcagagggtgattttgaggattttccaaccttcggccactcccagaccgactttgacaccctcgtccaccctttctacgctcactggcagagtttctgcacaccaaagaatttttcctggaaggaagaatatgttacccgccaagcctcgaaccactgggaaaaacgagccatg

SEQ ID NO: 8998 - DNA, 173 bp, Mus musculus
accaagaggagcgtctgatcatggcctaagttggtgtttcacgttattatatttttttacccccatccccccccccactaaaatcatcattttgggcctggcgaacctgtttgttcagtttttcatgtgaaaactcttttttcaagatttcttgtggtattctgaaccttggc

SEQ ID NO: 8999 - DNA, 508 bp, Mus musculus
  misc_feature (271)..(271): n is a, c, g, or t
  misc_feature (296)..(296): n is a, c, g, or t
  misc_feature (304)..(304): n is a, c, g, or t
  misc_feature (313)..(313): n is a, c, g, or t
  misc_feature (318)..(318): n is a, c, g, or t
  misc_feature (331)..(331): n is a, c, g, or t
  misc_feature (333)..(333): n is a, c, g, or t
  misc_feature (351)..(351): n is a, c, g, or t
  misc_feature (354)..(354): n is a, c, g, or t
  misc_feature (364)..(364): n is a, c, g, or t
  misc_feature (368)..(368): n is a, c, g, or t
  misc_feature (374)..(374): n is a, c, g, or t
  misc_feature (389)..(390): n is a, c, g, or t
  misc_feature (419)..(419): n is a, c, g, or t
  misc_feature (421)..(421): n is a, c, g, or t
  misc_feature (424)..(424): n is a, c, g, or t
  misc_feature (435)..(435): n is a, c, g, or t
  misc_feature (443)..(443): n is a, c, g, or t
  misc_feature (457)..(457): n is a, c, g, or t
  misc_feature (477)..(477): n is a, c, g, or t
  misc_feature (483)..(483): n is a, c, g, or t
gatgaagacgactatcccaacggctacctagtggtgctgcctgacagtagtcctgctgccgtccctgttgtctcctctgctcctgtgcctagcaaccctgaccttggagacagtgccttctctgtggagtcgtgtgaagattacgtgaatgttcctgagagtgaggagagcgcagaggcgtctctggatgggagccgggagtatgtgaatgtgtccccagagcagcagccagtgaccagggctgagctggcctctgtgaactcccaggagntggaagacgaaggagaagaggaagnggtggatngagaggaanctccngactatgagaatntncaggagcttaactgaaanccnactgcagctntctntcctgnaactggacttgctgnngggtgtcgctaagaggatcccatttgacntnctnccttgccacancctgagantcttcccctaactnattgtcactttggggtccantctgtntccccaatattctgtaccttctgat

SEQ ID NO: 9000 - DNA, 328 bp, Mus musculus
  misc_feature (237)..(237): n is a, c, g, or t
  misc_feature (242)..(242): n is a, c, g, or t
  misc_feature (246)..(246): n is a, c, g, or t
  misc_feature (284)..(284): n is a, c, g, or t
  misc_feature (298)..(298): n is a, c, g, or t
  misc_feature (301)..(301): n is a, c, g, or t
aacacccttttctcagtgaaactagaggaagagctgtcggtggaagggagcacagacgttaatgccgacttgaaagactgagagaacagtattcttttcagccacaccaccggtatttcctaacaacatgagaagtccaccttgtgttcactcagacaaaccttcattgtttattgtttggccaatgaatcttcggaaacttgcacaaacaggaaggaagttggaaggacaggacangccangcanctcaaggttttactgtgttttacaaaactgcttggcanccccgggtgaagcntcnaaggactgtttggtagaatttgtgttc

SEQ ID NO: 9001 - DNA, 461 bp, Mus musculus
  misc_feature (270)..(270): n is a, c, g, or t
  misc_feature (300)..(300): n is a, c, g, or t
  misc_feature (305)..(305): n is a, c, g, or t
  misc_feature (334)..(334): n is a, c, g, or t
  misc_feature (336)..(336): n is a, c, g, or t
  misc_feature (338)..(338): n is a, c, g, or t
  misc_feature (342)..(342): n is a, c, g, or t
  misc_feature (344)..(344): n is a, c, g, or t
ttatttatttgtagctcctgcagcatcatgtcataattaagttttttggagatttctgttaaatgtaatgttgctttcccatcctgatttcctttctatttataactgtattttgatgggcagtaaaacaaagtgtcttaaaagttttaaatagagaaaaatgtgctttacacagttgcctataaaaagtctatgttatccaagcaattcactctagaagcttcggtctcgttgttgtatgcaatttttactatcatgcaaataagcttnaggtaaataaaactaatagatcaccttagnaaatnatgcaattaatgtgaaaataattgatgtntncnatgntntcttcctttggtttacaatcaattttaaagcgacatctgtataaagtttctgtataaaggtgtatttcttttttatgagtttatggctatgaaaacaccagctattttgttacagct

SEQ ID NO: 9002 - DNA, 545 bp, Mus musculus
  misc_feature (278)..(278): n is a, c, g, or t
  misc_feature (281)..(281): n is a, c, g, or t
  misc_feature (286)..(286): n is a, c, g, or t
  misc_feature (308)..(308): n is a, c, g, or t
  misc_feature (310)..(310): n is a, c, g, or t
  misc_feature (316)..(316): n is a, c, g, or t
  misc_feature (318)..(318): n is a, c, g, or t
  misc_feature (320)..(320): n is a, c, g, or t
  misc_feature (329)..(329): n is a, c, g, or t
  misc_feature (344)..(344): n is a, c, g, or t
  misc_feature (371)..(371): n is a, c, g, or t
  misc_feature (373)..(373): n is a, c, g, or t
  misc_feature (375)..(375): n is a, c, g, or t
  misc_feature (390)..(390): n is a, c, g, or t
  misc_feature (392)..(392): n is a, c, g, or t
  misc_feature (394)..(394): n is a, c, g, or t
  misc_feature (412)..(412): n is a, c, g, or t
  misc_feature (419)..(420): n is a, c, g, or t
  misc_feature (515)..(515): n is a, c, g, or t
gtgggatcaaaacccagccctttgacagtcccatcacaggaactgcatcctggcatttttcttcactgtagaagagaaaacagctgtttggaaggaggaagttcctagacgtgggactcagtgcctgttctgcctgcttgttctcaatttatcttcattgccaactagaagttctttgtcacggattagtataaatgtaggcaaatgattactgtcctttgtaggtagtgatattctgtatggtaaatgtcaggggaatgtggctttccatgctgganccnccttntcccagataagaacctggcttnanattctntntnttcattctngactggcacctactncatagaactcttcacatcctgactctntntntcctgagttttagtntntnggtagttgaacttcattntcagccnnacctgaatttagaatcacatggaaacataaccctggactgactgactacctttgagcacgttttcagtaaagttatactgaagaggaaagacccncctgaaatggtggtaacacccattactgaa

SEQ ID NO: 9003 - DNA, 553 bp, Mus musculus
gtccctgctggttcaaaccaaccatacggcaaagatgtcctgtgaggttaaaagcatctctaagttaacaagcatctactggctgcgggagcgccaggaccccaaggacaagtactttgagttcctggcctcctggagttcttccaaaggagttttgtatggtgaaagtgtggacaagaaaagaaatataattcttgagtcttcagactcaagccggccctttctcagtatcatgaatgtgaagccagaggacagtgacttctacttctgcgcgacggttgggaggagagcccgaattcacttcatgaaacagtttcacaaatgatcagcgcccacaacactgatagcctgctagaataaaaggactgtaactcaatcaaagcaagatctggactagtgagagacagcgcattcaggactggagaggcccttgcccttgctcaagctgcctgctttgaactgctgcaagctctgtgtgtggtttggggtctcacaaggaaggcctcagaacccaagctcacgcacagagtggctgaagaaccaagaactccca

SEQ ID NO: 9004 - DNA, 559 bp, Mus musculus
  misc_feature (315)..(315): n is a, c, g, or t
  misc_feature (355)..(355): n is a, c, g, or t
  misc_feature (380)..(380): n is a, c, g, or t
  misc_feature (425)..(425): n is a, c, g, or t
  misc_feature (430)..(430): n is a, c, g, or t
  misc_feature (462)..(462): n is a, c, g, or t
  misc_feature (490)..(490): n is a, c, g, or t
  misc_feature (519)..(519): n is a, c, g, or t
taagtcacgtggcatttaggctggcttgaggctcaaatgcatcacttccaactgtaatcactgtgtccagataaaactctgtcattcagaaaatgaacttcctcaactggtccacaatcatctctgtttattctcttttgggaaaccttaattaagagacgatttctgggacatccaatctggaagataaacactggaaccgagagaagtctgtggtgtggtttaggagactggcccccatacggtggtattggctctcttaacctcacatgcacgaaggctttgatggacgcgtgtgcactgcttactccagtntcctgcttgggaagatgggattctcttctgctggtttctntcttacattttttttgtaaatggtnccctgtgttcacagaaaggttttggtttgaaatgtattttgtagnccttncaattcataatgtttggaactatgtatttatncctagatcaggagagtatttattgcttntcttcatgataaaaaatactgcaggtatntcttaccctctgtgggggccacaagtcaatcattgcttat

SEQ ID NO: 9005 - DNA, 363 bp, Mus musculus
cttcacatacaggagcgacagttttgagaatccagtcctgcagcagcacttccgcaacctggaggccctagctttggacatgatggagtcggagcaagtggtagatctgacactacccaaggttgaagccataaagaaaagactgggttccctggcagatgagtttaaagaacttgtctatcctccaggttataatcccgagggaaaagttgccaagagaaaacaagatgatgaaggttctacgagtaaaaagcccaaggtagagttatcagaagaagagctgaaggcccattttcgtaagggcacactgggtaagctcactgtacctacactgaaggacatatgcaaggctcatgggcttaa

SEQ ID NO: 9006 - DNA, 535 bp, Mus musculus
  misc_feature (319)..(319): n is a, c, g, or t
  misc_feature (344)..(344): n is a, c, g, or t
  misc_feature (450)..(452): n is a, c, g, or t
  misc_feature (489)..(489): n is a, c, g, or t
gacagaagcttctatggcaggataaagtctgtgtggcttgacccaaactcaagcttaatacatttattgacttgattggggaagttagagtagagcaatcaaaaagatcattcattcagccttgggaagtcaatttgcaggctcctggatgagccctgccccgttttcacttgccagcacatttcagtcatgtggtgtgatagccaaagatgttttggacagagaagaaaggatagaaaaaccttctctttggctaagttggtgtttggggtggggataggttagagtatagtacttaactatttgaaaaataatgaanacacttttttcactcatgaaatganccacttagctcctaaatagtgttttcctgttagtttagaaagttgtggacatatttttttaatgatttctgaccatttttaatcacattgactcatggaatggccnnntcaaagcaccccccagtgcttctttcctcattcccgntcatgggaactcagtattattaatagtcacaacatgatttcagaac

SEQ ID NO: 9007 - DNA, 451 bp, Mus musculus
  misc_feature (42)..(42): n is a, c, g, or t
  misc_feature (212)..(213): n is a, c, g, or t
  misc_feature (227)..(228): n is a, c, g, or t
  misc_feature (232)..(232): n is a, c, g, or t
  misc_feature (240)..(240): n is a, c, g, or t
  misc_feature (242)..(242): n is a, c, g, or t
  misc_feature (245)..(245): n is a, c, g, or t
  misc_feature (248)..(249): n is a, c, g, or t
  misc_feature (252)..(254): n is a, c, g, or t
  misc_feature (256)..(256): n is a, c, g, or t
  misc_feature (258)..(258): n is a, c, g, or t
  misc_feature (261)..(264): n is a, c, g, or t
  misc_feature (269)..(270): n is a, c, g, or t
  misc_feature (272)..(272): n is a, c, g, or t
  misc_feature (275)..(277): n is a, c, g, or t
  misc_feature (279)..(279): n is a, c, g, or t
  misc_feature (305)..(305): n is a, c, g, or t
  misc_feature (320)..(320): n is a, c, g, or t
  misc_feature (325)..(325): n is a, c, g, or t
  misc_feature (328)..(333): n is a, c, g, or t
  misc_feature (359)..(359): n is a, c, g, or t
  misc_feature (371)..(371): n is a, c, g, or t
  misc_feature (377)..(377): n is a, c, g, or t
acagggtcttcacttactcagcgagtgattattggccgcagnttatcagagtaaggaactgtgctaggtatgggagagccagagattaaagtcataggccctaacccccaaaagctatcagttggacttcaacatagctagagcctgtgttctgtgcttccaagggagttctgaagaaggccacacaaacattgggacttctttttgacacnnttacggagtttttnncaangtgtaaancnaantannaannngnanggnnnnatttnntnaannntncatgagtaaatccagcttttattgtnaggtgggactttatnagatnccnnnnnntgggagatgtggggtgaaggctatgncctcagctcctncccctnatcatcttaggaacaacttatttttcctgtgagggttgtagacgttcctaaatcttcttgagtgcattatgtat

SEQ ID NO: 9008 - DNA, 496 bp, Mus musculus
gaaaccattcctatgaaagctatgcatttagtcatcagatgtgatcactgctggccaatttaactacatatagaatctgcatatagaatctgtactcctatgaggaccatgtagcccaggataggttgtacgggattctctcaggttaatatggtaggaaacccatcctaagtgtgggcagcaccattcctgtggactgaagacacagtagaaagatgaaagcaatctccctaccacttgtggcttcaactgtggatgccatacaacaagccagccttgacttctctcagaatgcattatccagccttgaccgaatgtatcatcatgatacatggagctcaacaaaccattcattaagttggttttgtgagggtatttcatcacagcaagaggaaaagtcactgatatcataatagtgataatcctggaaactacttaatcatccctgagttagattggcaataaattttaatatgacttgttcttggagtactgt

SEQ ID NO: 9009 - DNA, 384 bp, Mus musculus
tacaagcgtgaggagtgccaccctaggtcatcccaggatggtgatgatgcccagaaagaccaacaattaagttaattactcagagtaagcaccagctggaggatgggaggagtctgctgaagtgccgtcttctaggcatgccagtgccaatgaactcactgaagctacagtttcctgtacaagaccagacccaccaacgtctcagcatgtatgaggaaggaactactgcgctaaaggccctcccactcaccaaggagctattggctattgatgattgctgagggaagggagtaattttttttctctttctgaagtgtgacttgagtaaattgcccatagttcagtatataatccccaacctgtgctcaggcaagcaaccctaat

SEQ ID NO: 9010 - DNA, 380 bp, Mus musculus
  misc_feature (340)..(340): n is a, c, g, or t
  misc_feature (351)..(351): n is a, c, g, or t
  misc_feature (354)..(354): n is a, c, g, or t
tgtcatgtccgctagttgcagaacaaactgtgggaacgtgagcaacgcaggctggcaggtcaagttctgagagctcaggctgcctgctgtccacttcatcagatgttaactcatggccttcaaaggaagaggagactgacgactggctgaggacttccatatacactcaacgtgcaaacgattgctgctggtattctgtacaaactaatcaaagactaatacacacattagctggttaatggtgcataattccgtcatgtctgctaggtatgcctttctagcttagctagtgacatgaattcatcaaggtaagattttctcctaccactgaataccactntgtagattacnatntccctgattcggattagttttgtact

SEQ ID NO: 9011 - DNA, 486 bp, Mus musculus
  misc_feature (290)..(290): n is a, c, g, or t
  misc_feature (326)..(326): n is a, c, g, or t
  misc_feature (368)..(368): n is a, c, g, or t
  misc_feature (374)..(374): n is a, c, g, or t
  misc_feature (380)..(380): n is a, c, g, or t
  misc_feature (404)..(404): n is a, c, g, or t
  misc_feature (411)..(411): n is a, c, g, or t
tttgtaaacaatcaccgtccctaagacaatgaaactcagaactctgtgattcctgtggaaatatttaaaactgaaatgattagtgacacactattttgttgatgtaatttccatttgaacatctggaatatacttttactagtagtgtcaaaataaatatggtgactgttttattcagtgtttcatatttatactttagagtatttttgtacaagatccagatttattttgcttgaggtgtttatgctatcataaagttgtaaataattttctaagactgttttaatgcnatctacagttttcctaaaatatttttcttgaggccntcttttaactatcactaggagttgtctctctcaaataaactnaaatcncaatanccatgtgaccacacgattagtgantcattgngctgcttccgtggctgaatccttgcatgtgcaaaagcatctcttaaattaggtttgaatttgtaattccccaatg

SEQ ID NO: 9012 - DNA, 252 bp, Mus musculus
  misc_feature (36)..(36): n is a, c, g, or t
aagagtacaacttccttggattgctgcccctacccnaagaatattgtttggaaaccttttgtttttctgtgcccagtgactaggctggctttgtttctacgttaatgtcacccaaaagaagacaggacaggagaaagagatgctgggactggtgttgggactggtggtgtttttagtaattaaagactaggcttatctctcagccagatatgcccaacactccttaatgtacctccagagccatcagcatgg

SEQ ID NO: 9013 - DNA, 435 bp, Mus musculus
  misc_feature (57)..(57): n is a, c, g, or t
  misc_feature (298)..(298): n is a, c, g, or t
  misc_feature (351)..(356): n is a, c, g, or t
ggcaacaatgccaaagaccctcgaggcacgtatcagtgtcaaggagcaaaggagacntcaaaccccctgcaagtgtattacagaatgtgtgaaaactgcattgagctaaacataggcaccatatccggctttatcttcgctgaggtcatcagcatcttcttccttgctcttggtgtatatctcattgcgggacaggatggagttcgccagtcaagagcttcagacaagcagactctgttgcaaaatgaacagctgtaccagcccctcaaggaccgggaatatgaccagtacagccatntccaaggaaaccaactgaggaagaagtgaactcagcaggactcagggtgtccnnnnnnccccttctatccagcacccagaatcaaaacaatgcattttggagagagcccagtagagagattttcaaccctacaggta

SEQ ID NO: 9014 - DNA, 404 bp, Mus musculus
  misc_feature (351)..(351): n is a, c, g, or t
  misc_feature (354)..(354): n is a, c, g, or t
  misc_feature (367)..(367): n is a, c, g, or t
  misc_feature (369)..(369): n is a, c, g, or t
  misc_feature (372)..(372): n is a, c, g, or t
  misc_feature (379)..(379): n is a, c, g, or t
aaggttacatctacacatatcgagtgtcccagacagaaacaggttcttggagtgccgagacagcacctggagtacataaaagatttttccggaaagtaaaaaatctcatctcagcgtttcagaagccggatcaaggcatcgtgacgcctctgcagtatccagttgaaaagtcctctggcaggggcccacaagctcccacagggagaagagattctgatatctgcctgaatgcaccatgaagaagagtaactcactctgtactctattttcaataatttaagtatgtgccaagtcttgtatattgtagatagtacagttcagcgagctgcaaatgccttttaagcacgactntantcctgtaatagcntntcncctgatntcaaagctgcaagtggacgtggtag

SEQ ID NO: 9015 - DNA, 531 bp, Mus musculus
  misc_feature (32)..(32): n is a, c, g, or t
  misc_feature (240)..(240): n is a, c, g, or t
  misc_feature (265)..(265): n is a, c, g, or t
  misc_feature (281)..(281): n is a, c, g, or t
  misc_feature (296)..(296): n is a, c, g, or t
  misc_feature (303)..(303): n is a, c, g, or t
  misc_feature (306)..(306): n is a, c, g, or t
  misc_feature (309)..(309): n is a, c, g, or t
  misc_feature (317)..(317): n is a, c, g, or t
  misc_feature (321)..(321): n is a, c, g, or t
  misc_feature (329)..(329): n is a, c, g, or t
  misc_feature (332)..(332): n is a, c, g, or t
  misc_feature (456)..(456): n is a, c, g, or t
  misc_feature (487)..(487): n is a, c, g, or t
tgatcatcatgctggcagtctgtcttcttacncaaacggatgggaaacccgtgaggaagagagctgtcagtgaaatacagcttatgcacaacctgggcaaacacctggcctccatggagaggatgcaatggctgagaaggaagctgcaagatatgcacaattttgttagtcttggagtccaaatggctgccagagatggcagtcaccagaagcccaccaagaaggaggaaaatgtccttnttgatggcaatccaaaaagtcttgntgagggagacaaagcntgatgtggatgtatnagttaantcnaantctcagtnaatnctgatttnttntagacagtgcagggcactgacatatgctgctaccttttcaagcttatgaagatcaccaagtgctaatacttctactgtaatgaaactttggaatttttttgattacatttttgctcatttaagntctctttcaatgattccatttcaatatgctnttctttttaaagtactactcatttccacttctctccttaaatat

SEQ ID NO: 9016 - DNA, 570 bp, Mus musculus
  misc_feature (48)..(48): n is a, c, g, or t
  misc_feature (112)..(112): n is a, c, g, or t
  misc_feature (144)..(144): n is a, c, g, or t
  misc_feature (201)..(201): n is a, c, g, or t
  misc_feature (391)..(391): n is a, c, g, or t
  misc_feature (476)..(476): n is a, c, g, or t
  misc_feature (480)..(480): n is a, c, g, or t
  misc_feature (532)..(532): n is a, c, g, or t
gagccaagccactacatggaacacagggatgaataccacacagatctntggagctagttccaggccctcggtatacacacacacacacacacacacacacactggagcgcancccctggcagagatcttgagaggatggaggangccattctggtttcaaatccctccttgatcactgctgttctcacccccccctccttncccccaaaaccctagttctcttagagtgaggctgggagagatgcacagagacctgccgcagtgtgtgcagagcctgggaagtggaccatgctggggtcctttatggagagagcattgtggcaggtggctgtgccttccatccaggaggtcaggggtctaagggctctccctgagagtcttgatctgtttntcatagatccacagcctcctctgcctctgtcgtttgcctgcttcagcacttccttccccttttttcctcttttcttcccagctgncctnttctagaaacatcccttccccacttctcttcattattcacttcttatttttncccactccccactcctgcttcctgagctgacagaaaaa

SEQ ID NO: 9017 - DNA, 454 bp, Mus musculus
ttgtccgttcagaccaatggcggttaatgacctttgagaccactgagaatgacaaagtgaagaagataaatgaacatattaggtcccaaaccaaggtctctgtacaggaccagatccttctgctagactccaaaatcctcaagccccatcgaaaattgtcatcctatgggattgacaaggaaaccactatccaccttaccctgaaggtggtgaagcccagtgatgaagagctgcccttgtttctggtggagtccaaaaacgaggggcaaaggcacctcctccgagttcgaagatccagctcagtggcccaggtgaaagagatgatcgagagtgtgacctctgtgatccctaagaagcaggttgtgaattgcaacggaaagaagctggaagatggaaagatcatggctgactacaacatcaagagtggcagtttgctctttctgacaacacactg

SEQ ID NO: 9018 - DNA, 448 bp, Mus musculus
  misc_feature (291)..(292): n is a, c, g, or t
  misc_feature (297)..(299): n is a, c, g, or t
  misc_feature (301)..(301): n is a, c, g, or t
  misc_feature (306)..(315): n is a, c, g, or t
  misc_feature (321)..(324): n is a, c, g, or t
  misc_feature (331)..(331): n is a, c, g, or t
  misc_feature (333)..(337): n is a, c, g, or t
  misc_feature (341)..(341): n is a, c, g, or t
tggtccagctcctggcacaggttgttcaggcttttcctcagactcacctggtttcttctcagacccagctgtctcttcctcagtccaaagttctgtactttctgcagcaagtagcacccttccttccacaagatatgtctgtccaagaccttctgcagtacctagaacttcttaaccccaccgtccaattccctgccactccacaacattccgtttctgtctaagaggatttccaggttattttctcctccttatgttttttgaactgactgaaactggaaatgtacaaannttttnnncnttggnnnnnnnnnnaaaaannnnatatttntnnnnnaatntacatggaagaaaagaaaatgtattcttttatttattctatgtattatatggcattcatttgaattcgacccatggactctatatgcttctcagttatattacagga

SEQ ID NO: 9019 - DNA, 539 bp, Mus musculus
  misc_feature (327)..(327): n is a, c, g, or t
  misc_feature (335)..(335): n is a, c, g, or t
  misc_feature (395)..(395): n is a, c, g, or t
  misc_feature (398)..(398): n is a, c, g, or t
ggattaccaagtggccaccagtgcacacactccgcagctgtgactcagccttgtgtagggtcccaaagaagcaagccttagaaccgagcaggtgaatcttagagagtcagccaaggacagtgcagagtcacgggttgggaggtatgtgggctagggtatgtggtttcctcagtcctaaacgtctgtgtggccaactcagcatctgcttccagaagtttcccacttgcagatgttcagtgcagttacagacatgcgtttgattccacagttttgtttcatttcaaaagaattcccctcacaggaggatggctgagcatcaaaggaggncaaccatntataacttggtgtcattgacaactatattaatgtttatccagctgccgtagtttgaaacnttntgggctgggagaagagggaccccggggtttctaatttcaaccccaaatgacatgtttatttgcacctgatgctcaggagccagatgtggaccctgcagagccaggcttgtaccacagctcagaggcgtcaagtttccaatt

SEQ ID NO: 9020 - DNA, 544 bp, Mus musculus
  misc_feature (284)..(284): n is a, c, g, or t
  misc_feature (287)..(287): n is a, c, g, or t
  misc_feature (303)..(304): n is a, c, g, or t
  misc_feature (354)..(354): n is a, c, g, or t
  misc_feature (361)..(361): n is a, c, g, or t
  misc_feature (366)..(367): n is a, c, g, or t
  misc_feature (378)..(378): n is a, c, g, or t
  misc_feature (380)..(380): n is a, c, g, or t
  misc_feature (383)..(383): n is a, c, g, or t
  misc_feature (395)..(395): n is a, c, g, or t
  misc_feature (399)..(399): n is a, c, g, or t
  misc_feature (402)..(402): n is a, c, g, or t
  misc_feature (406)..(406): n is a, c, g, or t
  misc_feature (412)..(412): n is a, c, g, or t
  misc_feature (438)..(438): n is a, c, g, or t
  misc_feature (459)..(459): n is a, c, g, or t
  misc_feature (480)..(480): n is a, c, g, or t
gctttgaacatgtcttctctggcgaagtgaagaaaggcaaggtcactggctttcataactggatccgcttctacctgcaggagaaggagggtctgctggactactacagtcacaactacgacgggccctgggactcctaccccgatgtcctggccatgcagttcaattgggatggctactacaaagaagtgggctcggtcttcattggcagcagccctgagttcgagtttgccctttactctctgtgcttcatcaccaggccaggcaaaaagtgccatctgagnccngggtggctatcctctnnccatccagacctacacctgggataagaccacctacggaaatggcaagaantacattnccacnncctacgtggtntnttnttcccaatagancctncanccanctgggntcctgagggcagagggacaagcaggntcctggtgctatttgctcctnactggggaggggagggaggantctgggaggaatcccagagctcagttttgtaaaaggaatctcgaatctagaaatgcccacttgg

SEQ ID NO: 9021 - DNA, 322 bp, Mus musculus
agagctttggtctgctggatcccaaactctgctacttgctagatggaatcctcttcatctacggagtcatcatcacagccctgtacctgagagcaaaattcagcaggagtgcagagactgctgccaacctgcaggaccccaaccagctctacaatgagctcaatctagggcgaagagaggaatatgacgtcttggagaagaagcgggctcgggatccagagatgggaggcaaacagcagaggaggaggaacccccaggaaggcgtatacaatgcactgcagaaagacaagatggcagaagcctacagtgagatcggcacaaa

SEQ ID NO: 9022 - DNA, 479 bp, Mus musculus
  misc_feature (229)..(229): n is a, c, g, or t
  misc_feature (248)..(248): n is a, c, g, or t
  misc_feature (251)..(251): n is a, c, g, or t
  misc_feature (260)..(260): n is a, c, g, or t
  misc_feature (271)..(271): n is a, c, g, or t
  misc_feature (286)..(286): n is a, c, g, or t
  misc_feature (291)..(292): n is a, c, g, or t
  misc_feature (315)..(315): n is a, c, g, or t
  misc_feature (326)..(326): n is a, c, g, or t
  misc_feature (361)..(361): n is a, c, g, or t
  misc_feature (363)..(363): n is a, c, g, or t
  misc_feature (365)..(365): n is a, c, g, or t
  misc_feature (387)..(387): n is a, c, g, or t
  misc_feature (402)..(402): n is a, c, g, or t
  misc_feature (418)..(418): n is a, c, g, or t
atgtctttgggcagaaattggcaccgaccctgcctgaggtgccaacgttgcaggaagaccctgactgctgggagtcatgcggagcatgatggcatgccttactgccacatcccctgctatggatacctgtttggccccaaaggtgtgaacattggcgatgtgggctgctacatctatgacccagtggacataagatccaaatgagccattcgcaggagtgattaacctnactcaggcttcccaccatntcntccgaggtncttttggaatntctggaattctctantcctnnggggaggaagaaggtgacacccngggggcctggncctaggctctgtggtagatctgagtccagactgtntntnccagttctgtttccccattccnatctggataccccanccacccccacacactnagaatggtggttgcctgggttcccagttcctccttccagcactgcatgagcttcaaagtgt

SEQ ID NO: 9023 - DNA, 563 bp, Mus musculus
  misc_feature (199)..(200): n is a, c, g, or t
  misc_feature (327)..(327): n is a, c, g, or t
  misc_feature (334)..(334): n is a, c, g, or t
  misc_feature (336)..(336): n is a, c, g, or t
  misc_feature (343)..(343): n is a, c, g, or t
  misc_feature (389)..(389): n is a, c, g, or t
  misc_feature (398)..(400): n is a, c, g, or t
  misc_feature (408)..(409): n is a, c, g, or t
  misc_feature (427)..(427): n is a, c, g, or t
  misc_feature (429)..(429): n is a, c, g, or t
  misc_feature (435)..(438): n is a, c, g, or t
  misc_feature (491)..(491): n is a, c, g, or t
  misc_feature (526)..(526): n is a, c, g, or t
ttcccttgtgatgtttacagcctgctgtttgctgcccagctaaaaaccactcatgacagaagcaagcatagccatgtcctgaccctagcgctctgatggcaggtgggcaggcgggcacacgttagtccctctgcccagcgccccagttggctctctgcatcactaacctttctacctttggggattcgttttttttttnngttttcttgttcttctgtcccatttttctggcttggttttgcacttttctccccttaaatttccttgatttccttgccaaaaaagaggaagatgaagagcccatcgtggacacttgccctcccccanccccgantntcccctncctttcctcctggatctgatcccatcagaggatttaataatcacanatacactgnnnaaaaaaanntgcctggacatttttccnangccccnnnngatttttttttccccctgaggaaatttagacttagctaaaggactgtgtgctncaacccccattttcaggcgcacggaaatattttanccattcacacatgacatcagcccatgcaggataggtt

SEQ ID NO: 9024 - DNA, 491 bp, Mus musculus
ttcgctgctatggttttagcctgtaggtcatgctgctagctagtgtcagggggcaatagagcttagatggaaaaaagagaaagagactcggtgttagataacggactatgcactagtattccagacttttttattttttatatatatgtaccttttccttttgtcaattgaaaaacttatttgggagaattttgcatttgttgtacatttttgttttttaggatttttttttttgttgttgttgtcggtttataaaagcattgcacttctttttctttttttgggagatttgtgttgtttatgtcatatgttttgttttgagttcagcctgaatgttcatccgtttgggcgtttttctgacttggaagaacattctctgtaggtttctaagtgtacagagccggaactgcctcgtggttcctgggcttcagggaagacaaatatggaagtcaacagccagtttctgccttgagagcatttgcaagaatgct

SEQ ID NO: 9025 - DNA, 470 bp, Mus musculus
ttcgctgctatggttttagcctgtaggtcatgctgctagctagtgtcagggggcaatagagcttagatggaaaaaagagaaagagactcggtgttagataacggactatgcactagtattccagacttttttattttttatatatatgtaccttttccttttgtcaattgaaaaacttatttgggagaattttgcatttgttgtacatttttgttttttaggatttttttttttgttgttgttgtcggtttataaaagcattgcacttctttttctttttttgggagatttgtgttgtttatgtcatatgttttgttttgagttcagcctgaatgttcatccgtttgggcgtttttctgacttggaagaacattctctgtaggtttctaagtgtacagagccggaactgcctcgtggttcctgggcttcagggaagacaaatatggaagtcaacagccagtttctgcctt

SEQ ID NO: 9026 - DNA, 128 bp, Mus musculus
  misc_feature (81)..(81): n is a, c, g, or t
gaaacacaaaatcacacctagcagagaaatccaagaagggttcccagaaacaccctctaaagcaactgttcccaacctgtntaatgccttgacccttgaatacagtttctcacactgcagtaacccct

SEQ ID NO: 9027 - DNA, 511 bp, Mus musculus
  misc_feature (137)..(137): n is a, c, g, or t
  misc_feature (157)..(157): n is a, c, g, or t
  misc_feature (162)..(162): n is a, c, g, or t
  misc_feature (173)..(173): n is a, c, g, or t
  misc_feature (184)..(184): n is a, c, g, or t
  misc_feature (194)..(194): n is a, c, g, or t
  misc_feature (216)..(216): n is a, c, g, or t
  misc_feature (219)..(220): n is a, c, g, or t
  misc_feature (233)..(233): n is a, c, g, or t
  misc_feature (236)..(236): n is a, c, g, or t
  misc_feature (248)..(248): n is a, c, g, or t
  misc_feature (251)..(252): n is a, c, g, or t
  misc_feature (278)..(278): n is a, c, g, or t
  misc_feature (290)..(291): n is a, c, g, or t
  misc_feature (295)..(295): n is a, c, g, or t
  misc_feature (297)..(298): n is a, c, g, or t
  misc_feature (308)..(310): n is a, c, g, or t
  misc_feature (312)..(312): n is a, c, g, or t
  misc_feature (315)..(318): n is a, c, g, or t
  misc_feature (322)..(331): n is a, c, g, or t
  misc_feature (333)..(342): n is a, c, g, or t
  misc_feature (345)..(345): n is a, c, g, or t
  misc_feature (347)..(348): n is a, c, g, or t
  misc_feature (350)..(350): n is a, c, g, or t
  misc_feature (352)..(355): n is a, c, g, or t
  misc_feature (357)..(357): n is a, c, g, or t
  misc_feature (359)..(359): n is a, c, g, or t
  misc_feature (470)..(470): n is a, c, g, or t
aaccacagcgagtgactcatatccaagatatcgctgggaagcctgtctgcgtggtcagggacgagttctctctgtcggccttgactcagcccacattcttatcccgctgtctgatggggatgcccaccatctctgtncccattggggatccacagtncaatnggaacccccanctttctacttntgacacctgnaggaagaaactgaaggacctgnctnnccgagtgactgtnttnactaaggaaatncanncaaagcccgatgaggttggtgttgcncaaagaatggannctanannaaaaaggccnnntnaannnncccnnnnnnnnnncnnnnnnnnnnggngnngnannnncntnataacctcgaaggtgacagcgaaaatcaaagaaacacaaaatcacacctagcagagaaatccaagaagggttcccagaaacaccctctaaagcaactgttcccaacctgtntaatgccttgacccttgaatacagtttctcacactgcagta

SEQ ID NO: 9028 - DNA, 462 bp, Mus musculus
gccgccgcagcgacacatgtgagtactgcggcaaggtcttcaagaactgtagcaacctgacggtgcaccggaagaaccacaccggcgagcggccttacaagtgcgagctgtgcaactacgcgtgcgcgcagagcagcaagctcacgcgccacatgaagacgcacgggcagatcggcaaggaggtgtaccgctgcgacatctgccagatgcccttcagcgtctacagcaccctggagaaacacatgaaaaagtggcacggtgaacacttgctgactaatgatgtcaaaatcgagcaggctgagaggagctaagcgcatacgtgggggacactgcgtgcgtgcgtctgtacagcgtgaccatcgccaaccttcgccaacgggaccggtgaccggactggcctctgcatccccggggcccagggaggcggcagtccagcctaacctgtgtctgcgaagtcctatg

SEQ ID NO: 9029 - DNA, 372 bp, Mus musculus
agagctgagtcctgggttgaacaaacagggtctggccacttcttgggagtggtgaagggtcatgctgggtgaccctgaggccttatctcactccgtgtctggcactttgatcctaagcctcaggaagctgctgaaggggctgagtagcccacccactgctgaaatacaggccctggccaaggggctgccattatcacccaggaagtcagcgatgtctcaatacaacctggggcctcaatcaatcagagtagcagccgctttagcacgggcatggcctccctgggcactgtcacctaagagtaaccatggcgaatacatgcttgcttccagaggtctctgagtccaccacaggcactagctggactcctttct

SEQ ID NO: 9030 - DNA, 447 bp, Mus musculus
ttcttcagagcttgtcgtctttttcgctatattagactttgcagtatgcccagaagctttccttcataaaatagaaagaaaaaaagatttggcttatttttcactgtagctagtcttttatacaataatcttgtaagaaaatttcttgaattctaaatattactctttctagatttttgaaatcaaaagttttcagtaaaaagtttcttactttattttattatattaggtagttaaagaaaatgtagggttatttaccataacctgttcattaatatcagaaatttacaatagcattttaagagcatagtaggttctagcataccatgtagttcctatggagtattgtgagagcgaattgttggagatgagctgcttttcatcttgttctccagtttccattgttggtttattgcagatttgtattctgtgtcaaattcaaggtat

SEQ ID NO: 9031 - DNA, 587 bp, Mus musculus
  misc_feature (258)..(258): n is a, c, g, or t
  misc_feature (441)..(441): n is a, c, g, or t
acagttgtctgaacccagttctctatgtttttgttggcgagagattccgaagggatctggtgaagaccctgaagaacctgggatgcattagccaggcccagtgggtttcattcacaaggagagagggtagcttgaagctttcttctatgctactggagacaacttcgggggctctctccctatgagagaacttctcacagggcatatggtcctttttggaaataatgagatatatagccacaacacagtctaaagagncagtaaatagtaagaaaactgggggtggagggcaggaaaaacaaaacaaacaatctgggatgagcctaaacaacttttatcatgttcagtcagaatctaccaaagtttccaaaactgagcactccagaagcgcagcagttggtttttggttatagtaactgcagttctgaggaggatgcttgngcagcagcaaagacagcccagccttgcacatgctgatcatcagtgcagctgggttttggaggcagagtttcttcagtgttcccagtttctgttacttcagatctggtgctactcctctttagaggtgacagaacactggctgccac

SEQ ID NO: 9032 - DNA, 474 bp, Mus musculus
  misc_feature (219)..(220): n is a, c, g, or t
  misc_feature (227)..(228): n is a, c, g, or t
  misc_feature (231)..(231): n is a, c, g, or t
  misc_feature (234)..(234): n is a, c, g, or t
  misc_feature (243)..(243): n is a, c, g, or t
  misc_feature (284)..(284): n is a, c, g, or t
  misc_feature (299)..(299): n is a, c, g, or t
  misc_feature (305)..(305): n is a, c, g, or t
  misc_feature (315)..(317): n is a, c, g, or t
  misc_feature (319)..(319): n is a, c, g, or t
  misc_feature (332)..(332): n is a, c, g, or t
  misc_feature (335)..(336): n is a, c, g, or t
  misc_feature (343)..(343): n is a, c, g, or t
  misc_feature (350)..(350): n is a, c, g, or t
  misc_feature (354)..(356): n is a, c, g, or t
  misc_feature (359)..(359): n is a, c, g, or t
  misc_feature (362)..(362): n is a, c, g, or t
  misc_feature (385)..(385): n is a, c, g, or t
  misc_feature (417)..(417): n is a, c, g, or t
  misc_feature (422)..(422): n is a, c, g, or t
tacactcaaacattctgaggttgaatgccattctgattgatctctttgatctctcttgagccagggagaaccactgtccctagtttggagccacctgtcagacaggttagtcagccaatgtacagctgaccacatcacattacctggagtcttgctcccaatccacttctgtgtcaggcagaagataccatgtccaaacctagctgcaagcacaaactnngaaaggnnatntancctgttccntggtgtggccctcacagaattaagctggagaatatgtttgnatggtgggaacctancctttnggacttcctnnngncaagaggcacttnctnncaggttntcccatntctnnnccnagngacatgccctttccttctgaggntccctgctacctcccctttccatactctgtantcccnacagtttacaacctttaaattttagattaagaagaactggtaggttgggcat

SEQ ID NO: 9033 - DNA, 560 bp, Mus musculus
  misc_feature (217)..(217): n is a, c, g, or t
  misc_feature (220)..(220): n is a, c, g, or t
  misc_feature (222)..(225): n is a, c, g, or t
  misc_feature (228)..(230): n is a, c, g, or t
  misc_feature (232)..(240): n is a, c, g, or t
  misc_feature (242)..(252): n is a, c, g, or t
  misc_feature (254)..(260): n is a, c, g, or t
  misc_feature (271)..(271): n is a, c, g, or t
  misc_feature (298)..(301): n is a, c, g, or t
  misc_feature (303)..(303): n is a, c, g, or t
  misc_feature (313)..(313): n is a, c, g, or t
  misc_feature (331)..(331): n is a, c, g, or t
  misc_feature (454)..(464): n is a, c, g, or t
  misc_feature (517)..(517): n is a, c, g, or t
aacattctcaggtcgctctgcagctctcactcttccagcccctaagtctccaaagaccccccacagcaccctccagaatccacagatacagcaacaagaatctcagagacaggcagcctaacagccttggttgctaggcacagaacacctggcttgctccaggggcccacccctaactcaggaggaggcaacatgaccagctcccatggaaccagcnagngnnnntcnnnannnnnnnnngnnnnnnnnnnntnnnnnnntccctgaaccnggggccatcaattcaagaggtgggggnnnngntctatgtagntgtatcatcttaaggggntcctgccgcctctgacagccatatctcttgttattgctggctggacctccctattggcctaggaggttttgtttgctgtaggtcagatgggttggactgatctcttcagctgcctaccctacnnnnnnnnnnnctgccctctgccacaccctccccatgccaatacttcttggaccaagaataccntggtttgtcacacaaaataactctgtggtcaacgggcagcttt

SEQ ID NO: 9034 - DNA, 580 bp, Mus musculus
cctttgaaagaatcaggctgctcagattgtctgccagccaccttgtggggatacttttttcagccgccctgctgccagctccccgctgcctcaccagtgtcctctctgcctcagttcctttcctctcctaattggccctcatagctaagccctttcctacagctttctgttttttctttttctttctttttaggttttctttcttttcttttttattcctttttatttaatctttttttttaaacactccagattttattcccttcccggcccatcctccgactgttacacaccccatacctcctccctgcccccttgtctctacgagaatgtcccccaccccccatccccacctgctttctggtttttggtttttggtttttttttttttttttaaactctgtgttttacactcttctctgggatggattctgtaatcattggcacaggtcctgccccatttatagatcctggcccagcccctgccacaggtgcctctccagatttccccttagatcctcggatggtcatcaccatctccatgaatacaccagccccctctctgctaatgcaaaaggca

SEQ ID NO: 9035 - DNA, 411 bp, Mus musculus
  misc_feature (211)..(211): n is a, c, g, or t
gaaagttgctgtgagtaccaagcctacaacttgctggcaagataaaaatgatgtgctgcagctccagttcacgatcacctctgcctactacacctaccttctcctgctcctcaagagtgtgatctacttggccatcatcagcttctctctgcttagaagaacatctgtctgtggcaatgagaagaaatcctaaagaaacgagtggtggtanagcaagtcagctggatttcatcctcactgccataaaggtgccttaaggaggtccagctgccttcacttgttggctttcacttctataaagtccctcactcatgttgcataaacattttctgaacttttgtgtgcaatttctgcaacttctctctaactcacatcacctcattcctgattccatccactgcagaagtcccc

SEQ ID NO: 9036 - DNA, 70 bp, Mus musculus
agtgtgatctacttggccatcatcagcttctctctgcttagaagaacatctgtctgtggcaatgagaaga

SEQ ID NO: 9037 - DNA, 535 bp, Mus musculus
  misc_feature (106)..(106): n is a, c, g, or t
  misc_feature (109)..(109): n is a, c, g, or t
  misc_feature (205)..(206): n is a, c, g, or t
  misc_feature (216)..(217): n is a, c, g, or t
  misc_feature (260)..(260): n is a, c, g, or t
  misc_feature (262)..(262): n is a, c, g, or t
gttgcttttgtactgcgacatcttagagtcaacctttgaaaagttcaagcagcccagcaggaaggtggatgctctcgaccatttccagaaatgcttcctgattctnaanctggaccacgggagagtgcacagcgagaagagcggccagcaggaaggaaagggctggaaggccatccgtgtagatctggtcatgtgcccctatganngccgggcctnngccctgcttggatggaccggctccagacagtttgagagagacntncggcgctatgccacacacgagaggaagatgatgctggacaaccacgccctgtatgacaggactaaggggaagactgtcacgatttcacctttggatgggaaagtgtcaaaactacagaaagccttgagggtgtttcttgaagcagaaagtgaagaagagatctttgcccatctgggactggactacattgaaccatgggaaagaaatgcctaagacggagttgttgacatttttcttttcggtttagacaagctgtgctctgtgttagtaaaa

SEQ ID NO: 9038 - DNA, 455 bp, Mus musculus
  misc_feature (123)..(123): n is a, c, g, or t
  misc_feature (247)..(247): n is a, c, g, or t
  misc_feature (254)..(254): n is a, c, g, or t
  misc_feature (260)..(260): n is a, c, g, or t
  misc_feature (265)..(265): n is a, c, g, or t
  misc_feature (301)..(301): n is a, c, g, or t
  misc_feature (304)..(304): n is a, c, g, or t
  misc_feature (307)..(307): n is a, c, g, or t
  misc_feature (316)..(316): n is a, c, g, or t
  misc_feature (322)..(322): n is a, c, g, or t
  misc_feature (330)..(330): n is a, c, g, or t
  misc_feature (372)..(372): n is a, c, g, or t
  misc_feature (374)..(374): n is a, c, g, or t
  misc_feature (415)..(415): n is a, c, g, or t
aaggtctcactattttcacaggctgaccttgaatttgagactctccaatgccagcctttgggtaactgggatgacatatgtgtgcccacccacgggattagttttgcaagcagttgtttgatncatgtgtatgccattagatactgtatggcagttgttctagttttcctataagatagtttaaatcagagttgatactttgtagacatttaaaatttttttctttctttaagtatctatgtaagcnaaacccngaattnatttnttttgggagatattttgtggggttgtattttacttnatnatnattgttatnattgtnattatttnacatatattgaatgatacattttgttcaatggcttccacgantntacttttcctctctgaggggaggtttagacaccaggatgcnatgtactatttgatttgaggacctatatttccatgttaaa

SEQ ID NO: 9039 - DNA, 548 bp, Mus musculus
  misc_feature (317)..(317): n is a, c, g, or t
  misc_feature (336)..(336): n is a, c, g, or t
  misc_feature (418)..(418): n is a, c, g, or t
  misc_feature (434)..(434): n is a, c, g, or t
  misc_feature (506)..(506): n is a, c, g, or t
  misc_feature (523)..(523): n is a, c, g, or t
gagatctcacttgatttcacacaactaaaaaggattttttttttttaaaaataataataatgaataacagtcttacctaaattattaggtaatgaattgtgaccatttgttaatatcataatcagattttttaaaaaaaataaaatgatttatttgtattttagaggatacaacagatcagtatttttgactgtggtgaatttaaaaaaaaaatttacacaaagaaatatcccagtattccatgtatctcagtcactaaacatacacagagagatttttaaaaaccaggagaagcattattttgaatgttagctaantcccaagtaatacttaatncaaccctctaggagctcatttgtggctaataatcttggaaatatctttattatactaaaccatttcatgaggagaattttgnttgtcagcttgcttgnaaagttattactgtatgaaatagttttattgaaaaaattatatttttattcagtaatttaattttgtaaatnccaaatggagaaatgtnttcgctgctatggttttagcctgta

SEQ ID NO: 9040 - DNA, 542 bp, Mus musculus
  misc_feature (354)..(354): n is a, c, g, or t
  misc_feature (403)..(403): n is a, c, g, or t
  misc_feature (416)..(416): n is a, c, g, or t
  misc_feature (446)..(446): n is a, c, g, or t
  misc_feature (474)..(474): n is a, c, g, or t
  misc_feature (477)..(477): n is a, c, g, or t
  misc_feature (510)..(510): n is a, c, g, or t
gcgggattctggctagtctgatactgattgctgttctcccccaagggagccccttcaagatacaagtgaccgaatatgaggacaaagtatttgtgacctgcaataccagcgtcatgcatctagatggaacggtggaaggatggtttgcaaagaataaaacactcaacttgggcaaaggcgttctggacccacgagggatatatctgtgtaatgggacagagcagctggcaaaggtggtgtcttctgtgcaagtccattaccgaatgtgccagaactgtgtggagctagactcgggcaccatggctggtgtcatcttcattgacctcatcgcaactctgctcctggctttgggcngtctactgctttgcaggacatgagaccggaaggccttctggggctgctngaggttcaagcantgctgaagaatgagcagctgtatcagcctnttcgagatcgtgaagatacccagtacanccntcttggagggaactggccccggaacaagaaatnttaagatggaggtttctcaaagtgccatagca

SEQ ID NO: 9041 - DNA, 530 bp, Mus musculus
  misc_feature (30)..(30): n is a, c, g, or t
  misc_feature (112)..(112): n is a, c, g, or t
  misc_feature (154)..(154): n is a, c, g, or t
aagcgctctgccatcactgaagaagccccntagggctcttgggccagggcacactcagtaaagatgcaggttcagtcagggaatgatggggaaaggggtaggaggtgggggnagggatcaccccctcctctaaaacacgagcctgctgtctccnaaaggcctctgcctgtagtgagggtggcagaagaagacaaggagccagaactctgactccaggatctaagtccgtgcaggaaggggatcctagaaccatccggttggacccagcttaccaagggagagcctttattcttctttcccttgcccctctgtgccagcccctcttgctgtccctgatcccccagacagcgagagtcttgcaacctgcctcttccaagacctcctaatctcaggggcaggcggtggagtgagatccggcgtgcacactttttggaagatagctttcccaaggatcctctcccccactggcagctctgcctgtcccatcaccatgtataataccaccactgctacagcatctcaccgaggaa

SEQ ID NO: 9042 - DNA, 517 bp, Mus musculus
  misc_feature (157)..(157): n is a, c, g, or t
  misc_feature (275)..(275): n is a, c, g, or t
  misc_feature (429)..(429): n is a, c, g, or t
  misc_feature (438)..(438): n is a, c, g, or t
  misc_feature (446)..(446): n is a, c, g, or t
acgccttggtggagcattactctgagctagcagatggcatctgctgtcccctcagggagccgtgtgtcctgcagaagcttgggccactacctggcaaagatacacctccacctgtgactgtgccaacatcatcactaaattggaaaaagctggaccncagcctcctgtttctggaagcacctgcgagtggggaggcatctctgctcagtgaggggctccgagagtccctcagttcctacatcagcctggctgaggaccccttggatgatgcttanccctggagcacaaagagaaagggaaccaagactgtggcaccgagagctccaactccgctgaccctgacaaagctccaggaggcaaggctgggagaacagagacggctggggtggggcacagacactcggggcctcacctgggctttctgataantcatgtatntcctaagncctcacccctacctactacttctagtccatgtgcagtgcagttcaaagcagggctggcctctacagagaat

SEQ ID NO: 9043 - DNA, 385 bp, Mus musculus
  misc_feature (338)..(338): n is a, c, g, or t
gccagataacttttgttacccggagggtaagcattataactatattgattttatgtagatcttaattatttaacatttattgtttttctggtaagaaatccaacattgtcatgcattctacggctgttggcccattcatgtcctcttgatgtatatgctgcttgccagaggttagctttctgcatacttcagcccataataatgaaatcagcagtactcacatattttgggcatagaatgcacccataaaatgtgacaatgggcagcaggtgtgagcatgcatccggtcacccctccctgccctccctaacgcaccgacgtttgaaagttcgtgtcantcttaagtcctgaatggttcttaaccacctgactttcttactgtgaa

SEQ ID NO: 9044 - DNA, 450 bp, Mus musculus
atatggcttcatcccacaacaagataacgtgggacgagaagctgaattcgtcgaaactgttttctgccatgagggacacgaataataagtacgttctcaccctgaacaagttcagcaaggaaaacgaaggctactatttctgctcagtcatcagcaactcggtgatgtacttcagttctgtcgtgccagtccttcagaaagtgaactctactactaccaagccagtgctgcgaactccctcacctgtgcaccctaccgggacatctcagccccagagaccagaagattgtcggccccgtggctcagtgaaggggaccggattggacttcgcctgtgatatttacatctgggcacccttggccggaatctgcgtggcccttctgctgtccttgatcatcactctcatctgctaccacaggagccgaaagcgtgtttgcaaatgtcccaggc

SEQ ID NO: 9045 - DNA, 254 bp, Mus musculus
  misc_feature (55)..(55): n is a, c, g, or t
ttctttatgaattctctttgacacaaagcatacttgtatgcatacaatgggagtnatgagcagactgtaacaccagagctagttccagtttcggggtccatgtcgctggtggcctcagcacccacttgatataaatctcctgtctgcccatcatatagaagaagctgaagatcagaggtggaaacagcaggatctgtagacccggagagaacccaagctagaggaaccctcactgactggtgcagggatctcac

SEQ ID NO: 9046 - DNA, 420 bp, Mus musculus
gaacccattgtattgctttatctctgctaagccggacagaagggagccgggtgtgatggtgcctgcctgtgatcctgacactcaggaggctggacccggagagtaaagagctgattgatcatcgccacactataagtgtgtgcatgtttatgtgtatgtctcccagtgggggccagatggaaggccatgttctccctgggcaggtgctctagggttggaggagaaagcaggctgactggtctatataccaccatatctgccttggttgttgtgataccagatgtctcttgtttctttgtactttttttttaaagatttatttactttatgtgtatgaatgttttgcatgtaatgtctgtacatgctccgttatagatgcctgtgagccaccaaatgagtgctggctatcgaccaatggtc

SEQ ID NO: 9047 - DNA, 406 bp, Mus musculus
  misc_feature (42)..(42): n is a, c, g, or t
  misc_feature (194)..(195): n is a, c, g, or t
acaactgtccggaagagctgtaccacctcatgatgctgtgcntggaaggagcgcccagaggaccggcccacgtttgactaccttcggagtgttctggatgacttcttcacagccacagagggccagtaccagccccagccttgataggcctttcggtcccaagatcctcccaaccactgtgccctggctagggnncagatggaattcctgtgccatatctgtgtggcctgtgcacacatggactctgactctgtacatgaaacctgtgcgtgtgtcacacataatgcagtttctgtcttgtacacacatctgtagttatgtgggttctacacatgtgtcttatacctgtggagcacgtgagtctaagccttggatacctcctaagatgtctcttcctataccgttc

SEQ ID NO: 9048 - DNA, 599 bp, Mus musculus
  misc_feature (29)..(30): n is a, c, g, or t
  misc_feature (205)..(205): n is a, c, g, or t
  misc_feature (456)..(457): n is a, c, g, or t
  misc_feature (459)..(459): n is a, c, g, or t
  misc_feature (461)..(462): n is a, c, g, or t
  misc_feature (464)..(464): n is a, c, g, or t
tgcctctccaaagatgacctcatggaagnncttacagagtacccagatgccaaaactatgctggaagagaaagggaggcagatcttaatgaaagatggtctgctggatataaacattgcaaatatgggcagtgaccctaaagacctggaagagaaggtcactcgaatggaggggtcagtggacctcctgcaaacgcgatttgccngtatcttggctgaatatgagtcgatgcagcagaaactcaagcaaagattaaccaaggtcgagaaatttctgaaaccgcttattgaaacagaattttcagctctggaggaacccggaggggaaagtgagctcacggagtctctacaggactgaaaagctggtcaacagccaaacccatgcacggtgtgtgatccttttgagtgtttgaccagagacagctgagaattgggagaaagagtcgtctgggaaatnncncnncngtgaaaatgtgtgtgggtagatgacacaaatcgtttgtgtaatactgcaacaaaagtatcatcttctcctgggatttttcacaatggacaccgtgcgagggacctgaactgattaacgtgtctgtgtcaggatct

SEQ ID NO: 9049 - DNA, 74 bp, Mus musculus
cttctgtgccagcagtggagcagggggcgcgggcaccgggcagctctactttggtgaaggctcaaagctgacag

SEQ ID NO: 9050 - DNA, 504 bp, Mus musculus
  misc_feature (319)..(319): n is a, c, g, or t
  misc_feature (329)..(329): n is a, c, g, or t
  misc_feature (338)..(338): n is a, c, g, or t
  misc_feature (353)..(353): n is a, c, g, or t
  misc_feature (360)..(360): n is a, c, g, or t
  misc_feature (368)..(368): n is a, c, g, or t
  misc_feature (372)..(372): n is a, c, g, or t
  misc_feature (377)..(377): n is a, c, g, or t
  misc_feature (382)..(382): n is a, c, g, or t
  misc_feature (406)..(406): n is a, c, g, or t
  misc_feature (437)..(437): n is a, c, g, or t
  misc_feature (439)..(439): n is a, c, g, or t
  misc_feature (466)..(466): n is a, c, g, or t
tgctgtaaatttggcttctgttgtcacactttgcagtgttgaggtaacatgtaattaggccacattgtgaaaggcagagaggcaggtacaagggagtccaggtaaatgccagccagaggtggctcaaagaagggaagcaacacacaaggaaggttcctagccacaggggaacagtaacaaggggcctctttccatcaagagtactttccacatctcccagcctttgtgccaggcactccaggaacggtaagatgtcttaccttcatgaagaccatgcttttaagagtgcaaataacttgtgtacaaactgacacagaanataggatggnccattaccnccaacgacaagggancaagagnaaagggancaantcctnccttnttccaggaactcggttcatccctntcaggtggcaggaagacccagaccacccagntntgcaacgttcccagtgacaatcagtgnccggcaaggtcattgtgtcattaaagtgcctgtaccca

SEQ ID NO: 9051 - DNA, 62 bp, Mus musculus
tatgtactggtataaacagagcgctgagaagccgccagagctcatgtttctctacaatctta

SEQ ID NO: 9052 - DNA, 141 bp, Mus musculus
tctacaatcttaaacagttgattcgaaatgagacggtgcccagtcgttttatacctgaatgcccagacagctccaagctacttttacatatatctgccgtggatccagaagactcagctgtctatttttgtgccagcagcc

SEQ ID NO: 9053 - DNA, 242 bp, Mus musculus
gggtcagcacggaccctcaggcctacaaggagagcaattatagctactgcctgagcagccgcctgagggtctctgctaccttctggcacaatcctcgcaaccacttccgctgccaagtgcagttccatgggctttcagaggaggacaagtggccagagggctcacccaaacctgtcacacagaacatcagtgcagaggcctggggccgagcagactgtgggattacctcagcatcctatcaa

SEQ ID NO: 9054 - DNA, 362 bp, Mus musculus
  misc_feature (28)..(28): n is a, c, g, or t
  misc_feature (74)..(74): n is a, c, g, or t
  misc_feature (167)..(167): n is a, c, g, or t
  misc_feature (185)..(185): n is a, c, g, or t
  misc_feature (250)..(250): n is a, c, g, or t
tatactcttgaatgattgattagcatanacttgaaaagattattttttttttaaagacaaaataatagaggtcngccctctcatgcaaggtcagtatttagccaatcaccctccacactgctctgtaaccgctgctgtcccctcactgtgcctcctctgtgtagctncctccaaattcctgtganctgctctctctgggccagcatttgatgcagagatggtacaggaccatctggttttacatgggtgncgcttagctgttccgttgtgatctttaatttaaccttagctctgacgtgatatctctgctcctctctccatctcttcccgatgcctctcctttgccctttgctctgcaggga

SEQ ID NO: 9055 - DNA, 388 bp, Mus musculus
  misc_feature (71)..(71): n is a, c, g, or t
  misc_feature (73)..(73): n is a, c, g, or t
  misc_feature (86)..(86): n is a, c, g, or t
  misc_feature (91)..(91): n is a, c, g, or t
  misc_feature (109)..(109): n is a, c, g, or t
  misc_feature (112)..(112): n is a, c, g, or t
  misc_feature (122)..(122): n is a, c, g, or t
  misc_feature (198)..(198): n is a, c, g, or t
  misc_feature (205)..(205): n is a, c, g, or t
  misc_feature (227)..(227): n is a, c, g, or t
  misc_feature (230)..(230): n is a, c, g, or t
  misc_feature (232)..(232): n is a, c, g, or t
  misc_feature (238)..(238): n is a, c, g, or t
  misc_feature (255)..(255): n is a, c, g, or t
  misc_feature (265)..(265): n is a, c, g, or t
  misc_feature (270)..(271): n is a, c, g, or t
  misc_feature (282)..(283): n is a, c, g, or t
  misc_feature (288)..(288): n is a, c, g, or t
  misc_feature (295)..(295): n is a, c, g, or t
  misc_feature (302)..(305): n is a, c, g, or t
  misc_feature (307)..(307): n is a, c, g, or t
  misc_feature (339)..(339): n is a, c, g, or t
  misc_feature (354)..(354): n is a, c, g, or t
gggtcagcacggaccctcaggcctacaaggagagcaattatagctactgcctgagcagccgcctgagggtntntgctaccttctgncacantcctcgaaaccacttccnctnccaagtgcanttccatgggctttcagaggaggacaagtggccagagggctcacccaaacctgtcacacagaacatcagtgcagagncctgggnccgagcagactgtggaatcacnttnancatccnatcatcagggggttctntctgcaaccntcctnntatgagatccnnactgngggaagnccacccnnnntntgctgtgctggtcagtggcctggtgctgatgnccatggtcaagaaanaaaaattcctgagacaaacttttatgcatcctga

SEQ ID NO: 9056 - DNA, 286 bp, Mus musculus
taccctcagggctccatcttggaaacaaaccatgaagctataactctagtttactgctttggaaactcagccagtaatgtgaacgcagataatctcaacagaagcgggttgagttttagagtcaaagaatttaactccacttgtgagatttttcttacgaatttgttacagtgctgttgaggggatttcaagcctttcgtcctctaatcaggcccggagtaggttctgctgtcaagacctttagctcgtgacattttatatgcattttttagtttgtcatgggcaa

SEQ ID NO: 9057 - DNA, 531 bp, Mus musculus
  misc_feature (237)..(237): n is a, c, g, or t
  misc_feature (245)..(245): n is a, c, g, or t
  misc_feature (253)..(253): n is a, c, g, or t
  misc_feature (265)..(265): n is a, c, g, or t
  misc_feature (269)..(269): n is a, c, g, or t
  misc_feature (271)..(271): n is a, c, g, or t
  misc_feature (280)..(281): n is a, c, g, or t
  misc_feature (283)..(283): n is a, c, g, or t
  misc_feature (287)..(287): n is a, c, g, or t
  misc_feature (301)..(301): n is a, c, g, or t
  misc_feature (304)..(304): n is a, c, g, or t
  misc_feature (319)..(319): n is a, c, g, or t
  misc_feature (329)..(329): n is a, c, g, or t
  misc_feature (331)..(331): n is a, c, g, or t
  misc_feature (341)..(341): n is a, c, g, or t
  misc_feature (343)..(343): n is a, c, g, or t
  misc_feature (345)..(346): n is a, c, g, or t
  misc_feature (348)..(348): n is a, c, g, or t
  misc_feature (392)..(392): n is a, c, g, or t
  misc_feature (460)..(460): n is a, c, g, or t
  misc_feature (482)..(482): n is a, c, g, or t
  misc_feature (489)..(489): n is a, c, g, or t
gtcagggacgagttctctctgtcggccttgactcagcccacattcttatcccgctgtctgatggggatgcccaccatctctgtccccattggggatccacagtccaatcggaacccccagctttctacttctgtcctgaagacacagggaggacaaacaacacctaccgccccccacccccatctttcctgtcctctcaaacacctggaggaagaaactgaaggacctggcttcccnagtgactntcttcacnaaggaaatccanccanancccgatganntnggtnttgcacaaagaatngancctagaaaaaaaagnccttcttaantntccccaatgntnanntnctggcacgggaggggaaggaccctcataacctcgaaggtgacancgaaaatcaaagaaacacaaaatcacacctagcagagaaatccaagaagggttcccagaaacaccctntaaagcaactgttcccaacctntctaatnccttgacccttgaatacagtttctcacactgcagtaacccct

SEQ ID NO: 9058 - DNA, 287 bp, Mus musculus
ggaggtgacacatgcaacccaggcatttacaaccagtggcttaggcctcttccagaagtagaggggagcagtagagagaggtctgcttccatggtgtaaaagacaagaagaaacttcaaagaactgtagtggatagctatagaggataagctgtgataactcaaaagcccaagggatgttttagtagctctatcgtttgtctgaacaatgggcctttgtatattctctcaagccacactatgcaaggccattggtaaacctaaaatgattctcatctgcaggtcaaa

SEQ ID NO: 9059 - DNA, 393 bp, Mus musculus
ccggctttacctgctgctttataaaggcatgggaagttatgaaaacagatccattttattttgcccccataattggtatactttgaaaatggtgtttcatccttcttcatttacccagaactaggaagtggggaccacttcattatccaggaggaaataatcttaagagagagaacccgtatctttttagctaaacatggaaagctgtactcaactcatccctagccagagccccctcctgcctctcctgaggcgagcatggcccagctcccccccactttgtatttactccaatagtcacacaggagagttttcctagcagcactatggtgtgaacaattttagcactttctgtttctcctaatactttacaaacaaactcacacttggctt

SEQ ID NO: 9060 - DNA, 564 bp, Mus musculus
  misc_feature (84)..(84): n is a, c, g, or t
  misc_feature (318)..(318): n is a, c, g, or t
  misc_feature (329)..(358): n is a, c, g, or t
  misc_feature (375)..(375): n is a, c, g, or t
  misc_feature (409)..(409): n is a, c, g, or t
  misc_feature (422)..(422): n is a, c, g, or t
  misc_feature (446)..(446): n is a, c, g, or t
  misc_feature (449)..(449): n is a, c, g, or t
  misc_feature (460)..(460): n is a, c, g, or t
  misc_feature (485)..(485): n is a, c, g, or t
  misc_feature (496)..(496): n is a, c, g, or t
  misc_feature (498)..(498): n is a, c, g, or t
gtgaatactcaacaaactgcccttctgagaccaacggggacaagagcaggatcccagtgtgtggcccagcaagctggggagacncaggctctagctataaagcacacttactctaagtgaaaccgtccagctgacaaaactacatgccaggggtggaaatggctcaccaagggctccagagggggcttggcagtgaggagcacgaagtgttcctccagaggaccagagtttgattcccagcactgtcaaatggatcgaaaccagctgtaactctactttcagagggtctgacacctttgacctcctctggcatctacnaacacaggacnnnnnnnnnnnnnnnnnnnnnnnnnnnnnnacacacacacacgattnaaaataataattttttttaaaaaaatggaatganccaccggcaggtnccctggtaccagaaggactgactnccntgagagacacnatctacagacacacagacttcctgnccttggttctntnttctctgtaagttgtgacagtgctgtgggaaagctgaggctgagactttctctcagttgagctaaa

SEQ ID NO: 9061 - DNA, 459 bp, Mus musculus
  misc_feature (54)..(54): n is a, c, g, or t
  misc_feature (180)..(180): n is a, c, g, or t
  misc_feature (189)..(189): n is a, c, g, or t
  misc_feature (199)..(199): n is a, c, g, or t
  misc_feature (202)..(202): n is a, c, g, or t
  misc_feature (205)..(205): n is a, c, g, or t
  misc_feature (225)..(225): n is a, c, g, or t
  misc_feature (245)..(245): n is a, c, g, or t
  misc_feature (261)..(261): n is a, c, g, or t
  misc_feature (269)..(269): n is a, c, g, or t
  misc_feature (296)..(296): n is a, c, g, or t
  misc_feature (311)..(311): n is a, c, g, or t
  misc_feature (339)..(339): n is a, c, g, or t
  misc_feature (368)..(368): n is a, c, g, or t
  misc_feature (380)..(380): n is a, c, g, or t
gacagtcagagctggttgcacagagaaacatcaaaaaacaaaaaaacaaaaaanaaaacaaaaaacaaaaaacaaaacaaaacaaaacaaaacaaccccaacaaccaaccaatcaagtaaaaatccaaagggttggagagatggctcagtggttaattcccaaccagcgttcaattcccnacacctacntggcagctcnaanctntcttcaactccagttccagnggatctgatagtctcacacngacatacaagcaggcnaaacaccnatgcacatgaaataaaaataaaatganaaagaaaaatatgtnatataatttaccttccacctatgttttnaattacttgataaatttatcacattgaanaaatcattgctnatctttaaatgtgttttataatgtttagttacaaatgtccttcacttgctatttgttttaccatttctcaatattgtat

SEQ ID NO: 9062 - DNA, 434 bp, Mus musculus
  misc_feature (355)..(355): n is a, c, g, or t
tagaataatcctgagtatttttccaaaatgtaaataatattatcattttttaaactgttataaaaataaatccatgctctttgcaacaattaaaaattaagaacatagaaaattctactagtcagagataatcactatgaataactttctctgtgtttttggatattttactggacataaccatctatgtgtatcagccttttttttttctgatttaacttaaaagtaggggattgtgcatattatttaaattctctttgtgtatcaagagactatggctttagttctactacatttaactatattaacctgtattcagctttgtatttgatgattctgggcagcaaacacaggntctttcagatgaaagacgagtgctccatcctgagcttcatcccaagtctgtctcaaaattctgatgtctgcattgtatc

SEQ ID NO: 9063 - DNA, 149 bp, Mus musculus
gggctacagctgatttatatctcatacgatgttgatagtaacagcgaaggagacatccctaaaggatacagggtctcacggaagaagcgggagcatttctccctgattctggattctgctaaaacaaaccagacatctgtgtacttctg

SEQ ID NO: 9064 - DNA, 216 bp, Mus musculus
ggtgctgtgctcagtgtacgtcttgtcacagctgacactgttgctgctgtcatctggcctacccagtcacccaaaggtttgtgggaacttggtaccataattactaaaaattgctgtagaaaaggtgttctgggaaattaaagatgatagctcagcagcgggttgatctgaaaccttggtgttctgcttcaggaacttaaccttaataatgtcact

SEQ ID NO: 9065 - DNA, 258 bp, Mus musculus
  misc_feature (26)..(26): n is a, c, g, or t
  misc_feature (116)..(116): n is a, c, g, or t
  misc_feature (134)..(134): n is a, c, g, or t
  misc_feature (156)..(156): n is a, c, g, or t
cgaggatgaggcttgagttccccagnccaagcaggttagggaaagctgagatgaaaggagggggtgggggggcttaatctgtgaaaataccttggcagttgaaggaaggagaatgntcttaggtttgtgctggntctctggtgctcttcactgttncctgtcactttttttctctttttgtaataccgataacatcaatgtaacacttgagatctttctgaactcctgttgtaatggctaaaatcacataaacctttg

SEQ ID NO: 9066 - DNA, 451 bp, Mus musculus
actcctggcttactctgatttttaaaagcaggttctgactagtttcttttggttttgctttagtttgatgtccacttttcaaagatgcttcctaaaaaacaagaagggccagagaattggtaaagttggttgaatgtttgcatttcatgcaaaaagtcttggcttcagttttcagcattatataaactgttcatagtggcacattcccataattcctgcacttgggaagttgtggcagaaagatcagaagtttgaggtcatcctcaattgtatagcaagtttcagttttagcccaggctgagctatctaaaaccctttctcaaacaagcaaaaaacactacctcttttctcatactaaaccttataagtaaatatgtaatatgtaattgatctctgcattattttcaggtatattgaaagacctctgagttttcacacagcatctagtata

SEQ ID NO: 9067 - DNA, 478 bp, Mus musculus
  misc_feature (172)..(172): n is a, c, g, or t
  misc_feature (247)..(247): n is a, c, g, or t
  misc_feature (258)..(258): n is a, c, g, or t
  misc_feature (290)..(290): n is a, c, g, or t
  misc_feature (292)..(293): n is a, c, g, or t
  misc_feature (340)..(340): n is a, c, g, or t
  misc_feature (352)..(352): n is a, c, g, or t
  misc_feature (355)..(356): n is a, c, g, or t
  misc_feature (367)..(367): n is a, c, g, or t
  misc_feature (370)..(370): n is a, c, g, or t
  misc_feature (372)..(372): n is a, c, g, or t
atcagcattgagaaccggccagcttcagtttctctgtggggctgcaggaagaaatgttactactaaagcaaggaacccataaaacctctctgtggtggacatggttccttgccacattctagaaactctttttgagccaaacttaaccctgagccttgaaaaacaagttttnttgtttgtttgttttaactttttttttttcattctcgctgtagatagcctgaatccaaagaaaaccaaaaggggnttatccaagtnattccacacaaaaacaaaacaaaaaacccttnanntgttcctactttagtcactcatttctcaatccaaagatcatgtttcnaacgtagtgttnaanntcttgagaaantcngnccaagtgtggtagtgtgcacctataaccccagcacttgcgagatagaggcagggggacctctgtgaattccaagacaaccagggctgtatagaagaccttttctca

SEQ ID NO: 9068 - DNA, 485 bp, Mus musculus
  misc_feature (282)..(282): n is a, c, g, or t
  misc_feature (287)..(287): n is a, c, g, or t
  misc_feature (331)..(331): n is a, c, g, or t
  misc_feature (382)..(382): n is a, c, g, or t
  misc_feature (386)..(386): n is a, c, g, or t
  misc_feature (439)..(439): n is a, c, g, or t
ggtttttaaaactggtgcattcacagcaaaaagggattctgtagctttaacttgtaaaccacatcttttttgcacttttttttataaagcaaaaacgtgccgtttaaaccactggatctatctaaatgccgatttgagttcgcgacacaatgtactgcgttttcattcttgtatttgactatttaatcctttctacttgtcgctaaatataattgtttcagtcctatggcatggtgatagcatatgtgttcaggtttatagctgttgtgtttaaagattganaaaangtggaaaacatctttgtacatttaagtctgtattataataagcnaaaaagattgtgtgtatgtatgtttaatataacatgacaggcacgaggacncctnccttttaagaggcagttccgttaagggtttttgttttaaaactcttttttttncctttctttttttatttctttttttttaaccatccatcctgtgcaa

SEQ ID NO: 9069 - DNA, 355 bp, Mus musculus
gtgtcccacacctgctattattaaattcttccctggtcccagttgttcacatttggctaacaaggtccttgattgtcacagtattttcaataaatgagctattatgaactgcctggtgatattttcagcaagagcaactaaaatgtgtatggcctgtgctatatagccatggaggagatgggactgtgctaaagccagccagaaatgtggatggcagtgtgggaacccagcagctccatagccatcaaaaaacggtcatagaaagaagtctctcaagggcctattcttggattcagtgttccctcagaagcaatcctttaaatgtaaatagtgaatacttgcatgtctttggaca

SEQ ID NO: 9070 - DNA, 134 bp, Mus musculus
  misc_feature (41)..(41): n is a, c, g, or t
acaaacaactttgccttttcggcagtcttaagctccactgnatattatttatagtttgagttcttagatcagagcgtccattcctttatccagggtggatgttgagctacaggatccagctgtgagcagatgga

SEQ ID NO: 9071 - DNA, 308 bp, Mus musculus
  misc_feature (266)..(266): n is a, c, g, or t
  misc_feature (271)..(271): n is a, c, g, or t
  misc_feature (280)..(280): n is a, c, g, or t
cagctttctgtactaccatatgggaactatatgtaacttgtatacttacctgaatatgttaaattcaactacatggtaagatggaccagaaattgcaatgttcatgtccatatagccaccattaacccaagttaagcacagtagtgtgggttctctcaggacttgtgaatgagtttatgctctctacaaagacaggtgaagcttaaatctctcttgcactgctatgtttatgcaaatatcaagattgtttctgtaccagggacttnacacnttctattcntactattttccctgtctacaatgttatt

SEQ ID NO: 9072 - DNA, 44 bp, Mus musculus
acaaatcctgggttattcatattccttgggattttgacttttgg

SEQ ID NO: 9073 - DNA, 266 bp, Mus musculus
tgggcttgggaaaatctgggattctttgacctcagaggatgctggcagcaagtggatcataagtatactatgcagagagaatattctaaggcaactttgaattcttgataaaccaggatgcagccatggttcacattcttgggccatctgtcctactgttgcatagaattcatattcttttttttgctttgtttgaataaaaatgttcttgtcattgcagcatcatctagagaagcgcatcaatccccacctgactcctgtgtgtc

SEQ ID NO: 9074 - DNA, 246 bp, Mus musculus
ggattgatgcgcttctctagatgatgctgcaatgacaagaacatttttattcaaacaaagcaaaaaaaagaatatgaattctatgcaacagtaggacagatggcccaagaatgtgaaccatggctgcatcctggtttatcaagaattcaaagttgccttagaatattctctctgcatagtatacttatgatccacttgctgccagcatcctctgaggtcaaagaatcccagattttcccaagccca

SEQ ID NO: 9075 - DNA, 291 bp, Mus musculus
gaggagactggattactcgaagcaaaatgtgaaccctgaagcgaacacagccttccacctggccctccccgtccgaggtttgattccgtgattttggtgctttctgtgtctgccctgcatagccaaggcacattgatctctgcggtttgcttttgtactggcaaggcggaatatttttattaccttttctattacgtatcgtatgagcttttgttgtttgcctagagggtttgtctcttacagcaagtttggagctatttattattgcttggtatttgtgctctgctttta

SEQ ID NO: 9076 - DNA, 537 bp, Mus musculus
  misc_feature (45)..(54): n is a, c, g, or t
  misc_feature (59)..(59): n is a, c, g, or t
  misc_feature (62)..(62): n is a, c, g, or t
  misc_feature (66)..(67): n is a, c, g, or t
  misc_feature (70)..(70): n is a, c, g, or t
  misc_feature (75)..(75): n is a, c, g, or t
  misc_feature (85)..(85): n is a, c, g, or t
  misc_feature (90)..(91): n is a, c, g, or t
  misc_feature (98)..(100): n is a, c, g, or t
  misc_feature (105)..(105): n is a, c, g, or t
  misc_feature (109)..(109): n is a, c, g, or t
  misc_feature (117)..(117): n is a, c, g, or t
  misc_feature (120)..(120): n is a, c, g, or t
  misc_feature (125)..(125): n is a, c, g, or t
  misc_feature (150)..(150): n is a, c, g, or t
  misc_feature (154)..(154): n is a, c, g, or t
  misc_feature (196)..(196): n is a, c, g, or t
  misc_feature (204)..(204): n is a, c, g, or t
  misc_feature (260)..(261): n is a, c, g, or t
  misc_feature (271)..(271): n is a, c, g, or t
  misc_feature (284)..(284): n is a, c, g, or t
  misc_feature (291)..(291): n is a, c, g, or t
  misc_feature (297)..(297): n is a, c, g, or t
  misc_feature (305)..(305): n is a, c, g, or t
  misc_feature (309)..(309): n is a, c, g, or t
  misc_feature (313)..(313): n is a, c, g, or t
  misc_feature (328)..(328): n is a, c, g, or t
  misc_feature (345)..(345): n is a, c, g, or t
  misc_feature (347)..(347): n is a, c, g, or t
  misc_feature (350)..(350): n is a, c, g, or t
  misc_feature (395)..(395): n is a, c, g, or t
  misc_feature (397)..(397): n is a, c, g, or t
  misc_feature (401)..(401): n is a, c, g, or t
  misc_feature (438)..(438): n is a, c, g, or t
  misc_feature (459)..(459): n is a, c, g, or t
  misc_feature (461)..(461): n is a, c, g, or t
  misc_feature (470)..(470): n is a, c, g, or t
gctggtggtcttgtgttctataaccacagacgatgagcaagccannnnnnnnnnccctnccnatgnnccnttgcnatacgttccntgctnnccagttnnnttccntgtntgagttcntgnccccnccttccttcagtgatgagcagtganacanaagtgtaagccaaacaaaccctttcctcccagctcgttcttnagtcacgntgtttcgttgcagcaatagaaaccctgagtaagtgcccaccccgccccccagtttnnaccatcttgntctgactcccttnatatgancctatnccccttcnttcnaganagcttcacttctcantttgatggtttcaggtntncgntagaggaagaaatgaatgacagttccgagaccttctatagaaagntntggnccaaggaagggagacttgtagtggtatcatttgagtntgaggccaggaaacaacttantnttctgcatntccgaaattacataggttacagagcttcattgtatccctttatgtgactataacttatgatgctgta

SEQ ID NO: 9077 - DNA, 558 bp, Mus musculus
  misc_feature (392)..(392): n is a, c, g, or t
agcatgtactttatccaggtggtattttccatggcacttgaggctccatactagaaaattattatgaacatgacaaacttgtaaaagtcttcaagtcttagaagcaagtatttttgctgagagaaactctgaaaatatgacaatgaagaaaattacttattctcaaatatttcatgatggagacaaagtgagaaagccagaagatgtggtattgtgtaacagtgctttgaaaccaaaataattcaatggaaaaggaaagtgattattgcagctaatatacctctcaaaaataatactgaaactaatagcattctgtatgtttaactcaaatgaagaaactcagacaaattatacttcttaaaagaggatagataggaccaactgagccaccnacataatatggtctttatcctgttgatatacctacagatatgcagttttctcccagtgtctagtattcatgatctgtatcatattctggtttcaaatttctgcatagctaactgtctttgtgtcccttgtgctgttgtcaacaacttcttgctcatattcctgtat

SEQ ID NO: 9078 - DNA, 566 bp, Mus musculus
  misc_feature (319)..(319): n is a, c, g, or t
  misc_feature (323)..(323): n is a, c, g, or t
  misc_feature (325)..(325): n is a, c, g, or t
  misc_feature (329)..(329): n is a, c, g, or t
  misc_feature (334)..(335): n is a, c, g, or t
  misc_feature (337)..(337): n is a, c, g, or t
  misc_feature (341)..(341): n is a, c, g, or t
  misc_feature (353)..(353): n is a, c, g, or t
  misc_feature (359)..(359): n is a, c, g, or t
  misc_feature (366)..(366): n is a, c, g, or t
  misc_feature (381)..(381): n is a, c, g, or t
  misc_feature (395)..(395): n is a, c, g, or t
  misc_feature (441)..(441): n is a, c, g, or t
  misc_feature (525)..(525): n is a, c, g, or t
gttgcgaactcactaacaggtttatttctttttctttttctttctttctttttttattttttatcttttcttttcttttcttttttaattaggtactttgttcattcacatctccagtgctatcccaaaagtcccccacaccctccccctcagggttactttctgagctctgtgttccttgttaaacaaatatatgcttcaatttcattcagagatagctgtttaaccgtatttcacgtggtatgtggtggaggtcagggaggtctctttccaccatgtgggccctggggcaggcttgatgctggttacctttaccttntcantnatcntgctnnangtgncttttaaggctnattttnacagatnctgataatttgattntctgagttgtcatnaaccagacataaataagtagccaattcattttctgtatatgacttntctagatttatattgttgagttgtttgaatatgcttaaaccctaatatcactgtcaatatatccatcagtagaaaaccaagttntccctttcattttttatattttgctgatatgacaggcttgt

SEQ ID NO: 9079 - DNA, 432 bp, Mus musculus
  misc_feature (361)..(361): n is a, c, g, or t
aagagagcgcgcacttggtaacaaagtgtcattactcggttttcttttctaacactgcacttcaaaaacatcttgggccatttcacttttttcctgtggtacttaagagctatacctgtataccttaaaaaaaggatggctcataattaaagcagcagtaggaaaggatgtttgatgtttgctgaaacttagcgtatagagtgggagtaagtcccaacatgaaagggacttaccgttaggcatatgtgatgtggaaaatcacagagtcgtacactcagatctattcagttgtgtaatcaccgtctgtctgaattcacttgctttttttggaggcggggtggggagaattactggagatcanccccaggacctcacacatgattgacagatgcgctactactgaattatattctcagcacctgaagtttcaaa

SEQ ID NO: 9080 - DNA, 247 bp, Mus musculus
tctgattcagaaagcccatgtttttcacagtatcaggaagtattttatctaaaatggtggtttctattttattacagttttttatagcggtacatggtatcactttaggcagtttgccaaaattgagatgagagagaacccaacatggtgttacacaagtgtaatcccagtgtggctgacatgcaggagggcctgcgttcagggccagcctgggctactcgtgcaacaaaagccgacgcagagggaa

SEQ ID NO: 9081 - DNA, 528 bp, Mus musculus
  misc_feature (150)..(150): n is a, c, g, or t
  misc_feature (175)..(175): n is a, c, g, or t
  misc_feature (293)..(293): n is a, c, g, or t
  misc_feature (295)..(298): n is a, c, g, or t
  misc_feature (301)..(301): n is a, c, g, or t
  misc_feature (303)..(303): n is a, c, g, or t
  misc_feature (306)..(307): n is a, c, g, or t
  misc_feature (316)..(316): n is a, c, g, or t
  misc_feature (341)..(341): n is a, c, g, or t
  misc_feature (351)..(351): n is a, c, g, or t
  misc_feature (371)..(372): n is a, c, g, or t
  misc_feature (395)..(395): n is a, c, g, or t
  misc_feature (399)..(400): n is a, c, g, or t
  misc_feature (411)..(411): n is a, c, g, or t
  misc_feature (413)..(413): n is a, c, g, or t
gcctcattgagtttgacacgttcgtcagacataaggtaccagtgatagccttggtaggaaacgatgcaggttggacccagatttctcgagagcaggtgcccaggttgggcagtgatgtagcctgtagcctggcttacactgattatcacnaggcagccatgggcctgggggcccnagggattgatactctcacgggacaataaggatcaagtggtcaaggtacttcgtgaaggccagcagctgtgccaggatggtcatgcagttgtggtcaacatcctgattgggaggacagnannnnccnangannggctccatnttctgtatagggactatccagggtnagtgtgcttncctctttggaccaggacttnntctacctggagttttcatccttncctnntcctgagcttntnctcataaggtctaaccctctaagtggggaatgtgggggtggggaaccaaagctcaaagaggcaccttggcaaccctgggtagctctttccaaaaggttcagctgtaccctctctc

SEQ ID NO: 9082 - DNA, 448 bp, Mus musculus
  misc_feature (325)..(325): n is a, c, g, or t
  misc_feature (335)..(335): n is a, c, g, or t
  misc_feature (351)..(352): n is a, c, g, or t
  misc_feature (356)..(356): n is a, c, g, or t
  misc_feature (395)..(395): n is a, c, g, or t
  misc_feature (400)..(400): n is a, c, g, or t
  misc_feature (405)..(405): n is a, c, g, or t
gattctttagacaatgcctttttcttatttctcatccccaataaagatctcccagtgagattttgtgtaaataatctgtaatataggaattcagagggcctcagtcatttatcacagctagatgaccttacagacagcagaaaggacaggaaagatagtgggagacagtagttttcctcacaaattcttacattccagccaagacaaaggatgtgtgaagtctgagttggtactgttcctgcagaatggtaggagcaggtgggatctcctgatacaatctggaacaaagtttggcctgtcacatgaggttttgtttaccaggctntcttgaaatntctgggcagatgggtnntctnccaaagcaaggactgatcctgtctgtgaacagcaatgtntctgntcttnttctctgtggagtgactcacccatttactgaccacttgtgaaa

SEQ ID NO: 9083 - DNA, 465 bp, Mus musculus
  misc_feature (157)..(157): n is a, c, g, or t
  misc_feature (162)..(166): n is a, c, g, or t
  misc_feature (200)..(200): n is a, c, g, or t
  misc_feature (216)..(216): n is a, c, g, or t
  misc_feature (229)..(229): n is a, c, g, or t
  misc_feature (296)..(296): n is a, c, g, or t
  misc_feature (320)..(320): n is a, c, g, or t
  misc_feature (331)..(331): n is a, c, g, or t
  misc_feature (353)..(353): n is a, c, g, or t
  misc_feature (359)..(359): n is a, c, g, or t
  misc_feature (390)..(390): n is a, c, g, or t
agagataggaaggaccacctttctgaaggcccctcccctgtaggcgccatgttcctttctgaatgctctcctctcccctcccctacctcaacagggctgccaactttggggaatctagaagttgggaattctagggagttaagccccagcttctgtntcccnnnnnctggtctcacttttcacactgactggggctcccngtcaccctcctcttanttgggcgggaggnggaatcaccctacttccagagaagtgtccggtccggtacagcttccggtacagcttcaactaggttnaactgtgcagctgaactcttaatntctcacaaggncctgctttcaggtctggctagngagttntcatggctgaggttttttaaagcgggtctgnctcagaactaaactaaccagtattgtattgtgatacatggctttagggactgacagagcaggtagacactccctc

SEQ ID NO: 9084 - DNA, 407 bp, Mus musculus
gtaataattgagactgcctgggcattttacaaaatgagaagaaaaaaaagtcctttttcttttccttgaaaccgttacagtaagttttaaatggtgggtctataaaatctgctctgtcacagcaacctgtaaagtcggagttttagtaaatttttttctgccttgggtgttgaatttttattttgaaaacaaaatgtatagaaacttgtatttggggtttaaagggggattgctgcaatgtgtagaaaaagtatgtagagaaagtgcttaatattgttactgctttgcagaagaagaaaaaaaaaatcacacttctgacctgtgcgtatttttctctcccacctccctctggaatggatctattggtcggttcatatgatgtaggctctcgctgtatttttaactgg

SEQ ID NO: 9085 - DNA, 541 bp, Mus musculus
  misc_feature (326)..(326): n is a, c, g, or t
  misc_feature (333)..(333): n is a, c, g, or t
  misc_feature (339)..(339): n is a, c, g, or t
  misc_feature (379)..(379): n is a, c, g, or t
  misc_feature (468)..(468): n is a, c, g, or t
agagaccacagaggcttgctgcttactggtttactccttatggtttgcccaaggatgcccctccccccccacacacacacaatgagctgggaccttcctcatgaagagggcaaagtatcaggatagactccctcttgctctctaaactccattttaagttgcttgtcctcagagtgacatggccttcacccttggcatctagaaaagtgaccacaaagtattatcaggagttgaaaatagacataaaacctttggctagctcataataacaagatagattggtcacaataacaggatgatttcagaaaacctgagtcattcccagntcaagancccctnagatgtacactctctccttgtggtttgaacagatgatttncaccaatcagtttaaaggtcaatatttctttactcatttacccaatcatgtaacaccaaggcttgaaagctcctgcttgcaattttttncctatataaatcctaaactcctagacctttcttaatctgttgcatcaggaaggtttgtgttccgagtccaaat

SEQ ID NO: 9086 - DNA, 549 bp, Mus musculus
  misc_feature (59)..(59): n is a, c, g, or t
  misc_feature (292)..(292): n is a, c, g, or t
  misc_feature (302)..(302): n is a, c, g, or t
  misc_feature (341)..(341): n is a, c, g, or t
  misc_feature (343)..(343): n is a, c, g, or t
  misc_feature (420)..(420): n is a, c, g, or t
  misc_feature (438)..(438): n is a, c, g, or t
  misc_feature (449)..(449): n is a, c, g, or t
  misc_feature (465)..(465): n is a, c, g, or t
  misc_feature (478)..(478): n is a, c, g, or t
cttgcctgaccctactgagaaagaggaggacatttatgaagtcctaccagtggactatnccgattattaccagggcctatgggattgccatggtgaccagccggatgaactgtccttccaacggggtgacctcatccgcattctgagcaaggagtacaacatgtacggctggtgggtaggagagctgaacagcgtcattggaattgttccaaaggactatctcaccaccgcctttgaaatggaaggaatatgaagcccagggaacatattctcagaccatcagaaactcccntcccctactntggccatggatccttctcttccctgaatggagccaagantntgctgcttcctgtgactttaagccactgataagatgagtaggaagaagacagttcatcagacctgtttctcaagcanccagcttctagcttcctnccctctctgtntccccacatccataancctttcctacaancctgctacaaagaagacagcaacgaaggaaatcatgggaggaagaggttactgatgggttgtggcttgcaa

SEQ ID NO: 9087 - DNA, 128 bp, Mus musculus
  misc_feature (36)..(36): n is a, c, g, or t
tctgaactacattggacaagcactttattccctganccacattcctggcctggaaatatttttttcagaacttgacatattaagctgggcgtggtggcacacactgtagtctcggtttctgggaggta

SEQ ID NO: 9088 - DNA, 423 bp, Mus musculus
  misc_feature (240)..(240): n is a, c, g, or t
  misc_feature (260)..(260): n is a, c, g, or t
  misc_feature (263)..(264): n is a, c, g, or t
  misc_feature (266)..(266): n is a, c, g, or t
  misc_feature (295)..(295): n is a, c, g, or t
  misc_feature (303)..(303): n is a, c, g, or t
  misc_feature (308)..(308): n is a, c, g, or t
  misc_feature (323)..(324): n is a, c, g, or t
  misc_feature (334)..(334): n is a, c, g, or t
  misc_feature (337)..(337): n is a, c, g, or t
  misc_feature (342)..(342): n is a, c, g, or t
  misc_feature (371)..(371): n is a, c, g, or t
caaatatttttgtatgaggcatccgatttcagtctcttcagctcatcctgtctctaaaaggctagcggaaacacgcttcagcgcagattcatcgcgttatttttagataaggaattagaagtattatttaagggcagaggttaatagcaaagtactggaagtgttatgttagtcatgggcaattaataaaaataaggatctgtctgggaagtgccgaagacacagaagtgacaatatagncaaaatgtttgttgaatgantcnngnttctctttctgaaatatttgttaaacccncacgagtntgatnatttaggaattagcnntcattattanccnttttnaaagaactaatgattttcttttccaaagnacatctgtgatccacatgtttttcccttccatccaagcaccaagtgatctct

SEQ ID NO: 9089 - DNA, 407 bp, Mus musculus
  misc_feature (55)..(55): n is a, c, g, or t
  misc_feature (149)..(149): n is a, c, g, or t
  misc_feature (165)..(165): n is a, c, g, or t
  misc_feature (167)..(167): n is a, c, g, or t
  misc_feature (170)..(170): n is a, c, g, or t
  misc_feature (172)..(172): n is a, c, g, or t
  misc_feature (175)..(175): n is a, c, g, or t
  misc_feature (180)..(180): n is a, c, g, or t
  misc_feature (197)..(197): n is a, c, g, or t
  misc_feature (207)..(207): n is a, c, g, or t
  misc_feature (209)..(210): n is a, c, g, or t
  misc_feature (216)..(216): n is a, c, g, or t
  misc_feature (230)..(230): n is a, c, g, or t
  misc_feature (232)..(232): n is a, c, g, or t
  misc_feature (235)..(235): n is a, c, g, or t
  misc_feature (237)..(238): n is a, c, g, or t
  misc_feature (276)..(276): n is a, c, g, or t
  misc_feature (280)..(281): n is a, c, g, or t
  misc_feature (283)..(283): n is a, c, g, or t
  misc_feature (292)..(292): n is a, c, g, or t
  misc_feature (295)..(295): n is a, c, g, or t
  misc_feature (305)..(305): n is a, c, g, or t
  misc_feature (310)..(310): n is a, c, g, or t
  misc_feature (313)..(314): n is a, c, g, or t
  misc_feature (333)..(333): n is a, c, g, or t
  misc_feature (340)..(340): n is a, c, g, or t
  misc_feature (345)..(345): n is a, c, g, or t
  misc_feature (358)..(358): n is a, c, g, or t
  misc_feature (382)..(382): n is a, c, g, or t
tgtggtttggcgcagctgtgatcgctggcggactgatcttgtgctgctgccttanctgttttgttggccttgcgagtgcttcaaagtaagaacaagagactgcaggatcggtggcagcagatgctgtcctgtttgcactacagctttcnccgcggtggctttccnanatntnagntacanagcttaaatttgaaganatcaccagtntnntcaacnagagaaagtacccnangangnnacaacaatatgaaataaccagtaccccccagaactgtntctnnanttgcatatntancagaggatgncctanttnnctatcaatgagaggagagncccttgntcctncgaagatcatatnccccagtacaggggaatgccaggnccaagaagcattagtggatgggttg

SEQ ID NO: 9090 - DNA, 397 bp, Mus musculus
  misc_feature (222)..(223): n is a, c, g, or t
  misc_feature (227)..(227): n is a, c, g, or t
  misc_feature (244)..(244): n is a, c, g, or t
  misc_feature (255)..(255): n is a, c, g, or t
  misc_feature (274)..(274): n is a, c, g, or t
  misc_feature (284)..(285): n is a, c, g, or t
  misc_feature (287)..(288): n is a, c, g, or t
  misc_feature (295)..(295): n is a, c, g, or t
  misc_feature (297)..(298): n is a, c, g, or t
  misc_feature (309)..(309): n is a, c, g, or t
  misc_feature (317)..(318): n is a, c, g, or t
  misc_feature (326)..(326): n is a, c, g, or t
  misc_feature (329)..(329): n is a, c, g, or t
  misc_feature (351)..(351): n is a, c, g, or t
  misc_feature (357)..(357): n is a, c, g, or t
  misc_feature (372)..(372): n is a, c, g, or t
aaacattgtcttgatttgtagccaagcttggaactgttttcacaatattcttgctatagcctattgagagctgagattacaagtgtgcaccaacacgccttgatatattgtttctgatttaaaatagtttcttcattttttttgctttcttatttttaacaactaattgtacaggctatcatctacatttttactctctacctacttatgtctttaaatttnnagtntcttttgatacacatantatatgctttnatatttttcttccatcatnttaagtgtgnntnnatcattntnntgcttttagtnaatatcannactgatantanagaatttagtgctattgttttnccactngtttttcatgttttntatttttcattgctctctacatttt

SEQ ID NO: 9091 - DNA, 383 bp, Mus musculus
  misc_feature (224)..(224): n is a, c, g, or t
  misc_feature (295)..(295): n is a, c, g, or t
  misc_feature (302)..(304): n is a, c, g, or t
  misc_feature (307)..(308): n is a, c, g, or t
  misc_feature (337)..(337): n is a, c, g, or t
  misc_feature (342)..(342): n is a, c, g, or t
gagttccattatgtctggtccagtgtagaatccagttgtgtgtatctgtactagacaggtctacagtttggatgaggatgctgttttttgatgggcactactacccatgggtagttaagcttgagaataaatcacacaagaggtaagaccttgagtactggaaaggttttgttttgagggaatgtgctattttggcatctgaggtcaaggagaataatttatgngtggcatttgatgttggcttcgtgtgtctgaactccatgttgtgcgaattgaggtgagcccacaatagatngacggcnnnttnnatcggagacttgttatggatgagtgaaanccctncctttcattatgcagcaacttggcagggtccaggcagagta

SEQ ID NO: 9092 - DNA, 475 bp, Mus musculus
ttggaatctgtgctccgtcaggaaccttgaagacgcttgggccttaactctatgtccgtggtcctgggtaaggaggcggcagaatggcgagcctggtggctgagccaggaaagctaaggtgagattgaggccacagctgggattgatcacccctgaaataggggggttctcagtttgttcctgttgagacttggccagtctaggtctgccgagtccagggctctgccgggccaggctgtctctcagcttttatatcttcactgtcctggtctcacaacaaatgccaactacatttacactctttatgctcttgcttatttactgtcgcccctaaaagtagtcatttaccactcagaaagtcgccctggccctgaaacaataaagacaacgagaactgaacgcacaggacctggaggtcagcaaaaccacggcatcccgcttaaaatcgaacaggcctcattttctgcgtttagaa

SEQ ID NO: 9093 - DNA, 504 bp, Mus musculus
  misc_feature (263)..(263): n is a, c, g, or t
  misc_feature (266)..(266): n is a, c, g, or t
  misc_feature (280)..(280): n is a, c, g, or t
  misc_feature (285)..(285): n is a, c, g, or t
  misc_feature (292)..(292): n is a, c, g, or t
  misc_feature (330)..(330): n is a, c, g, or t
  misc_feature (342)..(342): n is a, c, g, or t
  misc_feature (355)..(355): n is a, c, g, or t
  misc_feature (421)..(421): n is a, c, g, or t
  misc_feature (445)..(445): n is a, c, g, or t
ggttcccaggtcctacttgatggaaggagagaagcgacgcctcaaagttaccctctctgacctcagtgcaagaaccaggcccacccacccacacaataaacaaatgtaactttcaaattttctcttaaggaagagaacacagtcagaagatctgggtttgatgttatttttatggctacttggccaattcagacctttacagatcatgtgatcagatgtcttaagtggatagccttataatggccggaattccggtttcaganctnaccacagagtaganttcgntttggancctacaatatttagtgtgagaatgagtacatttcaaantcatttcttccntctttgtgcactngacgtttttgttttccttcatgtgtacggaattggtgttcttgaaactcacaaccattatttatanccttgtgtttgtaacagaacagancaaattggtcaggatgggctttggcttgagtaacaattcagatttcttgtagcccgaga

SEQ ID NO: 9094 - DNA, 335 bp, Mus musculus
  misc_feature (268)..(268): n is a, c, g, or t
  misc_feature (288)..(288): n is a, c, g, or t
  misc_feature (296)..(296): n is a, c, g, or t
gatctccacgtgtaagtgacgggacagggtactgacagctggcgtagctggacagagccagacgcttacgtacgtacatacgcttacgtacggacgcttacgtacgtacagacgcttacgtacgggcactttcatacagttcgttggcgcctgaatgggacagatatccccgctagcccaagctaaaagagagtgctggaggtgaagttcttgtgataactccatcctacgtacttatctgatgggaggtcatgccgttatggagtantcatagccgatggtacctgncctgggcntgatatattcatgctgataatactctgaacccgtggctc

SEQ ID NO: 9095 - DNA, 455 bp, Mus musculus
  misc_feature (235)..(236): n is a, c, g, or t
  misc_feature (245)..(245): n is a, c, g, or t
  misc_feature (262)..(262): n is a, c, g, or t
  misc_feature (353)..(353): n is a, c, g, or t
  misc_feature (357)..(357): n is a, c, g, or t
tttatcaagtatttccttctccggcctcttttctttctcttctcttctttctttactttttatgaagaattaagttgaccactctgatataattggaaggtaatatgttactaatgtatgtataatttggaaaaatattgtttacttttcagttgctataataagataccatgaccaagaaaacttattaagaaagtttatttggagctcacagtttcagagggttagagtccannaccatcatngcagggagcatggcagnaggcaggcaggcagacaggcagcaggcaggcagcaggcaggcatggctttggagtagtagctatctgggaatggttttggaaaactcagtncctncccgcagtgacaccttctccagcaaggccacagcttctaatccttccaaacagttccaccaattggggaccaagtttccaaccatatgaacctgtggg

SEQ ID NO: 9096 - DNA, 537 bp, Mus musculus
  misc_feature (390)..(390): n is a, c, g, or t
  misc_feature (420)..(420): n is a, c, g, or t
  misc_feature (427)..(427): n is a, c, g, or t
  misc_feature (449)..(449): n is a, c, g, or t
acatcctgcaattgtgtgttaccaggagatatgataatgtccttttctgggggagcttggcgtattgggaagccgcctctgccctttgctgtagatttggctgcataaaatgggccaaggatacccactgggtagacagctgtggcctgtagtggcgggaaagaagagactaacaatgttctctcaggcttctcctggcaagatggcttctcttttcagcccccagcctacagataaatcccaggtgtccattgctacagtggtaacttgactgtgtcccaagcagacaactggccctgatggtgaactggagaagttagctgcggggtcgctcatctcacgctgatgggcactgtagggcaaaggaatctcacccgttctctcttcccngaggagctggtaagagttctgtccaaggtnccccacnctgcttccgtttctgtgttttntcttttccttcctccaattaagttgggacatactatacattggacttgttgggatttgatgtttgaattctgttgacccgcactttaa

SEQ ID NO: 9097 - DNA, 582 bp, Mus musculus
  misc_feature (312)..(312): n is a, c, g, or t
  misc_feature (323)..(323): n is a, c, g, or t
  misc_feature (326)..(326): n is a, c, g, or t
  misc_feature (330)..(330): n is a, c, g, or t
  misc_feature (345)..(345): n is a, c, g, or t
  misc_feature (375)..(375): n is a, c, g, or t
  misc_feature (382)..(383): n is a, c, g, or t
  misc_feature (395)..(396): n is a, c, g, or t
  misc_feature (404)..(404): n is a, c, g, or t
  misc_feature (407)..(407): n is a, c, g, or t
  misc_feature (410)..(410): n is a, c, g, or t
  misc_feature (413)..(413): n is a, c, g, or t
  misc_feature (425)..(425): n is a, c, g, or t
  misc_feature (427)..(427): n is a, c, g, or t
  misc_feature (431)..(431): n is a, c, g, or t
  misc_feature (474)..(474): n is a, c, g, or t
  misc_feature (525)..(525): n is a, c, g, or t
  misc_feature (557)..(557): n is a, c, g, or t
aatgctttttcagatcgtgagggatttgggtatatcgggagcaacatttcagacaggcacagtagaaaaaagttcatcttagaaactattgaacgtatgtgagtaacttgtttttgaagctgttggtatgtgcagacatgtgggctgtattctgttatcaagactatgttctttgagtcctaaccaaaacacaccgaagaatgatgaaacaagccataacaggtttcattttgaaagagtctgtgaaatgcaagcatacatgtgcatccaaccatatatgtgctattgaaagaaagatgaagtcagcaattnccctctgattnacnaagnatgtctgagaatccnaacaggtcacgagttaatgtatatctaggntcccctnnagaggctttcannccaatttnttnctngtnctgggagatgtntntatnttgaggagtggataagagtgtgtgtgatatcatgtatgaggtncatgtatgtgcacacagacacgagaatgcattcagagagagtatgaacacntccaccagaccaggagagctatttttgggaancaaagcaccagttgttgacctgaat

SEQ ID NO: 9098 - DNA, 124 bp, Mus musculus
  misc_feature (32)..(32): n is a, c, g, or t
  misc_feature (35)..(35): n is a, c, g, or t
  misc_feature (46)..(46): n is a, c, g, or t
  misc_feature (53)..(53): n is a, c, g, or t
  misc_feature (89)..(89): n is a, c, g, or t
gggttcacatccagggatctcagaacagggcntgntccggggagtnggggatntttgactgggatggaggaagaattggacaaaggtgncacaggcttttaaacctagcattcgggagggaagg

SEQ ID NO: 9099 - DNA, 178 bp, Mus musculus
  misc_feature (133)..(134): n is a, c, g, or t
  misc_feature (145)..(146): n is a, c, g, or t
agtgcgggacccactggtcacctatgagggatctctcccaccagcatccccgctgcaagacaacctggttatcgccctgcacagttatgagccctcccatgatggagacttgggctttgagaagggtgaacanntccgaatcctnnagcagagcggtgagtggtggaaggctcagtcc

SEQ ID NO: 9100 - DNA, 503 bp, Mus musculus
  misc_feature (286)..(286): n is a, c, g, or t
  misc_feature (291)..(291): n is a, c, g, or t
  misc_feature (306)..(306): n is a, c, g, or t
  misc_feature (319)..(319): n is a, c, g, or t
  misc_feature (344)..(344): n is a, c, g, or t
  misc_feature (368)..(368): n is a, c, g, or t
  misc_feature (374)..(374): n is a, c, g, or t
  misc_feature (395)..(395): n is a, c, g, or t
  misc_feature (414)..(414): n is a, c, g, or t
  misc_feature (421)..(421): n is a, c, g, or t
  misc_feature (433)..(433): n is a, c, g, or t
  misc_feature (451)..(451): n is a, c, g, or t
  misc_feature (456)..(456): n is a, c, g, or t
  misc_feature (458)..(459): n is a, c, g, or t
  misc_feature (462)..(462): n is a, c, g, or t
  misc_feature (477)..(477): n is a, c, g, or t
ttatccatatgcacgtacacacgcgagcacgtgtgcatgcctgtgcacaagcatgtgtgtgcacacacaaacacactaatatttaggcctatttaatgtttagtgcaacttctctgctttaactctataggtgctgacgggttggctaagatggcaaggtttacaagtccagggtcatctatgagtctgtgcatcccagaagccctgccatgcagagcattgtttagcctcgtctttctggaactaaggcctggtctgatgtctgcagctccctggtaccgtgganctgtntctgctctgatagcntgggtagcatgcnttctcacttacactgcatggacctnataaatgaaactgaccctcacctnggttanctttccttctttttctccccntcttacagaagtaaggatncactttnagttgggctgtntcttatgtttaacctttncaggncnntcncctttctcttacagncctttgttccccttcagagaggaaat

SEQ ID NO: 9101 - DNA, 241 bp, Mus musculus
aacacacttgcgatataaacctgaaggcatcagtttgataggaaggcctgaaagtgggctcgaacaatggaggcatcggtactgagccccacatcctgggagaaacgaagggcctggttacgacagagtcgtaactggcaaacccaggtcctggaagaggaagcagcagcagctcttcaggatgcactggatcccgagccttctagcctggatgatgttttccaggaagggaatccaatca

SEQ ID NO: 9102 - DNA, 537 bp, Mus musculus
  misc_feature (160)..(160): n is a, c, g, or t
  misc_feature (245)..(245): n is a, c, g, or t
  misc_feature (249)..(249): n is a, c, g, or t
  misc_feature (252)..(252): n is a, c, g, or t
  misc_feature (256)..(256): n is a, c, g, or t
  misc_feature (260)..(260): n is a, c, g, or t
  misc_feature (264)..(264): n is a, c, g, or t
  misc_feature (269)..(269): n is a, c, g, or t
  misc_feature (273)..(273): n is a, c, g, or t
  misc_feature (341)..(341): n is a, c, g, or t
  misc_feature (350)..(350): n is a, c, g, or t
  misc_feature (468)..(468): n is a, c, g, or t
gatatagccctggaatcatgccacaagttcatacttttgcactacggacatcgagtctttaatttggaatcagtgggtcagtccccaccctacctggttcatgtacacacctgtatgtatgtatgtacacatactatataatgcaatcaatgtgtttttntagtatagttgtttttaaattgacttttggcttcttccctctctcatcatataatgaagagtaaaataccaacccaccattccanattnagntacngatnccangtctncatnactgatactcaggtcctaaggacttagaaactctttagtcatcaaacagctttctctgagatatattntctcatacnaacatcacaagagaacatatatttgggaaaaaactttcagaaaggattgaagcattactttttttttttgtttgttttttgtttttttgttttttcgagacagggtttctctgtatanccccagctgtcctggaaccactttgtagaccaggctggcctcgaaaagcactactttcttgattttgct

SEQ ID NO: 9103 - DNA, 521 bp, Mus musculus
  misc_feature (116)..(116): n is a, c, g, or t
  misc_feature (296)..(297): n is a, c, g, or t
  misc_feature (317)..(317): n is a, c, g, or t
  misc_feature (330)..(330): n is a, c, g, or t
  misc_feature (372)..(372): n is a, c, g, or t
  misc_feature (419)..(419): n is a, c, g, or t
  misc_feature (432)..(432): n is a, c, g, or t
  misc_feature (474)..(474): n is a, c, g, or t
  misc_feature (479)..(479): n is a, c, g, or t
atggagggtacaattctgtggcattgattgtatttacaccgatataaacagctgtcaccacccgctcttctgaattctttcatcaacccctttgaactaacctctacttttgcttnatcaaatttcaagcattaaaatgaggttgaatcattttctagctgagaagaatttgtcccaggttgtggctttcctttgcttaagtgttctgtgatgtttgctcatggcagtacagtaccagatactgcttttggcagatgtctccacagacattatttggactagttatttgggtcttnntccttgcaactaaactcttnacctttgcaactnaaccagaaaacactaataataataatattcataataataatnatattcatatctctaaggaagtctgattggtatatcttggtgaaagnctgggaagggctntcggaattcataagagttagaatccttccagcttcccaagantcctnccctcctaatcaaggttgaagtgtccctcagttattgtcaag

SEQ ID NO: 9104 - DNA, 574 bp, Mus musculus
  misc_feature (285)..(286): n is a, c, g, or t
  misc_feature (288)..(288): n is a, c, g, or t
  misc_feature (290)..(291): n is a, c, g, or t
  misc_feature (293)..(294): n is a, c, g, or t
  misc_feature (296)..(296): n is a, c, g, or t
  misc_feature (298)..(300): n is a, c, g, or t
  misc_feature (306)..(306): n is a, c, g, or t
  misc_feature (318)..(318): n is a, c, g, or t
  misc_feature (325)..(325): n is a, c, g, or t
  misc_feature (331)..(331): n is a, c, g, or t
  misc_feature (344)..(344): n is a, c, g, or t
  misc_feature (355)..(355): n is a, c, g, or t
  misc_feature (368)..(368): n is a, c, g, or t
  misc_feature (376)..(376): n is a, c, g, or t
  misc_feature (385)..(385): n is a, c, g, or t
  misc_feature (401)..(401): n is a, c, g, or t
  misc_feature (466)..(466): n is a, c, g, or t
  misc_feature (547)..(547): n is a, c, g, or t
ttttttccttctcgctctggctctgctcactccagccctgcttgctccaaccccactcactttagcccaaggattgatttgtttgattgattgattgattatatgagtacactatagctgtcttcagatgcaccagaagagggcctcagctctcattacagatggttgtgagccaccatgtggttgttgagatttgaactcatgacctctggaagagcagtcagtactcttaactgctgagccatctctccagccccttcatatctttgaaacaaataaataaanntncnntnncncnnntttcanttacccacattnaactttnttttgnaaatatgaaatgnaaaatttcagnatcaaactattgntcagtttnagatttcanaacattctgagtcatntgatgaaccatctagaatgtgagtcactcctttgtataatgcatttgtttacactgtacatttcntccccattagtcacttagtgttggttctcaaattgactattatggtatcatagtgctgtgttcaagaaacccttcatttanccaataatgccccagtatgtaagagta

SEQ ID NO: 9105 - DNA, 570 bp, Mus musculus
  misc_feature (161)..(161): n is a, c, g, or t
  misc_feature (175)..(175): n is a, c, g, or t
  misc_feature (198)..(198): n is a, c, g, or t
  misc_feature (247)..(247): n is a, c, g, or t
  misc_feature (275)..(275): n is a, c, g, or t
  misc_feature (299)..(299): n is a, c, g, or t
  misc_feature (304)..(304): n is a, c, g, or t
  misc_feature (312)..(312): n is a, c, g, or t
  misc_feature (341)..(341): n is a, c, g, or t
  misc_feature (364)..(364): n is a, c, g, or t
  misc_feature (378)..(378): n is a, c, g, or t
  misc_feature (400)..(400): n is a, c, g, or t
  misc_feature (406)..(406): n is a, c, g, or t
  misc_feature (466)..(466): n is a, c, g, or t
  misc_feature (470)..(470): n is a, c, g, or t
  misc_feature (477)..(477): n is a, c, g, or t
  misc_feature (481)..(481): n is a, c, g, or t
  misc_feature (485)..(485): n is a, c, g, or t
  misc_feature (495)..(495): n is a, c, g, or t
tgagctgtgactgtggttgccacacagcacgggggtggagtttccccagtgagttactgctttcataaaccaagtcagacgcatttgcacagtgatttaatgccggccatcacagccataacttaaacatttatctatttgtaacaataggagcataaaangacagggacatttntttgatataatgtgttcgctttnaaaaaaataaaatatgcaagacactgtgcaaggtttataccgagatttntgcataatgaaggtctggaattaatttnaagtataaaattttaaacatttgnagatntctcattngacgtggaagtcccacttctaggaatgtnatatagaaattaaatatatgttnatatattgcagatntcaatgaggtgggaaaagtagntgatgntcaattggatcatgggacatccatcttagtttgcatcaaaagaacttggagatctgtgtntctntctgacntctntctntcttggcttncagtatgtccatggagtgtttttaagactaaaaagatgtaataaacaacagcacatataatgatcctttttctat

SEQ ID NO: 9106 - DNA, 75 bp, Mus musculus
gtggtagagcacatgttcaatcccagatctcctccactgagatgggaggtgaagaaaagagaacagccagaagcc

SEQ ID NO: 9107 - DNA, 79 bp, Mus musculus
  misc_feature (31)..(31): n is a, c, g, or t
caggcactgtttccacggctgaagttgcggnctccccacgtgtgccatggtgtgttatcacacatattttcccctttcc

SEQ ID NO: 9108 - DNA, 486 bp, Mus musculus
  misc_feature (248)..(248): n is a, c, g, or t
  misc_feature (289)..(289): n is a, c, g, or t
ggacaaatctgatctatcgaggttttcataagttcagctctggaatagaatccaagcataatgtaagtcctagtaactgaagcagtcttttagaccgggaaacaggaccaggggagcgaaggtccttccaatttaaacactctcaaaaggctgtgtaattgctttctgataggagaggactctggcggtggaaagactattgttaccacagatcatttgtctcttaagatgtagcctctgaagaaagngtgactgtctaccgtaggctgctgggtgcttgggggaaagncttaggtaagctcagagcggacagaagatcgttttcggccctacactcccaagccagggagagaggctggggaatggtaggagcagatttgtgtaaagggggctggcactgtgtagatagaggttcagccttagggaggctgcattttggagctgggactcagctgattgtcatacctggtgagtaggtttctttct

SEQ ID NO: 9109 - DNA, 540 bp, Mus musculus
  misc_feature (296)..(296): n is a, c, g, or t
  misc_feature (300)..(300): n is a, c, g, or t
  misc_feature (320)..(320): n is a, c, g, or t
  misc_feature (354)..(354): n is a, c, g, or t
  misc_feature (377)..(377): n is a, c, g, or t
  misc_feature (386)..(386): n is a, c, g, or t
  misc_feature (389)..(389): n is a, c, g, or t
  misc_feature (413)..(413): n is a, c, g, or t
  misc_feature (417)..(417): n is a, c, g, or t
  misc_feature (424)..(424): n is a, c, g, or t
  misc_feature (429)..(429): n is a, c, g, or t
  misc_feature (475)..(475): n is a, c, g, or t
  misc_feature (482)..(482): n is a, c, g, or t
  misc_feature (484)..(484): n is a, c, g, or t
  misc_feature (487)..(487): n is a, c, g, or t
gatggaagccacttgggcagtaaacataaatgttgcaatgaagaagaaagtctagccttccagctgaaaaacagcaattccccaatggactttggcagaatctggactggccactgcaaagacaaaaacaagcttaaatgttttatcatatagagctcaaagagagaaccatgatatggaatttaaattgtctatttggtttcttaaaacccacaagtgtggttttcttgttgtttaagacatatttatttaatatgcatttttatgtagcttgtttttgctatcaacaattggcnattnagaaataattttgtacttcnattattcagtagaatcctatttttgaaagtctanactctcactgaatgttcaccttnatttccaancanttttctttccatttttccaggttnatcntcatttntgctnaactcaataaggaaaatgaattacatctgacagtgacttaaaatgnccaagtntnttntctgattccttgggaacagtgaaaataagtttgacttcacattttcaatttgt

SEQ ID NO: 9110 - DNA, 403 bp, Mus musculus
  misc_feature (164)..(164): n is a, c, g, or t
  misc_feature (166)..(166): n is a, c, g, or t
  misc_feature (172)..(172): n is a, c, g, or t
  misc_feature (174)..(174): n is a, c, g, or t
  misc_feature (176)..(177): n is a, c, g, or t
  misc_feature (179)..(183): n is a, c, g, or t
  misc_feature (185)..(185): n is a, c, g, or t
  misc_feature (192)..(192): n is a, c, g, or t
  misc_feature (199)..(199): n is a, c, g, or t
  misc_feature (206)..(206): n is a, c, g, or t
  misc_feature (247)..(247): n is a, c, g, or t
  misc_feature (256)..(257): n is a, c, g, or t
  misc_feature (273)..(273): n is a, c, g, or t
  misc_feature (284)..(284): n is a, c, g, or t
  misc_feature (299)..(299): n is a, c, g, or t
  misc_feature (304)..(304): n is a, c, g, or t
  misc_feature (308)..(308): n is a, c, g, or t
  misc_feature (361)..(361): n is a, c, g, or t
aaatacaatcaacttcttacagacttttccaagatgctatattcatatacatacaacacaaacaaaaccgtctctttcctttcttttttttatatagcagctgcataatctatacacactactctttttttttctctccattggttagcagcctcatttggagntnagtccntngnngnnnnntntaaaganccttttnatctttnatgaatggaaaatggctcattatgtggattaaatgtttccnttatacatnnagtgtgcttctgtttngtttttacaancaacaagaatgaatnacctntatntcacttttaatggttataactgtgactattagaggcagcctatggacatttantctcattggagattggagatatgattgctactgatgttcagt

SEQ ID NO: 9111 - DNA, 450 bp, Mus musculus
  misc_feature (257)..(257): n is a, c, g, or t
  misc_feature (300)..(300): n is a, c, g, or t
  misc_feature (303)..(303): n is a, c, g, or t
  misc_feature (328)..(328): n is a, c, g, or t
  misc_feature (346)..(346): n is a, c, g, or t
  misc_feature (355)..(355): n is a, c, g, or t
  misc_feature (368)..(368): n is a, c, g, or t
  misc_feature (395)..(395): n is a, c, g, or t
ggcacagccgtaaggaataccccagagattgaacgagtgaagaaaaaccagcacaatattagctcattccagtataaagagcaaacctataaggccactcctgtaaccatgaccccagagatagagagagtgaagaggaaccaggaacagctgagtgcggtttattataaaggtcaactgggaagggctacagctttgagtgtaactcctgaaatggaaagagtaaagaagaatcaagaaaatatcagctcggtganatacactcaggaccataaacaaatgaaaggtagaccgtgtctnatnttagatacaccggctttgagacatnttaaagaagcacaaaatnatgtttccntggtaggatgcancggatcactgtctccatgactaaaacntactaaggaacggcaagacctgtatttggatggcattcactcactacttatctga

SEQ ID NO: 9112 - DNA, 420 bp, Mus musculus
  misc_feature (312)..(312): n is a, c, g, or t
  misc_feature (341)..(341): n is a, c, g, or t
  misc_feature (350)..(350): n is a, c, g, or t
  misc_feature (371)..(371): n is a, c, g, or t
gctgacccaggtagatctccttgaatgaatagcttcacaaacatattgcatacctcatttgtgtcatatcggcggtggtcccattgttcaaagagacattgcccaaagagacctggtccatcccttagctcctttaagtgggtgctgtgattcccatctgaatatcaggctgtggaatatttggtgacagtaaaaagtttctgaaagcaccgactcaggatcaaatgtgtaataaactcgaggcctttctggctgagcttccgtgagctgctcaggtcccccgtcactgtagactcggtttgaacacaagcntgcgtcacgctgcgagacaccaaggacanctgccagantcccctccacttggattgganaccgaaatgttggcaagcgcagtgtttttactggacgtgcaaagctctc

SEQ ID NO: 9113 - DNA, 542 bp, Mus musculus
  misc_feature (229)..(229): n is a, c, g, or t
  misc_feature (335)..(335): n is a, c, g, or t
  misc_feature (451)..(451): n is a, c, g, or t
  misc_feature (484)..(486): n is a, c, g, or t
gagagagtctcaccacatggctaggcttgtcttaaacttgtaatcctcctgcctcagcagcccctccaagtgctgggtctatccaggtccagttatggggctggagagatggctcagtgattaagagcactggccattcttcctgaggacctgggttcagttcccagcacccacttagtggctcacaaccatctgtaactccagtccctagggagccaacacactcttntggcctctgggtagaccaggcacatacttgctacacagatatacaatcagagaagacatccatacacataaaataattttaaataaataaatagaccttaaaagtntttgtttgtttgttttctaaaaatcagctatgggattagagagatggctcagtggttaagagcactggctgctcttgcagaggacgtaggttcagttcccaacacttacctgacancccacagctacctgtaactctagttccaggggnnntgatgccctcttctggtctccacagaccccagtcacttaaatgttatatctgcatg

SEQ ID NO: 9114 - DNA, 432 bp, Mus musculus
  misc_feature (114)..(114): n is a, c, g, or t
  misc_feature (118)..(118): n is a, c, g, or t
  misc_feature (252)..(252): n is a, c, g, or t
  misc_feature (265)..(265): n is a, c, g, or t
  misc_feature (302)..(302): n is a, c, g, or t
  misc_feature (304)..(304): n is a, c, g, or t
  misc_feature (339)..(339): n is a, c, g, or t
  misc_feature (347)..(347): n is a, c, g, or t
  misc_feature (362)..(362): n is a, c, g, or t
tcaggaaaccttatggtgggttacaaccataaacaacttccatttgaggtaagtagagggatgtatatgatatacagatagaaggaaggaaggaaggaagacagacagtcagtngggngggcaggcaggcagacaggcagacaggtaaaacactcatacacataaaatataataaggtttaagaaaaagaaactggttcctaactgcagctatgattcccatttttaacaatgacatcctgtgcctacggtntgacagatctcancacgcttacttcagtgtgcaccgttttcagcccgggntntaaggcgccgagaaaagcatggaacagacacaatntgtacttntgaaagagacatccntcaattaagctgagttgaattgcttgtaggacctttggaaataaggatgataccccagttgtgaagagca

SEQ ID NO: 9115 - DNA, 194 bp, Mus musculus
  misc_feature (53)..(53): n is a, c, g, or t
  misc_feature (61)..(61): n is a, c, g, or t
  misc_feature (102)..(102): n is a, c, g, or t
  misc_feature (120)..(120): n is a, c, g, or t
  misc_feature (122)..(122): n is a, c, g, or t
  misc_feature (129)..(129): n is a, c, g, or t
  misc_feature (135)..(135): n is a, c, g, or t
  misc_feature (165)..(165): n is a, c, g, or t
gtgaagaaatggacacgtatactttgaatcaggaagcgtctggaattaacacnactacaanctgttgcaactagaattcccttgaaagaccacccgattccntctcctttgtattaaagncntgataanccgggnccaccttcagaacgtggatcagtgatgtgncctcaccacagcggggatgtatctgcaaa

SEQ ID NO: 9116 - DNA, 104 bp, Mus musculus
  misc_feature (31)..(31): n is a, c, g, or t
  misc_feature (35)..(35): n is a, c, g, or t
  misc_feature (61)..(61): n is a, c, g, or t
gggacaagcttacagttaggtgaccagaagntctnccgtgtactatgtatcacaatagtanttaagtgtgaggcttcagaactgtgacctgatacattcacaaa

SEQ ID NO: 9117 - DNA, 77 bp, Mus musculus
  misc_feature (39)..(39): n is a, c, g, or t
caggagaactccctttagcggtgcacctggacatcaganccccttgtaagaactgggaaattgctggcattttagtg

SEQ ID NO: 9118 - DNA, 465 bp, Mus musculus
  misc_feature (126)..(126): n is a, c, g, or t
  misc_feature (243)..(243): n is a, c, g, or t
  misc_feature (250)..(250): n is a, c, g, or t
  misc_feature (259)..(259): n is a, c, g, or t
  misc_feature (376)..(377): n is a, c, g, or t
  misc_feature (418)..(418): n is a, c, g, or t
gatctgtcataattaccattctgcatgtttctgacacacgctgtgaaatatttcaatttaactgccgctaccagcacaaccagatgtagtgcgagtgtggctgcattggaaatattattccgcagnataaactctctcctcctcctcttccctccccccctccagctaatgtggcacagaagctgatgtatcctgtaaatcttgaatgtagcgctagattgataacaggcgattagacagttnaaccacnaacagcttnttcatttttcacaaatgaaaaccacatgtggtggaactaaaatttcaaccccttttttttgtaagggttggggtatgtgtatgtgtggaagatgtccttaaataacaataaaatganncaatccaaagaagttaagtgtttagaaaaatggagacattncctagtttccctccagatttatcaaaacctcatcatattccctttta

SEQ ID NO: 9119 - DNA, 524 bp, Mus musculus
  misc_feature (117)..(117): n is a, c, g, or t
  misc_feature (340)..(341): n is a, c, g, or t
gtatctccagacagtggcgtcagactgtcatctactaatttattatgtcatctagtacaaagatgttggtgaagtgaaactccagtgtttctctgcccctatttctgctgggttganaagatttctgctttgacaacagtctgttctcaactggtcaatctgtcggttttgttgttgcttttagtatctaaacaacttttccaaacttaagtttataagttttcacatttgggtcgcaaaatacagaatttctcataaaacagctcactttgtgtctgtgtgtacatgtatgtgtgtgtgcacaccgcgcacacatggtgtatgcatatgtgtgtgtgtnngtgtgtgtgtgtgtatgtgtgtgtgaaagccagtggttgatgtcagatgtcttctttgacaactttctatcttactttttgactcaggattctcactgaatgtggagctcatcaatttgactagagtggctggccagcaagtcccagctttcacaatgggtgctgggcaatcggaactcacgt

SEQ ID NO: 9120 - DNA, 507 bp, Mus musculus
  misc_feature (273)..(274): n is a, c, g, or t
  misc_feature (284)..(284): n is a, c, g, or t
  misc_feature (302)..(302): n is a, c, g, or t
  misc_feature (359)..(359): n is a, c, g, or t
  misc_feature (409)..(409): n is a, c, g, or t
  misc_feature (422)..(422): n is a, c, g, or t
acagcagcgtggtcctagcttcagtctggattagcttagggagaatgagttgttctagaagtttaataaagaaataaaatcctccccagagtcaagagacttcataaggaatcctaggtttaaaatgtgtttcagagtcatatatgctcaacatatggagagagaagaagccttaagaataaaaggagaatttaaatacccaagcataaaacaaatggtctacacttaaattagacagcaagccacagcaaaggcttgtgagctgtccttctnntcccctcccnaaaggaacccaccttccnacagcacggggtcacaggtgctttaagacctggaactttctccctctaatactcttntcaagtgtccttacagggaaagtgacaaccaggctgtcactccccacttncccacatgggggncccaggtgtagattctagctctttcttctgctggtttttgttgaggttattgtcacagtggaacacgggttaccagaacttctat

SEQ ID NO: 9121 - DNA, 487 bp, Mus musculus
  misc_feature (251)..(251): n is a, c, g, or t
  misc_feature (342)..(342): n is a, c, g, or t
agccaggcactggtgatttagtaaatattgcagtgtcagttttatttcatttatacaatttatttcattgagaaatattgggtaaaatagatttccaaaacaaacgttatgacttatattctcccagggtgagcagactgcatttctcacaagctgaagctgcagatctcttccaaagaaaaatgatgggggttgacgctacaaatctgggtacatctttgggtgaagatttaaggtagagagaccagaangtctgactgatgagggacaggtgtataacaaaaactctaaagtctacaggccatgttttactctaaggaacattttaacatctaaattttnaattagaaagctagtctctttgctaaattacatggtcatccactttaaggaaataatgttgaatttaataattatgaaatgttttagaggaaaatcaagttgtttttatgtattccttcagactgcgttcatcttaatatgccat

SEQ ID NO: 9122 - DNA, 162 bp, Mus musculus
gagcagaagagttgaattaagttgaaacctgggcttggcttcctggctgctgggacagtgactgccagagcgctgtggcttgaacattgttaatagcttccttgagatggtcagtttagctttgtaaccaacatctgaaaatccaccttaactgcctctatt

SEQ ID NO: 9123 - DNA, 64 bp, Mus musculus
gaaacaaactgttattagcttagaacactatacaatgctttaggtgcagtggatctttgtttca

SEQ ID NO: 9124 - DNA, 531 bp, Mus musculus
  misc_feature (74)..(78): n is a, c, g, or t
  misc_feature (81)..(82): n is a, c, g, or t
  misc_feature (85)..(89): n is a, c, g, or t
  misc_feature (91)..(91): n is a, c, g, or t
  misc_feature (93)..(114): n is a, c, g, or t
  misc_feature (116)..(117): n is a, c, g, or t
  misc_feature (119)..(121): n is a, c, g, or t
  misc_feature (123)..(126): n is a, c, g, or t
  misc_feature (128)..(130): n is a, c, g, or t
  misc_feature (416)..(416): n is a, c, g, or t
gtgttttgctctaggaaatgcgtgcagcaaatgcacctttagaagtcagcagctggaactgagatgtgactctnnnnntanngtnnnnnanannnnnnnnnnnnnnnnnnnnnnanncnnntnnnntnnnagcactctggaagcagaggtgggcagatctccaagaatttgggacaagcctggtctacctgacaagttccaggccagccagggcgacacagagaatctcagtaactgaaaacactggagcagagacaggcctctccttccacctgctctgccggcagggtgggtgtgaacaggaagacctcagtcccagcgcacctcccgtggataggtttagggatatttatgggataaagatgcagatggtcgagggtgtggggaaatgattggagggactcagtggtctgctntgcgacgcttcagctgcagtggcaatggttaactcttgaggcactcatccgatggggacgatgacgtcaaaagcccatccatcagatttgtacataggcccaagtcaagagtcag

SEQ ID NO: 9125 - DNA, 505 bp, Mus musculus
  misc_feature (85)..(85): n is a, c, g, or t
ctagcattcctctatgctgggacatcaagccttcagaggacaaggggactcccctcccactgatgccagataaggcaatcttccncaaaagagggaaaaccaggaagtggaataatatttgaaatgtaaataaataaaaaataaaaaatttataaattaaacaagtgaaaaccttgaatctggagaaagatttatgttaatgaatacatgctaattttaatcaagctataaatatgttcacacaatcagaaaattccatgctttatatgtagttaaaatttttaattatatgtacatatacattatactataaatttcataaatattttactgtattgtggatgaataggcatgtgggtgctattgaacatggaatccagaggcctttgatgcatttatgaccagatttcatgaagttgagagttatcaaattttggtgattgtaacatttgtggatggtcttttgcaagagtagcaattgatcttaaccacaaagctcttactt

SEQ ID NO: 9126 - DNA, 395 bp, Mus musculus
  misc_feature (103)..(104): n is a, c, g, or t
  misc_feature (321)..(321): n is a, c, g, or t
  misc_feature (323)..(323): n is a, c, g, or t
  misc_feature (333)..(333): n is a, c, g, or t
  misc_feature (335)..(335): n is a, c, g, or t
  misc_feature (355)..(355): n is a, c, g, or t
aaattcctaaatgggccatcccaagtctaaactattctcttttcatcccatactatattctgtaatttgaagtacttttatacatttatagatatttagtatnnatttttccacccctattcttacaattagattctatccatactctctcaggaagtgagaaccaggaattaggtcctttcagactatggaggtcgggattcctattgtttagttctaaatagacacctatacatagacttatacatatactcacaggtaggcatatggattaagcttgtagtagtcatgtgctttgtctctgagggtccttttactctncntatgtctagnanagggtcatagtaatttcctntgaattatgaagtatagaaggagagcttaaccatgcctgg

SEQ ID NO: 9127 - DNA, 351 bp, Mus musculus
  misc_feature (49)..(49): n is a, c, g, or t
  misc_feature (87)..(87): n is a, c, g, or t
  misc_feature (247)..(247): n is a, c, g, or t
  misc_feature (255)..(255): n is a, c, g, or t
  misc_feature (261)..(261): n is a, c, g, or t
  misc_feature (285)..(285): n is a, c, g, or t
agttctgcgaatgcctcattggcatggagaggcactccaggaatccccngtgctctctgggcgggtgggttcttatctggaaagagnaagttgagctggtaggtttaccatggacttcatgaccttccttagttagagagtatggcgattggactccccaggtaagggaagccctgctggaaaggggagtcctccattttgcactgagctcagaggagctatccagacgtggtagactacaaccctnattagcanggtttnccaacaggattctcatgaggcatncacatagtgatgaccttcttctaaaactagacaatccattggctttcaagagaatgccagtggctt

SEQ ID NO: 9128 - DNA, 490 bp, Mus musculus
  misc_feature (330)..(330): n is a, c, g, or t
  misc_feature (342)..(343): n is a, c, g, or t
  misc_feature (351)..(351): n is a, c, g, or t
  misc_feature (354)..(355): n is a, c, g, or t
  misc_feature (362)..(362): n is a, c, g, or t
  misc_feature (404)..(404): n is a, c, g, or t
  misc_feature (415)..(415): n is a, c, g, or t
  misc_feature (422)..(422): n is a, c, g, or t
  misc_feature (451)..(451): n is a, c, g, or t
  misc_feature (455)..(455): n is a, c, g, or t
  misc_feature (459)..(459): n is a, c, g, or t
gaggcatccgccaacagaagagctatttcagccctgtaaacgtcaatgtccatacattcagaaacctcactgggtcgtttttagtgctaaactcagaggaacaaaatggcaaacacacatgttttatttgttaagctgccagctttgtattctgggtaaaaggtaggtcaggaaaaactagtcaaaagcacatgggctatgtgtatttaaaggcagtgtctctttccaatgcatggtattaggtgctacaggcacatttactattaagcatcatgtatatttaatagcacaatgtctactttagtgtccttaaaagcctgtatccacttnatagtttccatnnttgaaganccnntgttcanttctcttgtaattttgtaaagtgctggcaacccacaagagcntctagatttanccagtgnccccacgggaccatggtaattattacganatcnttanttctatgtcagtactttcaactgtcaggtac

SEQ ID NO: 9129 - DNA, 565 bp, Mus musculus
  misc_feature (304)..(304): n is a, c, g, or t
  misc_feature (306)..(306): n is a, c, g, or t
  misc_feature (311)..(311): n is a, c, g, or t
  misc_feature (318)..(318): n is a, c, g, or t
  misc_feature (331)..(331): n is a, c, g, or t
  misc_feature (351)..(351): n is a, c, g, or t
  misc_feature (381)..(381): n is a, c, g, or t
  misc_feature (385)..(385): n is a, c, g, or t
  misc_feature (388)..(388): n is a, c, g, or t
  misc_feature (394)..(394): n is a, c, g, or t
  misc_feature (398)..(398): n is a, c, g, or t
  misc_feature (408)..(408): n is a, c, g, or t
  misc_feature (412)..(412): n is a, c, g, or t
  misc_feature (442)..(442): n is a, c, g, or t
  misc_feature (446)..(446): n is a, c, g, or t
  misc_feature (453)..(453): n is a, c, g, or t
  misc_feature (478)..(478): n is a, c, g, or t
  misc_feature (501)..(501): n is a, c, g, or t
agcttataatcatgggcacttcttcatttgtctgaagtatgagttcttaaaaatctgataaacattatgcaaaagtgtatttaaaatatacttttctggtaagtagtatcttgatctgtttttgaagaaagcttgttaaaagaagcaagatgtttctgcctggctgggaggacaaaggggagttcagagtggctctgtacagaactctgtctcacagaacttgcttccaaagcaggaactagttttccacattttctgggtcagattctcataagctgtgccattcccactgtgctcacttatncnaactnaactcanctgtgactattanacaaaatattttcctgacanaaaagggatccctgtacaaactatgggagnaaanacnaattancacncagaagaaanccantcttttgtggtaatatactgttttaatttngggntcacctntcttgcacatttaagacatagattntaagtttctagcaatcacatatntcacctgaaagacaaatagattttaaaattctaggttaaaacagtattttgctttccacctata

SEQ ID NO: 9130 - DNA, 560 bp, Mus musculus
  misc_feature (315)..(315): n is a, c, g, or t
  misc_feature (333)..(335): n is a, c, g, or t
  misc_feature (341)..(341): n is a, c, g, or t
  misc_feature (346)..(346): n is a, c, g, or t
  misc_feature (348)..(348): n is a, c, g, or t
  misc_feature (354)..(354): n is a, c, g, or t
  misc_feature (383)..(383): n is a, c, g, or t
  misc_feature (396)..(396): n is a, c, g, or t
  misc_feature (407)..(407): n is a, c, g, or t
  misc_feature (410)..(410): n is a, c, g, or t
  misc_feature (416)..(416): n is a, c, g, or t
  misc_feature (437)..(437): n is a, c, g, or t
  misc_feature (442)..(442): n is a, c, g, or t
  misc_feature (446)..(446): n is a, c, g, or t
  misc_feature (453)..(453): n is a, c, g, or t
  misc_feature (460)..(460): n is a, c, g, or t
  misc_feature (467)..(467): n is a, c, g, or t
  misc_feature (478)..(478): n is a, c, g, or t
  misc_feature (481)..(482): n is a, c, g, or t
  misc_feature (489)..(489): n is a, c, g, or t
  misc_feature (496)..(496): n is a, c, g, or t
  misc_feature (516)..(516): n is a, c, g, or t
  misc_feature (534)..(534): n is a, c, g, or t
gaccacccagtgaacgccagatttttatttctagtgagaataatatttgtgacgtgttgggaacccccttcataacatgcacgtcttttgtttcacttctttttagaaacaagattactgattttacctaatttagttcagtgactttattgaagcacctatgggacacagattggctgtactttaattgggtacctcagctggtactgtaatgtgacagggtgtgtggtctttccgtactgtttctttagtatgctagattgttggtaatgatgtctggatcagtcagtcatgagaaattaatactaatgaccntaaccttccctggcaagnnntgcacnatatntnacctanatcacctgggaaaagggaccacatagacnctgaattcatcanccattcgaacnacnactggnacaggacccagactttcactntagtncctncatcctnacagctnccatttncatccagattnttnnacattgntcttaantcatttttaaaaattaacantaaatcatatgatttctnacaatatttttcaggcatttccacca

SEQ ID NO: 9131 - DNA, 316 bp, Mus musculus
  misc_feature (100)..(100): n is a, c, g, or t
  misc_feature (108)..(108): n is a, c, g, or t
  misc_feature (164)..(164): n is a, c, g, or t
  misc_feature (181)..(182): n is a, c, g, or t
  misc_feature (188)..(188): n is a, c, g, or t
  misc_feature (190)..(190): n is a, c, g, or t
  misc_feature (193)..(193): n is a, c, g, or t
  misc_feature (205)..(205): n is a, c, g, or t
  misc_feature (207)..(207): n is a, c, g, or t
  misc_feature (243)..(243): n is a, c, g, or t
  misc_feature (259)..(259): n is a, c, g, or t
  misc_feature (261)..(261): n is a, c, g, or t
  misc_feature (263)..(263): n is a, c, g, or t
agatgaatacagtcggagtcattctaaaaatgttattctaaaaacaaccaattaggaataggttgattttccatttaaagttctcaagttctctctcaanagcttctngacatcctttttgtttttattttttattttttggaaccttcttttaaaatgttgtnattggggctgaagaganntcccantnatntagagcatgacntnggctatttttccagaggtcccaggtttgtttcccancacccatatttgatgntntnttttgatttctatggccaccagatgcttatgtggtccaacagacattcattta

SEQ ID NO: 9132 - DNA, 491 bp, Mus musculus
  misc_feature (239)..(239): n is a, c, g, or t
  misc_feature (271)..(271): n is a, c, g, or t
  misc_feature (277)..(277): n is a, c, g, or t
  misc_feature (294)..(295): n is a, c, g, or t
  misc_feature (302)..(302): n is a, c, g, or t
  misc_feature (338)..(338): n is a, c, g, or t
  misc_feature (348)..(348): n is a, c, g, or t
  misc_feature (354)..(354): n is a, c, g, or t
  misc_feature (363)..(363): n is a, c, g, or t
  misc_feature (376)..(376): n is a, c, g, or t
  misc_feature (394)..(394): n is a, c, g, or t
  misc_feature (440)..(440): n is a, c, g, or t
aatgtgtgactagactgtttatttatttatttttttatttaatgaagtcttcagaatccagcatacaaggtatatttaacagcacatatccttcttagtgcattacaaaccttttagaaatgtgcttttattgtagagatttaaattaccaacataaataagtttttacatatttttgatcagtgctaaatacttaatctatatgtagacatagaaactaaaatcatgtttttgagtgntctctcacacttatacacatgcaccccccctntacgcnagaccagacattgtaannattgttntaagcacattacagacagtaactcattgaattctcncaagacctgnacacgncactttctncctttattctggnatccaaggggattggatnggctggctgagatcacagccacccagtggctggtctggaacttctnttctgaccatctcaccctctaagccaggccactatacctttgttaagatat

SEQ ID NO: 9133 - DNA, 217 bp, Mus musculus
  misc_feature (147)..(147): n is a, c, g, or t
  misc_feature (160)..(168): n is a, c, g, or t
tgatatgagcctgcatgattttctgtgtactgtatgcaggtggctgcagaggccacagagcattgggtgccctggagctgtagttacaggcagttatgggccatctgacatttgtgtgctcctaaccactgagtctaaccactgagncatctctccaacnnnnnnnnnaaagccctttgctccttctgggctgttagttctccaaggagatgctcag

SEQ ID NO: 9134 - DNA, 546 bp, Mus musculus
  misc_feature (230)..(230): n is a, c, g, or t
  misc_feature (237)..(238): n is a, c, g, or t
  misc_feature (245)..(245): n is a, c, g, or t
  misc_feature (371)..(371): n is a, c, g, or t
  misc_feature (377)..(377): n is a, c, g, or t
  misc_feature (390)..(390): n is a, c, g, or t
  misc_feature (515)..(515): n is a, c, g, or t
gtgcgtggcaaaccaccactgtgaaattcctgtagaattatgattctctctgctcttggacagcagagggtgaggtttgacagatacgactcaggcatcagagaagctgcaggcaggccctctcccatgtctaaacatgagacttggatgtgctcctgggatcaccagcatgctttatactctataaacatagaatccttggagaacattccttagcacccccggaaggnagatgtnnagaggcngactagacgtggaggaagacgctgactgtcaaaactgctgccccagagctaatttcctctcacagtaccatataagtaacaaataataggcaataaaaacctgaaggaactaagagtcacccatgntcctcnatctattgttacnatcattttatacctgattatttcctatgcatatatatgtaagaaagattacaccctgggttttaaaacacaacagtttttgtaagcagatttagtaaataaacatgtatattatcatttaatggntaaatagcatttcatagtttggttgtatcca

SEQ ID NO: 9135 - DNA, 469 bp, Mus musculus
  misc_feature (26)..(26): n is a, c, g, or t
  misc_feature (35)..(35): n is a, c, g, or t
  misc_feature (39)..(39): n is a, c, g, or t
  misc_feature (45)..(45): n is a, c, g, or t
  misc_feature (47)..(47): n is a, c, g, or t
  misc_feature (103)..(103): n is a, c, g, or t
  misc_feature (112)..(113): n is a, c, g, or t
  misc_feature (141)..(141): n is a, c, g, or t
  misc_feature (145)..(145): n is a, c, g, or t
  misc_feature (153)..(153): n is a, c, g, or t
  misc_feature (225)..(225): n is a, c, g, or t
  misc_feature (233)..(233): n is a, c, g, or t
  misc_feature (248)..(248): n is a, c, g, or t
gtaacttttctagaacttcccatcgnccagctggnatcngggatncnaagactgtttcctgtatacacacacacacactgaggaggtgggggcagtgagacgnatgagtcanngaggcagggacagcctgccagcctcacntatnaggaagtngtgcccatcctaatggagtcaggactcctgccctgaggccacatggactgggctgtggactttttgaaaacnaggctctnaattggtcaaccccnccccatcaccatccccagtacccagccaaacccaggccaggggaaatacacggtgagtatctccagagaataaaatttgaatactcaaatagaactgggccgaggggtgggcggagcatgagaggcatgccagccctttctgtaaacactcaaggctttttcacccaaaggttcagaaagagcaggcagcttacatactagagttgtgctcttatggagaa

SEQ ID NO: 9136 - DNA, 358 bp, Mus musculus
  misc_feature (266)..(268): n is a, c, g, or t
  misc_feature (272)..(272): n is a, c, g, or t
  misc_feature (275)..(275): n is a, c, g, or t
  misc_feature (277)..(278): n is a, c, g, or t
tcccattctcaatcctggcatagaatggccataaggtcccctgtcatcagtcatcttgtatcaccagtctttacccttccctggttcattctacctaaatttatctgcagtcagtgcttattcatttgtgttacgctgtttttgaccttgggatacttttccatgtcaattcttgtgtacctttccctcttatttctggaactccttttccctttaaaaaatgcttcaggaagaattatttttctttatccttttaaaaatgttannntagntananngttccccccccccacttctccctctaactatttacctccctccccctccatattaaaattcatggtctttattctgtagt

SEQ ID NO: 9137 - DNA, 501 bp, Mus musculus
gggaggctttacgtatagtgatctaaacctttcttcatgaagttgtcaagtgattgacattaaagttaaagagactctgtagcaagaatctaaaaccctaactgttgtggagtttctagaaggttccgatacatctgttagataaagagagttgaaaatttgggagtttggtgacaatagatccagggacgtgggcagaaagcaagttcatttttaaacttggtgccacaaatgccccaggtttgagttaaatgacctgtgtgctttgtggagtgtaaaggaaaagcgagctgcagcctgtttgtcgatggaaagctacagccctgagtctgggtatgtgcttacctgtgggtgtttttgactgactaagaaacactgtggggactggaggctataaagtggtctttggaagtgggactcgattgctggtaagccctggtaagtgagctaaggaagaaatgatgggaaggctgcgggtgaaaggtctttatggtccaggaa

SEQ ID NO: 9138 - DNA, 434 bp, Mus musculus
aaaaccacacttcatgggctagagatggggttcagttgttaagagtgctcacctagcatggataaagctggcagatctctgtgttcgaagccaacctggtcttcagagcaagttctaagatagccagggctacacagaaagaccctgtctcggaaaaacaaaaactgatggatgagaacagggcccacagaatcaactaagccgagctcatatggggctcacagagcctgcatgagtctgggcttggcctctgcatatatgttatgactgtgtacctgggtgttcttaaggtacctctaacaaggggaatgaggggtgtctccaactctctggcctgtgcttgggacccttttcctcctccagtgttcctcgtccagccttgatgtgagcctagtcttatagtaactggatatgcatgctcagttggcatccct

SEQ ID NO: 9139 - DNA, 263 bp, Mus musculus
  misc_feature (180)..(180): n is a, c, g, or t
gaattccacatagggcagagcttgagtttaggagacacatcctaatattgtcacgccctgtgggccaagcattcaagcctgtgagtctatgggggctatttgtattcaaactgaagtttctctttgctcctacagggacttttgtatcatgaggtcgacaatggtaacctctgttggaancaggatttgccttctacctgttctccaggatacaatgctttgctgttcgctcctctcctgtcagacttaaaggcctatcgaat

SEQ ID NO: 9140 - DNA, 305 bp, Mus musculus
caatcattgacctactaaactcagtctttgaccaactgggatcatacagagggacaaaagctcctctagaggattatacagatgatgatttaagcactgactctgagcagatcatggacttcacgccagccgcaaacaaacagaattctgagttctctactgatgttgagacagtctcctccggctttctggaagaattcactgagaacacagacatcacagtgaaaattccattagctgggaatccagtctcccctacttcctgagaagactccaactttgaaataaacctgcgactgccattc

SEQ ID NO: 9141 - DNA, 287 bp, Mus musculus
tgttctgtgactctactttccaggacaatcctgacctccaggatcctcgatacagcacagaactcggcatgtaccagcctcactgtggactagagaacgtccttatgtcctggggccatgatgagtacctataccagatgatgaagttcaacaagttctccctgccttcagaggccttctacatgatccgattccactccttctatccgtggcacaccggcggtgactaccggcagctgtgcagccagcaggacctggatatgctgccctgggtgcaagagttcaac

SEQ ID NO: 9142 - DNA, 303 bp, Mus musculus
accccaagtggtcaataagtcttatttgcaaaagccatgatcttcaagggtgagagaaaaatctgaaggtcagcggagacctcagagaaaacgggggcaaagtgtcttaggccagaagtacgctgtagcattgtaacattgtgcagatggagacaccccacccctctctaccccaccccacccaagacagccttccactagaggctgaagccaggaagcagacagttgctgtccttattcctgttaaaagcctctggcactatgaacaacgcagtgtggggacagtgggtgactcagaactct

SEQ ID NO: 9143 - DNA, 342 bp, Mus musculus
gaccatgactctactgggaggcagtgctgccttctttctgcttgagaccctcaatcggcccttaccagaaactatcgaggacatacaagactggtaccagcaaaccaagaaaacaaagcaggagccagaagcagaaaaggcatcccagacaatcccgctgaagactggtggaccctagctaagaacaacagaatcctctttcctgccttccagagactgatcccaagcagggcccttccaaggctattcgagcaccttaggggttgggtggagccccagctggctccatgctctcagaacaaagacttctgagagttcagcaaaagtgttttaccttcacca

SEQ ID NO: 9144 - DNA, 504 bp, Mus musculus
  misc_feature (109)..(109): n is a, c, g, or t
  misc_feature (117)..(117): n is a, c, g, or t
  misc_feature (121)..(123): n is a, c, g, or t
  misc_feature (125)..(125): n is a, c, g, or t
  misc_feature (133)..(134): n is a, c, g, or t
  misc_feature (141)..(141): n is a, c, g, or t
  misc_feature (168)..(168): n is a, c, g, or t
  misc_feature (174)..(174): n is a, c, g, or t
  misc_feature (194)..(194): n is a, c, g, or t
gaatctgtctggagatgggcccacagcctcagggcgtgctgcgggccgacctgttctcccggatgcgagctctggtggcatccattctggacttcatcgagctcttcanaccaaggncatnnnancttacccnngcctttngagatggatatctacaggaacttgggncagtgntggacttcccacgcactgcngatggtgacctggctggcactgtgcaccctcaactgcaggaccatgactttgagccactgaggcctggtgaacccatcttcaagcttttcagcggagaagacgtactgtatgagggggactccattgtgtaccctgtgttcattaatgaggctgcctattatgagaagcacgtggcattcctgaagtctgagaagatcagggtcacagtgcctgccctgctgaggttgaccccccgctccacccagactccctaacccaaatcatacctggcctgatctcagttttcctatctgaacaatgggtcccaag

SEQ ID NO: 9145 - DNA, 466 bp, Mus musculus
  misc_feature (299)..(299): n is a, c, g, or t
  misc_feature (313)..(313): n is a, c, g, or t
  misc_feature (317)..(317): n is a, c, g, or t
  misc_feature (346)..(346): n is a, c, g, or t
  misc_feature (362)..(362): n is a, c, g, or t
  misc_feature (366)..(366): n is a, c, g, or t
  misc_feature (381)..(381): n is a, c, g, or t
ggcagcatagtgagcccactgataagcatgactgccgagttctacccctccatacctctcttcatcttcggcgctgtccccgtggccgccagcgctgtcactgccctgctgccagagaccttgggccagccgctgcctgatacagtgcaggacctgaagagcaggagcagaggaaagcagaagcaacagcagctggaacagcagaagcagatgataccactccaggtctcaacacaagagaagaacggactctgaaaatggagagggcgtcacacagcactaaagggagtggggttctncaggtcccaccatntatngaggagggggagtgagtggagggactggnccatctaaatgcggancctnccattcagagaaatncctccccaaaggtcacttcaatagacctactaggaacaaaagctctaactgtgtgcagcttcttaagcagaatgagctcttcctc

SEQ ID NO: 9146 - DNA, 348 bp, Mus musculus
  misc_feature (277)..(277): n is a, c, g, or t
  misc_feature (285)..(285): n is a, c, g, or t
cagggattttttgttgccatcatatactgtttctgcaatggtgaggtgcaggcagagattaggaagtcttggagccgctggacactggcattggacttcaagcgtaaagcacgaagtgggagtagcagctacagctatggcccaatggtgtcacacacgagtgtgaccaatgtgggcccccgtgcaggactcagccttccccttagcccccgcctgcttcctgccaccaccaatggccactcccagctgcctggccacgccaagccgggcgctccanccattgangaacgaaaccataccagttactatgacagttcccaaggacgacggcttccttaatggctcctg

SEQ ID NO: 9147 - DNA, 526 bp, Mus musculus
  misc_feature (26)..(26): n is a, c, g, or t
tcaggatccggaatatgcttggcatnaaattttcttcttgatggcaggcattaatgtgacatgcctggttttctattttctatttgctaaaggagaaattcaggactgggctaaagaaataaaaaccacacgactgtgaagggaagacatgtgaaaatggcattgataacctttcactggacaagaaagacaacttgagaaaaatcttctagcctagactaatgtctctgaagtgttggactcttcagtgacatctctctgtgttttgtttcctttttctacaaaagttagtagaaaaaggagaagctgagaagcctgaggtcagcatccttatagaaagaaagaggatccttcatgggactgcagtcctgggagagtcgtgaacacctggagacaggtagcatgaggctcctgaacgctcagtcgcacccacttctgtctgagtgattcttttgcactgtgtattgtatgtaacaagttatacttctgactttaaaggaggatttatttatgtcttcctctatga

SEQ ID NO: 9148 - DNA, 460 bp, Mus musculus
  misc_feature (47)..(47): n is a, c, g, or t
aggatctgagtctactccatgccacagagctggtcctcagccggggnctggttttgcctcttgagagacgacagtcactctgtggtgtacacaagagagctggacggcatagataacgtcttcctcgtggttctgaattttggagaatcatcaactgtgctaaatctacaggggatcatttcagatcttcctccagagctgagaataaggttaagtaccaactcagcctccaaaggcagtgctgttgacacccgtgccatttctctggagaagggagagggcctggtcttggagcacagcacgaaggctcccctccatcagcaggccgctttcagagacagatgctttgtttccagtcgggcgtgctactccagtgcactggacatcctctatagctcgtgttaggaaggaagctccctaagagatggccacccagaacatcacgtacgcacagggctga

SEQ ID NO: 9149 - DNA, 528 bp, Mus musculus
caactatagaccaccatttaaccgcctcttgatcacagtgctaaatagtgtattcaccttctcctacaagaaggctcagcgagatctgggctatgagccacttgtcagctgggaggaagccaagcagaaaacctcagagtggatcggaacactagtgatgcagcacagggagattggaaacaaaaagtcacagtgatatgaagagggagaggacatggccctgggtgttattaggtcctccagaaagggacttagaaacaatccaactcttaacaattccattttacactctgtccaacttgtctttgggtcaccagaagccttgcaagtcactggcccagttgcaacccttcagctctaagcacttgtccagcaatgcacaagatgtgcctcagctgctgtgacccaaggataggtggctgatagtgagttgcctggaacctcttgtaggttagaatttcatcagggcttcctcatctcctttccatgtgccaacgcatttcgtgtctgagaaaattcccatacctt

SEQ ID NO: 9150 - DNA, 451 bp, Mus musculus
  misc_feature (58)..(58): n is a, c, g, or t
gaaggatgctgttcctaccatcaggcttcactgaggagaggaaactttcatctgaggnagatgcccacaggtcacctgccccttctgagggatgataagggcttccgtaagctttcaaaccagccgtacttccataggccagagatcattcccactcaggctatctcttccaggagcagcatcaaggattccccgtcatcactgtcaacatttgggtatgatcactcattgttcaggtgtgaacgttgctgatggcaaggatggagtctatcatgtcagaggcagacccatttggagatgggaggttgtaggtggcacacactgtttcacttgagatgagagctgtcactcagtgaaaacacaccttcaggttagctgttcttaggaaacacctctcgaggaacaccatcgtgtctaggagtgacgtttgaggcttttgagagctcctgac

SEQ ID NO: 9151 - DNA, 480 bp, Mus musculus
atacatggtacctgtggttgtccaccatgatacccatatgtggcaactccaggtcaaagtgattgtgtgtcgctgcaacgtggaaggccaatgtatgcgcaaggtgggtcgcatgaagggaatgcccacgaaactgtcagcggtgggtgtcctcttgggcaccctggcagcgataggcttcattctcattcttgtgttcacgcacctggccctggcaaggaaggacctggatcagccagcagacagcgtgcctctgaaggcagcggtgtgaatgatccaagcagccccagctgggaggttggccccagctccctctgaactcactgagaaaggacccagtacccaagatgcactggggaccaagacagagtaaaagcccttcaccttgttggagtgaagacattatcacaggcatgtccccaaagcctgagcacctactttatgggatgaccatgggaacactccaaatggcagctcttt

SEQ ID NO: 9152 - DNA, 409 bp, Mus musculus
aatcataaggtgttagcttctcaaaatattctagaattttctttttgataactgattatgtaggtatagtgtgtgtttgtagttactgatttgagcatttctagaaataaagtcagggctgtaactatatttcatattttgaagacctaagaaaaaaattttcactggagaatggctataacatggcatagaaatcattaaaaatggatctttttgaatactgtttatattactctgtatatgatgcatcgagtaaaattaaacaagagatggataaaaatggcaagggaattttattctgttatcacaccaacagttgcttgtatagtttctgcatattagtctttagtagggcaagcagatctatttgttgttgcctgcaatttgtacacatcctacctatgctgat

SEQ ID NO: 9153 - DNA, 566 bp, Mus musculus
  misc_feature (110)..(110): n is a, c, g, or t
  misc_feature (407)..(407): n is a, c, g, or t
  misc_feature (478)..(478): n is a, c, g, or t
aatgcctgcaatatacttacctaccaaataccagtattcgaaacattgtaccaaccggaatgttgattttgcacccctgggattgcagggagtcacctggagactctagnctcactgccactgtccccatgtttccaaaggatagtgtcacacattgtgaacccaggaaaagctccccgttcaaaaacagtctcttctgaatgcgtgtcacttttgcatcaatgttaaagttgagcccctggaaagtgaatcactgtttaagtctgggcccacgtgcagttttgaacatagagacaattcagagccagtcattatagttaacagaattcaactgtgcccatgggaattatgaactgagaattcaaaaattttgtttctctaataaataaggtaaacaccatatagtncaatgtgggggagactatgggggagtattaattcatctgccactgtcaaacatgcactgctgtctactgtnttcattccgggctggaattcctatttcttctgcctattgttttctatgctacaaaactatatctgaactgcttctatattcttgctgt

SEQ ID NO: 9154 - DNA, 239 bp, Mus musculus
  misc_feature (32)..(32): n is a, c, g, or t
  misc_feature (194)..(194): n is a, c, g, or t
agcaggaacccagaggtgtgagcttggaagcngaggccatgtcaagaagccaactgtgggctgccgtcgtcctgctgctgctcctgcagagtgcacagggtgtctacatcaagtaccatggcttccaagtccagctggaatcagtgaagaagctgaatgagttggaggagaaggagatgtccaatccccagccncggagaagtggcctcctccctgctgtgtgccataacccagccttg

SEQ ID NO: 9155 - DNA, 273 bp, Mus musculus
gggattccatattggcagctgcagacaagtggttacgtggcttggcagagtggcatgttcccaaagctggcatgtttctatggattaaagttaagggaatctccgatacaaaacaactgattgaagaaaaggctattgaaagagaggtcttacttgttcctggaaatggtttcttcattgatggttcagctcctacctccttcttcagagcatccttctctctggctactccagcacagatggatacagccttccagagattggcccaactga

SEQ ID NO: 9156 - DNA, 510 bp, Mus musculus
  misc_feature (94)..(94): n is a, c, g, or t
  misc_feature (356)..(356): n is a, c, g, or t
  misc_feature (375)..(375): n is a, c, g, or t
  misc_feature (386)..(386): n is a, c, g, or t
  misc_feature (462)..(462): n is a, c, g, or t
gagcaccaggtgcacatgcgagcaaaacactatacacatacgattaaaaagataaggtagagaatgactgaagaagaaatcttacgtcaacttntgatctacacacacacacacacacacacacacacacacacacagagcatagtgatgtttgtttcagtattcagtgggtaggttatagggccacaggtctggtaaaagaggttttattccttcctctctcaagatggtgctgaggactgggaaagcagtcagcctggagtgtgtatgatgctaacaccgaatggttcttgtgtttctctgcctagtggttgaactgcaattctaggtatgaaggagaaaggaacgagatacancaccacagtcaggatgctnctgctttcttntctctaaaggccatccctacatcttccaaagggaacaagttagcaggagaatttacttcggaggaaggttctaatntcttgtttgttcatttccacatctgcatcattctgatttcaccttggg

SEQ ID NO: 9157 - DNA, 387 bp, Mus musculus
tgccctatatccaatccagctatattacaacaattatatttctgacaatttcctgtggactgtgccctctatctcaggcaggaatctatattaatgcgttagacattgctccaaggtatgccagctttctcatgggaacatcaagaggattggcacattcatcggctgtgctggtacccattgttgctggctttttcctcagccaggactctgaattcgggtggaggaatttcttttttgtagtgtttgcagttaacctacttggcttaatcatctacctcgtgtttgggaaagcagatgttcaagaatgggctagagagaggaagctcactcgtttgtgaagctgtcccacttgctgtaaagaagtcattacatacgctggctcct

SEQ ID NO: 9158 - DNA, 470 bp, Mus musculus
acattcatagcgttgggcatcaccctgagcttggttttgatcccgcttgtcaagtctccaaagttgcattatatctatgtgttcctcttccttctcagtgggctggtgttttacgtgccattgatacactttaaagtgaagttcgtttggtttcagaagttgacttgctatctgcagttactgtttaatatttgcatccctgatgtgtctgatgaccacatacatgaagaaagttgaggaagaatagcctttgtagccatactgtgttccagataaaggttaagtgtaagctaaaatagtaatgatggcaatgctataaactgaaatggtatatagaaaagtacccaggaaattcctagtttttaaaatatcaaaggaaatggctgggtagatgactgtgctgttaagggcaccagatgtccttccaggggactgaagttcaattcacaggccccacttagaagttcata

SEQ ID NO: 9159 - DNA, 569 bp, Mus musculus
  misc_feature (26)..(26): n is a, c, g, or t
accgtctcactgacatctggctgganttcccgctggtcgtatttgctgtggttggccttgttgctgggggacttgtgctattgctacctgagaccaaagggaaggctctgcctgagaccatcgaggatgctgagaagatgcagaggccaagaaaaaagaaagaaaagagaatttacctccaagttaagaaagcagaactaagctaaagagaaagagcatcattgctgctggagatgactttgctctctctgagaccagaggcagagcttctcttcccctcccgcgaaagccacacaacccaacctcacttacccctgaattcctgaactccatcagcagtgagctgtcgcccgcccagtttgttgcactgatgtgtccagctcttcctctcaaccaggacctcactccacctcactccactctcaacagtcctggggaatgcccattgctttgctggatttgttggggtttttttcatctgtacatttctttacttggtttctttctccaagcatgacatcaaaccaaaatatacaagggagctgtgggtcaggacaactaactattaa

SEQ ID NO: 9160 - DNA, 111 bp, Mus musculus
  misc_feature (27)..(27): n is a, c, g, or t
aatcccttcgagtacgactatgaaacngtccgcaaaggaggcctgatcttcgcgggcctggccttcgtcgtgggcctcctcatcattctcagcaaaaggttccgctgtggg

SEQ ID NO: 9161 - DNA, 471 bp, Mus musculus
  misc_feature (125)..(125): n is a, c, g, or t
aagggcaggcactccctggctcctgcgtacctcagacacctccagcagctcctaccatggacaggtggtacctgggtggcagtgccaaggggacagagaatcccttcgagtacgactatgaaacngtccgcaaaggaggcctgatcttcgcgggcctggccttcgtcgtgggcctcctcatcattctcagcaaaaggttccgctgtgggggcggtaagaaacataggcaggtcaatgaagatgaactgtgacagaagagccggcaagtgcccacgggtgcatgggcaccagcgatgaccaccttccccagcgtgcgcaccacagaccccagcacagtcagcatgggctgaaggaagtgccaggcatcctgggaaccccttcatggtcatcccctcctgcctcagatccttaacttcctctcttccccagcttctctaacaccccactccctgttccaagttgaggagcatg

SEQ ID NO: 9162 - DNA, 508 bp, Mus musculus
  misc_feature (34)..(34): n is a, c, g, or t
aagaatttgcgatcgtgcccttgcatgcagcccnaacagaagctgtgagtgagatcgacgccctctacgatgtttacctagatgtctggcaaaagtggggcctggaggacatcatgttcatgggagacttcaatgctggctgcagctacgtcacttcctcccagtggtcctccattcgccttcggacaagccccatcttccagtggctgatccctgacagtgcggacaccacagtcacatcaacacactgtgcttatgacaggattgtggttgctggagctctgctccaggctgctgttgttcccaactcggctgttccttttgatttccaagcagaatacgagactttccaaccagctggctgaagccatcagtgaccattacccagtggaggtgacactcagaaaaatctgatgtcattgagcagttcagccatactgcttctggtgaggaagaatccacttcaactctatttggtactacagcattccaccatctcagaacagag

SEQ ID NO: 9163 - DNA, 348 bp, Mus musculus
gctgtattctgggttgagtttgtcatgcgccacaaaaatgctaagcacttgaggccacttggacataaccttacctggtaccagtaccactctctggatgtgattggattcctactcgcttgtgtggcagccactgtagttcttactgtaaagtgcctcttgttcatttaccgattctttgtaacgaaaaaaaaagaaaatgaagaatgagtagagttcattgtcaatgcaccacatgaatgaactttcagcctcattctaatttatgagccaccttctaaacactgatttgattcttttttaatcaaggcacatcttctttataaattctaccttgtaagaagacat

SEQ ID NO: 9164 - DNA, 252 bp, Mus musculus
  misc_feature (166)..(166): n is a, c, g, or t
ctggcttcctctggcaaaggcatgaagggaggaaatcttgctgctcctgccactcatccactgctgcctggtccttccagtgcagtgattcttgctggtcctaaccaaggcttgggtgagataggctgcgtggtgcaattcttctcaagccgtagtgactgtactnaggctggtggtaccgggtggcaggacctgcgttcagacctataaggagtggtctggatcttttgcttagaactctgacgaatggtt

SEQ ID NO: 9165 - DNA, 381 bp, Mus musculus
aggctcctgtttaaaacctttgcagggagtaccgcaccttctctctgggatttgggaaaagggaagaaaaattgaaaaccccaggctctgtgtggactgcaagaaatggtagagctcaaggcttctctagtcttatgagaacttgtactactgaatttgcgaattttgtttttttgagctggaccgatctctgggggacgacgttgagctaggatggcatttcactgtgatcccccaagttcaagccagtctttaactcagtgttggcttaagtttccctggagctggcacgtcagcttttcttcagtgacagttggtgttcctcttgatttgggtatatgtgcttagttcagagtctgttctgtatctgctatcctaact

SEQ ID NO: 9166 - DNA, 542 bp, Mus musculus
gggattccatgaagttcacgtccttcccgacatcaaccagaagccccaggccgagcacaccaagcggtttgaggacatgattgcacccttccgcctcaatgatggcttcaaggacgaggccaccgtcactgagatgaggagggactgtccctggaagatctcagatgaagagattaacaagaacagaattaagtcccttcggcaggtgagactgagtgagatactgctggattactctcgggatgctgctctgatcatccttaccctgcccattggaaggaaggggaagtgccccagttcgctgtacatggcctggctggagaccctgtcccaggacctcagacctcccgtcctcctcatccgaggcaaccaggagaatgtgctcaccttttactgccagtgatgcctggggtgacgggaaccgccacccagaaccccaaagctgagggcttgggatagagtcagaacgcaccctctccagctggagaagaggcttcaagttctactgtatcatcccatccatcagcgcctatgcagaagat

SEQ ID NO: 9167 - DNA, 396 bp, Mus musculus
  misc_feature (152)..(152): n is a, c, g, or t
  misc_feature (176)..(176): n is a, c, g, or t
  misc_feature (279)..(279): n is a, c, g, or t
agtggtgccagtgttaagtggcctagctgcactgctgctgcctgagaccaagaacttaccactgcctgacaccatccaagacatccagaaacagtcagtgaagaaggtaacacatgacacaccagatggctccatcctgatgtctacccggnctgtagttgcctggagaaggaacnacagccacaataagaggaggaggaagaagaggaggaggaggaagaggagaagagagagagagagagaaggaggaggaggaggaggaggaggaggaggaggagnaaagggcagggctggcgacggcgggtaaagacacctgcctccgggcctaaatttctgaaactcatgtgacaacagacttcacaaagttgtcctctgagctccgcatggacacatacc

SEQ ID NO: 9168 - DNA, 539 bp, Mus musculus
tactcagggccacgtggtgactaaggattatcctacatacgcactagctgtcattgggcttctggtagcctcctccaccatgtgcatccctctggtagccctggggacttttgtcacacgccacttcaagatcagagaacagttttctgcagcctgagaactggaggtcccacagacttcctgtcagtcactgtttcacagccactccctatatatccagcagtgggaggtctacagctgctttttaaagccacaagtattttctgcttcctgaatctgcaaggaaaattaaattctctgtattaaattgtaggctgacagaaacctaactctgaccataaatgctgaggcttttacccttttgtttttgttttcaagacagggtttctctgtgtagccctggctgtcctggaactcactctgtagatcagactgacgttgaactcagatctacgtgcatcccaagtgctgggaataaaggtgtgcaccaccacttcccaacagcttttattcctcctcttccatgacgtatacttttg

SEQ ID NO: 9169 - DNA, 513 bp, Mus musculus
ttggcatttccatggcaggctggcaggctatggtcggagtgggcacgccctttggggctctactggcctttgtggtgcttgttaatgtcctgcagagccgaagtcccgggcacctccccaagtggctgcagacatgggacttcctacctcgctggatgcactctttgcagcccctggatggccttatcacaagagccaccttgtgttatgccaggcccgagccccgttcaccccaacttccccctagagtcttcctggaggagcttcccccagccacgccctccccccgcctggcactgcctgctcaccacaatgccacccgtctctaggctacaggccccgactactgcctggaacgaggagtggtatttttacaatgcccacagtagaaagacagagcatgtgtgtgtgtgtgcacacatgtgtagatgcgtgtcacttgaggtacatgcttttgtgccacccttgggtacctgtgcatattaagggccacagtggcatgggcttttgtaa

SEQ ID NO: 9170 - DNA, 75 bp, Mus musculus
tggcaccagtaccactttctagatgtgatcggcttcctactctcttgtgttgcagtcactatagttcttactgta

SEQ ID NO: 9171 - DNA, 500 bp, Mus musculus
  misc_feature (297)..(297): n is a, c, g, or t
  misc_feature (314)..(314): n is a, c, g, or t
  misc_feature (318)..(318): n is a, c, g, or t
  misc_feature (321)..(321): n is a, c, g, or t
  misc_feature (343)..(344): n is a, c, g, or t
  misc_feature (359)..(359): n is a, c, g, or t
  misc_feature (373)..(373): n is a, c, g, or t
ggatgccatgatgttcaactttcttagtcgatccggcagcaatcacagtgtgagcacactgggaacctgtccttgcggccgccgagatctaccgtgtgcttctgtgaagaggctttgacgtagcccctctttgagctcttacaccatgctactgacttctagaaaggctaattaggtcttcttctacacctaataccctaagtcttactgactctcacgggagaagtctctgtgctacacctgagtggtcttattgataaccctgataccagatcaggcaagataaatccgtcatancaggcatggctaccctngctnccnacagggtcacagcacatagctnnatcaccctgttattnttcatcttgcaatntggtatggttttcctggtgaatgatcagcttttgctgtggtattctttatacatctggacttattattgaaatcaaatgctatagaatcaatagtttattttatgtctatttttcttgatcgcagag

SEQ ID NO: 9172 - DNA, 538 bp, Mus musculus
  misc_feature (98)..(98): n is a, c, g, or t
  misc_feature (101)..(102): n is a, c, g, or t
gatgattctgaataagcctgggctcaagtacaagccggtatgcaaccaggtagaatgccatccttatctcaaccaaatgaaacttctggatttctgcnaanncaaaagatattgtattggttgcctatggtgttctaggaacacaacgatatggaggatgggtagaccagaattcccctgttctcttggatgaaccagttcttggttccatggcaaaaaaatataatcgaactccagccttgattgcccttcgctaccagttacagcgtgggattgtggtcctcaacaccagtctcaaagaggagcggatcaaagagaacatgcaggtttttgaattccagctgagttcagaggatatgaaagttcttgatggcctgaacagaaatatgcgatacatacctgctgccattttcaagggccaccctaattggccatttttggatgaatactagtatgtgaggatgtctcctgaaaagcctatgggtgggacactgctcagctgctgccatctacagacttgccacttctctgtagcaat

SEQ ID NO: 9173 - DNA, 339 bp, Mus musculus
gcggataataagcttaccctctgatcacatgtagcttacacttgctgctagctggaggtatattaggtaggtgagcaagagacccatgttccacttacatgaaatagagtcttaacatacaaatatctattgtcttcctggctaaatattttggtatttctaccttagtactactttatttttttctctctctaagtggtatgcatagatgaaataaaaatcgatgatctcatagaaaattaatttcacaggtttccaatccactattaaaaatgtatccagatcctacatttatttactttctaaatatataggtatttaacccgtgctttacagaat

SEQ ID NO: 9174 - DNA, 314 bp, Mus musculus
  misc_feature (39)..(39): n is a, c, g, or t
  misc_feature (201)..(201): n is a, c, g, or t
  misc_feature (265)..(265): n is a, c, g, or t
ccctattctatgtgacagaggaaggaagaatcagccggnctcagtgggtccacaactcatgagcttacacaccacctccataaaggagtgtgccactgacctctgcagagcacagaaagaggcagtggtctgaagatcaatctatgggaagacttaagaatgaccctttaatggaggagttggcatatatttcaagttgtntctgttggttccagggtttttaacctctctagttaagggcttagctttcttgggacatcggctnccttatttctgaaaaagaccaaatgtaactggtgtaaccagcagtttgg

SEQ ID NO: 9175 - DNA, 477 bp, Mus musculus
tcaaggaaggtcaagcaggcataatactgaaattctgggcttggttctggtgtggtgatgggaggtctgtggctcatcagaggccttccataattcagtacatagcaactctagcattctctgcctccatcttctacagatgcacctgaattggtacctcacacttttggctcctttgctccttgttttcctcttgtgaccttcattcctacttagatagaaacaacttgcatcatgttctcctcctctcactcatttatcctaaacacactgcttcaataggctgtgtgccctgtggctcctcatgttcttcctctctttatcccttttatcatttgggattaacaccatatttgtgcattttttctcttgttcttcttctcttttacaataaacactctttacagctcagaacacctgctctgccttactcctctatttccctcaggcctgggcagcaatcattctatattatac

SEQ ID NO: 9176 - DNA, 477 bp, Mus musculus
  misc_feature (170)..(170): n is a, c, g, or t
  misc_feature (174)..(174): n is a, c, g, or t
caccaagtcttggatcactgctctggtggtgatagggaaagctttttctgaagcagcctttactacagcctacctgttcacgtctgagttgtaccctactgtgctcagacagacaggaatgggattcactgcactcataggccggctaggggcctctctggccccactgngtgngtcttgctggatggagtgtggctgttactgcccaaacttgcttatggggggatttctttcctggctgcctgcactgtactcctgctgcctgagacgaagaaagcacagctgccagagaccatccaggacgtggaaagaaaggggaggaagatagacagatccgggactgaattagcctagggacagctcaccaagtagctggaaatagaaggcaggctcttgtgactgggacatcaaattcctctgcctaaggatggagctgctactggtgctgtctgcctgtgtttatccagtctccaaaaa

SEQ ID NO: 9177 - DNA, 440 bp, Mus musculus
tgcagatcctgcgtgtatttttgtcaacattaggaggagcaatttcttctgcctctataacgagtactcttgtacatgcaaatgagctagtccccaccataatcagggcaactgctttaggagtcgttggaattgctggcagtgctggaggagcgctgtctcctctacttatgatcctcacgacatactctgcttccttgccctggatcatctatgggattcttcccttccttggtggcctcgttgcccttcttcttcctgagaccaagaatcagcctctgcctgactcaatccaagatatagaaaataagaggaaaagctcaaaagaggcaaagaaagatgtggttgccaaagtgacaccattataaagaattccaaccggcctctgatcaaggagaaagatgaaaaaatatatatcattcagcatatcgtggtccaga

SEQ ID NO: 9178 - DNA, 501 bp, Mus musculus
tgaactctcaccagtagaactcaggtcaactctaaatggtgtttttttagctgttgttcgattggcaggggtcctgtctgcactaacacttgctactagaaagtattttgtatatcttcccatgatactctatggagtcctacccatcgtggcaacaatcagcatcctctttctgccagagacctttaaccttccacatactgacattatcaaggatatggagaaaaggaaaagattgatgagcaaaaacatcagtaaaaaagaagggcaagacttcttggaaactaccgagtgctaaagagagtcaagatccacagggttccatccatataaagactctttattctgtcctgtaccctagagactttacccattgatcagcagttacggatatatttattaaatgaagctactgcaaaagtaaatctcttagccaatccgttatatagatgcaagtcctaaggtttttatcaaatactggagtacaatcccctttcataa

SEQ ID NO: 9179 - DNA, 257 bp, Mus musculus
tttaatcctcaccatcaaaaacaagttggcatctttcagtgctgttcttccttcaaatgtgatatgtatgaagcccctgtctcctgaaggaatgtggcaaaataataagtttaaagtatcagcttttggactcattaattcaagtcgttacagaacacacagttgctgtgagcactgtctgttgtgctgggcattacatggtgggaataaaacagatcctttctctatctttatggacttcatagatgctctaagaa

SEQ ID NO: 9180 - DNA, 324 bp, Mus musculus
ttgtgtgtagacatgaggtcgcttggaaggctctgcctgtgagcgggggagaagcaacaatcggccatcttgcccacagcaaactcacagtgcagaaggaaacggccattgggctgtggcttcttacagagggtttacactaccaaccaaccgcaaaggcatctgggaccacaaaacagttaaccaggacgacattccagcagatcctacaataagtcagacaattgtggatgaaaaaggccaccgtaagtgacaacttaaaaaacaaatccaaatggaaacacagcaagcttatgtgagaagacactgatccggagacctgac

SEQ ID NO: 9181 - DNA, 190 bp, Mus musculus
tcttgcttgacagaccttaaatcaacccttgcctggcatctcaggtgtcacctcccttagtgactggaattctggagctgactgactaaaaccaaacctacttcataaagtagggtgccaaacagataccagttaatcgaaacctcagctgggtgtttggctctgggtgcaaactgttattgtattgact

SEQ ID NO: 9182 - DNA, 506 bp, Mus musculus
  misc_feature (243)..(243): n is a, c, g, or t
gaacaattcgtcatggaggtaggcaagcagcctgtgatatttgaaaacccaatgtatgcagccaaagacagtacttccaaagtgggcctggcagtgcagggaccgtcagtaagctcacaggtgactgtaccagaaaatgtggaaaaccagaactatggaaggtccatagatccttctgagatagttccagagccaaagccagcctcccctggagctgatgaaactcagggcacaaaatggaanatcttcaaacgaaaacccaagcagacaacgaacttcgaaaatccaatctatgcagagatggacactgagcaaaaggaagctgtggctgtggctccccctccatctccttctcttcctgctaaagcttcaaaaagaagttcgactccaggctacactgccacagaagacacctttaaagacaccgcaaaccttgtgaaggaagactctgatgtatagccttgccaactctctagggaacatttagacactcacttttgcacata

SEQ ID NO: 9183 - DNA, 504 bp, Mus musculus
  misc_feature (454)..(454): n is a, c, g, or t
gcagtctgactagtactagctggtgcatctctcttgctgggcgggcgatcaaatggtgattcatttcttgtacctattttcgccctcagcttcctgatatgatttaataaaaagctgttaatgtgtaaatgtataccctgaagatttagagtagaaatgactgattttttatataaaagtttagatttacgattctttgaagattttgtatgattactttttaagataaattgaaacctgccagtaagacaacctggggagaaaattgccttgttaagttataacaagttctttggttatgaatgcatgtgggttcttgggaataatttgtttttaacccataatatgtaaaacatttgatcatgtgaagctattgaggagcatatgtatctctcttttttaaaaatgtattctcattgtaattattcacttaaagaaaaatagaatgtaaccncattgtggttttatgctgcttgaaagaatttcctggtagatatataagct

SEQ ID NO: 9184 - DNA, 473 bp, Mus musculus
atttccacttcatagggcggtcagacgatatcattaattccagtgggtaccggattggaccttccgaggtggaaaatgcactgatggagcatcctgccgtaagcgaaacagcagtgatcagcagcccagacccttccagaggagaggtggtgaaggcatttgtggtcctagcccctgaattcctgtcccatgaccgagaccagctcactaaggtgcttcaggagcacgtgaagtcagtgacagcaccctacaagtaccccaggaaggtggagttcgtcttagacctgcccaagaccgtcacaggaaaaattgagcgagcaaagcttcgagccaaggaatggaaaacatcaggacgagcctaggcccagtgagactcctgaggcttttgatggggttctgtcttccccaatcctttcctgtgacttcttcgtctccacttatggagatataagattattcacacagaggcacgt

SEQ ID NO: 9185 - DNA, 526 bp, Mus musculus
  misc_feature (58)..(59): n is a, c, g, or t
  misc_feature (119)..(119): n is a, c, g, or t
  misc_feature (199)..(199): n is a, c, g, or t
  misc_feature (201)..(201): n is a, c, g, or t
  misc_feature (207)..(207): n is a, c, g, or t
  misc_feature (224)..(224): n is a, c, g, or t
  misc_feature (227)..(227): n is a, c, g, or t
  misc_feature (231)..(231): n is a, c, g, or t
  misc_feature (262)..(262): n is a, c, g, or t
  misc_feature (283)..(288): n is a, c, g, or t
  misc_feature (290)..(290): n is a, c, g, or t
  misc_feature (297)..(297): n is a, c, g, or t
  misc_feature (301)..(301): n is a, c, g, or t
  misc_feature (460)..(460): n is a, c, g, or t
  misc_feature (472)..(472): n is a, c, g, or t
ggatttcagggctattgccatctctagtgacttgcaagaagagttcatctctccctgnnggagcctgccgacaagtcatgagagagtttggcaccgactgggccgtgtacatgaccaanccggatggcacattcgtagtcaggacggtccaggagctgctgccggcctcgtttggacctgaagacctgcagaagattcnantgaagnttgaagaatagaatgtntgntgantgtgcaagccctacctaaggaacggctcttngaagacttcataatgatgctnnnnnntntctggcntggngccttggggacacttgccacatgggtcccaaatggctgggcaagggtgaccttgattcacacaccacagcctccccttgagtgatggaaggtgccactcacctaggccaaagcccacatcctcttggggactcagagcactcctctccttccactcccnaagacacgggtnttccagacccggtctgcctccctaccagccttcttaggctctgtcgtgtgactt

SEQ ID NO: 9186 - DNA, 543 bp, Mus musculus
taggcggaacctaccggatctagaaggacgttgagttcagagctccagagagtttgccgaaaagctcggcagtggcaaacccagtagcctggagtcgccaagctggagctggaagtggagttccggggtttcggggccgcggctgctgggcagcgcctcctccagaccgagaccacagcgcagaatgaccagaaggcggtggccttccggcggagtgtccgcgccaagagcgtgctgcgctggttctccaccgtggtcctgtatgccgccttcctggggctggtgagagctgaggctgcacccctcccaggctggggcgcgagcctccttcaggggacctgcccttcccagctcgactctcacattcgctccctgcacgttctgtgacttggcacttcgggctcatcagctgtctcatgggcgctattttaatcactgagggttgctgtccagttcgaaattaatcgcactgttttctaactgcagcaaactttcctagcattgcctgggtctgtagccaccgcactctgaactattactaac

SEQ ID NO: 9187 - DNA, 469 bp, Mus musculus
gtgatgcccacacacagcgattgtccgagtggcccacgatagccacgtcatcgatccgctgatcccgcagcactgcactgatgtagcccttccagtcactcatctccgctcagtcagtcccagcaacttgtgcttgcattagggggggtggccggctgcattcagagctaagaacactggcagcatgcccgaagttcgcagggcggggctgtgacgtaaggcaaacgtcacagaacatctaactaggaggagaaggagagggcggtagagttggtgggggttcgggggcggttctaaaagtagcatgtaggaggaaatggaagaagatggatgagaggctggaaaggtggctcagcgttaagaaagagcattcattacacagagcctgagttccgttcccagcatcacctcttttggcctacaaagcctgtaactcccactcgagagatctgacaactcctgaggcaag

SEQ ID NO: 9188 - DNA, 497 bp, Mus musculus
  misc_feature (392)..(392): n is a, c, g, or t
  misc_feature (425)..(425): n is a, c, g, or t
  misc_feature (439)..(439): n is a, c, g, or t
aggctgatcctggactttgtctacgcgcagcctcggtgtgaccagcctgatgaccggccagctgtggtgaaggatgtccactacctctacttctccatgattctgtcttttaccaccctcatcactgtggtcactgtgagctggttcacagagacaccctccaaagagatggtcagccgcctgacttggttcactcgtcatgaacctgtggcccagaaggactcagcaccaccagaaacccccctgtctctaaccctttctcagaatgggactacagaggcccctggcaccagcatccagctggagacagttcaagaaagtacgaccaaagcctgtggcgatggtgtgtctcccaggcattccaaggtggtgagggctatcctgtggctctntgggatggaaaagaacaaagaggagcccccaancaaagcggaacctntcatagtttccttggaggaaaatcccttggtgaaaaccctgcttgacgtcaactgcat

SEQ ID NO: 9189 - DNA, 211 bp, Mus musculus
gaatggcactagtgtcttccccaagttggctcaatccttagggacatcatgttcaaaggaggaggaaataccacgttgtcatgcccatgtcctacacatgttgtgagccatcttgcttcatctttgtgtcatttgcaggttcaacttctacaccccaaaacatatcacttcctttagctcacagtcgttgtcatatcttcacttccttgaa

SEQ ID NO: 9190 - DNA, 328 bp, Mus musculus
caaaaacaagttggcatctttcagtgctgttcttccttcaaatgtgatatgtatgaagcccctgtctcctgaaggaatgtggcaaaataataagtttaaagtatcagcttttggactcattaattcaagtcgttacagaacacacagttgctgtgagcactgtctgttgtgctgggcattacatggtgggaataaaacagatcctttctctatctttatggacttcatagatgctctaagaaagctaggctcaatgcatgttctgctatgtgatctaagatgagacacacaatgtatatgaacttcacctgtctatccattcatgtat

SEQ ID NO: 9191 - DNA, 68 bp, Mus musculus
  misc_feature (34)..(34): n is a, c, g, or t
ggacaaggacggacatgcacagagagaaccacanccttgggaccataggattcatgatttctgatact

SEQ ID NO: 9192 - DNA, 163 bp, Mus musculus
  misc_feature (56)..(56): n is a, c, g, or t
  misc_feature (58)..(58): n is a, c, g, or t
  misc_feature (110)..(110): n is a, c, g, or t
  misc_feature (131)..(131): n is a, c, g, or t
ggtcacccatcaaatgcttcatggtcacttatagtttgctgtatatgtgacatgantntcatagtttcacttaaaattgtaagttcacaaatttaacatgttaagacctntctgctttggttttcatagtntcttaacctggagtaaattctgtagaacactg

SEQ ID NO: 9193 - DNA, 311 bp, Mus musculus
  misc_feature (67)..(67): n is a, c, g, or t
  misc_feature (80)..(81): n is a, c, g, or t
  misc_feature (84)..(84): n is a, c, g, or t
  misc_feature (101)..(102): n is a, c, g, or t
  misc_feature (158)..(158): n is a, c, g, or t
  misc_feature (208)..(208): n is a, c, g, or t
  misc_feature (210)..(210): n is a, c, g, or t
ggtaagaaacataggcaggtcaatgaagatgaactgtgacagaagagccggcagtgcccacgggtgncatgggcaccagnngantgaccaccttccccagnntgcgcaccacagaccccagcacagtcagcatgggctgaaggaagtgccaggcatcntgggaaccccttcatggtcatcccctcctgcctcagatccttaacttccntntcttccccagcttctctaacaccccactccctgttccaagttgaggagcatgtgtagcctcatccccctggttttcaatgaatccttgtataagcaactgc

SEQ ID NO: 9194 - DNA, 465 bp, Mus musculus
  misc_feature (100)..(100): n is a, c, g, or t
agagccctggtctggaggtacttgcagttgttccccagaagtccacgagagggcgcgcaacaccagaaacctagcagacacttttagggtggccagtctnctaggcattttacccttgtgggtcccagtcaactgtagtaccatcttctctactgctaggtacttgggttggaaaaaaaaaaggaagaagcagcctcctgccccccaccctgacactttcttagtccaacttcaggtctgtctcatgattctttggcttgctcccaaactacttcaggatgaagaaacccaaacaccagtcccgaattcaccattgagaaatatcgccagtgaacccccctcacccccagacagtctgttcacctcaagtcctcccaagttgagttccactgggcagggctcctacatacaccctccaataatgggaaactcaatacacagccatttccccacaatttcttttat

SEQ ID NO: 9195 - DNA, 239 bp, Mus musculus
  misc_feature (93)..(93): n is a, c, g, or t
  misc_feature (110)..(110): n is a, c, g, or t
ttcccaaaatgcttgctcagaagtcaggcaacattatcaacatgtcgtctgtggcctccagcatcaaaggggtggagaacagatgtgtgtacnagtgctaccaaggcggntgtgatcggtctcaccaagtccgtggctgcagacttcatccaacagggcatcagatgcaactgtgtgtgtccaggaacggttgacaccccatctctgcaagaaagaatacaagccagagacaatcccaa

SEQ ID NO: 9196 - DNA, 484 bp, Mus musculus
  misc_feature (66)..(66): n is a, c, g, or t
tggagagtttatcgctgtgttcttcagaagttaggtgtcaaagcagctcaggagatcttacagatntcattcaaggtgggaaagaagtgccccgagactgctaaattaagctgccctggttaaattcccctctgctctggttttgaattctctcagctaagaaaccctctgcagctggagagtcgctctgtgatagagtgattttggagcccacgcagtgccttgggtttgatctctagagccagaagaaaacaaaaacaaaaacaaaaacaaaacaagacctctctacataaagtgcaggaggaaaattcacccatttccccatcccccacccgatatccatttgaaggatatcttagttttgaaagattgtcttagttttaaatccggcagccatggcagctctcagactgatgaaagggaggctggcaagcaagcagggaagagagcaggctcaggtagaaatttccctgcacggcgctga

SEQ ID NO: 9197 - DNA, 481 bp, Mus musculus
  misc_feature (94)..(94): n is a, c, g, or t
  misc_feature (363)..(364): n is a, c, g, or t
ggcaccattctaacccctttaagagaagtgcacagtgaggtttacagacagaagccattcacctctgtgaaactgccatactccaaagtcactntcaacctcggcactgatatcccctccgccatgcagccccaaccctgagcaaactcagggctgtgaagattgccatttccgcatagtggcaatgcactgcacgcaggcccgttcttctgctagcttctccacatccaatgaaattctttatttctttgccaatatcttatcagcaggttatctatttcccgtggtgtgggttcattaatctaatttgactcatatctctagcttctttcagtaaatagatcactgatttttttttttttnnggtctgtcagtatgaacttatggtactagaaaaattacctttcttcttcctgtatttgaaacaacaaaatgttaaacccttgatgcttctctgccacatccttagcctatattcatt

SEQ ID NO: 9198 - DNA, 391 bp, Mus musculus
  misc_feature (179)..(179): n is a, c, g, or t
  misc_feature (251)..(251): n is a, c, g, or t
  misc_feature (253)..(253): n is a, c, g, or t
tggagatgatcagtcatcccgtctcccccaccccccgcccccgggcgtagctctcaccttcatttgaacaaagaaaagctggtagccttcagcttcctaagtctgaacggtgtcaccaaccacagcccaaagctgcagactttaggaggtgtccaaagaattagaaagaaaacagtttnacaaagatcaaaggccactcaaggtaaaggtggctgcccccaagagagatacaggaattgtcaggtcttgangnttttggtactgtgcttatatgtgggattgcttttactctctgtcagaagagtccaggtttttcaaggatatcagcaaaacaatcttggtttattattgtgattcatattatgcctcagggacatttcacttggatgat

SEQ ID NO: 9199 - DNA, 449 bp, Mus musculus
  misc_feature (157)..(157): n is a, c, g, or t
  misc_feature (159)..(159): n is a, c, g, or t
  misc_feature (296)..(296): n is a, c, g, or t
  misc_feature (304)..(304): n is a, c, g, or t
aggactacaccattcatgatactgtaggtgtgtaacactcagccaatatttgatctgggctctcagtttcatattgcatgcatcccttcatttaattaacttgtaaataacaacacttcgtggcagctaagcaaatattttaataagccatgaaagncnagatataagaactctgtactttcaggtatttagaaaaaaaaaatgtacttgccataagttaaagcagagttgccatttgaaatttccttcccttaaaaatatgctgtaacaccatgtgttcattgttgtcttttcanccttatanatatatgatgtgactactacatctttgtgaaattttgtttaacaattaatggttttaacaatctgaacaacaattcaaggcagaagtaaatgcataaggaatttgagcctgtttgtaagaagtctactccttatgttatatttac

SEQ ID NO: 9200 - DNA, 444 bp, Mus musculus
  misc_feature (35)..(35): n is a, c, g, or t
  misc_feature (37)..(37): n is a, c, g, or t
  misc_feature (312)..(312): n is a, c, g, or t
acatgcactacctcatttaatccagaacagaatcncnaagatattctgatgattaatctccatttttaaataaagaaatagagccttgaaaagctgatttattgctttagaagggagctcaggcttagatcttgaattaggtctttgggctgttacccctgttcctaatcactacaaaatcccatcctgctgcctttccttccttgtttttacacacccacacccacacccacacacatgggggcagtacatgagatcattcacatgtgaaacacttaggatactcatatttgaggtttttatttaacttgnccaatcaggaccagaaaaatgggctggaacttgggtctcattccaaatcagtgtttatcctgttatacaatggaactctgcaagtttctcttgattgttcttgctaagagagattctccactaaattcctat

SEQ ID NO: 9201 - DNA, 411 bp, Mus musculus
  misc_feature (178)..(178): n is a, c, g, or t
taattttactatcttgtgactacagtgcttcaacaagaatagcaaagcccacaagctgtgatgctttcacacagtatttaaaaacaagtatgagcaaaatgttttataacttgctcagaacatcagaaaatacaatgcatgtcatgcaaagtctgagctttctctcatctgttcagantttttttttttcaggatagtttagaaaaaattcagaatttgtatagtgtctgtttgtatatttacagattccatgtatttcaaaatcagttgtagctttcgattaatagatcactgctgggttatttctatttatagttcttggaaagattaagtgctacagtttcatactactgaggaagtcaataaaaattcgcaaacatgtaaatgacactcaaaggtgtacttttccaa

SEQ ID NO: 9202 - DNA, 437 bp, Mus musculus
taggagaacttgttactcttcccaaggacctgtgttcaattcccagcacctaagttgagtagcttataactgcccataatggtagctctcgaggtaatctgatatctttttgtgaccttccttgacattcacattcctgtgcacatacttgcacatagatgcatatacataataaataattaaaacattttaagtggaaaaagtctatgcatatccagaagttaagaatcgcatatacaaagtttaataaaggggaagtcgggaagtcatgctttattgaaagctgtgaggtcagacagtatattttaaacgaaccctgaaagaacatatcatttacagcagagatcattagccatagagtcttacaaattatccaaagaactcatccaggtcacatatgcaagcttaagtcacaccctcagatgcaagcactatat

SEQ ID NO: 9203 - DNA, 415 bp, Mus musculus
ggaacaattggccagttgtgaactgttcattttcttcactgctcttatgcaaaaatttacattcaagtccccaatcaatgagaagccgagcctgaagttcagaatgggcctaacacttgccccagtcagctaccggatctgtgcggtccctagattgtgatgctggagcaaaaaggaagaaaaagaacaagaagaattggagtatgccctgaagattcttggccttgctcacataaaaggagaaaggcataacagaatgaaggagattcaagaaatactgaagaaattaggctaagaaattgaatcaaatatctggattcctggtgcctaaatttggcagtgagaaaaatcagttatgatctcaatggcataactttccatttaaaagtttcaaggagaatggtactttttccct

SEQ ID NO: 9204 - DNA, 431 bp, Mus musculus
gaggcccaccaaacggagacgtcatccagcagccatgagactggttctgagaacatctgactgggatctcaagacaagcccaccagctcagagatttaagagaagacctcacaaggctaaaaacactttctaaggaatggcagaagtgtttgttcctccaaacacatggatcaatgcaaggatgtgctaaatcaaaaggaatctggcaaactgaacactggtaaagaaaccgaacaaggctgggacagctcaccacagaaattagagacctgtgagttgtaggaaggagaattcaaaatgctcacattacagaagctcaatgaggtggaagggaacacacttaagaagaaaagtaaaggaattggatgggaaaataaacatatttatccttcaataaaatataaacattttttccagagacaatcataggc

SEQ ID NO: 9205 - DNA, 552 bp, Mus musculus
  misc_feature (361)..(361): n is a, c, g, or t
  misc_feature (439)..(439): n is a, c, g, or t
  misc_feature (493)..(493): n is a, c, g, or t
  misc_feature (523)..(523): n is a, c, g, or t
tatgagcagtgttcagagtccaagtaggtggtatagatggttcaatctaaaagggtctgagaacctgtggccatctgtagcagaaatggctaggacatagcatggagtagtcattgtagttcaggccccaagaagactgccccagagagccacacagcatagggaagtacctctgccatgcttagatacgtgggagtagatcctctgttaagtagatgatcactcaaaatagacaggaggggaggaagcagagggaagggcacaggggagagggtagcgagcaggcaggcatggcggcatcctggaactacagaggtggcagggaatttgagttagatagttctcagtaaaaagtttagcnaagtatcttttctaaatagtatgtttggtccacaggattactgccagaaaaaaaaaataataaaggcatgttattccncatagctgacccccagtgagcgagcaacagaaattaagagtcctatagtttgtntctgaggaggggacccacttcagggctctntgatgggtaagcctcaaatcttgtacttt

SEQ ID NO: 9206 - DNA, 215 bp, Mus musculus
ccggttttctcaagatgcactcgagtgatactgcattgaccagctgaacatctggaccaatatgctggagccatatcgccagaacagagcccatgatgtcttcagcatacagctcccatgtggtctcagaggcagtccctggatggcatttacttcccatgcttgtttgtcttgaggttcttaaacctaacatttactctggagctttctttcca

SEQ ID NO: 9207 - DNA, 288 bp, Rattus norvegicus
caaagtggcacatgtcttcaatcccagtacttgggaggtggaagcaggggaatatctatgagttcagggccagactggattccagagtgagtttcaggtcagctgtagttgcacagttagtccttgtctcggaaaaataagtcttcatatgagtttctaaaatgaagttctgaaaacaccactaagttgggaaaccttcgctgaggctgtagatgtttgttccgtgatggccctgggttaagcactcttggtattgtattgtagaactcaaattcctcactgcaaagc

SEQ ID NO: 9208 - DNA, 507 bp, Rattus norvegicus
  misc_feature (53)..(53): n is a, c, g, or t
  misc_feature (57)..(58): n is a, c, g, or t
  misc_feature (62)..(62): n is a, c, g, or t
  misc_feature (66)..(67): n is a, c, g, or t
atctatgctaatatccctgaccttccaagttcctacataccttcccgattaanaaannaaanaaannaagagtcagatgatgaacaaaacagaaaagctttgtatgccatggaaattaaagttgaaaaagatttgaagactggagagagcgtggttctgtcttcaatacctctcccatccgatgactttaaaagcacaggaataaaggtgtatgaggaccggcagaaatcagtctacgcagtcagctccaatcagaacacagcctacaatggcactgatggcctcgcaccagtcgaagtggaagatctcctgagacaagcctccgagaggaactctaaatcacccacagagtaccatgagcccgtgtatgccaatccgttttgcaggcctatgaccccacagagagaaagagtaataagccctggaccaaattctcaagaaaggatggtaatgatgaaagctaacggactggaccaccatgaaagcgaatctgtgcacggtatgacc

SEQ ID NO: 9209 - DNA, 298 bp, Rattus norvegicus
  misc_feature (152)..(160): n is a, c, g, or t
tcagactgccaactgtgtcacagacctccctgccttatcccatgggggctttacttataaataagtgtccccaagatggacagtctagccaagagctggggaatagagcatcagctgggctgtgcacagggcaacctggtttcttctgttcnnnnnnnnntgatgtcccctctcatgctgccctccttgtctctccctccctgcttggagcatcctgagcccatggatgcctaacacacagggacattgagttttgttggtcgtgcctgtgctgagttcctgctttgggagaagacta

SEQ ID NO: 9210 - DNA, 502 bp, Rattus norvegicus
  misc_feature (206)..(206): n is a, c, g, or t
  misc_feature (209)..(209): n is a, c, g, or t
agatcatcttggagtccttcagggccctgactgaattcttcagaatggaagagagaatgaaagggctgagcaggcgcaggacttcatttttagggggccggcgtcgctgggggggcctgcagaagcgagaggtttccccttcttccaatctggaggagatcttcgactggaagcgttcttacacgaggtgagaggtgaggcttacntanggaagaccctggacctgcgagatagatcccacagtatcacagcgaagggggaggggggacctgcacccctctcttaaagtggagaaagaacttccaccctgaacgtactacctaaagaagaattgccctggctctgagaaacattgcacatcctgctcggcccctggccactgtcttctgtcatcaagtcacaagcaaagcagcacatgcattgtggttcaccaacagtctgtaactcctgttccacaggacccgatgccttcttctgaattcttcaggcaccagggatgcat

SEQ ID NO: 9211 - DNA, 285 bp, Rattus norvegicus
  misc_feature (68)..(69): n is a, c, g, or t
  misc_feature (154)..(154): n is a, c, g, or t
tactgtctgtaaatgcatctgcccttggtatgtcactttataaacttggtcctattaatgtatacatnngtgtatgtatatgtgtatatgtacatatatatacacatgtgtgtatatatacacatatatatacatatatatatatattgctacnacaaaatatttgaccaaagtaggcctacagctatttcaactaatagtttccagaaagagctgtggaagatttactggaaattaagaacttgctgctgttaaataagactttgtatatttctggtctgcagg

SEQ ID NO: 9212 - DNA, 216 bp, Rattus norvegicus
aacagtgagtggtgtcttagatcaacctgatacaagctaaagtcatgagaggagacaaccccaattgagaaaatgctcccataaggccaggctgcagacagtctgtaagacattttcttaattaatgattggtgggaaatagcccagcccattgtgggcggggccacccaaagcaggctcagcagatcaccaagagcaagccaacaagcagcatcc

SEQ ID NO: 9213 - DNA, 510 bp, Rattus norvegicus
  misc_feature (52)..(52): n is a, c, g, or t
  misc_feature (109)..(109): n is a, c, g, or t
  misc_feature (206)..(206): n is a, c, g, or t
  misc_feature (209)..(209): n is a, c, g, or t
  misc_feature (222)..(222): n is a, c, g, or t
  misc_feature (249)..(249): n is a, c, g, or t
gggtcttttcatgcatcagtgtgtgttgggggaacagtgagaaagagaccantggtagctggtgggggaccagatttggggaatctgtgacggtttctgggatggaaanacaggatctcctggcttctctcttcctctagttctgagctagagaaggcaaggccaagagtttacatcagaatttctccaccttttgtttgtttgtntgnttttgttttttgnttttgtttttgtttttgtttttgttcntgtttttgttaatgccttcctcaggtctccacccctgtttcccttaaaacaaggtattatgtagccgaggccagccttgaccggaactctgtatacccaagtctagccatgaactcttgaccctctggccttcacctcctgagttctgggaatatgggcgtgtaacgctattcccagtttatatgtggtgctggggttcgaacctagggccctgtgcatgctaggagatatctataactaatttaaatccacagctcccca

SEQ ID NO: 9214 - DNA, 462 bp, Rattus norvegicus
  misc_feature (56)..(56): n is a, c, g, or t
aggccagcttctgcttggaggacactgagtgtgagggagacattcagaagagttangagtgtgccaacttcggagaacaaggcatcaccatgggctgctgggacatgtatcgtcatgacattgactgccagtggatagacatcaccgatgtgccccctggagactacctgtttcaggttgtcattaaccccaactatgaggtgccagaatcagatttctctaacaacatcatgaagtgcaggagccgctatgatggctaccgcatctggatgtacaattgtcacgtaggtggagccttcagtgaggagacagaacagaagttcgaacacttcagtggactcctaaataatcagctctctgtgcagtaaagacgactctgggccaggcatgatggctcatgcctgtaatccccgcactcaggcaggaggattgccacaagattttcactctggacactagacc

SEQ ID NO: 9215 - DNA, 228 bp, Rattus norvegicus
gaacagcacctttctggaggagtacatgtccgtgaagtccctggaggtgatcggccgagccaacatcacagtgaaatcctccattaagaacttgctgctcagagatgcatccacagtgatcccagtgatggtatacttggacccggtggctgtggttgcagaaggagtcccctggtgggtcatcctcctggcggtgctggctgggctgctagtactggccctgctggt

SEQ ID NO: 9216 - DNA, 588 bp, Rattus norvegicus
  misc_feature (329)..(329): n is a, c, g, or t
  misc_feature (331)..(332): n is a, c, g, or t
  misc_feature (335)..(338): n is a, c, g, or t
  misc_feature (340)..(345): n is a, c, g, or t
  misc_feature (347)..(348): n is a, c, g, or t
  misc_feature (350)..(356): n is a, c, g, or t
aaggcctacgtcacatggatcacgctcgccgtctacattgtaccggtcatcgtgctggccgcctgctacggcctcatcagcttcaagatctggcagaatctgagactcaagacggcagcggcggcggcggctgccgaggggaatgacgcggcgggtggagctgggcgtgcggcgttggcacgggtcagtagtgtcaagcttatctccaaggccaaaatccgcacggtgaagatgaccttcatcatcgtactggccttcatcgtgtgctggacacctttcttcttcgtgcagatgtggagcgtttgggacgtcaatgcgcccaaggaagntnntgnnnncnnnnnngnnannnnnnnggccagcctcaacagctgctgcaacccgtggatctacatgctcttcacaggtcacctcttccacgaactcgtgcagcgcttcttctgctgctctgctcgttacctgaagggcagccggcccggcgagacgagtgtcagcaagaagagcaactcatccacctttgtcctgagccgtcgcagctcaagccagaggagctgctctcagccatcttcagcatgagccataggcctg

SEQ ID NO: 9217 - DNA, 496 bp, Rattus norvegicus
gactgtacagggacatgcggatgctggggaagataagtttgagatcaactttttaacggacgcgggagacatcgccttccatgtcaaacctcgattctccagcgccacggtggtgggcaatgccttccagggagggcggtggggacaggaggaggtgtccagcgtgttcccgctgaccttgggagagccctttgaggtggaggtgagtgcagacacagaacactttcacatttacgcccaggaacaaaaggtgctccagttcccacatcggcacagaccgctagctaccatcaccagagtgcgagtgctcagtgaccatcggctggcccaggtggagctggccaagcggggcctgagctggggggatgggggctactgagtggactggaccacacagcctacaagagccagccttggccatcctgtatcccctgccacctggagccacatgccacgcattgcagatgctgggaagctgaggctctgtatgaacccc

SEQ ID NO: 9218 - DNA, 480 bp, Rattus norvegicus
  misc_feature (138)..(138): n is a, c, g, or t
  misc_feature (159)..(159): n is a, c, g, or t
agcaacaagttgtctgtcacacccagcgccttcagtaatggcgtacctctgctcagccagtatttaaaatgtgtttgtgtttgctcatttgctttttctgaggattggaagatgtaggttctgtgtcgactgggtctnaccagtggtattaaaatcatntgctatttagcctcatcatgaatgagcaatgggatcaattcaactaattcaagaaaccaaactagttagcgctaaaaagactgtttccacaccataggcaatcacctcataatttgcaaaatataagcatatgcctactgtattcgagggttttcccaatcagaacgtgttggtctataccagtgagtgtgtgttagcggtgaaatgtgagggttttcaggaagtcttttacctgtacaagaaggttgcacatgtttaataacaatcagaaacagaaaatctcctttaaaccacacactgcatgaccctctctgataattc

SEQ ID NO: 9219 - DNA, 346 bp, Rattus norvegicus
gaaggtccagagctctcaagcctgtctttcacctctgtggatgcaatgtcaattacctgtttttcagccagcggcacccagggcacttacacccccacgaatactagaatataaacaccctgggcagaggctatctttttccttgtatcttgagcttagaataaagtctagcctgggtgctagtaagtatctatagagtgagggctggtgggatggttcagtgggtaaggatgctgctgccaaggccgatgacctgaatttgatgcctggaacctacatggtggaaggagagagtggactcctgcaagctgtcttctcccttccacatgtgcactgaggctcgtgt

SEQ ID NO: 9220 - DNA, 265 bp, Rattus norvegicus
aaacttaccatgaatctggcagaaaactcaaggccacactagctacatatagtttactattctgatgtaagtagaactatctgcatataatgtgatttaatttattgttgttctgtgtagaaagcaaggattaatgattgtggatataaccctgttttgtataatatatttgatttctggtgcaaaattggtcatttaagcaatctacttcatttggtgtttggatataaatgtgtatgtgttcttgtaaaggttcatattcagc

SEQ ID NO: 9221 - DNA, 315 bp, Rattus norvegicus
  misc_feature (113)..(113): n is a, c, g, or t
aataggtcctttgaagccaatgcaaaatcacattgaaggggttttattcattggagcacacagaaaaggcacttgtgcagtttctgtagtatttctctctttgaccaacaatntgcagttgtggagaatcaaaccagtagatcagcctgactgaagagttaggtaaaacggtggtaataagcccttgttaacgtgaaattgggcatggcttattgaatcacatcaccacaaaacatatcaagctataatcaagtcaataattcttttcaatcaaatgatgaggacatattgcaatgcgggttcgtttgttattaa

SEQ ID NO: 9222 - DNA, 283 bp, Rattus norvegicus
  misc_feature (136)..(136): n is a, c, g, or t
ttaatggtcacttactgacccctggtgggaataccgattgccacctccttgctagccagatccagctgagaagaaaggtgctcattcattcccttaggggcagggctctggcacatagctatccaaacttgatganaagctttgagcagcttaccctatccaagctttggtatatcccaagtgtgacatcaccatgctctgcatagatgggccattttcttctgggaacacggcaggtatgaactcaacaactgcagaggtggtcaagctgaattccattctt

SEQ ID NO: 9223 - DNA, 242 bp, Rattus norvegicus
acagctttaaggataagaatggccaagctggggaaaaaggtgatctgagagccattgtgcccaccagagtaacctctgaagaagaagccaagaaatgcctgaaaacgtctcttctgaatactttgatttcttgttcttaaagtccaaaactatataattatacccgtagtaagccacataaataaatagtagtcattatttgtggggagaaaatccccaccccaaaaaagctgaggacgaca

SEQ ID NO: 9224 - DNA, 514 bp, Rattus norvegicus
  misc_feature (51)..(51): n is a, c, g, or t
aaactcgtgtcaatagtctgtgggttttatgccaactcagtggagtgatanttatatattatttctagttccctctcaatgtcttatattaagattgatgtattagttgcattgttggttaatctttcttggcgtttaagagaagtgacgtcaccttgcctttagatagatgttaatatcacctatttgtctaggaataggcccgctcagtggaactgtcagattaaagatatgctttattaattgaaactctgtacagctgtaagtttaaaagaagacttattttgtatgtctgttgaagctctgattttggtaaattgtgaaggaacaatggatgggcggacttctgggaatttgttcagtggtcaagggaacccaaggacaacaccagccaggccactctagatgcatggttctgaacatttaggtgcctgttattttactgtgtatattttactttaaatatattaactttttgtggattcatttaaagtctgctcatacgcaacactgt

SEQ ID NO: 9225 - DNA, 387 bp, Rattus norvegicus
  misc_feature (112)..(117): n is a, c, g, or t
  misc_feature (122)..(123): n is a, c, g, or t
  misc_feature (125)..(125): n is a, c, g, or t
  misc_feature (229)..(230): n is a, c, g, or t
agactgatttgcatactcgtgtatatatttacaaacagttggcccttgctaagaagaaaacctcattatatatagaatttgtgaataaacaggttgaaattatttacagaannnnnnaaaannanaaggtattaagaacttattgcatctgtgccagagacgtactgttgtttagaaagtccaagccgagtaaataacggctgccttctcgcatctcagcttaggtgcnnatgctcttccagggctgaagcggaggggaggggaccattgtgacagccgagtgtccactgactctcttatgatggctgcttagcatcccactggctgttcagaaaggctttctcacataactcttgtacttagacaggcaagttcccagatacttta

SEQ ID NO: 9226 - DNA, 532 bp, Rattus norvegicus
tgtaccccagtaccacgcagtgaagatccttcgggaagaccggcagcagttcaaggaggagaagacaggcaccattcagaggagtaactggggcaattcccagtgggagggctccgacgcacaccctatcctggctgccgactggcaccctgagttgggtcctgatcgacatcctgtgtcagtcactgcctaacttctcctgtcccaagccagcctctgggttccttccaccctttcccaagatggctctttgggggtggagatagtggagtaggttgctggcttcatgttgaaataaggcaggttctgctttctcaggggcacagatctttcccaccgtgagaaccaccccttcccatcttctccgtacaatgctgtgagacacggggcatggctggaaggacaggcatgacctggtgcaggatggagaagaaggggtactgagctgcctctctcacccaccctgtaagaccgtcttccccaaagtgccttagacagagggtcagggaagagatcgtgtcactgtctcagg

SEQ ID NO: 9227 - DNA, 553 bp, Rattus norvegicus
gttctgtgagacgaccattggctgcaaggaccctgctcagggacagctcctgaaggacctgatgcaaacacccaacttccgcatcaccgtggtacaagaggtggacacagtggagatctgtggggccttgaagaatatagtggctgttggggctggcttctgtgacgggcttggcttcggtgacaacaccaaggcggcagtgatccggctggggctcatggagatgatcgcctctgccaagctcttctgcagtggctctgtgtcctccgccaccttcctggagagctgtggggtcgctgacctcatcacgacctgctacggggggcggaaccgcaaggtggcagaggcctttgctcgcaccggaaagtccattgagcagctggagaaagagatgctgaacgggcagaagctacaggggccccagacagcccgggagctgcacagcatcctccaacacaagggcctcgtggacaagtttcccttgttcaccgcggtgtacaaagtgtgctatgagggccagccagtgggtgagatcatccgctgtctgcagaac

SEQ ID NO: 9228 - DNA, 523 bp, Rattus norvegicus
acgttctggctttgcatgaagtgctcagagctggctacagcaagaaggatggggggaaaatcatccagcagacttggaacaggacatttgaaggtatcgccgggcaggtgtccatagatgctaatggggatcggtatggagacttctctgtggttgccatgactgatacagaagcaggtacccaggaggtcattggtgattactttggaaaagaaggccggttcaaaatgcgatccaatgtcaaatatccttggggctctttgaaattgagaatagatgaaaccagaattgtggagcacaccaacagctctccttgcaaatcatgtggcctagaagaatcagcagtgacaggaattgttgtgggggccctactaggtgctggtttgctaatggccttctactttttcaggaagaaatacagaataaccattgagaggcgaaatcaccaagaagaaagcaacattgggaaacatcgagagctgcgggaagattccatcagatcacatttttcggtggcttaaaa

SEQ ID NO: 9229 - DNA, 514 bp, Rattus norvegicus
  misc_feature (452)..(452): n is a, c, g, or t
gtgggcaagacgtctcaggtcacgctctatgtctttgaaaaagtgcccactaggtatggggtggtgttgggagccgtgatcggtggcatcctcggggtggtgctgttgctgctgttgctcttctacctgatccggtactgctggctgcgcaggcaggctgccctgcagaggaggctcagtgccatggagaaggggaaatttcacaagtcttctaaggactcctcgaagcgcgggcggcagacgccagtgctgtatgccatgctggaccacagccgaagcaccaaagctgccagtgagaagaaatctaaagggctgggggagtctcgcaaggataagaaatagcggttagcgggccgggcggggggtcgggggtctgcgatggagtcttccaaaggctctcaggtggtggtcatcgagatggagcttcgcaaagatgagcagagctcggagcnccggcctgcagtcaaatcccccagtagaaccagcctcaagaacgccctcaagaacatgatgg

SEQ ID NO: 9230 - DNA, 510 bp, Rattus norvegicus
  misc_feature (244)..(244): n is a, c, g, or t
aaccccactactgattttctgaactgcctcttctgagccagagtaccctccgtcttagagggagaacccgatgtggatctgtgttgtgtataatctgactctttccaaagtgctcccacgggagaccagagctgatactctgacaggcatacttgtgaaaacacaaagaccactgagacctcttctttgactaggacaaagaataataaggaagacgaaggatagcttcatctgtcaaactacntttttttttccttagaaaaggcataaatgtatggagttcgattatttcggggaataactcaaaacctgcattgtgacatccgatctctggagcatgctatggtatgccaagcacccaagcacactgtgttcactcttacagacgagataattgctaaaatcctcttgagtcacaaggtcggtgatcgtacttgaaaaccagcccagttcaccctatgtttacacgggaagagttttcctttgatagcaatttgacttttgacccaa

SEQ ID NO: 9231 - DNA, 522 bp, Rattus norvegicus
ccagacctccatacagtatagacttataactcagagctgatgaagccccacccctgcctctccacccctccaccaggccctttggtgctatccctttccatagttaagcactggatacctcctggtccctggctaggacctttccctctcattcctattctttctttgagtaaagaggtaaacaagatcaacgtgggacgccctcccctgagacgcgccttccttctgcttccttgacccagctccgcacaattccctctccccactctgccccattcccatgtccccaagccttctggggaccaagatgttgggcacaaatcaggatcctaaatggtgctgccctgctcgtaactgggaactgtatgaaatggggaatgaatggtttgtggtctatttaatctgcttccttctgaaggaagtctgggatatgatgagagattccagaagggtctctactctccctcccctgtgctgccctcctcccaaggacacagggcaaaactgccatctcaagaataa

SEQ ID NO: 9232 - DNA, 463 bp, Rattus norvegicus
ggacattgaaatctgttgctggcattgagttgtgccaggaggtcagacacccctttggctttgcatgctatgcagggctgtacctgcctcactcttgcttggcagccaagtgtcccctggccttcccacatccccaagagctcttgcccacagaccagaagatgctcttggcatctcaaccttggctctttgggtcccaactctgagtcagagggtctagcagaggatggtcagaaatgagtcctttggggttaattctctctcaccaactttcaaagacatggctgacattcccaaccccatcaccctcttgcaccctgggccttggcattaggcagagctgttgttttaaatgccaacactggtttccccccatatcctcccaacaagtagtgttggttaatgaacacttctggctccaagacaatccatcttcctgaaagcacagcgtcttcaaagagta

SEQ ID NO: 9233 - DNA, 446 bp, Rattus norvegicus
gaccctgctaactttcagttctttagccactgtctgctggtgactcttgcccggcactatcccggagacttcagcccggagatgcatgcctccttggacaagtttctgggtcacgtgacttcggcactggtctccaaggatcgctgaactgaggatacacagcggtgtagtctttgcccctgcccttcttcgaattcacaatatttgagtaaacctccccgggactgcattgctgtcttgtatgcagagttgcacaggagaaagataccccacacgcagtatcaaacaaaaggttccaagagactggaattacagctaaactagtgtggaaaacctcataggaaagtcagcttcccttgtttttgttgttttaattcatttttgcctttgagatacattttatgctctatgtaatccaggctggcctctcaaatccatcgtacaaa

SEQ ID NO: 9234 - DNA, 382 bp, Rattus norvegicus
  misc_feature (228)..(228): n is a, c, g, or t
aggagaagctacaacgtgaccccacctcccattgaggagtctcatcccttcttccatgagatctacaatgaccggaggtacaaagtgtgcgacgtgcccttggatcaactgccacgttcagaaagcttgaaggatgttctggaaagacttcttccctactggaaggaaaggatttctccggaaatcttgaagggcaaaaccgttctgatatctgctcatgggaatagnagtagagccctcctgaaacatctagaaggtatctcagacgaggatatcatcaacatcactctgcccactggagttccgattctgctggagttggatgagaacctgcgtgccattaggcctcaccagttcttgggcaaccaggaggccatccagg

SEQ ID NO: 9235 - DNA, 274 bp, Rattus norvegicus
  misc_feature (189)..(189): n is a, c, g, or t
  misc_feature (227)..(227): n is a, c, g, or t
atggctctctggtatggtcccttttcctttcttgagattgcatatgttttcttcagaatacaacagtgattcttaaaataactcaaatgaaagacacccatagtgtgcgagcatgaatcacagcctgcactgtgtgagcatgaatagtgggataaaaagtggatgtcaaaagagtggaaatcaaacctntgaaaagctctttctctctgtgaaatgtgttaagaaanacctgaagtctgtgtctgtggtggtacccagactgtcaatcaataag

SEQ ID NO: 9236 - DNA, 182 bp, Rattus norvegicus
  misc_feature (58)..(58): n is a, c, g, or t
  misc_feature (85)..(85): n is a, c, g, or t
gaaacattatcatcatcaagtcatcaggatcatctacaggaccagctgctcagttcanacctagggaatacaaacggctccctanaattccgcgcaaacatttctccagtgtgatagagactagtctacatctttacggacctccaggtctttgagagaccagcctcccgaataaaactaat

SEQ ID NO: 9237 - DNA, 168 bp, Rattus norvegicus
  misc_feature (87)..(87): n is a, c, g, or t
  misc_feature (123)..(123): n is a, c, g, or t
agagactgatctgtccccgccaatagaaattaatctttgatccctgggctgatggcttagcttgcactctcccaaacactaaacctnagctttctccatggaacccattgagtgatggatggnaaaactctaagagccaacaaatagagggtgaagtaagtcagcctg

SEQ ID NO: 9238 - DNA, 218 bp, Rattus norvegicus
  misc_feature (50)..(52): n is a, c, g, or t
  misc_feature (58)..(58): n is a, c, g, or t
  misc_feature (70)..(70): n is a, c, g, or t
  misc_feature (79)..(79): n is a, c, g, or t
  misc_feature (166)..(166): n is a, c, g, or t
gactacttttgaactctacccaatcagtttcaaatttagacccgaccacnnntgccantgtaccccaatnaagtgtaanccaagggttgtgcttggatgctgaagtggccttagcaactgggcagttccttgccccaaacagtcaccagtccagcactgcagcctntcagttttcggagtcccgaggtgagaccccctgttcattcaacgatgaagag

SEQ ID NO: 9239 - DNA, 324 bp, Rattus norvegicus
  misc_feature (69)..(69): n is a, c, g, or t
  misc_feature (110)..(110): n is a, c, g, or t
tatgccacagttgtcttcccgggaaggggcaaaggtgaaaaagcctccggtgagccggctcaggatctnccaaacagacaaactccacccagtaaatgatactccttagnttatactcttgggatcacccctggagaattctcggcagcctgtccaactagctctgccttttatgcccagagtatgtcagcaaccggtgactcgggggctctgatctagtatcttggtttggtggacataggaagtggtgctcagttatgattgaggtgtttgggggaagaattctttcctgctgcttcctggtgctggatctgctgtcattac

SEQ ID NO: 9240 - DNA, 405 bp, Rattus norvegicus
  misc_feature (42)..(42): n is a, c, g, or t
tcggctccggtcgatgacagtgagaagcatgctttccactgntctccctgatcccgtttgccacccaggatgtctgtgagtgagagtgcagtgtttgcctacgagtcctctgtgcacagcaccaacgtcttgctcagcctcaatgaccagcggaagaaggatgtgctgtgcgatgtcactgtcctggtggagggccagcagttccgagcccaccgctcggtgctggctgcatgcagcagctacttccactcgcgaatcgtaggccaaactgatgccgagctcaccatcacactgccggaagagtttcctgcactgtgggatgagagaagtggtgtgctgtctcagcctgtgagaggacggcttagcagggaaaggcacttgctaccaagctgttgatctgggttc

SEQ ID NO: 9241 - DNA, 398 bp, Rattus norvegicus
caatacgtggattctcagtggagcctggccagctttactgtgcctgctgagtcagcctgcatctgcgcctttggtcgaaatacttccaaaaacgtcaattctgtaatcgccatctgcgtagatgggaccttccacaaatatgtcttcactcctgatggaaactgcaacagagaggcctttgacgtgtaccttgacatctgtgatgacgatgacttttaagagtcctggcagctatactaggaacctacagtagccgatggccgaactgagtcttgagggtgttgaaccagccagcaagcataaaaatgagcctttccactctccattcaaacacagctgtgtctaaataaacagccaacatccccccaagcacttttgtgactgcgtgctaaaggcca

SEQ ID NO: 9242 - DNA, 320 bp, Rattus norvegicus
  misc_feature (26)..(26): n is a, c, g, or t
gttgcgccaaccactgagcggccttngcagccgcgatgccacctttaatcgatcataaatcggcgcgatttttcgattgagctctgaccattgagctgccgcaccccctccccagccccacccctcgcttcagggcccggatgccatctttttaagtcagcaatcagggggggcggccggcgctctaaccactgagccgccttgctccccggccacgatgggggccagccatcctttatcagtcacagatccgcgtgactgttcgaccgggctctgaccactgagccgtcccatcgatcgatcgctagagattcccaaag

SEQ ID NO: 9243 - DNA, 461 bp, Rattus norvegicus
aagactattccaactggccaaccatcccgcaagtgtacctcaatggcgagtttgtggggggctgtgacatccttctgcagatgcaccagaatggggacctagtggaagaactgaaaaagctgggaatccgctctgccctgatagatgagaaggaccaagactccaagtgagggccccgggtcctcgccgggcgggcagagcgccctccccgtcgtcagggccagaaaagcctcactgcgtggtggtgtcctgttgctgtggcgcttgcactgggtctcctggcctgcaagcgggcagggtgcttttactttagtctttggctcagaatcccctctggtgaactcaccaccactgcactgtaaatcaacgtcgtgatcctgtattgctgtaacccaatcgttcttacgttgactttactctgccagcttcgggagtcagtcctgatcttgtacgtggtttgg

SEQ ID NO: 9244 - DNA, 544 bp, Rattus norvegicus
ctattatctttgttgccttttgctttgtgggtgtcgctggtttttcttgcatggtttggagctgatcacttaaccctgggtaccagcaggttcacagcgctcaggctgcagtctgcaggctcacagcgctcaggctgcagtctgcaggcacacagcgctcaggctgcagtctgcaggcacacagcgctcaggctgcagtctgcaggcacggtccttaggctgcagtctgcaggcacacagcgctcaggctgcagtctgcaggcacacagcgctcaggctgcagtctgcaggcacggtccttaggctgcagtctgcaggcacacagcgctcaggctgcagtctgcaggatggctcaagctctttgctcaagaccacacgggagctctaccaactgtccaggtgtgaccagctcatggaagctaataggtttactttggtggtgtttttaaaaaaaaaaaaaagaagaggaagaaaatatatttttgtgaagtaagacctgcctattccagccttttcccaggcaggaacctattgctgttttaat

SEQ ID NO: 9245 - DNA, 485 bp, Rattus norvegicus
  misc_feature (53)..(53): n is a, c, g, or t
  misc_feature (60)..(60): n is a, c, g, or t
  misc_feature (331)..(331): n is a, c, g, or t
  misc_feature (342)..(342): n is a, c, g, or t
aactaggtagttgtcatggcccagacgtgacctttggatgtctaagtctaacntaacttntgctcctcccgtttgatttaacattgcaaagtagtagccagcagggtttgaccaaggttgttttttgttttagagacaggagagtaacaggatgaaattgtttatcacttaacaagtcatcactgagtccccactggcagtcactgttccaatgagcaggtcactgttttattccacaatagttcctgagaagagtgaacactactaggtagcacttgggcagtttacaccagaggcccatcgaatggcagagtcatggatgggcccttgngaaggcatccnagaaccacagtagtacaaggccctttgatttcccccagcccactgccatcctgtttgccgtcagtaaaatcaacttcagccagtgagaaggaccgggattggcacagccgtagccgtttatgttcttctgtttctctttgagc

SEQ ID NO: 9246 - DNA, 524 bp, Rattus norvegicus
  misc_feature (127)..(127): n is a, c, g, or t
atcttggccagctggattggttctactgggttcctaatgcaccctgcaccatgcggctgccaccacccaccaccaaggaagcaacaatggagaagctgatggctacactgcccaaccctaatcagtntactctccagataaatgtcgtttggctcctgggcagacgccaggctgttatggtgcccctgggccagcattcagaggaacactttccaaaccctgaggccaaggctgtgctgaagaagttcagagaggaactggctgccttggataaggaaattgagattcgtaataagagcttggacataccttatgagtacctgcggcccagcatggtggaaaacagcgtggccatatgagcatccccagactcctgctttgttgtttagttaagaccacccaagtacatccctgtgcttgagtggtggcagtcctgccctcccaagccccgccctctgaccctcaaagccccaccccctgcccatgtgggaccctcctccaagctgtccattgtctgctgcaat

SEQ ID NO: 9247 - DNA, 449 bp, Rattus norvegicus
cgcccgccatgatgctaggtaacaaacgaatggggctgtgtggactgaccctcgctctatccctgctcgtgtgtttgggcattctggctgaggggtacccctccaagccggacaatccgggcgaggacgcgccagcagaggacatggccagatactactccgctctgcgacactacatcaatctcatcaccagacagagatatggcaagagatccagccctgagacactgatttcagatctcttaatgagagaaagcacagaaaatgcccccagaacaaggcttgaagacccttccatgtggtgatgggaaatgaaacttgctctcctgacttttcctagtttccccccacatctcatctcatcctgtgaaaccagtctgcctgtcccacccaatgcatgccaccaccaggctggattccgacccatttcccttgttgtcgttgtatat

SEQ ID NO: 9248 - DNA, 471 bp, Rattus norvegicus
atgactcccaggactttgcagtgctgaaagagggacccctcagtggctcctacagattgatccagtttcactttcactggggctcatctgatggccagggctctgagcacaccgtgaacaaaaaaaaatatgctgcagagcttcacttggttcactggaacaccaaatatggggattttggaaaagctgtgcagcacccagatggactggctgttttgggtatttttttgaagattggacctgcctcacaaggccttcagaaaatcactgaagcactgcattccattaaaacaaaggggaaacgtgcagcctttgctaactttgatccttgctcccttcttcctggaaacttggactactggacatatcctggctctctgaccactccgcccctgctggaatgtgtgacctggatagtgctcaaggaacccattactgtcagcagtgagcagatgtctcatttccgtaaac

SEQ ID NO: 9249 - DNA, 284 bp, Rattus norvegicus
ggaacaggcaacaattactacagaaaaccacatccaatcaaaatacgacatcataaagcccagtcccagtgtttacatctgcaaaacactctgacgaattgccagcatcaagaggaacatctttgcttgaacttaagtagccattacttacaggtgttttccgaaacaaaacaatagttcagagtggaatgttgaagaacaaaggaacagcacatttgaatacaattacattttatattgagttattttagcccagattgctgttcacgtttcctttgattata

SEQ ID NO: 9250 - DNA, 306 bp, Rattus norvegicus
ggtctgggctacacgtcggacgaaaccgtcctgttccgctactgcgcaggcgcgtgcgaggcggccatacgcatctacgacctgggcctgcggcgcctgcgccagcgacgacgcgtgcgcaaagagcgggtgcgagcgcacccgtgctgccgcccgacggcctacgaggacgaggtgtccttcctggacgtacacagccgctaccacacgctgcaagagctgtcggcgcgggagtgcgcgtgcgtgtgatgctacctcacgccccgacctgcaaaggggccctggcgactttcaggagaactgaat

SEQ ID NO: 9251 - DNA, 528 bp, Rattus norvegicus
  misc_feature (97)..(97): n is a, c, g, or t
caagggtcgggcagctaagtccattggtccttagggaagtggcagttggctctcccctgatcagcatagttgaacaggagccagtgtctgtcccttntaccttcccatccagagtttgtttcccatgagggtgctagtgccagtcaaccattcccgtgtgtcacatgtgcacatatgaccacgtacaccagagcaggacccctcagatgaggctagactttgaggaccacaggaaacacacccctgcacctagaagggctttggaatagggggcaacctggtgggggcctccccatctgtactgaggccccagccttacatctcctctacccctgactgcacaaaacaaccctgaccgtgaggaccttctccctgcaccagaccccacctttgacctttaaccttctctctcccccgaaggagctcttctgagtggacatgggcccaaggccttacctaagtggagagggagggcagggctgctacatgtctccttctatggtaggtcaccattttgcacatctacta

SEQ ID NO: 9252 - DNA, 472 bp, Rattus norvegicus
attgccaggaggaaagcccttcacccccggaggaggagcagtacctcctaactgatccggcacctgcttgtcaccaggatccagacattttgtgttcctgagcactttgcaagagagaggagtctgcaggactcagaactttcaggagaccctgggagttgtggctatctcctggtggggagcctccagcattcctcaagctcttagttctccagaaaactggctttcatctgtctgctaacctcagaagctgggaatgggtgtggactgaggaaatggatctcaaggaatatcgtggttgttgttgttgttgttgtttttaccacaggttaaaggtcagatttaggcagctttcctcacaaggtgacagagtacagaaccaactggtgtagcagccataccaggaagacaagcctaccctatcagagtaaagactctctagagtgagggaccaatcctgtgactttacaag

SEQ ID NO: 9253 - DNA, 260 bp, Rattus norvegicus
tgctctgtgaccctgtgtgaacatatttttaagggttttgttttgcacattattgtatatggcaagcacagatggacagatttgagctttggatggagtaggcacccctatctcactctgagatctgtttgacaccctttggacagcagctttagctgctggtgtcaagggtgcgtgcccattgggctagaaggttccagcaggcttcttgcattactctgcacctagctggcttgctttactggcactcttgacttata

SEQ ID NO: 9254 - DNA, 500 bp, Rattus norvegicus
  misc_feature (160)..(160): n is a, c, g, or t
aggcaagaccatcagcaccgagagccccaaacctatttttacttagagactggctttggtcagtagctccctgtggagacagttgacagtatttctctgtgccggtgtcactgatggagctgcccctcccccgcagggttgccctcacaaactgcagccntgcagggggctgggctcctgtctgctgatgctgcccacctcacctgcagaggtgcctgccagggcgagttctcaggtgtctgttgctgtgccatgggggccttcttctggccctgtgcccctcaggcaggctctgtgcccacccagccccccattgtcacctgtaccagtctggagcatgacctagctgcacagggagaaggtccagcccacacacgtctgggaggggaggagtgggcatctctggcagcatgggctgcccacaggctgggcagtgggtccctccacacctacctcagggagccagtgtgtaggcactccacagcatgcctgttagtcaa

SEQ ID NO: 9255 - DNA, 588 bp, Rattus norvegicus
  misc_feature (135)..(135): n is a, c, g, or t
  misc_feature (242)..(242): n is a, c, g, or t
  misc_feature (389)..(392): n is a, c, g, or t
catgtactcattaggcttggcttttgttagcccacaaagggatcttttcctttaagacccccagagctagagcaaaggcctgattcaggagcctctgggagccccatcctcactgctgtgaaccctagagcctcnctggtcagcacttgttgctgggcaatgaaccagtcactgagcttcactttttggtccttctctgtccctccctgtccctctctgtccttctttccatatctggtccngagtatgcatggtttttccgtgttgctgtactagtgacagagtctaggccctttgttggatggtcatggatgcacagtgccttgtacacatgtatgcacacaaatcgagtgaagtattttggtaagcatgatggcctatggcaggannnngtgtgtgtgtgtgtgtgtgtgtgtgtgtgtgtgtgtacaaagtctttacacttagcatttggaaatattaaagaaatattgtcataggggagggaggaagaagcaacttttgggttcagaatctacatatgaaaaggtcatgctggaaggcccccaatgcatcctctgttggggccttggttcaataaagcactga

SEQ ID NO: 9256 - DNA, 356 bp, Rattus norvegicus
  misc_feature (30)..(30): n is a, c, g, or t
gaggaaccctacctgagtcttgtcacctcntccctgtctcagccctgcctccccaaatcctgtcatcaaagagagcctcattggcaggagttccaggaaggtgacattcccaattcacaccctccacaaagggggagtcctgggctgtgggacacatggctgtgagcccacagtgtcagccattgctcccaagctagtcatcttctgagggaagtgacctccctgggtttgcccctttctctgaccctttcccttcacccctccaggagggccaccttgatgtcatcccactggcctccaactgacccagaatgtccacattaacttttccccaatctttcccaatgcccataaaa

SEQ ID NO: 9257 - DNA, 462 bp, Rattus norvegicus
  misc_feature (80)..(80): n is a, c, g, or t
  misc_feature (91)..(91): n is a, c, g, or t
  misc_feature (339)..(339): n is a, c, g, or t
tgttacagagcccaagaagatccaggatgaacaccttcctcctcctcctcaccatcagtctcctggttgtggtccagatncaaacaggagncttgggacaaaacagtactgctgttactacccctgccaacaaagccgccacgactgccgccgccaccaccaaggctgccgccaccactgccaccaaaaccaccaccgctgtcagaaaaacccctgggaaaccccccaaggctggggcctcatccatcaccgatgtgggggcctgcacttttcttttctttgccaacaccttaatgtgcctcttctacctcagctgaggggaaggcatttctaaagccntatgctcctcacaccgctgccactaccagtagcaagagacaccccaacccagtccctgggaagggttgataccagagatccaaggaggttcaagttgacagcccatagccagaacgtcgaggt

SEQ ID NO: 9258 - DNA, 551 bp, Rattus norvegicus
  misc_feature (263)..(263): n is a, c, g, or t
tgagcgcgagttctaccgcgacctgcgctgtgtcgcgcctctggcgctgcgtggccgcttgctgccctacgtggcggaggatgagctgcgggccgcatgcgcgcccggcctactttgctggggagctctggtggcgcagctagcgctgctggtcctcgggctgctacacgcgctgctgctggcactcctactgagtcgcctgcggaggctacgcgcgcaggcgcgcgctcgctccacccgcgagttctcactcacagccccgntggtggccgagtcggccggaggtggtgcatcttaagaaaggacaggcgcagagcaacgacgacctgcaaattttacaggtccctgctggaggaccctccgccttcacctggatcggccttggcctctatccttgcccaacttcccagacccaagctctgcaagcctgaatccacatggggtcaaactgctgccagtactaccagaatgaggcaaccttgagtcttcagagcctagagtgctggagcagtccagtctcctgccagactccgcactgaataaacctttct

SEQ ID NO: 9259 - DNA, 385 bp, Rattus norvegicus
ttacaaataccctgggccttctgattctggtatttggagccctcatcttttggattgtcaccaggccacaatggaaacgccctagggaaccaggctctatccctcttcagctaaatggaggcaacgcagacggaatggagggcgccatagcaataagctccgcccacaacatggacgctgcagacgcagagttaagcagcgagggagcagcccggaaaagaaccctcggccttgttgacactggccagaggtccaccatgtgaaatgttgatgcagccacgtaacttctcttccaaagtcagccctacgatttagcttctcctacctagccataggccgatgtatattgtggtaaccaaggaggttttcctgagagcgattgtgt

SEQ ID NO: 9260 - DNA, 259 bp, Rattus norvegicus
gtagctggtgcaggaatctcatccccctcccctgagctctctgtttaggtgacacacttgtgcctcaaaccacagggagcaagtggtatgaacctgtgatctgctcagctctgccttgagcgtcagatgaaacaaatccaagacaagagaactgcccttagcagtgcaactggacatcagagctccttgtaaggaactgggaaattgctggcagtcaagggaaggggtagagtaaatctggaaaacagtcccctctgtc

SEQ ID NO: 9261 - DNA, 479 bp, Rattus norvegicus
tttagctcaagctgtctgcctgaactgctgcaagtcctgtgaatggtcaggcacgttacctggagtctcacagagaaggccccagaatccaggctcactcacggagtgtgctgaagaaccaagaactcccaccatgacacccctgtggcttttgtacccttcttggactggaccttggatggcagccttgcagccaccatctttgtaagttgcttggtagggcagcatgactggctttttggcgtctcatgggagagagctaggtggcagccctgcagaagactgcacatcctcacacagagaggccacctcatgaataaggtttcctgcaaacatcttctgggcccttggcagccatcttgctctctcaggccttgctgtggttttgggaagctgttggctcagaagacagacttctacttcatctcctagtaggaaatttcttaagcttcttctccctcgtggcttatatatttctt

SEQ ID NO: 9262 - DNA, 550 bp, Rattus norvegicus
  misc_feature (216)..(216): n is a, c, g, or t
  misc_feature (261)..(261): n is a, c, g, or t
  misc_feature (442)..(442): n is a, c, g, or t
  misc_feature (460)..(460): n is a, c, g, or t
  misc_feature (464)..(470): n is a, c, g, or t
tgagtacccagcctacaacttgctggcaagataaaaacgatgtgctgcagctccagttcacgggcacctctgcctactatacttacctgctcctgctcctcaagagcgtgctctacttggccatcatcagcttctttctgcttagaagaacagcttcctgtggcaataagaagagatcctaaggaaataaacggtggaccagcaagtccattgatnttcatccttactgtcataaaggtgacttatgggggtccagctgcnttctcttgctggctttgacttctgtaaagtcacatgcacagcattctgttattgtgcaaacatttttctcacatttgtaagcaatttcagcaacttctctctaactgagctcaccttcctgattccatcctctccagcagtcccctcccccagaagcccaaagtatcaaagctctggtacncataggctgcaggatttncccnnnnnnnttgttgctcttgaaccagtcaactctctgaaagcctccgctctagacaacctgaagagccttctttattgttggattctg

SEQ ID NO: 9263 - DNA, 587 bp, Rattus norvegicus
aactcggtgatgtacttcagtcctctggtgccggtgtttcagaaagtgaactctattatcaccaagccggtgacgcgagctcccacaccagtgcctcctcctacagggacaccccggcccctacgaccagaagcttgccgacccggggcgagtggctcagtggagggaatgggattgggcttcgcctgcgatatttacatctgggcacccttggccggaatctgcgcggttcttctgctgtccctggtcatcactctcatctgctgccacaggaaccgaaggcgtgtttgcaaatgtcccaggccccttgtcaagcccagaccttcagagaaattcgtgtaaaatggcgccactaggaagccacaactactacatgacttcagagatttctcacaagagaccgggccctcctttttcagagtttcctgctggcttatatattgtcctctgtattgttttaggggtaggatggggacagttcctttttctttatgaattctctttgatacaaaacatacttgtatgcacacaatggggtaaagatcagactgtaacaccagagatagtcccagtttcagggtcagcgt

SEQ ID NO: 9264 - DNA, 481 bp, Rattus norvegicus
  misc_feature (275)..(275): n is a, c, g, or t
  misc_feature (309)..(309): n is a, c, g, or t
  misc_feature (326)..(326): n is a, c, g, or t
  misc_feature (328)..(328): n is a, c, g, or t
tgtggctgcaagtctgtaaccctgggcattctcatatcaaatgtaacatcctccagtttgacagggttgtcattagcatgctcaagtggtcttttctctacttcaagatctagagtcatctctccaggaaaaagaaatagtcgagatgtggctttgagagagagagtttcctatgatccagtaatacttctttcccaggaacacaggatgttccaaaaggatgtgaaatagtccattcaattcaaagggttcaggaagtccctgaaaaccaccanacacaataggccctctccttcctaagtatattanctgtaaggactgctgananacactctcagacgagttgagctgcctgaaacattatccaacctgttgagctgtctgcaagttgtacagagggttccaagtttacagcttttgtgatgttgtgagctctcctgttgcagctgtcttttgagtcattcttgctcctgtgataatc

SEQ ID NO: 9265 - DNA, 251 bp, Rattus norvegicus
  misc_feature (223)..(223): n is a, c, g, or t
aagatcctgattctaggtgacacaagaagtatgatacgggagtttctccaacgacctcagataacttcataagtatcctagaatctttctcctgacagaaaatataattatctacttttcaaggtatattttttattaaggatagttcccatgtttggattgtgtttgtgagtgaaagaaagtaaaattataatgttataacattaacacaatgatcaggtcntacagctttggactggactctaaacaac

SEQ ID NO: 9266 - DNA, 539 bp, Rattus norvegicus
  misc_feature (184)..(184): n is a, c, g, or t
  misc_feature (187)..(187): n is a, c, g, or t
  misc_feature (278)..(278): n is a, c, g, or t
  misc_feature (415)..(415): n is a, c, g, or t
ctgtcatctatctcctagatccaaaccaataacctggaaaggaaaccacacaagaccctgcagaccatgcagaaagctagaatccaattcatgggtggtgcctggggctctcccacagatatagggcctcccgaagctggcctccaccgagatgaaacgttgatgtccagttatggagacaacnttntggcccctaccaaccttcatggccagaaagctgtgacaccagaatgtttcacttcagacagctggaaggattacagaattccaagccctcnttccaaaggtgcaaccaaccttcagagtcactatgatccagggtcagcccacaagtcttcatggctcctgcagagtaaaagtccaagattccatccctgggagctacagattcagagacttccaagctgactggcgnacagagtagcaagacttccttgtgatcagatgagattacagcatcttaggaaccctcggacacccccaaacccatagcatttaatcaacgggatatgaaccaactcctgtaacttcctaatgta

SEQ ID NO: 9267 - DNA, 343 bp, Rattus norvegicus
aacatggagcagaccatcaaggacctgcagcaccggctggacgaggcagagcagatcgccctcaagggtggcaagaagcagctgcagaagctggaggcccgggtccgggagctggagaatgagctggaggctgagcagaagcgcaatgcggagtcggtgaagggcatgaggaagagcgagcggcgcatcaaggagctcacctaccagacagaggaagacaggaagaacctactgcgactgcaggacctggtggacaagctgcagttaaaggtgaaggcctacaagcgccaggctgaggaggcggaggaacaggccaacaccaacctgtccaagttccgcaagg

SEQ ID NO: 9268 - DNA, 422 bp, Rattus norvegicus
  misc_feature (50)..(50): n is a, c, g, or t
  misc_feature (158)..(158): n is a, c, g, or t
  misc_feature (249)..(249): n is a, c, g, or t
  misc_feature (393)..(393): n is a, c, g, or t
taggagatccgcactggccaaggaagagaaccaagagccgcctccccttnttcctcccagctcttgagcagctgctgttgaagagcaattcagaggacccatctgttccgaaggcatctctttggagcagaaggcatagtcctggttcatcccagggntgatggagagccagtcgaggttatacaggactattgagaagaaagcatttccagtccacagcacctcttcctaaggggaaggtgtgtgctnttgctgacctggaacccagagtgactgtcactcctgtgccagaagcagctccttcagatgagctacttggaaacactggagagcaagaagggccacacaccacaccagccttttccactctgcagaagtggctggtcacaaggntagtgagtgcttcgtatatggtgtttgtt

SEQ ID NO: 9269 - DNA, 414 bp, Rattus norvegicus
aactgacaggtctggcatacacctaaggggcgtctccccatcaggctgacagcagtgattttacccatggcaggcttgcttccaattataacgccctgccctctgaggtttcttcaaatcgtcttgcttattctaagctcgtttaattcccttctacaggacaggctttgactcatgccaagcctgaagtgtcaaagagcagatacagaatgtgcatgaggaattgttcttagtttgatatttaaagcccttaattgcctggggctggggttcaaatctgtgtagatagctgggttgacccttatgtatttgtagaccaaactgtgtgggcttgtgtttgagggtctcctgttgggtttcttaaaaacaagctggctgatttatctcctgttgcctttgttgttacttctgtga

SEQ ID NO: 9270 - DNA, 484 bp, Rattus norvegicus
gaagatgaggtcatgcctccgcaggccctgagcgagcagaccgatgaagcgggggcggcacttagctccctctctgaggtgcctccctggactggggaagtcaacccgtctcagagagatggaggtgctctcgggcgcggcccctgggacccctccgatagatctgccctcttgaaaagcaaactgagggctctgctcgctggccctcggagcctgcgaaggtcaagctgcttcgggggtaggattgacaggattggagcccagagcggactaggctgcaacagcttccggtaccgaagataacagccaaatctgctcgagcagatcgcaaaagatcccaagcccttgcggtgtgtcacacagcttggtcgcattgccactgagaggtggtgaataccctcctggagctgcagcttcctgtcttcatctatcacgatcgatgttaagtgtagatgagtggtttagtgaggccttacctctccca

SEQ ID NO: 9271 - DNA, 444 bp, Rattus norvegicus
  misc_feature (37)..(38): n is a, c, g, or t
  misc_feature (372)..(372): n is a, c, g, or t
  misc_feature (404)..(404): n is a, c, g, or t
gtagtgctagagattcccaagatcaaagagattgctnnaaagcataagaaaacaatagctcaggttctgattcgattccatgtccaaaggaacgtggcagtgatccccaagtctgtgacactctcacacataaaggagaacattcaggtctttgacttccagttgagtgaggaggacatggccgccattctcagcctcaacaggaactggagggcctgtggcctgtttgtcacaagcgatgaagaggactttcctttccacgaggaatactgatgttggttcgcttgatgagattcaagccgggtagattcctttgtccttgtgtgagactcactcctcctgaagcagattttagccacgtctctctaaaancaacctggatgtaggctaccatttggccatgnaggatttaaatttttgtgttcatcaaggtgcagactctca

SEQ ID NO: 9272 - DNA, 381 bp, Rattus norvegicus
aggctctaccctgttggtagctttgtagagagaatcgtacactcagacctggtgcttcagaactatcatgtccctgctgggacattcgtcataatttatctgtactccatgggccgaaaccctgcagtgttcccaaggcctgagcgctacatgcctcagcgctggctggagaggaaaaggagtttccagcatctggccttcggctttggggtgcgccagtgcctggggcggcgcctggcagaggtggagatgctgctcctgcttcaccatatgctgaaaaccttccaagtggagacactgagacaagaggatatgcagatggtttttcgctttcttttgatgcccagctctagtcctttccttactttccggcctgtgagc

SEQ ID NO: 9273 - DNA, 419 bp, Rattus norvegicus
ttttgagctggctcggaacccagatgttcagcaggccctgcggcaggagagcctagcagctgaggccagcatcgttgctaatccccagaaggccatgtcagacctgcccttgctgcgggctgcccttaaagagaccttgaggctctaccctgttggtagctttgtagagagaatcgtacactcagacctggtgcttcagaactatcatgtccctgctgggacattcgtcataatttatctgtactccatgggccgaaaccctgcagtgttcccaaggcctgagcgctacatgcctcagcgctggctggagaggaaaaggagtttccagcatctggccttcggctttggggtgcgccagtgcctggggcggcgcctggcagaggtggagatgctgctcctgcttcaccatatgctgaaaa

SEQ ID NO: 9274 - DNA, 408 bp, Rattus norvegicus
  misc_feature (274)..(274): n is a, c, g, or t
tgcacttgctaaggactgggtggttgtggtatcagagatgcaggcaggaggacctgctggaacccagatactgtgtgaagtccccacagggacagtggtcttccatgaggtcaaggtgtttcctgacttctgccagtgcatgctgcttgggcaaaggtaattctcttgacttgtgaaagtggcccagatcataagattttttcaggtctcctttcagctgcaagtcggtagggcgaaaagttttggccaagaacaaccacttcacagggtctcntgtgctcagcactaaagcacaaatctactggagatgtgtgtgccaagttccaaggtcttagacctttgagtgtgaggcagtatagagtcggggcctttaatgatataattcgtgtgaaatgagattactgggtt

SEQ ID NO: 9275 - DNA, 334 bp, Rattus norvegicus
ctgcccagcctgagtcacaagaagaaaccgaggtcacagcagaagcagcatcaccccaaggctgatctgcaaaattctatagttgcttttttatttttagtaaccttagccctcctttctagaatattttaatataccttaaagaatttggctttactaatagatatttgattgagatttgatattctacatgtcttaatagttttctaccctttaaaatcagtctgtgttaagaccttaatcagtgttaagtttggatttaagttttacattctagaaattgagttatctatgcaacctatgtcactttgattttgctctgcctttctcttac

SEQ ID NO: 9276 - DNA, 445 bp, Rattus norvegicus
aagtatgtcctggtcaacacgtccacaggcttggtgcaggaccagacactatggtcggatcccatccggaccaaccggccctctccctacttggccatcgacacgtggccgggccgtcggagcggaggcatgattgtcattacatccattctgggctccttgcccttcttcctgcttgtgggtttcgctggagccatcatcctcagctttgtggacatgggcagttctgatggagaaacaacacacgactcgcagatcacccaggaggctgtccccaagaccctgggggcctctgaaccttcctactcatctgtgaaccgggccccacccctagacagagcggaggtgttctccagcaagctccaagactgaaatgatccttggccccaagccatcagccctgacctgtggttggcagcaatgcatttatgctctgactgggcca

SEQ ID NO: 9277 - DNA, 392 bp, Rattus norvegicus
  misc_feature (31)..(37): n is a, c, g, or t
  misc_feature (41)..(43): n is a, c, g, or t
  misc_feature (45)..(48): n is a, c, g, or t
  misc_feature (50)..(52): n is a, c, g, or t
  misc_feature (54)..(54): n is a, c, g, or t
  misc_feature (56)..(56): n is a, c, g, or t
  misc_feature (58)..(63): n is a, c, g, or t
  misc_feature (65)..(68): n is a, c, g, or t
  misc_feature (71)..(71): n is a, c, g, or t
  misc_feature (73)..(75): n is a, c, g, or t
ggttattaccacagtcagggctgttatgagnnnnnnnctgnnncnnnngnnngncncnnnnnngnnnntgncnnntttggatactgttacgctccaggacgacccttggttttcatttaacggagtgttcagacgtcctctcatgtcctgtggggtgatgtgcatttagcaacccccgtctctgttcacggagagcttgtaaaccttggcagcattccccatgcccattttacatcagctcagtctttgccctcaaggtttcaacctgaaacagttctcaaaccctggtatcagtgatttatggggacttgtgtttgctgtcacaatagtttgcttgcactaacgatcccgaaggaagtcctgacaagtcaccatttgtttgcttatccata

SEQ ID NO: 9278 - DNA, 473 bp, Rattus norvegicus
  misc_feature (78)..(78): n is a, c, g, or t
  misc_feature (83)..(83): n is a, c, g, or t
  misc_feature (120)..(120): n is a, c, g, or t
gaaacagctttctgaacttcgccttttccgggttgcgaggttgaggtgggcggaaaaacaagatacttggaagctgcnagganaggccagggcacaaggccttcttcacaaagccatttntgcgctgtctcccgcagcaggctcgctttgccttccctgtgtcccctgctttggtgcaatgtgagatatatgacccaaatcctactagccgtgactgagagcctggaagcaatctgttgccctccctcaattccaaatgcatcaggaattattcccaattctagtactcgaacccgcctgccccgcgtgacagtgtcttcacgcctactttccttggatgtctccagctctctccgctccgcggctcccgaagcaccttacactttgtaccagcgcctctgaacctgaggtccacccgccaaacaacctcggcggcggccagacttgcgattgcgctcattcgtaggatttta

SEQ ID NO: 9279 - DNA, 334 bp, Rattus norvegicus
  misc_feature (277)..(277): n is a, c, g, or t
  misc_feature (289)..(290): n is a, c, g, or t
aaagtgcaaacatttcgtcccaaagtctgagtactttagtgcagtgaaatgttgtttcatgtcctgtcaagaattcgtatagtacgagcctggatctacgtgtcaaactgttccatttgtttatgtaaagtgatattaaaaagatataaactatagctgtccattgcttttggcaaaatatacaaccacacaatgtatataattcctagtttccatatttatccgcatgtaaagggtctggtttatccatgttacagctattcaatatttatggctngaaaaaaaaaanntcgtatgtacactttagtttccagaactgtttggtaacctttcg

SEQ ID NO: 9280 - DNA, 315 bp, Rattus norvegicus
  misc_feature (47)..(47): n is a, c, g, or t
  misc_feature (83)..(83): n is a, c, g, or t
  misc_feature (98)..(98): n is a, c, g, or t
atgctggaggcctttgcgattttacaagaactctcactggcattganctgcttatattgagattagacatttctttttaaccntgctgtgttcttttncctcaataaaatgtggcattatatacacataaataatacatagtttataaattatgtatgcatatgtacatagctttagttatgctgcaatactgttgctatttcccactaaattcacctttaagaagatgatgcttgacataacaccaggaggttctaggaaggtcactcaatgtactatgactgtatattctgattcggattaccattgtgtgtt

SEQ ID NO: 9281 - DNA, 529 bp, Rattus norvegicus
agtcattctctctcaagtgtctttctggattaataaggagtcggtcccagcaagaaccgtctttggaatcaccacggttttaaccatgaccaccttaagcatcagtgctcggcactctctacccaaagtgtcctatgcaaccgccatggattggttcatagctgtatgctttgcgtttgtcttttctgctctcattgaattcgcagctgtcaactacttcaccaatctccagtcccagaaagccgaaaggcaggcacagactgcagccaagcccccggtagcaaagtcaaaaacaactgaatcactggaagctgagattgttgtgcactctgactccaagtaccatctgaagaagagaatcagctctctgactttgccaatcgttccatcttctgaggccagcaaagtcctcagtagaacgcccatcttaccatcaacgccggtcactcccccattgctcttaccagccattggcggcaccagcaaaatagatcaatattctcgaattctcttcccagtagcatttgca

SEQ ID NO: 9282 - DNA, 435 bp, Rattus norvegicus
  misc_feature (116)..(116): n is a, c, g, or t
  misc_feature (169)..(169): n is a, c, g, or t
  misc_feature (231)..(231): n is a, c, g, or t
  misc_feature (358)..(358): n is a, c, g, or t
  misc_feature (395)..(395): n is a, c, g, or t
  misc_feature (406)..(406): n is a, c, g, or t
aacagaaacgtaatgctgaggccgttaaagggttaaggaagcacgaaagaagagtaaaggaacttacctaccagaccgaggaggaccgcaagaacgtgctgaggctgcaggacctngtggataaattacaggcgaaggtgaaatcttacaagagacaagcagaggaggntgaggaacaatccaacgtcaacctggccaagttccgcaagctgcagcacgagctggaggaanccgaggagcgggcagacatcgccgagtcccaggtcaacaagctgcgggtgaagagccgcgaggttcacaccaaaatcagtgcagagtaaacgcatcttgaggaggccgccaagtggctgaaggaaangcacagaatgtgctgccttgggtcgcttgctgggtcncttgcctctcngtgtttacttttctcccactgctgactga

SEQ ID NO: 9283 - DNA, 159 bp, Rattus norvegicus
gtgtcattggttgattttctggctatgtgaacatcgtagtataccctacgtgaaagaaccctgaggttgtaggagcaaaacttcaggaggcctctaagtgccctcaagacacgtagtagacacaagttgcatgaggcttctgcgtgacaggctttcaga

SEQ ID NO: 9284 - DNA, 296 bp, Rattus norvegicus
aactaaggagtactggctatgaacttatggtgctaagatttttgccaatggaaaaaaaatttgaattctatcattttgttttagcatgtaatgtaattggtgaaattacataattataaaattagtacaagcaacaaggtataatattatcttttaaagaatgtctgtaataagactaattttttcactcaaaatataatgaatacatgtattttttaagtgcagctgagaacttttggaatggaacaattctttaaattttgtgctacttgatctgtgtatgtttgtattgtttt

SEQ ID NO: 9285 - DNA, 288 bp, Rattus norvegicus
attacaattacctatctgagaagacttgttttattatttttaagtagctttactgaattatatttaaattttaagaaactttgctaagcagtatttagaatctactcagggcagttaaaatagtaaactgctggacagaaaacaagtacaatgtagcagcttgactttatgttagtgtatgaaacattattgtcctataaaagtaattttaatctatttaatatttcttatttacattacatgacaaaagccatcaaatgaatgaataactctacatttgcctaacta

SEQ ID NO: 9286 - DNA, 564 bp, Rattus norvegicus
gacaactttgtagggtcggttctgaccttttgtttttatggggcatctggggattgaactcagctggcttttgtgacaagtacttcacccgctgcaccaccttaccggcccttttatttattatgtatgtggtcatgttcacacacatgtatttaacctatagaatgcttactgtgcgtcgggcgctgctccaactgctgtataaatattaaggtattcagttactcctactggaaggtattatgtaaccatttctctcttacatcggaggacaccaccgagctatccactcatcaaacatttattgtgagcatccctagggagccaggctctctactgggcattagggacagaggaatttattggatgttggttcttccttcaagaatcgctcagggattctcagtgtcctcaaaacatgctgaaaccggaccccagactccactctggagaatccaacccactcacaggggaaacagcccgtttaaagtgcatgtgtgctagagaggtagggtagccgagatgatccctcagtggaaggataaccaagtatcttcctcggac

SEQ ID NO: 9287 - DNA, 529 bp, Rattus norvegicus
  misc_feature (432)..(432): n is a, c, g, or t
ttttatgttgggtcattactcgagactgtgcacactgatagaggacacagagatggagaaattctctttttattaaatattttaggtgtttaaaaggccacaatgtggaaaatcaaaattgttataaggtacctaagcaatagcatagtttttcataaattatttgactatttgcaaataaaacaagtgtttcaaccctgtttacctacccacttattttaatgacccatagattcttttctagtgacttgtgtgacaggagctaaggcagacatagtaagtagatctgttaagacacagacagcaagaataaagactgtgcgaactggacagtcacccttttgagaccaccctttcatgctcctccatgttcattagccccttccctgctttccttagtgactgacacttggtgcttactgatgtgtgaanaactattttgtcaagagatggtgtttattaaactgggacaaggaaaaagaagtgtgttttttaataatgtgttacactgtgcttatgttgtttctaa

SEQ ID NO: 9288 - DNA, 312 bp, Rattus norvegicus
  misc_feature (123)..(123): n is a, c, g, or t
cattgcgaacccaaaggacccaaatactttctaaccgcagtcactctaggatctgcactgaatggctgacctgacctgatattcaactatcctaacctcacagtccggaccattctccccttnctaagagacctgaactgggcagactgcaaaataaaatctcgaagttctatttatttattgtcttcctgtaagacctttgggtcaaggcggagacaggaactatctggtgtgagtcagacgccccccgagtgactgttcccagcccagccagaagacccctacaggtgctgggcacaggaactgtatgtc

SEQ ID NO: 9289 - DNA, 348 bp, Rattus norvegicus
  misc_feature (297)..(297): n is a, c, g, or t
gtttcaaaagtcatatttgctcaagacaatcaattcctctctttttttccactaaggtatttttctttaacataccttggagtagcaataaaattttaaaatcaccaactgaattttgtatctattttaagtaatatatgtaagacttgaaaataaatgttttattataatttcttatatgaagtgttaaattaattgataccagataccactggaacatttatcaactgataatttatctcaaagaacataatctgtaatcttgacatttaaaagtgaacatttgtaattcggaanttctttatttctgaaaccaagtttgtaaatgtcctttggaggaaggagata

SEQ ID NO: 9290 - DNA, 513 bp, Rattus norvegicus
  misc_feature (313)..(313): n is a, c, g, or t
aaatgacactgtccaccttaggatatttctgatggtgcatcactccatggttcacacaaccccttacatcgagataaagtcagatgcacggatagatttttttgaagtgctcctaagaaactaaaacactgtagtgaagttaatttcaattacaaggtgctttaccacagccatttcgagcttttctgcaacggcaggaagtccacgtacctggggcaacttagaaaaagtccacatacctggtgcaacttagaaacaggtgtctgacttactcttatgtcagcaacgcagtattactatggtataatttctngcatctttgtcaaatgattttaatgggcttatacgacatcagaatagacactctgtgtgccttctattccactggaagtataaattaacattaagcttttcaaagtcagactgaaaacgaaaagacattatttatttatgctctgtactgtatttttaccgttactgtttaaaactgggaagctgtacctcacttactaa

SEQ ID NO: 9291 - DNA, 357 bp, Rattus norvegicus
aggtgcaaagcccagcgactctgagtctgacaaagccttcatgtccaagcaggagggcagtaaggtggtgaatagactccggcgctacctcaacaatggacttggagccccagccccctacccagatcccctggagcctcacagggaggtgtgtgagctcaaccccaattgtgacgagctagcggaccacattggcttccaggacgcctacaagcgcatctatggcaccaccgtttagggcatgtgttgccctggagcccaacggcagcttcagctttggctactctccaggactcgaccctccctgttccctctctctgcctcgaaagtatggacggcacagctgctccaaaataa

SEQ ID NO: 9292 - DNA, 544 bp, Rattus norvegicus
  misc_feature (38)..(38): n is a, c, g, or t
  misc_feature (50)..(50): n is a, c, g, or t
  misc_feature (108)..(108): n is a, c, g, or t
  misc_feature (113)..(114): n is a, c, g, or t
  misc_feature (177)..(177): n is a, c, g, or t
  misc_feature (240)..(241): n is a, c, g, or t
  misc_feature (286)..(286): n is a, c, g, or t
  misc_feature (461)..(461): n is a, c, g, or t
  misc_feature (465)..(465): n is a, c, g, or t
gtgctgtgtacaccattgctaaccaccctaacataccntgtacaagaagnctcctaacgagagatttattaacaacactgtatacgatgtgtgtagttcctttatcanacccnntacctaatactgtattaggtttgattttcatcctcatgtattttacgtgacttgtgcacatgngtttttatcataaataaatatgcaatcattcacgtgtgttataattaaaaagaaagggagagnnttggaatgagtgtgggtctcaaggagcagggaacaatttggctanaaagcaaacgcttatctccatcagggtttaaaactcagaggatccggaaacactctttattcagtacatctgaacggctaaggttcgactacggagggcagaatcatctgtatacaggagggagtaaatgaccccttttagagttgccagatttaccaaacatgaatacacggtntganacgcccacctcagcttgaattccagatgaacaatggctggtttttaatacaacccctcccctacagataatttgtctct

SEQ ID NO: 9293 - DNA, 419 bp, Rattus norvegicus
  misc_feature (30)..(30): n is a, c, g, or t
aacttccccttgtcctggatgactttagcntggaagcgctgctgaccgtattccaactccagaagatctgccgcagccgggcctttcaacactgggagataattcaggaggatatcctcgatcatggcaatgagaaaactgagaaggaagaagtgataaagagaaaaatcccttatattctgaaacggcagctctatgagaataaacccagaaggccctacatactcaagagggcctcctactactactgagaagttaattcttgacatgtgattctcatcctttacctgttatctggatacacatgatgcttatctagatatataattatatgtgtgtatgaatgtatgccagaacttgattattttaccttttccacaattgtgctttcttggatgggattttcctgcattcatgca

SEQ ID NO: 9294 - DNA, 448 bp, Rattus norvegicus
  misc_feature (75)..(75): n is a, c, g, or t
ggccttcaccggcaaatacgaatttgaaagtgagaagaattacgacgagttcatgaagcgcctgggtcttccagnagatgtgattgaaaggggacgtaacttcaagatcatcacagaggtccagcaggatggagagaacttcacctggtcccagtcttactctgggggcaacatcatgagcaacaagttcaccattggcaaagaatgtgaaatgcagaccatggggggcaagaagttcaaggcaaccgtgaagatggagggtggcaaggtggtggcagacttccccaactatcaccagacttcggaggtcgtgggtgacaagttggtggagatctccaccatcggggatgtgacctacgagcgtgtaagcaagagggtggcttgagccaccaggctgggctctgagggactgcaacccatcaataaaagtgcaccatggatcaccact

SEQ ID NO: 9295 - DNA, 345 bp, Rattus norvegicus
  misc_feature (158)..(158): n is a, c, g, or t
  misc_feature (177)..(177): n is a, c, g, or t
  misc_feature (213)..(213): n is a, c, g, or t
  misc_feature (217)..(217): n is a, c, g, or t
  misc_feature (222)..(222): n is a, c, g, or t
  misc_feature (225)..(225): n is a, c, g, or t
  misc_feature (227)..(227): n is a, c, g, or t
gaatagccttttgtaaccgtatcatgttccagcaaaaggttaagtgtaggctagaatagtaaaatggcaaccctagaaatggaaatggtgtatagaaaagtacacaggaagttcctggttttgacaatgacaaagaaagtgcctggagagatggctcntgcttttaagggtaccagntgccctcccagaggactgaagttcaatccacaggancccncatanacngntcataactttctaactttaggcacagaggagccaatatcctcttctggattctgaaggcattgcacacatgtggtgtacagatagacatgtaggcacccatgcacatttacaaaacaa

SEQ ID NO: 9296 - DNA, 456 bp, Rattus norvegicus
  misc_feature (60)..(60): n is a, c, g, or t
  misc_feature (63)..(63): n is a, c, g, or t
  misc_feature (65)..(67): n is a, c, g, or t
  misc_feature (71)..(76): n is a, c, g, or t
  misc_feature (78)..(81): n is a, c, g, or t
  misc_feature (83)..(87): n is a, c, g, or t
  misc_feature (89)..(92): n is a, c, g, or t
  misc_feature (94)..(102): n is a, c, g, or t
gcaacatggcccagacaggtgtcttcctccgcagccctgggtacctcacctctgccccgnagncnnncctnnnnnncnnnntnnnnntnnnntnnnnnnnnntgtgctgcggtacagaagccagcagcggcaactcaaccctgagtacacaccacccagaccccgggaccctcgagcagtgtgctaatgtcgacttctgcccactagcctccctgtgttgccgagcttctgtggacgagtatggctggatcgctgcggcggttggctggagtttctggttcctcaccctcatcctgctgtgcgtggacaaactgatgaagttaactccagaggagcccaaagacctggcagcatgagcagagctttggctcccaaggatggctatttctaccatatgtggatagcgggaaggggcgggggatgcttctagaagccgggcttctgtcactttaaagt

SEQ ID NO: 9297 - DNA, 532 bp, Rattus norvegicus
gttgccttaaccctactgaagcatgatgatctgcaaggtcctggtgatcactgtcttctgtgtgctgactgtggctttccccagtttggacatagattcaatcaatgaagaactacaggattcaatctttgatatactaaactcaacctctgacttccaactggcatcatatgaaccatcaacatctcctccagaggatagcacataccaggaatcaaacactgacttcatgcaaaccacatattccaaaagcatacagatttctgagctctctaatggagctgagacagtctcttccagcttcctggaagaagtcactgagacttcagaaagcacagtggagtttccattagctgagacaactacattctcctctacctcctgagaagactttgaaacaagcctgtgactaccattctggatattgagtctttgtagaaaatcatgtaagtctaagatgctcccagcaaagaagaaagaacaaggaagtggtcctggatgagaaatgctgtgtcaggcacttatgagctct

SEQ ID NO: 9298 - DNA, 477 bp, Rattus norvegicus
taaaggccccgagtgcaccaacaagctgcagtaccttttaatactatcaggatttctcagtatcctctactcattcgcagccatacctggatacatggtttttctgaggtgtatcaagtctgaagagaagtcacttgggattggaatacatgcattttgcataagagtatttgctggcattccagcacctatttactttggagctttgatagacagaacctgtttacactggggaactcagaaatgtggtgcgccaggggcgtgcaggatgtatgatataaatagcttcaggcgcatttaccttgggatgtctgcagctctaagaggatcaagctatctccctgcatttgttattgtaatacttacaaggaagttctctcttcctgggaaaatcaactcttcagaaatggaaattgcagagatgaagctcacagagaaggaaagccagtgcacagatgtgcacagaaatcctaagtt

SEQ ID NO: 9299 - DNA, 537 bp, Rattus norvegicus
  misc_feature (237)..(237): n is a, c, g, or t
cagtgagactcccaaggctcttgctctgtctttcccaatccttttcttatgactccttagtcttcctatagcaatatgaaattattcatgtagaggcatgtatgtgatttaggtctttgcttggttattgacacagaacaatgacacgtttcatgctaaaagaagaaagaaagagggaataagaggtttgaagtcagaaaaggctaaaacagcaagggaaagaaattgccaattcangtggtcaggaaggggtagagagaaggggaaagcagaatgaggagagagagagatgagaaggaactggagagaaatagaaaaagggttgtgtagaaggacactagtgtcttcgccaagttgtgtcaatccttagggacatcatgcccaaaggagaaggaaataccacttacagagcatgcccaaggcactgttatacacttgtcatgagtcctatacaggtcatgagccatcttacttcatctgggtgacatctgcaggctcatcttctgcaccccaaaatgtaccacttcctgtagctca

SEQ ID NO: 9300 - DNA, 392 bp, Rattus norvegicus
gagaggctatgacaaccctaactttgtcttgtcagaagttgatgaaacggacgacacccagatgtagcagtggcttttccacctacaaaaagcctcccaaggacctaagggttgactgtgttcagaagcatctgacgggggtctgaaagcaggatgagaacatgcgaaatctgctagcacagtcacccctgaaccccagggctatggttctacaagacacatagctctctaaggctgcatacggtgcatgcatgtgaatgaaactgtggaagccaaaggggcccacttggatcctcactatgactgtgtaagctcatatcgtgttgatggaaacaaagtcattcaaggacaaaacttaggagctttagaaagcttcaggaactagccacatt

SEQ ID NO: 9301 - DNA, 552 bp, Rattus norvegicus
gacatcaactctccagtaactgatcatgtggagatgatgctcacagagaaggaaagcgagcacacagatgtgcacagaagtcctcaggtcgagaatgatggagaactgaaaacgaagctgtaatgagttttctactgccctgttcaaggccatgaacagaatgcacacttcccttcctcggaatcccgagagatacaataggaaccttctctttaaggacctcaatgattatttttctcactataaaaataattgctgatatcactttcagaacttcagggtgatatttaagatttccccgggaaagacttttatggtgacccccacactacactttaaagcttccttcattttcacataacattttctcttaactcaatcaagggaagtatgtgtttcccacacagcttcaaatgagtttaaaactttcctattccagaaacactatttaatttcactgaatttaaatttccatactgggggtaattagaactgaaaatatgccccctggttgtgtcatactgaaataaattgttcaaattcattctttct

SEQ ID NO: 9302 - DNA, 440 bp, Rattus norvegicus
  misc_feature (183)..(183): n is a, c, g, or t
taggctgcaggtccagactattgcctggaggcgagggacgggatttttacagagcccacagtagaaaggcacagcatgtttgtgagtgtgtgtgcatgcatgtagatgcatgtcacttgaggtacatgattttgtgccacccttgggtacctgtccctactcagggccacagcggggtgggcntttttttgcaattaagaagcagtgtgcacaaattacatgctaggtcctgagcctttgtggccatcaggacaggagtatgcgagtgcatggtgtgggtacaggggatgcagatgcatgaggagcccccaaaattttctgggaagagtcggctatgccctctcaccttctcactacccttgtcccaacaggagaggcagaagagcagctggccttctgtatacatgagcctttcctctgccaattctgctaactgtgca

SEQ ID NO: 9303 - DNA, 421 bp, Rattus norvegicus
tcgtcggttcccagtgcagagtagctgctccagcgagtgcagtgagcctcaagaaggggctcgcccgggagcctgacagtacctccgcccggaagccttgagctaccctcgagctcgccccttgcagggaaccagacacttggggaccgaggcgtggggagggaaggcaggccggcgagagacggagagctctggagagcccgctctggtgcctggggagaagtgcatagactcccttctgggggactgtgcttagtgcatctcattttattaggttgtaaaagtgctcgtctccgcgtatttcttttcctcacgaacagagtttgcatgatcctgagcgtgatcccgagtgcctgtggtgatacagagccggggactgtcattcccgctttggccttcttctcctgtacctgcaataaat

SEQ ID NO: 9304 - DNA, 546 bp, Rattus norvegicus
agagaatggcgagtcctctcaggcccggttctctattcagatgttccggtttgcaggaaactccgaccttgtctaccttcactgcgaggtgtacctgtgtgacactatgagtgagcagtgtaaacctacctgttctggtactagatatcgaagtgggaacttcatagatcagacccgtgtcctgaacttgggtcccatcacacgacaaggtgtccaggcctcagtgtccaaggctgcttccagcaacttggggttcctgagcatctggctgctgctgtttctctcagctactttgaccctgatggttcattgatggaaaacagaaaacctggtgtggctcccagttcacttcctgctggccaggagtggggatgcaggctggtaagcagccaggagagagggagctcacactgcctccagcttgcacttacccttttcctttaaccctcaccatcaaaaccgagttgatatctttcaatgctgctgattcttcaactggaacttgtaatgtgtctgtacatgaagcccctgtctctttaaggaatg

SEQ ID NO: 9305 - DNA, 483 bp, Rattus norvegicus
acaggcctgggcatgggcagcaccatggcccgggtgggcagcattgtgagcccgctggtgagcatgactgcagagttctacccctccatgcctctcttcatcttcggcgctgtccctgtggtcgccagtgctgtcactgccctgctgccagagaccttgggccagccgctgccagatacagtgcaggacctgaagagcaggagcagaggaaagcagaatcaacagcagcaggaacagcagaagcagatgatgccgctccaggcctcaacacaagagaagaatggactttgagaacggaagggcttcacacagcactaaagggagtggggttctacaggtcctgccgtctacatgaggagggggagtgagtagagggactggaccatccaaatgtggaggctgccattcagagaaatccctccccaaaggtcatgtcagtagacccactaggaacaaaagctctgactatgtgcagcttcttaa

SEQ ID NO: 9306 - DNA, 574 bp, Rattus norvegicus
  misc_feature (49)..(50): n is a, c, g, or t
  misc_feature (52)..(56): n is a, c, g, or t
  misc_feature (58)..(60): n is a, c, g, or t
  misc_feature (63)..(63): n is a, c, g, or t
  misc_feature (67)..(68): n is a, c, g, or t
  misc_feature (70)..(70): n is a, c, g, or t
  misc_feature (74)..(75): n is a, c, g, or t
  misc_feature (77)..(78): n is a, c, g, or t
  misc_feature (81)..(82): n is a, c, g, or t
  misc_feature (84)..(84): n is a, c, g, or t
  misc_feature (86)..(96): n is a, c, g, or t
  misc_feature (99)..(100): n is a, c, g, or t
  misc_feature (102)..(102): n is a, c, g, or t
tgttgttggagacactttccccgtgggctgccgtccccaggcctccgtnntnnnnngnnnctntacnntncagnncnntcnngncnnnnnnnnnnntcnntncagcacagaacttggcatgtaccagccccactgtggacttgagaatgtccttatgtcctggggccatgatgagtacctataccagatgatgaagttcaacaagttctccctaccttcagaggccttctacatggtccgattccattccttctatccgtggcacaccggcggtgactaccggcagctgtgcagtcagcaagacctggatatgctgccttgggtgcaagagttcaacaagtttgacctctataccaagtgccctgacctaccggaagtgaagagcctgcggccctactatcaggggctgattgacaagtactgcccgggcatcctgagctggtgaatggtttctaataccttctctctcactgctgaggggcaccaaggctggacaacttcagggacaataatagcccatgccacctggccacagtccccacccatcacagttgaggtcacttttgcctggcta

SEQ ID NO: 9307 - DNA, 146 bp, Rattus norvegicus
gtgggcatttacaccaatatttactcatatgtcccatggattgagaaaccccctaaggagaagattaaatgaagccctgcttttccgtccaaatttcaccgtttttgccattggccaaaggagcttacatgttccctaaactcaaa

SEQ ID NO: 9308 - DNA, 273 bp, Rattus norvegicus
atagggaatctatccttgaaggaatctgaaagcttgctaacaaaaaccgatatccatgaacctcaccttctccaaaacccaaaagtaaaggaaaatttgtctgagaataaggagtaaattctgcctccagtgatttgatttcttcatagaacgaggcaacagcgtgttttgagggtttatagacttcgtttatcttggtgtgtatgttgtttttttctttatagaatctgagactttgctttatgtgtgtgaattctgggatctatttactct

SEQ ID NO: 9309 - DNA, 291 bp, Rattus norvegicus
gagtgtatcaacatccatgtctagttcttactgcagccaaagcgtagaagcagctgaagactggttttctgataattctcttgaagccaagaacccctcaaagcctttgctcggggagcctctagccgagaaggtgcttgcatacctgtcatccatttcattagaagaatggcctggaaactcagcgaacacaacattttgtagtgcagaaaaagctgagagcgttaaggaaatgtttgtacaaaaaaacacagaggttagcaaacacaaccttcagtttgacattgaatg

SEQ ID NO: 9310 - DNA, 244 bp, Rattus norvegicus
  misc_feature (158)..(158): n is a, c, g, or t
tctagattctctgccagcatcggaatgtgcaagccggaacgtggagtcacctcaggtgacactgaaacacatgagccagagctgcagtcccatgggtgtgagcagcatggtcctccaggtgctgggcttcctggtggacaccgccacaggcaataagntagagacccccacacagacaagacacacagagagacagagacacagatacatacaaggggagaaagacagagacatacagagggat

SEQ ID NO: 9311 - DNA, 326 bp, Rattus norvegicus
  misc_feature (75)..(75): n is a, c, g, or t
aactgatccttacgctggtgcacaatctaagcacttgtaaccaccttcgctgtgaccttgctgccaagctcctgntaatgatctgtgtggagcctggcttcaggaaggagcaggtagctgagctcttgcaaggtctgttccaggagctgccaaacatccacctcaaaaatgtgcagcagaccataagtcaggccacgttggctctggggatccagcatatccaggaggtggtggaggtgatcttatccctatgtcagccctcagagaggtggatcctaccactgtggaaggctctggccgccaactaccacgtggctcgtgaagtt

SEQ ID NO: 9312 - DNA, 315 bp, Rattus norvegicus
tatcaagtccctagatggctccgtggatgagaagaaactgcgcgagctgacacatcgctatctgactctgacggcaaggctggagaagctgggctacagccgcgaagtgcacccagtgttcagcgagtttctcatcaacacctacggcatcctgaagcagcgtccagacttgcgggccaacccactgcacagcagtccggccgccctgcgcaagcttgtcattgacattgtgccgcccaagttcctgggtgactccctgctactgctgaattgcctgtgtgagctctccaaggaggacagcaaaccactcttcgc

SEQ ID NO: 9313 - DNA, 373 bp, Rattus norvegicus
gatgtgagactgaccaaggctctacaaatgtttctgcttacagctcagaactgcacaattctctgacatcagaaatacagttcctgaggaagcagaatgaggccctcagtacgatgctcgagaaggggtccaaagaaaaacagaaagagaatgaaaaattgcgtgagtccctggccaggaagactgagagtcttgagcaccttcagctagagtatgccagtgtaagggaagaaaatgaaagactgcggagagacatcagtgagaaggagagacaaaaccagcagttgactcaggaggtctgcagcagcctccaagagctgagcagggtacaggaagaggcaaagtcaagacagcagctgctcttacagaaaga

SEQ ID NO: 9314 - DNA, 399 bp, Rattus norvegicus
  misc_feature (223)..(223): n is a, c, g, or t
  misc_feature (311)..(312): n is a, c, g, or t
  misc_feature (350)..(350): n is a, c, g, or t
agaagtcacacttgtcctagacagccctcttgtggaatctggagagagccccaagttaccctgtcacacatcagagctccgagccgtgagtaacaagaaaggagtggtgaggaaaccccagccagtccgcctcagtggagtagattctgtttttggtagggtcatcacagcccagccacccaagtggactggaaccttcagagtttcagacaagtcagccttntgcaaaataatcagcagggagcaccggtggcctactggactcaaggagcctcagatccaaatgacagtgactatgtgcaaacagatgnnacgctcaatcctcctgctgtatgcgacttacaagaagngcacctttgccttgcagcactccaagtgagggtccccatttgacacctg

SEQ ID NO: 9315 - DNA, 526 bp, Rattus norvegicus
  misc_feature (46)..(46): n is a, c, g, or t
  misc_feature (60)..(60): n is a, c, g, or t
  misc_feature (100)..(100): n is a, c, g, or t
  misc_feature (111)..(111): n is a, c, g, or t
  misc_feature (115)..(115): n is a, c, g, or t
  misc_feature (145)..(145): n is a, c, g, or t
  misc_feature (439)..(439): n is a, c, g, or t
  misc_feature (441)..(441): n is a, c, g, or t
gtggctatcaacatgtgagaggcgaggagtcctggaaagggcagcntaacagaagccggnatgaaggttatcagtaccatcgacatgttagaggacgccnttacagggganatangaggaggtcagggatgggagatggccacangggacaacacacttaatggctggttgtcgctcgtactgtagagctctagccttttcttaggtggaatatttctgaaggctttaaaatcattataataaaaacccaaattggaactatctcctcccctccccttttccccttaatttcctattctgatgagactttggacataagtttaaggggcagatgaatttttggcattgtggttttttcttactcagaatctgtttattgggttactgcccccataagaagtaaacatgacttttaagtatttttttataaacagctcantntaaaacatagacagtgtttgatttttttttccttgtgtaagtttgatttaaaacgttggaaatgtgtgctttttagtgtttacta

SEQ ID NO: 9316 - DNA, 381 bp, Rattus norvegicus
aatagggccttggtggctcagctgctggagtgggagaaagccctccacggggaatatctcacggacatctctgagcctatctactaaccttcgcccgtgacccagccatggtctctgaggagtctgggttgggacttttgggggctgggagtctgggtttggagtagtcctggagaagacctttgctgtctggaggttcatatctgcatcttaagactgttctgttgttgttgttgttgttgttgtttcccccaatactgaggattgaacctagagcagtgagtgcttctcaaccttcctaatgctgtggctctttaatacagttcctcatgccatggtgaccttaaccataaagttataccattgctactccataactgt

SEQ ID NO: 9317 - DNA, 450 bp, Rattus norvegicus
agcttggcttttcatcttggatcacagcttcagtcttggcactaggaggacactttctgcccctgccctcagaggccctcctgggattgtctcactagtctgtagtcattcagacttaagctctagaaataattcactattttctcaaacacaaactccagatatcgatttaaaaatggagagcacatttgtcatagttcatgatcacagattgtcccaaccttagccatgggcagcagtgtgtgccttcctgacagtcccatagtcgctctggcaattgtcccacggtttcagtgctgtgcggcactgtgacaacttaatacaacatccccagcactgatattgatgtgggtgggtttgttccatttccttttactggcaatgtgtgtcagctcttctgttaaataggacttctcacgtaaacagttgcttgaatgttgatgtgcctca

SEQ ID NO: 9318 - DNA, 453 bp, Rattus norvegicus
  misc_feature (253)..(253): n is a, c, g, or t
ttgggattcgaaacctttgcaggcatgcgtgcgtgcgtgcgtgcgtgcgtgcgtgcgtgcctgttcctcatattggatggtgaataggcatgcaggagaagtcacgattaaagtggcaaaactgtgtgcaaatacacaagcccctaggggttcttacaggctgatcgctgacaaccagtgggggtgttgccagttgcatcctggactcacaaagcagacatgcactttgctaagaacagactcttgcgtcatntaatggatcaaaatgaaggatggatgatttttgagtcaggagggtgaaagcacctgaatgccctgtaagtgctacctgccttttacctctgcaaaagcactgctttattggaaatgatcatttcctaaaacaaagccggaacagtaggagctttgggttttgtacaaagctaccctgaaagtcagtctagctcatctcct

SEQ ID NO: 9319 - DNA, 482 bp, Rattus norvegicus
  misc_feature (358)..(358): n is a, c, g, or t
  misc_feature (367)..(367): n is a, c, g, or t
aaggcagaacgtctacctggagctagaggcctggaaccacagtccccagggctgggaggacctctgggtctcctgtcttcgtgttctcacctcctcaacattgcctctgcctggtctctgccgccttcctgccttcctactctgtttctgagtaggcatcagttaccaagttggacggtgtccctgacagaccgtagcttgcctcaagtggctaaagggagagctgaccaagaacggagatgaaatttgccccttacctctcccgttctcttcacctcttacaccctttcctatcccggacattgataacttctgccactttcctaaatgggatcctcacaggttccacctccctccnccagccccntgattcccttccacaacacctgcctgggcgtctctcttcccaaggccccttccttgacattttctgggaactctgcctcctgggcttcccatctggactggctgcctgattggct

SEQ ID NO: 9320 - DNA, 481 bp, Rattus norvegicus
agtgaggacactttctaccggacagcaaactcgcagcactttaagggggagcagtggaggcagtggaccgcccagagggcgtttgtggccttgtatgtctctgctcacagaggtcacgtggatgccgtgcagtatcttctagaacttggagcgaactgcctggccaaatcacccctgggcaggacacccctgcacgtggccgcagccatgggcaggacagaatgcatccagcccttactggaacatggcgcctccatccacgacagagacttgaagagcgaaacgcctgtcactatcgcgcggcgcctgaagcgggggaatttcgagcgcaagatgttcattctctactggatgatcaagtctgggaccagggaccctgacttagtatcgagggatgcttcagagaaacacagccctggggtcatggcaaggaagacctcagtgttgatctcctgagtacctttgcccgtcatgtgattct

SEQ ID NO: 9321 - DNA, 380 bp, Rattus norvegicus
  misc_feature (118)..(118): n is a, c, g, or t
  misc_feature (332)..(332): n is a, c, g, or t
gggagggctgtgatcactgcatcttgcggccggccgcgggtgtgggtgggcctccgttgggagccagcgtggacagtgtgtggggaccggtttcccagtcctctccgcacagcagccnccgaggtggtttaactggcgtttggtggcggtcgggtttctcgcagttagatgtcatctcagctagtgtgacatcaccccaaaccagtgtgatccccccccaacaccccaatcacatcccagcgattgggcagcgcagggagacattgactggagatgaccctgagggtgaagaattatctcggtttatactccaactgtttgctgcgatgtcnatttcatggcaacataagaaatttagatgcttccgtatgctcaagcgc

SEQ ID NO: 9322 - DNA, 145 bp, Rattus norvegicus
  misc_feature (37)..(37): n is a, c, g, or t
  misc_feature (57)..(58): n is a, c, g, or t
  misc_feature (89)..(89): n is a, c, g, or t
  misc_feature (110)..(110): n is a, c, g, or t
  misc_feature (113)..(113): n is a, c, g, or t
  misc_feature (120)..(120): n is a, c, g, or t
tggagggcgccctacagaaatggacttcgaagtagtntgaatcacccttccagatgnntactgtaccccgaactcattgaacaggagantgggtttcctgagctgggatnttntgcctcnccgtggactcggaatcagagaagcc

SEQ ID NO: 9323 - DNA, 188 bp, Rattus norvegicus
  misc_feature (46)..(46): n is a, c, g, or t
  misc_feature (48)..(48): n is a, c, g, or t
  misc_feature (57)..(57): n is a, c, g, or t
  misc_feature (120)..(120): n is a, c, g, or t
tgggacttccgatttccaaatccttcccaggctttagcagaagtgncntgtgttgtntggacctcccacggcctccagtgttgattggacttgagattgatccgtagggaaaggactctntgctccgcctttgaaggagtccacactcctcttgcaccaagcaagaagaaaaacttcagagcagccct

SEQ ID NO: 9324 - DNA, 172 bp, Rattus norvegicus
  misc_feature (30)..(30): n is a, c, g, or t
  misc_feature (32)..(32): n is a, c, g, or t
  misc_feature (41)..(41): n is a, c, g, or t
  misc_feature (104)..(104): n is a, c, g, or t
caaatccttcccaggctttagcagaagtgncntgtgttgtntggacctcccacggcctccagtgttgattggacttgagattgatccgtagggaaaggactctntgctccgcctttgaaggagtccacactcctcttgcaccaagcaagaagaaaaacttcagagcagccct

SEQ ID NO: 9325 - DNA, 322 bp, Rattus norvegicus
tggtagcttcaaacctacgtggtcccttcagctggcactgtttccccaaagtgtctacaaactggcagaagagacattgcccgtggtatgcagtgacatgcccactctctgtgctggttgccttaatcagggaaggatggactctgctcttaccctgctcaggacaaggttaggaatggggaaggcgtggttccgctgacgaagcactttggacagttggtggctgctggggagagtcagttttcttcaagagtgcagccccctctccccccagtaggctgactcaaatccagtggttggcccaacccaatatccatgagta

SEQ ID NO: 9326 - DNA, 319 bp, Rattus norvegicus
agaccacatacttctctctggagagtgtgtgtgaaggttttcacccgtgcaagggagactgggtagaggctgaatattggatcaggccagggacatggagcagtgaggccatctctgtgaagcctctgaggtacaagcgtgtggacaaggtttgcatttccagcctgtgtgggaggaatggggtgatagaggacagcatcttcttcagcctggactccttgaagctgccagaagggtacaccccgaggagacatgacatcgtcaatgctgtggttgtggagagcagccagtcatgctacatctggagagcactgtgcat

SEQ ID NO: 9327 - DNA, 294 bp, Rattus norvegicus
agcaggagtcccgtttgtggtgtttggtttcacagctgttgaacccctcagtgctaaggggccgccacggactcgtcagcgcagctttggcctctcccgtgggctcgacgtgcgtgggctcaacgcgccgcagctgtgctctgatcccccacgtcaggcatgtacgccgggctattctcaaaccagtgacttctcattagtgatgctcaaggccagggggatgtggattgacacatctaaggtcctgaaagtaaataactaccaaccaagatctctagatacagcaatgctttc

SEQ ID NO: 9328 - DNA, 175 bp, Rattus norvegicus
aggagatctggtcaacatggaagcagcaaatccatgagaaactgaggcttcaggaggaagagcgccagcacaacatggactgggacctgcgcaggacccggaaggctcatgccagcctgctgcaggagcgacaacagcagcgtttgttgcgggaacagcgcagggccttggactg

SEQ ID NO: 9329 - DNA, 296 bp, Rattus norvegicus
  misc_feature (107)..(107): n is a, c, g, or t
  misc_feature (171)..(171): n is a, c, g, or t
  misc_feature (270)..(270): n is a, c, g, or t
gtcacttgtccagacactaaggcaggagttgctatgaaagcattttttgcctgcgattgaagaccataatctgctgattttagccgagcgagagagccctagagagnccggttggtctgccacaagactgagagtggagctgatgcttcctcaaggaggaaaaagtctgcntgagccccaacacttcagccagtgctgtttgtcctgatgctgctctctgggattttggacctgcctggcttgccccacagccacataaaacattccgtntggtaaatctctgtgtgttactcccc

SEQ ID NO: 9330 - DNA, 160 bp, Rattus norvegicus
gagaagaccagagaacattcttgaatttgctgcatactatttcacagatccaagacttcccaacaaaattcacatgcagctaattaaagagaagaagggagcctaattagcaagccacaatgctcagctgctgggagaaggcagaaggagtccagccttg

SEQ ID NO: 9331 - DNA, 267 bp, Rattus norvegicus
ggaggaagtcgcatctaccccgtggctggggtcacaattactactaccatgatgctggttatctcacgcgtgatgttgcaccggtggcgagctaaggtggctaagggtcagctcccacaggtgaccaccaattcctgcaaacactggaaacgacagcccacggtctcagaccgcaccctggtcctcagggtccttcacatgctggatgccatcctgctccacattgagggccacctgcagcggctggcttcccaacaacaaattcaa

SEQ ID NO: 9332 - DNA, 237 bp, Rattus norvegicus
gatccctacgacttcgcagatgacaccctagatccgctgtgacgtgcgtgggcagggtcgtgggacatactgtgcaccctgcccggggtcacacaggatcacgcaactgaggactacctcctcggcggcggtgagttcaatcgactgaggacaacctcgacactcccatgacatcctgtgaccccacgtgacctcgcaccccactgtgcgcagaaccgtcgtctgtaatttttgaat

SEQ ID NO: 9333 - DNA, 279 bp, Rattus norvegicus
ctcaccctggtgagaatccttaggagctcggtgcgagcgtgtgcaatcattgggtcatatgtaccagctgaaggaacatcattgcactgaaacagaagaaaatgtcctcgactgggaaagttttcaacagctgaaggctcgtctttcattctgtgccgagaaacctaaggtgggtttcaaacacaagtcatatttcagtagacccagtagacctgacactatagatactgatcatgtgaaaggctttaccacaaagtcaattccttatccatgttttta

SEQ ID NO: 9334 - DNA, 292 bp, Rattus norvegicus
  misc_feature (48)..(48): n is a, c, g, or t
gcccagcgacatattaatttctgcaaaaatcagacctctcggcgcgtnttcgactcaaaccaaatggcagccagactggcagccagagctcagggtaaggccccggcgagtcccaaaaaataaccaactgttacgagtgctgtgggtgcccttcggcagagcaggactgtggagaccaaaaaataaaaaccgacagcctggctagttccagtaagtcagagcacgcaccatgtgcttgtgttgtcaagtcatgggagcagagcctctgtcctgctgctgtgatgaccagctg

SEQ ID NO: 9335 - DNA, 272 bp, Rattus norvegicus
  misc_feature (143)..(143): n is a, c, g, or t
  misc_feature (186)..(186): n is a, c, g, or t
  misc_feature (211)..(211): n is a, c, g, or t
gagaaggaatcctcagtcctggaatgaatgctggaatgaggtcgattctgggattcagtttcgttcttggagttacacctaattgagctaccctggaaatgaaattgttttgtatttcgtagcggtagaaaaagatgttaaanaggttgttatctaaagcctagttcataaaaataagacatatgnacgctcctatttgccaaatcctggntcttttgaaagagcagcaaccagtgcttttaaccacggaacaatctctctagccctaaatt

SEQ ID NO: 9336 - DNA, 453 bp, Rattus norvegicus
  misc_feature (316)..(316): n is a, c, g, or t
tgtagttccggtcattctccagaagccacgcaacagcacggagttgtgagaaagtccttacgagtttcaccgataaccagtctggagtgaatcagatgtgtctgcttcacggccaggatttcagtgaattatgccttttcggtttgggacccagccaaggaggtttccagtggaaggaggagactcttcaattgagctagaatcaggcctgagctccagtgcttcctgtaatgggaaagagacgtcacccaacaggcaactccgaagatgccccggaagtcattgcctgacaataactgatgttcccatcaccgtntatgcaacaatgagaaagccacctgcgcaaagcagcaaggaaatgcgtcccaaatagcatcattaagtcttctgtcgagggttgactaggtcaagggtaatgggccagtatcatctcgtggtctgcctggtaaacaa

SEQ ID NO: 9337 - DNA, 495 bp, Rattus norvegicus
  misc_feature (286)..(286): n is a, c, g, or t
gggcgtctgtgaccttttcgagtcccccagttccagctcggacggtgccgacagccccgcagtgtctgcggtgcgggactgcagctccctactcagctctgcccagcccttgacagcgctagatctccagaccttccgagaatatggccagagctgctacgacttccgaaaggcgcaggagaaccttttccacccacgggagtcgctggcgcgccagccacaagtgactgctgaatcccgctgtaagctgctcagttggctcctccaagtccaccgccagttcggnctctctttcgagtcgctgtgcctgaccgtgaatactctggaccgtttcctcctcacgacccctgtagctgcagactgcttccagctgctcggggtcacctgtctgctcatcgcttgcaagcaggtagaagtgcacccacctcgcatgaaacagctcctggccctgtgcggcggggctttctcccggcagcagctgtgtaacctcgagtg

SEQ ID NO: 9338 - DNA, 485 bp, Rattus norvegicus
  misc_feature (190)..(190): n is a, c, g, or t
  misc_feature (240)..(240): n is a, c, g, or t
  misc_feature (269)..(269): n is a, c, g, or t
  misc_feature (337)..(337): n is a, c, g, or t
  misc_feature (400)..(400): n is a, c, g, or t
  misc_feature (434)..(434): n is a, c, g, or t
aacctccagacccagcaaaatgtggtctcaggaactgcaggagacatggaataggacagatcccaggaagagagccccctgaagagtgagtttctctgtcaggagttccctgctgacgacaatcctcaacagtcaaagacttttttggggagaatattcttcttctcagttaatttcctcattgtatagngaccctaaatttatgtatccgtatgccagcctgtctcattgaggtctttntcctctctcataccgacaacaccatttgngagacatctgaggggactgccttgaaatctcgtgtcctagaggagaaacagcactacaactgtgtttntaaatgttcattaagaaaatgctgttaagaaatatttttggttatgattttcattgaagtttnctttttgttatatcatagttatatattcttgttnctgtttttcattttttataccattttagttgttcattttatgcctgttttt

SEQ ID NO: 9339 - DNA, 494 bp, Rattus norvegicus
  misc_feature (234)..(234): n is a, c, g, or t
  misc_feature (462)..(462): n is a, c, g, or t
gggacgtgcatcgaatacattacctagaacacaaactgaatcggatgctgtagcccaccaccgtgaactgaagcttcatgaagagagactcatgtgaccctcgtgtggaagcgaatggaacaaagaccaacttttccatttggacccctggtttctctcgaatgcagttgtcccatcctcagcctttgaatgaaatgactgtgctggtggtcccacgcccaggggaaacatccngtcccctagaggaccctcagtctgttggaaagtgtaatgagtaagactcagtgagcagcagaggctgagaaagttgggggccaaggagcaggtcagagtttccccacttctgcttttaactctcctccactcaaaatagaaactatttccaccttactccctgtccccaacctcagcttcaaggtggtctaccacaaacactctgagtgacagtaggggagtcaccanctctcctgtgagtctgcacaccaagctgagga

SEQ ID NO: 9340 - DNA, 259 bp, Rattus norvegicus
aagctacgtcaggaacttgtataagaaaaggcctttcccctggtttgatctgactactgtgcaaaccaaggaaactcccttcagccagcacatctccgctactcgtgctcttcaggaccacattagtcttctctactgtgaatcatttggcctctccataggcgaagaagaactgccttacatttccaccgttctccaacctctagaagaagtctcggattgacgagagccatgcattgtgtgcaatacctgagtgaag

SEQ ID NO: 9341 - DNA, 379 bp, Rattus norvegicus
  misc_feature (83)..(84): n is a, c, g, or t
  misc_feature (105)..(105): n is a, c, g, or t
  misc_feature (327)..(327): n is a, c, g, or t
  misc_feature (331)..(331): n is a, c, g, or t
ggcagacatcaagggaacaccgcttacaagctttctttctgtggctcctcagtcagctttatactacctgctcagggatggcnntacccatagtgggctgggctntctcatggcaatcatcagtcagttgactctaggttatgtcgagtttgtcaaacacaagcagaacagagaggaacagcatcccggaagactggcaggcaggcatccagcctagtgagaaggcattctgaggacctgtgatcacagccccttcccctgaggtcttgcctttgggtgacatagaggtatcgatgtcctgggatacctgaccaaggccccactatntgcntcctcaggaaaaagccttctaaagtgttgtatctaagtgttgcctttt

SEQ ID NO: 9342 - DNA, 268 bp, Rattus norvegicus
aacattttgatcagtccagaggaatctagggtcacccaggacacagataaaaacacccaaggccaagcagaggacatctatgaggaagcagaggacatccatgaggaagcagaggacatccaggaggaagcaggggttacccaggaggaagtccaacctcttgcacaaccaaagagtgtttctggcccgcgctactcctttgatgtttccatacctttgccagcatccagcgtattcccagaagattcatacaggaatgccccaccag

SEQ ID NO: 9343 - DNA, 295 bp, Rattus norvegicus
agttccgctctccaccaaagaaagcccaaagtatttcccccagcaaagacttcactttcaatactttaacccagctcgagatggaactggtgaaatttgtgtccaaggtgcggaaccttaaagtctccatggcaactagcagtaactccaggctgcagatcccagatatacccatggacccgtacaataatgtcacgatatatgagatatggggggaggaggagtctgagtgaaggggtttatagcaaagtataagagaaaacaagtctagtattgacagacagtatccaaacta

SEQ ID NO: 9344 - DNA, 329 bp, Rattus norvegicus
  misc_feature (66)..(66): n is a, c, g, or t
  misc_feature (75)..(77): n is a, c, g, or t
  misc_feature (81)..(86): n is a, c, g, or t
  misc_feature (88)..(88): n is a, c, g, or t
aaaagaagtatgaagccctggccaagcgcgacaaagatcggtaccaacgtgaaatgagaaactatnccggaccgnnnaggnnnnnnanggagagaagaaggagagatccagatgcaccgcggaagccaccatcctcgttcctgctcttctcccaggaccattttgacgagataaaagaacaacacccaaactggactgtggcgcaggtggccaaggctgcagggaggatgtgggccaggtgttcagaagcggataaaatcccctacgaggagagggctgcggttctgagggccaagtaccttgaagagcgggaggcctactaccaccaa

SEQ ID NO: 9345 - DNA, 510 bp, Rattus norvegicus
  misc_feature (114)..(114): n is a, c, g, or t
  misc_feature (348)..(348): n is a, c, g, or t
  misc_feature (356)..(356): n is a, c, g, or t
  misc_feature (358)..(370): n is a, c, g, or t
  misc_feature (372)..(373): n is a, c, g, or t
  misc_feature (410)..(410): n is a, c, g, or t
  misc_feature (418)..(418): n is a, c, g, or t
  misc_feature (454)..(454): n is a, c, g, or t
gagaataccgtcttgctgcaaagcccccgcctccagcagtgttcctacagagatgtgagggtgttagcatttagaagtggcgtctcccgaggcagtctgcaggagcagggtccntactgcctactgcagggaatcggaagacggaaagacctggagcgcctgtggaagagacacaccttcctacgctgggcaccctgcgaactggaattgagccagcagccacctctggaatcatcctaccagactgattttcggtcaggcacaggactcagtcagctcccccagcgcctggtccagtttatgcaggtccagcctccctatgccaacaccacttaccaacataacttntgccagcnannnnnnnnnnnnnanngtggtagcgtcaagttaaggccccatgagccagtcgntgaaacantgcccggcctcccgggaatcccaaaacccaagttgntgcagcactacctccacgccggagtttctgagtgtttagactggtcccaagcacta

SEQ ID NO: 9346 - DNA, 531 bp, Rattus norvegicus
  misc_feature (159)..(159): n is a, c, g, or t
gcgaggtccacacgtccaggataaaagcaaaggcatgccacgtgtacacgtgcaagccagccctccagagccctcagcctctgtattctgagagcaggctccactgggagccagtcccacagcgctgccagggtgacctggaagatgtccttttgtgtntgtggagcctcttccttgacacaggcaattaaaaccgccagatcccagaagcccccttttctgtgctgtcattgctaggtgttctcggacggccgcctttggctgactccctgacatttcaccatagatctttatttttaataaggaggcccataaatattattgacaagaattagtgaattattaaaggcaacaattgagaagaaaaagtgcctttgtttccagttgttctgagaccaagcatgacctaagagtcacaggcgagaggctgagaaagccctgtccttccaggctcctcagaggccagaacagttcaaggatgcctgagacagcgccagctcgctcacaccggaaccccagcatgtagagaga

SEQ ID NO: 9347 - DNA, 319 bp, Rattus norvegicus
ataacccaagtcttgacagcccttgtggggttccagaagaaggcactttgtctgagacagacagggagacttgtgagcagaccagcactgacagtgctaccaggcgtgccagcgacaatcctgagctcccatcccagacagaagccatagccccttcagctcatgaagacccatctgccagggactctgctctccaggacacagatgacagcgatgatgacccggtcttgatccccggtgcaagataccgagcaggacctggtgatagatttaatatcagaggaacaacagtaggtgatagaataatgaggcgctccgc

SEQ ID NO: 9348 - DNA, 488 bp, Rattus norvegicus
  misc_feature (318)..(318): n is a, c, g, or t
  misc_feature (324)..(324): n is a, c, g, or t
agcgattgggagagcgcgaccctccccgcggtggccgtgggttctcttccctcacctgcggggcggcactctggacgtggaggttgcggaggcgacagcgggatgtgcgttcacccgctctagctctcagtctcacggcttccctgggcgacccaccgcagcagccagcccgcgacgctcggggcggcgccctctggcggcgggaggccttgcgtgccgccccgcagacgccaccattggctgcgctgccagcgtcaggccaggaatggaggcgccacgtcggggccttggggctgcggaagcggcggcgataggcgnaacccnaggtggtcacacggaaaggggtgagcgaccgcaagctcgtgagcccagtgtcctcgccctctcccacggcccttggactagagaaggagacctagattcatctgcgcacaggtgtcactttctccggaatttgttccttgcagcaacttatgccgagcgtcctt

SEQ ID NO: 9349 - DNA, 317 bp, Rattus norvegicus
gaggtggagctggaccccgacatccacctggaggacatcgctgagaagacagagggctactcgggcgctgacataactaacatctgcagagatgcttctctgatggccatgaggcggcgcatcaacggcctgagtccagaagagatccgggccctgtccaaggaggagctgcagatgcctgtcaccagaggggacttggagctggcactgaagaaaatcgccaagtctgtctctgcggcagacctggagaagtacgaaaagtggatggttgagttcggatctgcgtgactggtcaccgtcttccatttccgggagtt

SEQ ID NO: 9350 - DNA, 471 bp, Rattus norvegicus
  misc_feature (35)..(35): n is a, c, g, or t
  misc_feature (132)..(132): n is a, c, g, or t
  misc_feature (260)..(260): n is a, c, g, or t
  misc_feature (404)..(404): n is a, c, g, or t
tggactacaagacagccgagcagaagtacctccgnggccccacactcagctaccgggaaaaggaaatctttgacaatgaactcctggaggagaggaaccgtcgccgtcgctgatgccgtagtctccacctgnccagcaccgtgtctgtggcctgccagaggcctgtgagaatgtgctagaagcaagaggcctagtaatgtgctgactttgatctgtgcatgggttctgcgtcttcagccctgagcctgggagatcagagnccatcttcacactagaagactgctgcatctatgaacagctgcttctggaagtttctgtgtgtgtacgcgtgtatgtttggttttatttttttaattattattttgtttataaatgcgtttgaatgcaaaaaaaaaaaaaaaaangcagtgtggctggcatgtacgcttaggtcttgtgttgcttggtgtgtcagccctacagagtttctgg

SEQ ID NO: 9351 - DNA, 490 bp, Rattus norvegicus
  misc_feature (258)..(258): n is a, c, g, or t
aggatggcgcagaacccagtgccaactccgtgtcggcccacaacctcctccggttacacggcttaaccggccacaaggattggatggacaagtgtgtgtgcctgttgacagccttctcggagcgcatgcgccgagtcccggtggccttgcctgagatggtccgtgccctctcagctcaacagcagactctgaagcagatcgtgatctgtggagaccctcaggccaaggacaccaaggccctgctgcaatgtgtccacnccatctacattcctaataaggtgctcattctggctgatggagacccatcaagcttcctgtcccgtcagcttcccttcctgagcaaccttcgacgagtagaagaccgggccacggtctacatatttgagaaccaagcctgctccatgcctatcacggatccctgtgaactacgaaagctgctacaccaatgactgcccagaactctccaagctgggccagaggctatgccaaa

SEQ ID NO: 9352 - DNA, 261 bp, Rattus norvegicus
gggatgtgtcacagttcaggctcgtgaatgaggtcttcaccatagacgacactctacagacgctcaaactgaggcttcgggagacgcaagatgcgttgcagctgctggtgatgaccaagtctcggttggagcacgagctggccatcaaagccaacaccttgtgtattgacaaggagaagtgcatgcgcatgcgcaaatccttccccagcacgccccgcctgactggctacacctgctctggcataggctcaggcccttata

SEQ ID NO: 9353 - DNA, 270 bp, Rattus norvegicus
gaaaggtgcaacaacttagtttagttataaaaagttagttctaaagtttgatttgggggaaaaatgaggtttctctttaatgcatttagagcgattgctgatttgagcttttgttgttgttgttaagcttaagtatgtacgtggagatttgcttgaaatgagaaacctgatgtttgcacacctgtcctatggaagcttggttacactaagatacagagaagcttgaattatttttatgtactatgagatgaaagtaaacactgcggtaat

SEQ ID NO: 9354 - DNA, 214 bp, Rattus norvegicus
ggaccacttcgccaagctgaagcaagagaaccccaactggacagtggtacaggtggccaaggctgccgggaagatgtggtccatgattacagatgtggacaaaagaccctatgaacagaaggccgcaattatgcgagcaaagtacttccaggagcgggaggcctacctcagccaatgccagaacagtaagatcaacctccagggatcgtccaaa

SEQ ID NO: 9355 - DNA, 278 bp, Rattus norvegicus
ggaactcggccagctctggatactgctaactcctgctcttccaggagagatttcattggctgctccttttgagtttctgagagccaagttcagctgagactgctcagtgctcatcttccctccctctgccatttcttgcaaatgtctaactgttgacactagatgactactcacaaaggaagtagtcacaaaaaaggtcaaaagtcatttgagagtcacagatgatctctcaaacttgatgtattaaaatgtgtctcacccggctttcacaaataaag

SEQ ID NO: 9356 - DNA, 265 bp, Rattus norvegicus
tgccagaggctacacaagaagattctggagctggagcgccaggccttggccaaacacgtcagggcagaggccctgagctccacccttcggctggcccaagacgaagccgttcgggccaagaacctactgctgacggacaagatgaagccggagtgaggacggaggcagagggcatgggaggaggggagaaggtggccactttggactatatgcatttgaagatgtgttccctccacgaccaactcagccacctgccacttgaggg

SEQ ID NO: 9357 - DNA, 343 bp, Rattus norvegicus
ttacatgttcagtggccacaccgttgtcctaaccatgctgaatttctttgtcacagaatatacgccaagaagctggaatttcttgcacactctctcgtgggttctcaacctctttggaatcttcttcatcttggctgcccatgaacattattccattgacgtgtttattgccttttatatcacaacaagactctttttgtactaccacactctggctaataccagagcgtatcaccagagcaggagagcgagaatttggttccctatgttttctttctttgaatgcaatgttaatggcacagtacctaatgaatattgttggccattttctaaaccagcaata

SEQ ID NO: 9358 - DNA, 334 bp, Rattus norvegicus
gtcctactaggaccgcttgaaaactgagcccgcgctgaccgagcctgggccggatgggcgcagcggaccctgccgcggaccgccgagcggccgttgcactggctttctcttgtcccagtgtgtggaccgcaccacacgccctcctgaccagcaacggctcttgcgcatgcttttcggtgtttttatcggagagtccggcagagccctagctcctccagagctggcccagaaccgagtgacaagtgcccagcagacatggtaaaaatgaccaagtccaaaactttccaagcttatctgccacactgtcacagaacttacagctgcatccactgca

SEQ ID NO: 9359 - DNA, 387 bp, Rattus norvegicus
  misc_feature (138)..(138): n is a, c, g, or t
  misc_feature (245)..(245): n is a, c, g, or t
  misc_feature (261)..(261): n is a, c, g, or t
ggctagctcctcatgctggaactgcccccgcgagtcagctcaggaaccacagctctacctttctgaggatgccaccgtgagcagccgcctacccttcatctccagggccaccgccccaaggccaaggggaggcctaanaaccttcctggacacccctaacaatccggagcaggtgggcaaatcgccctgtcccgggagccagaagctggaatcctttctgcccagtttggtgctgcagaccgttntaaagcaaggccgccntaagggctaccagctccttctgccgaccacaaaccggcagcaggctcacaggtgaatgcctgccagaggcccccctgctcagaagtgtacccatgccaggcaatgaggagagtgcttcttcgcccc

SEQ ID NO: 9360 - DNA, 516 bp, Rattus norvegicus
  misc_feature (413)..(413): n is a, c, g, or t
  misc_feature (431)..(431): n is a, c, g, or t
aaggacggcatgttccacggagatggaaccctgttcttcccccagtgggagccgattcgacgccatctgggagaagggactggtggtgtcgggcaagtataccttcaaagacgggctacagtatgaggataaacactggcactactgtgacagctatgaccggaggttctacaccgagatatgctatggcctgaagccctcaggtatctctcagctcaccaacatggacccacccagaaaaatcccccctggctactatgactgtggagatggcttctataaccccatgaccagggtcatcaaggattaccggaaccgctttctgagaaatgcagatgatgacgaacatgagtggatcatcaggacctgccgcaagggctggttggtaacagcatccacacagaagtcccagntgtgaacatcccaaccancctcggaacctcaccagagacttccctctgcccacagctggcctgggaaactggctgtagtcctagcttcgatttgggtttcaaa

SEQ ID NO: 9361 - DNA, 242 bp, Rattus norvegicus
aaggactgcaaccactttcagacgactgtaacatcccaggactttgaatatcagaccaaggaacctgctgaagagccattgagggccctcaggaagtggctgaagacaaacttgcacgggtttttggagaagctagagaaagaggtcagagagctggagcagctggtgcgggacctggaattctggctcgatgcgcttctgggagagccacactcagaggatccctgctttaccacgaaggt

SEQ ID NO: 9362 - DNA, 143 bp, Rattus norvegicus
gtaaaactcaaatgtcgtgtgtctctgaaaatccaaatggaaaatgctctgatgttcagaaagtggagctgtgtgtcttacgtcttagtagaattcatcagcaacagacctaaagaaattggaaaccaggaattcaagaggat

SEQ ID NO: 9363 - DNA, 150 bp, Rattus norvegicus
gagacctgcgctggcctaagcaaggcgtgcactgagcaccaccagcgtctgcctggggcaggctgtgtgctgtgcctgggtgagcatccctgatgttttgaagaacaacaggttgccttggcattgtcatttgttggcacttctggcatt

SEQ ID NO: 9364 - DNA, 232 bp, Rattus norvegicus
atcatcattagccttgtggaagctggagctcataccgacatgacaaacaagcagaataaaactccgctagacaaaagtacaactggggtgtctgaaatactacttaaaactcagatgaagatgagcctcaagtgcctggctgcccgagcagttcgggctaatgacattaactaccaagaccagatcccccggactcttgaagagtttgttggatttcattaagtgactggat

SEQ ID NO: 9365 - DNA, 120 bp, Rattus norvegicus
agtttcatgccacagaggccagactcgacccgcaggtctcagaactttgggggctttgattcagccaagatccttccagatcaccaaaggaccagaaatcaagccagctcagctcagagc

SEQ ID NO: 9366 - DNA, 168 bp, Rattus norvegicus
taacaccaaccccagttgccgggcacagcaccaccgctgtttccttcctccgttgacctgcgcagtccacgcaggggaaccttcgaccagttgccatcagcaccccagccatcccatccgctctgtctccgaaagtatagacctctactcggccgctgcgctacagga

SEQ ID NO: 9367 - DNA, 256 bp, Rattus norvegicus
gtgtcactgaagtgtgtcctgccttctccagcagaggctgctgctgtccgtggacagagctgatctgtggtatcattggtggagtggccggatgaaagctcatctttctccctgccattaggcacaaacggtagttctctgataaagcctagctcatttctacagaggatatttttgttaaagtctaggtgatataccttttctgaagagtattagattttccaacaatcttaaagtctactgttacctgttaatt

SEQ ID NO: 9368 - DNA, 104 bp, Rattus norvegicus
cacccaggagacttgattgaagtgttccgtccttgttatcagcactgggcactgtacttgtgatggctacgttatcaacattgcacctgtaggccaaccgagca

SEQ ID NO: 9369 - DNA, 264 bp, Rattus norvegicus
taactcctgtgttccgttatcctttaggaggctgcacaccaagcgagatgtccttacagccatatccacagtttgccactgttccttaactcatgccaattctgtctatatcacatttgctttccgcaccccgcactctccccagctctcgcactcgtcagtattagttagcaccaagattacaacgtatagggaggtctctcccgcggtgagagtacctaattgtattgttggtacactagctctttagtaacccatatgcac

SEQ ID NO: 9370 - DNA, 261 bp, Rattus norvegicus
gtatcgagctgattgcaagttggatactcgaccaggctcaagacccgaacaccggcctgaccacaaactggggagcaaaccccagcaccggctgctggtagcacctgagaatgaagacaggatggaggagaggctggcggagacttccagagctaaagaccatcacatctctggagctgaggtggggaaagcaagtacctagtggcggagagggccctgggggatcatggtgtgcagtctgcacccacataagctaagtag

SEQ ID NO: 9371 - DNA, 266 bp, Rattus norvegicus
gagttttactccagagctgatgcactgataggcgtctacccagagcacgatgaatgcatgtttagccatgtgttgactctggacctttccaagtatccagacactgaagaccaagaaggcagcaggagccaccggaaacccagagcacgagtatcacagtccccgcagtctctgtttatacccatgtgtcatagaagaaaaatttcttaccattttggtagaacaagttatagcccactccagctaaggagtgctcaaccccattc

SEQ ID NO: 9372 - DNA, 308 bp, Rattus norvegicus
gaaaatgggtacacctttccgatctccaatattttctggaagtgtgccgacctagggttccacagatgaatgttgtttgtgataaatcagccagatgaacagggagcattggcggctgcaatacattctgaccagatctgactttgctcatcgtaagacatcacaaaaagaaagtcgcaggcatccgcaatcccagtataattatagcaccttttgtctatgccctttggtgaccaagctacatcaaaagttacctgtgaaaaaactacatattatttacataacattttcttgccttattctactca

SEQ ID NO: 9373 - DNA, 437 bp, Rattus norvegicus
gggaccattggcttgtgaagtccatggcagatggattctggctggcatattctcgtgggagaaggcctgcaccaaagctccgaatctaagcgtatacacccgcatcgacaaatataccggatggatcaaggagcaagtgagccgtggggcgcggtccaggcgctgcaggacctcctgccttctgttcctgccctggctgctgcagctcccagtcagcccaggacctccccaccccttcctcttcctgctttgcctctgctgaatggcactaggttgcctctccatattccacaggagtcagggtgggaatggaatgacccctggagaacttgggtcctgctctggcgtcctagcagggaggactgtggtgggtgggctaggccttgcttgagtgtccaggagaaagggaggatgtgcctgtcaggaggaacgttctg

SEQ ID NO: 9374 - DNA, 458 bp, Rattus norvegicus
aaggtgcccatgagagcactcggctttgaacccaggaaggaagagatgaagaaaatgatttcagaagtggacaaagaggccacaggaaagatcagtttcaatgacttcttggctgtgatgactcagaagatggccgagaaagataccaaagaggaaatcctgaaggctttcaggttgtttgatgatgatgaaacagggaaaatttcattcaaaaatctcaagcgcgtggccaacgagttgggggaaagcctcacagacgaggagctgcaggaaatgatcgatgaagctgatcgtgatggtgatggagaagtgaacgaagaagagtttcttaagatcatgaaaaagaccaacctttattaagtgactggctggggtccctgcttctgcttttgtgaaagtataacagagcagctgtggtctgttccttcttcctgcctcctgtgcttgattagcttcta

SEQ ID NO: 9375 - DNA, 354 bp, Rattus norvegicus
  misc_feature (112)..(112): n is a, c, g, or t
  misc_feature (120)..(120): n is a, c, g, or t
  misc_feature (233)..(233): n is a, c, g, or t
  misc_feature (241)..(241): n is a, c, g, or t
  misc_feature (325)..(325): n is a, c, g, or t
caatggtttaggttttctactgacaaggatttcaagattgaagggaggtattctgaagtccacgctttaaggaaacagaaaaaaatgtatcctaatctcatctttgccccantcgaccanagagagacaaggaaacaagtttccatgaagtcggcggatgaaacaccaacttcgcaagtgctttgggaaccattgacattttcaaagctcctagaagagaagcctacaagaantgtgccangggagagctgctttcgctatggaagggcccagcagtgggtggtcaaaaatgcggctgtcattaagtgaagacaaatcctttaancccctctctgcgctctccaagaactgagg

SEQ ID NO: 9376 - DNA, 466 bp, Rattus norvegicus
  misc_feature (290)..(290): n is a, c, g, or t
atacgaagagatatacccgcccgatgtcgatgagtttgtctacatcaccaacgacacgtacacaaagcgacagctactgaggatggagcatctgctgctgaaagtcctggcattcgatctgaccgttccaaccaccaaccagttcctccttcagtacttaaggcggcaaggggtgtgcatcaggactgagaatttggccaagtatgttgcagaactgagccttctggaagctgacccattcttgaagtatcttccttccttggtagcagcagcagcttactgtctggcanactatattgtgaacagacacttctgggtacctgcacgtgtccctcatggagccgcccgtagttcttcccctgcagtgaacgggtcagctcaacagccacaccagcaggcttactctgacctgttacagttttctgcgggtcgggccaactaatgtcagttgtagatgtcaccttca

SEQ ID NO: 9377 - DNA, 254 bp, Rattus norvegicus
  misc_feature (46)..(46): n is a, c, g, or t
  misc_feature (91)..(91): n is a, c, g, or t
gaatcacagctcaaattctggagagtagtcatcggaagcccattcntacacacccaaggatacaaccccgtgaccagccagccttctaccntagactctaaactttgtcatcatgaaatgtctccagtgtttcttccagggcctggctcagttacctgatactcaaaggctatgacatcatccttgccagaacctatgggcagcgattgtgaacttggacatcacccgagagccaggcacatgctaactgccaa

SEQ ID NO: 9378 - DNA, 295 bp, Rattus norvegicus
  misc_feature (35)..(37): n is a, c, g, or t
  misc_feature (39)..(40): n is a, c, g, or t
  misc_feature (42)..(51): n is a, c, g, or t
  misc_feature (54)..(55): n is a, c, g, or t
  misc_feature (57)..(57): n is a, c, g, or t
  misc_feature (62)..(63): n is a, c, g, or t
  misc_feature (121)..(121): n is a, c, g, or t
  misc_feature (233)..(233): n is a, c, g, or t
  misc_feature (254)..(254): n is a, c, g, or t
atgctgctgtggagaaactgaggaagtcttaggannncnngnnnnnnnnnncanntnttttnntttgtgttcttcccccatgtcttattaccctagttctcctattcttgaatacagctgnactataaaccaaattactatgatgttctttactgtggagacgatgttctggagtcaatgtggaagatgacaagccagaagtagggtggggatgctgtgtgatccaactgtgnctgacactcttctacctgggncctttgactgagttctgtgtgtgcctatcgtgcgatgcaat

SEQ ID NO: 9379 - DNA, 373 bp, Rattus norvegicus
  misc_feature (58)..(58): n is a, c, g, or t
  misc_feature (180)..(180): n is a, c, g, or t
ggacgcttcgattggcaaagcccagggccccagccaccctgttggaagagtgggaccntatgccaaaacccaagccttatgtgtcagactataaccgccttcttcagctggcaacacccaaggccctgtcagaaaagtgcgttcctgaccgcagtcctcagtgggaggtcctgaatgtcnccaagaatgcggtggccagttcacggatcatctccctggcccagcccaaaattcgaaaggacctcaacgagggatacaacccgtactacatctccccagcttctctggtggcccaggcatctcctcgaatttacgagcttgctgtccccaaacacatcaccaagaaagtgtgacagccagacgtacactccag

SEQ ID NO: 9380 - DNA, 509 bp, Rattus norvegicus
aggtgaaagagtccctccgcagcatcgagcagaagtacaaactctttcagcagcaacagttcaccttcattgctgctctggagcactgccgggagaatgcccacgacaaaatccggcccatctccagtatcgagcaggtgcagagctacatggaacattactgcaataactccaccgaccggcggattctgctcatgttcatggacatctgctcggagctcaacaaactgtgccagcactttgaggccttgcactccggcacccctgtcaccaacagccttctcgagaaatgcaaaaccctggttagccagagcaatgacttgagcatcctcagagcaaagtacccgcatgatgtggtgaaccacctcagctgtgatgaggccaggaaccactatggaggtgtggtcagcctcatccccatagtcctggacctaatgaaagagtggatcgctcattccgagaagctgcctcgcaaagtgctgcagcatgggacgacttagcttctgtac

SEQ ID NO: 9381 - DNA, 304 bp, Rattus norvegicus
ggtagcttgacttctccgagcaagagaatgaccatggcaggacgtttggggcagaagatgaatcaggatgaagttcaccagaatcagatcatgcgggaactatttctcaaagagttccggacacagaagctgtacacgcagtatcacgtgaatcccctgcgcaaggttcacacaatcactcggaagcccatgtcttggcatgataacttggaggagccagaagatgctaagttcctgaacctcgttcaccatgctgcacagggtccaaaaaagaaatattcagagacacagaccgaagcccaag

SEQ ID NO: 9382 - DNA, 290 bp, Rattus norvegicus
aaggtgcgcatggagtttgaactgacgcgcctcaagtacctgcaccaggagaacgagcggcagcggcagcacgaggaggtgatggagcagctacagcagcagcagcaggctttgcctcgccagttctcaggaggcctccaggacctcttgctcccccagaaccaattcgccatgttcctctactgcttcatcttcattcacatcatctacgttgccaaggagatggtcttctttctcttctccaagcactacctgttctgcctcgcggccatcttgctgtgtttgattaa

SEQ ID NO: 9383 - DNA, 309 bp, Rattus norvegicus
  misc_feature (172)..(172): n is a, c, g, or t
  misc_feature (244)..(244): n is a, c, g, or t
gagcaacgactgtctttgaccgaagataagctgaaagactgccttgagaatcagcaaaagcttttcagtgtcatccaacagaagagctgagcaggaggtgtgcaagctcaggctggtccctgaagacgtactcacacactcaggacgttgcagaggccctccctccacaccntgccatgcactgatcactgtagattcttcaggggtgagcaacagaacaaaggttcaagtcatttgtaaggantgacttaaacacacaaatcactatcaaggatcaagttaagctcctcccaggtacaattgcagtaa

SEQ ID NO: 9384 - DNA, 241 bp, Rattus norvegicus
tatgaagatggacggcgcgagcctggctgggaacgacatgattaatggcgaggatgaaatggaagcctatgacgactacgaagatgatcccaaatcagactatagcagcgaaaacgaggccccagagcctgtcagtgccaactgaggagcttttgtttgctgaattaaaacactctgacatttcgctccctttccccaacaacaacaacaaagttcttaaagagcccgcatgcatttgtgg

SEQ ID NO: 9385 - DNA, 295 bp, Rattus norvegicus
  misc_feature (43)..(43): n is a, c, g, or t
  misc_feature (46)..(47): n is a, c, g, or t
  misc_feature (52)..(52): n is a, c, g, or t
  misc_feature (111)..(111): n is a, c, g, or t
  misc_feature (148)..(148): n is a, c, g, or t
  misc_feature (180)..(180): n is a, c, g, or t
  misc_feature (187)..(187): n is a, c, g, or t
  misc_feature (237)..(237): n is a, c, g, or t
taggtacatccagtgtgccaaagatgctggtgtgccctgccgntgnntcagnttctgtgccacaatagagcaggcacgccacaacaacaggttccgtgagatgaccgaccnttcacatgcgccggtatcagacatggtcatgtttagntacaggaagcagtttgagccgcccacactggntgaaggnttcctggagatccttcaggtcccattccggttacaggagcatctggaccntgcgctgcagcgactatactgccagttttccgagggctgagtcctcaataaacactgc

SEQ ID NO: 9386 - DNA, 301 bp, Rattus norvegicus
  misc_feature (38)..(38): n is a, c, g, or t
  misc_feature (150)..(150): n is a, c, g, or t
  misc_feature (168)..(168): n is a, c, g, or t
  misc_feature (181)..(181): n is a, c, g, or t
  misc_feature (216)..(216): n is a, c, g, or t
  misc_feature (260)..(260): n is a, c, g, or t
  misc_feature (263)..(263): n is a, c, g, or t
  misc_feature (268)..(268): n is a, c, g, or t
aaaagtgacaccgtctcatcctatactttcaaaaatcntactctctttgcccttgcaaatgtctatgcagtttactttgagtgactgaaaaaacggtccacgtgtcccgaaatcatgaaacaggctgggtgtctctatccacaaaagttntactggcaaaagctgtgngaaagagacaggntgaagatttcaaaggactggaagcttccatcacgnttgtgaggactggcggagggggaggggagcctaagaaaacagtnttntttgntcaaagcagaagtcagtgcggttcacataaaca

SEQ ID NO: 9387 - DNA, 219 bp, Rattus norvegicus
  misc_feature (40)..(40): n is a, c, g, or t
  misc_feature (59)..(59): n is a, c, g, or t
  misc_feature (61)..(61): n is a, c, g, or t
  misc_feature (64)..(64): n is a, c, g, or t
  misc_feature (112)..(112): n is a, c, g, or t
  misc_feature (124)..(124): n is a, c, g, or t
gttccagggtcacatccactaggaccatggattccaaaanttgtgctggcctgacctgncntgncctggcctggctccggtgtgctcctgtccctggatgtgcgtcgtgcangttgattgtgtncctggtaaaagctagaacacacgtgtgatgtcaccacttggacgtagctgtattgtaaggatctaagaagtcatggtgttcgatgttgagtgctt

SEQ ID NO: 9388 - DNA, 336 bp, Rattus norvegicus
gcgggccgcggccagcaagctggaacaggggaagcggacaagtgagactccagcagccaagcgccttcggatggacacaggtccccagagcctgtctgggaagtccacgcccagcagcggtgatgtccaggtgacagaggatgctgtgcgccgctacctgacccggaagcccatgaccacgaaggacctgctgaagaagttccagaccaagaagacggggctgagcagcgagcagacagtgaatgtgctggcgcagattctcaagcgcctcaaccctgagcgcaagatgattggggacaagatgcacttctccctcaaagagtgatgccaataaag

SEQ ID NO: 9389 - DNA, 483 bp, Rattus norvegicus
  misc_feature (209)..(210): n is a, c, g, or t
  misc_feature (212)..(216): n is a, c, g, or t
  misc_feature (218)..(228): n is a, c, g, or t
gatttatatgccactcatggtccaatgagcttaagggaactggagttacaacgtgattctaaccttattcttcccataacacatacaacaacaaaagtcattgatgttaatttaccagaagcagctgaagatttttctcagtaccaacaaaagcaagatacagacattaaacaagttgaacacaagccaatacaaagacatctaaccgnngnnnnnannnnnnnnnnnagttcactttcacaacatcaagggggcccagcagatccacttttcattacacacgtgtcacctgccaggatgtctgtgactctaccctctgcgaacctcgaggatcactctcagtccctgagcaccagctccatgcatggcagtgcggagtcctcagggacagacaccttctgagcaggagaagaagcagcacagtgttcaggaagacatgtcactggctgcagaccatgtttggacactatcggcctttgaaca

SEQ ID NO: 9390 - DNA, 366 bp, Rattus norvegicus
gtggacattcatctattgctcaagcaatgatgacaaccagtgagataaaaagatagtaaatagttcagcatggcaccactggctgttgttagtctaatttcattgatgtatgccgtgctttgtaatgccaggattaaaacatcaagtcagccacttaaacagtggcaaatgtgtatatgtgtttggtttccatttgttaagcagccattttattttcccatggtcatgagttgaagggaaattaagataacactccctccccaccaatgctattcaactacctctatctgcctgagttttttttaagggttcccttcttctaaatctgcacaaaatagtttcagctcatctacattgtactcgcaa

SEQ ID NO: 9391 - DNA, 396 bp, Rattus norvegicus
  misc_feature (359)..(359): n is a, c, g, or t
gttgcttctccaggtcgctgtcttccagtctccggctagtggtcagcatggcccgtggaaatcaaagagaaattgcccgacagaaaaatatgaaaaagacccaggaaattagcaaaggaaaaagaaaagaggatagcttaactgcatctcagagaaagcagagggattcagagatcatgcaacaaaagcagaaggtagccaatgagaagaaatctatgcagacaagagacaaatgatgactggctttttggaaaacctgggtgctattgccagtgggtgcatcatatgctctaagatcaaaacttcacagagtgactaatcattacatgtgttataacttgtccttataaaaatttcanattttacttttcagccttgcttgatgtgatgttttaa

SEQ ID NO: 9392 - DNA, 398 bp, Rattus norvegicus
  misc_feature (28)..(28): n is a, c, g, or t
  misc_feature (187)..(187): n is a, c, g, or t
  misc_feature (189)..(189): n is a, c, g, or t
agcttcgccggctctataagtacaccanaacgaaccagacggccaagttcctggtcgcgctctgtcccttggatgcaccagagagatctttgctcgccaaccaggaggacagtctccccaggctctgcagtgcctgggggttgcatggaaatatcagcggcatgaaggagaggttgtccaagatgcnancccctggccaagaggctatcttgctggatgagtcaaggtcctcacactgttccagagattctttaatgaaacttcctcaaaaaccaaagctgaagaaaaagaggattaaggaaagaccagagtctcccaagagctactcataggaagacccatagggatggaggccagctcccctggctccctgagcacttgcatgtatactctggaga

SEQ ID NO: 9393 - DNA, 522 bp, Rattus norvegicus
  misc_feature (114)..(114): n is a, c, g, or t
  misc_feature (365)..(365): n is a, c, g, or t
  misc_feature (374)..(374): n is a, c, g, or t
  misc_feature (393)..(393): n is a, c, g, or t
  misc_feature (405)..(405): n is a, c, g, or t
taattccagaattaccagctcacctctctgatttcctctacaaatctgaacacagagtttcatgggataaatctttgaaagcattcaacatgatacacaagattgattcggatncacttatatgccacaccatcacacagagttttgccatgggctcaatttccccgagagactttatcgacttagtacacatcaagcaccaggacgggaatatggacattatcagtactaggagtgtggagttcccaggataccctcccacgtcacattatatccgtggctataaccatccctccggctatgtgtgctcccctctcaaggaaaacccagcatattccaagctagtggtgtttgtccagacaganatgaaaggnaaaattgcttgcctcagtnaattgagaagtntatgccttccaacttagtaagcttcttcctcaatgtgaaagacggcctaaagatacacaaagccccaatcccagcacttcgttcacatcacagtatgcactccgctgtacacaaaaa

SEQ ID NO: 9394 - DNA, 240 bp, Rattus norvegicus
  misc_feature (119)..(119): n is a, c, g, or t
  misc_feature (134)..(134): n is a, c, g, or t
tgttctgaccgtgcggtactcactagagctgacggccgcccgctatggcctggaggtggaagctgtgagggcgttgctcaacacagggctggagaagctcttccaggcccggaaacatngaccgaaagcacacntggacaacaagatgctggctgcctggaacggcttgatggtgtctggttttgccgtggcggggtctgtcctaggtatggaaaagttagtcacccaggccaccaacgg

SEQ ID NO: 9395 - DNA, 236 bp, Rattus norvegicus
ggtccatcccaacaaggaagcactggagaaaatgaatgcttgcttggccctccagaataaggtccttgaacggctgttgctcagtgagatgaagctgaaggccttggaaaaccagatgttcatcatatggaataagttaaatcgacgccggtggaacagcggacagcggaacttctccaggaggcggcgccggtcaagaaggaacgactcggcgttttccaccgtatctaaatgta

SEQ ID NO: 9396 - DNA, 232 bp, Rattus norvegicus
agctgagacccctgtgctgtgcctaccaggccccagaaggcccagtaaaatttacctcatgtggtaagtcaccctagaggcacacagcacgaaagagtcagggagtgggggaagcagaaggcaggtgaacaggagtaagccagagcaacaccaagggtgcgtggtgtgcgggggacaggaagaggagacagcccgctgacttcccttgaggtgggcgtctactagtgaaaaa

SEQ ID NO: 9397 - DNA, 226 bp, Rattus norvegicus
gaattaagtggatcctgtggtccttgtaggcaacgaaggggacaacctaggccgccgtaaacaaagatctaacgaaagtcttctgatcaccgtgctgtggcgcaggctatccatgttcagccgtcgggggtcttcacggtcaggcaagcaagacaatcagatgcaggagcgcaaacgtgagggcagccacaaggaaccagaaaagggctgactacaaccctggtct

SEQ ID NO: 9398 - DNA, 366 bp, Rattus norvegicus
  misc_feature (37)..(38): n is a, c, g, or t
  misc_feature (40)..(47): n is a, c, g, or t
agcatgggtgccttcaacgatccgttcctggcccagnntnnnnnnnnagattcgcattccagttttcctgatggtgaacaaatagaccctgaaaatctccacttcaacaccgatgaaggcagtggaagactgcttgttcttggaacccagcagccatactgtgaggaagtccaaaccagccagcctggggagactgcatgtacagggtcacacgggtatgagctgagacctctggccccagctaacagccaccatcagctgcctgacgtgtaagtcacagggcttcagacagcaccagtcttcagcctgaggcttccaatccatggaacagaaatggggacttgctgtaccggtctgaaatcctga

SEQ ID NO: 9399 - DNA, 497 bp, Rattus norvegicus
  misc_feature (471)..(471): n is a, c, g, or t
tagaaatctagtccctcccgacgtcgccagtgccccgagccccaaactatggccccgagctaagtggccaagtggttgggagcgggaggcggagcagctgggagagctgtgggcgggacggactcgagtgcctccacagggccaggaacctgtggaagactctgtctcagaggactctggatggcccctagcggtgccccaggtcctcgaggctacgtcccaggtgctgtggaagcccatggttatttcagaaaacatgaagctggttcctggtgtgagtatgtggaaccggggcacccaggagctgctcaaccctgctgccatccaagaggaggctgaagaaggcacccctcaggcgcctgagcagcaacccatccagacaggtgtgtccaagcctcaggtgattatgaaacagctaaggaacgagacccccaaagcctggctgctccccaccaagcctgtgccccactntgggtcctgagcctccacactgagaa

SEQ ID NO: 9400 - DNA, 230 bp, Rattus norvegicus
gatgtacttcccaggatatttccccaatgagctgcgggccatcttccgggagcaagtgcgcctcatccagaatgccatcatagagagccgcatcgactgtcagcgtcactgtggcatcttccaatatgagaccatctcctgcagcaactgcacagactcacatgttgtctgcttcggctactactgcaagtcatcaccacagtgggagtcagctgtacagggccttctga

SEQ ID NO: 9401 - DNA, 343 bp, Rattus norvegicus
  misc_feature (162)..(162): n is a, c, g, or t
  misc_feature (194)..(194): n is a, c, g, or t
gggtcctggatgaacaccgccagcactgccagcagaacggacagcagcgctgccccttaggctgtggagccaccctggctgccttggagggtgagcaacacaactgctaccgtgagctacgtgacgcttgggtccaacgccatgagcgtaaccggaccctgntgctgaacctgctggggcgtgtacgccgggtntaccgcaccaccaacctcatccgccgacagctggcccagctgagcaacttcctggaggatgataccctgctcctgaatgcccgggtgcaagagactgaggttgccccggagcctgagatgtggggtgcgcagggccaaggtgtcttata

SEQ ID NO: 9402 - DNA, 373 bp, Rattus norvegicus
  misc_feature (30)..(32): n is a, c, g, or t
  misc_feature (51)..(51): n is a, c, g, or t
  misc_feature (53)..(53): n is a, c, g, or t
  misc_feature (55)..(60): n is a, c, g, or t
  misc_feature (62)..(63): n is a, c, g, or t
  misc_feature (65)..(67): n is a, c, g, or t
  misc_feature (137)..(137): n is a, c, g, or t
  misc_feature (280)..(280): n is a, c, g, or t
  misc_feature (283)..(288): n is a, c, g, or t
  misc_feature (290)..(290): n is a, c, g, or t
  misc_feature (292)..(298): n is a, c, g, or t
  misc_feature (300)..(300): n is a, c, g, or t
  misc_feature (303)..(304): n is a, c, g, or t
  misc_feature (306)..(307): n is a, c, g, or t
  misc_feature (309)..(318): n is a, c, g, or t
  misc_feature (320)..(323): n is a, c, g, or t
  misc_feature (325)..(329): n is a, c, g, or t
  misc_feature (331)..(334): n is a, c, g, or t
  misc_feature (336)..(336): n is a, c, g, or t
tcatgctttttgttcatctgataaaccgcnnnaaaaaattcaactccattntncnnnnnnanntnnnagaactccaagagaagaaagtatcctgtgtctccagcccaaagccctcagaagggcagcgtctgagcagnttgacgtttggatgcttcttgtcccgagcaaagagtccgccttgtgcagtaaggtccgaggaagcgagcaagatggcctcaagcgaacctgagttcgccgaagcaagatgcgtagaaggtacttagagcgacagcagtctacntcnnnnnntngnnnnnnncnaanncnncnnnnnnnnnnannnntnnnnntnnnncntgattttccccaataccccaatgcctcgtgggaatat

SEQ ID NO: 9403 - DNA, 398 bp, Rattus norvegicus
cccagccaagtgctttgagtactatgaaaagacacctctcaccctctcacagctctgcagggtgaccttgaggaaggccactggtgttcgagggctagagaaagtcgccaagttgaacatccctccccggctcatcgactacctttcctacaactgagctgcaggcaggaggatggaaaggctggtgactggccctgttgtcaccttgctatgcctagccctggggtttaaagacttctgcctgtttctctgaaacaccatcattgctgtagataggttgatgctccttcgttgatggttgataggttgatgcttttcggttgtccttttcgatgtctccttctaaaccccagaggaggtctctgaagcaccaggaggccagtgcgtgacatcacagc

SEQ ID NO: 9404 - DNA, 368 bp, Rattus norvegicus
  misc_feature (121)..(121): n is a, c, g, or t
  misc_feature (282)..(282): n is a, c, g, or t
agacattttgtattgctgacacgaggtgtctacaaactattgaccgacagcctgcgcttcccttgcagtggtctgtagtcctggaacgttcagtcccgatatggatgtcacctgtcagacntgtgtttctgcccatgtctacggagccaaagcttgcccataaacgccaagaacagaggcgaacgcatggttgtttgcctctgaaggtggaggcaaagatccgctcgcatcggagagcatcgtagatgcctctgtaaaggaagatccgtaagagcaaagctncggaagtacgcattctagaaacagcagaaagcagttgccgtggacaaccaaaagtaggttctgagaaggcctttacctcagtgcct

SEQ ID NO: 9405 - DNA, 496 bp, Rattus norvegicus
  misc_feature (404)..(404): n is a, c, g, or t
aaatgcggcgagttcagcgagcgaagcagatcgaagacatgagcagcagacaagtgaacagagacccacagcaagcttttcgactatggcttaagaaaaagcatgaggagcagatgaaagaaaggaagactgaggagctgagaaagcaagaggagtgtttgttctttctgagaggaacagagggccgcgagagggcctttagacaatggctcagaaggaaacagatagagaaaatagcagagcagcaggctgtcaaagagagagcgcggcagctccgactggaagctcggcgctccaaacaactgcagagcggcctgtacagtgtgcccgaggccaaggctttccgcttcaccgaccactacaactgaagccgcctaggaaagacttcgtttgaagctgctctncaccagaattgtgtgtgtcgtttcccatgggcccctgtcttgataatactccaaattgtgggagtgggatttgccttttggtgatgctgaat

SEQ ID NO: 9406 - DNA, 511 bp, Rattus norvegicus
  misc_feature (46)..(46): n is a, c, g, or t
  misc_feature (109)..(109): n is a, c, g, or t
  misc_feature (139)..(139): n is a, c, g, or t
  misc_feature (142)..(142): n is a, c, g, or t
  misc_feature (198)..(198): n is a, c, g, or t
  misc_feature (235)..(235): n is a, c, g, or t
  misc_feature (250)..(250): n is a, c, g, or t
  misc_feature (268)..(268): n is a, c, g, or t
ccagaggctgactctctacaagagagccaggaggacatacacctangggtagatgaaggagctgggcaaactgcctgtgggctcagctcttatgcctgtcaggactcanagcaacacgccagctccccgttctgcctgncangaagcagactcacgcttggtatgaagttgcacgagggagaggagagtggagggcantacccttgtgataacccttgggaaggagcctcttcangtctggagacctcanaggatgcagccaacacangtgtggaacctgcgacagtttgcaatgacggggacagacattaaccaaagaccactgcctacaataagaatctgctatcaaaacaacctgaagtctttaaggacagggactgggccaataaaaacacagacagtaatgagataaccccgcctgtaaggcacctgggataggtagcacaaggacaatcattgctaacgtggcagtttctttgatgcagttacgtggcaaaaccctgtcaagatg

SEQ ID NO: 9407 - DNA, 520 bp, Rattus norvegicus
  misc_feature (299)..(299): n is a, c, g, or t
  misc_feature (302)..(302): n is a, c, g, or t
  misc_feature (325)..(325): n is a, c, g, or t
  misc_feature (335)..(335): n is a, c, g, or t
  misc_feature (455)..(455): n is a, c, g, or t
  misc_feature (461)..(461): n is a, c, g, or t
  misc_feature (465)..(466): n is a, c, g, or t
  misc_feature (469)..(469): n is a, c, g, or t
  misc_feature (486)..(487): n is a, c, g, or t
gggctgacaaaccatgtcgagctatgaaatctgtgctgaaaaaagcgggagctggtaaatattttaacccattcattcttagtgtgaattttctgaaatagaagtataaaaaaattgtctctacaatctgattttaaaaagtgtgttttcccaagtaaatccccctttattcatgagaacgaaagtgcttggatactataataccttaatttccccaatttttaaaataaaatggaatttttgctgagtgaattaagcatagaaaatgtcaacccatcagaattatatttatacatatnggnggataagttcctgtcttcccacntcagagaatnattttttttaccaaaatgggcagaatagcattttgtatgtcagacaccattcttttctagtccttccgaacattcctgtgtcatttaagaatgttagtagaggtcgcttctttggaaatnggggantttnngtnttcctttgaaagtatgnnatctgaagaacacagtatcatgactcgggtgga

SEQ ID NO: 9408 - DNA, 358 bp, Rattus norvegicus
  misc_feature (57)..(59): n is a, c, g, or t
  misc_feature (225)..(225): n is a, c, g, or t
tatgacttggtcgatgcggagacaaaggcaaagataatgaagatggacgtggactannncagcgatgaagaactgtgtcagagtttcctgagtgaaaatgactggagtatctttcggagggatctgctgcggttgctggtggagcccctcaaaaagaagccattcatcccgatccagaccaagaagaaagagatctacaaccctaagtctttgttactggatctntgtagccttgacaagaaggtgagacagcgctatcctgtttttatggcgccccggaaatacctgcctcccttgaagattgtccaaaccatctcagcaccccggcacaaagtccaagaactcttacctcagtata

SEQ ID NO: 9409 - DNA, 368 bp, Rattus norvegicus
taaaacttccagtcaccagaggtccaagttttccaacctgactcagtgtacctgtcggcgcagaagtgaaactacgttctttcagattacggagaagggagagaaaagtcttcgtccggctactgggaccaaatcgaaaaaaaaggtcaaatcaagaattcacaaagaacctagtgagacagcgctggccttgctcatccatgagcgaatgaatgaaaattccaacgtgataccaccagccgaagttccaccggtccctgaaagcgtgccggttcctaatgaagacatggccagttcctagaccccaaatgggtccaaagacctaaaaaacatcaatgaatggggtctaggagctgagccatggtcat

SEQ ID NO: 9410 - DNA, 403 bp, Rattus norvegicus
  misc_feature (209)..(209): n is a, c, g, or t
  misc_feature (360)..(360): n is a, c, g, or t
acgtagatgctttctgtccaattcatagttaacaccaagataacgtgggggcaggagactgggttgggtttccccaagcagccacatgggtcagcaccatgggcctcccagaagaaccccaaaagctgtgtttgtggcagtcctgggtccctgcagtcttccagacacctcccccaaaactagccatgcttgctgctggcctgtggccnaccccttctcaaccctagaccatgagatctctgtggacaaatgaacaccaaggtctatcgggccctgagttctagaggccccaacacgtcacaccttgctgctgtcaccacttcagaattctgccctacacaagccctgccctcgcacacntaggaagcacctaatgaaatacgatagtttctctctttttgga

SEQ ID NO: 9411 - DNA, 438 bp, Rattus norvegicus
  misc_feature (89)..(89): n is a, c, g, or t
  misc_feature (225)..(225): n is a, c, g, or t
acaccaagatgggactgctttccgctccacccaggatgggcaatcctactgctgtgagcatgacctgagggcagactctgcaaataatnccaagactgagaaaccctttctagactcactcaaggcgaaggggaagaggaagaaaaggcggtgctggcgaagggtcacagacggcaaatagcgcttggtcagatcctggggtggtgtggggcagccagtcctgcntacagtgggaaggcgagcacggcactcaccccaaggacccaggtcatagtgctctatgtataggcctacttgggtgggaggcagctcctctcaccactgagccatcctcagcagctgtgctgtgtctgcactgatgcttgtcagctgcatgcttggcggtccaggataagcaagcctcactacacagcgtcacctctacacttgaatctgaga

SEQ ID NO: 9412 - DNA, 364 bp, Rattus norvegicus
aggagcactacaactgtcgcaggatctccagtgtcttataacctgctctatcccaggacttccactgttgtagcattaccatggtcacagcaactacactgtttcaggacatcaagtgaagctggacctccaatgatgctccaacttctctgtcacaggatctctacagttacaggaatactcctgtatcagcaattccaattgctggacctcagttgtcacatgacctccactgtagccgaaccttcaattttgcagcacctccactagaggtagaatgacctcccctatcacagtgcctccactttcaaaggaccttcactgtcacagaacctgcacaatttcagtgcctccgctgttgcag

SEQ ID NO: 9413 - DNA, 407 bp, Rattus norvegicus
catggcactgccactgtaagtcaggcactatgagtaggagccgagctggcaagctgcatggcctttctgggcgccttcgagttggggcactgaacgaactccgtacagagcaccggccttgcacctaccagctgtgcacttgcaacaggcaactggaggagtgccctctggactcgagtctctgtactgaccatagctgcagcactcatgttgccagcacaatttctccgattcctgtccacctgagacgcagacccatcctcccacccactagcccgagccccagcccagctcttgccttttggaaacgtgtcaggattggcctggaggatatctggaatagcctctcttcagtgttcacagagacgcaaccaatagaaagaacctagaggtaatggccacgtcac

SEQ ID NO: 9414 - DNA, 553 bp, Rattus norvegicus
gggaagttcatctcgacaaccagtctcagcctcacctcccagggtggcgaaagaaagtgtcattggctttgggtgtagggatcgccgctggagtggtcggaggtgtgttggtgaacgttgctctctgcagggtcctgggagggaccggtggcaatgggaacctcagcagcttataactcctgccttcctccaggaagctgagctagcttgtatgtgagtgtcccgtgcctctgatggtgaagtggcaagagagggctctcagccagagttggctaggaggcttggaggatgcaacctcatgatagctcagggcagcatccaccattgtagtccggtttcctccataacaggtgctcaggagccccctgcaggctttgcttctgctcctagggagagttctgtcttccacggtttttatgcctcacctcctgtgtgtgtatgtgtgtgtgtgtgtgtgtgtgtgcgcgctcgtgcgcgcgtgtgcgccgctccccccagctccacctctccaaacagtgtgtatgggccagaatgtactaatcgcagcctttta

SEQ ID NO: 9415 - DNA, 246 bp, Rattus norvegicus
agaaaccgctcaccgtatttcagggacctacggactgcccgggaaaaaaggattgaaagaggacccttcggatatgacccggttttgcagtcggactcattcctcaaagaagattgtcttccaacaccaagtcttctttcctttcggggaagccagctcctgtctaggctgaatgactcttctgatctttgacactggcagaagtggacaaggcatgttctgtcatttccactgatactcaacgat

SEQ ID NO: 9416 - DNA, 436 bp, Rattus norvegicus
  misc_feature (65)..(65): n is a, c, g, or t
  misc_feature (86)..(86): n is a, c, g, or t
  misc_feature (398)..(398): n is a, c, g, or t
tacacctcttgctaagctcagactggattccttcaccaatggccgggactcctgggagttggagnctgtggagaaggaggctctgnccaaagaagaacacagaaggggcaccgaattgtttcgagctgggaaccctcaaggggctgcccgatgctacggacgggctctccggctgctgctgacgttgcccccacccggcccacctgaacgaactattcttcatgccaatctggcagcctgtcagttgctgctaggacacccccagttggcagcccagagctgtgaccgagtgctggagcgggagccgggccatttaaaggcgttataccgaagaggggttgctcaggctgccctcggggacttggataaagcaactgctgatctcaagaaagttctancagtagatcccaaaaaccgtgccgcgaaagaggagctg

SEQ ID NO: 9417 - DNA, 371 bp, Rattus norvegicus
tgcataaccatcacgggcaccatggccgggaaaaggcgaagacggaacatatcccgctcaagaagagctgagcttcagtttccagtcagccgtgtagaccgcttcctccgggagggaaactattctagacggctgagttcctctgcacccgtgttccttgcgggtgttctcgagtacctgacatccaacatccttgaactggctggtgaagaggcccacaccagtggcaggaagcgcatatctccagaacatttgtgccgggtggtacagaacaacgaccagctccaccaactcttcaaagaaggcaccaagtctgtgtttgagtcagcagatcctgatgagaactgataatgcctgggtctcaagactct

SEQ ID NO: 9418 - DNA, 392 bp, Rattus norvegicus
  misc_feature (337)..(337): n is a, c, g, or t
  misc_feature (350)..(351): n is a, c, g, or t
  misc_feature (367)..(367): n is a, c, g, or t
aaataactggccacttctatgcttgccaggttgcccagaggaaaattcaggaaattctgactcaggtaaagcagcaccaacagcagaaagctctgcagagtggagcacctcagtcaaggcggaagtaaaggctcaggagacagccaccacagaggcaggcgccaaaccaaagacagatctgcttaaccaacagacgggcgctgacccacccagaatcacatgcacgagtttttacctagctggttgtttgtgaggaccaggcaactcgaactcctgtctctgtgagaatgtatactttatgctctctgaaatatatgacacccagctttaaaaaaanaaaaaaagtgggnntagggaacgagaactntgcacttcccttgtgatatcagagt

SEQ ID NO: 9419 - DNA, 74 bp, Rattus norvegicus
gttctatgatgtcattccgggagctattatttcactatgcatctggcactatgatggttggacggaactggttt

SEQ ID NO: 9420 - DNA, 283 bp, Rattus norvegicus
gactattctgaatcacttgggaaccaggagccctgctccatggagagcacatttttccagtcgaatcaggttcacctgctgtgtggcagccagctcagtcttgcaggcttccacctcctctccagtaaagacagacgttggcccgcattaattctaaaccgttgtcagctctaacaccattagagcttggcagctcctcaggaggaaggaaagaattggtccaagaaggtgatacgtcactacacagcttttgtccacaaaaccaatgtctccaagctggcca

SEQ ID NO: 9421 - DNA, 268 bp, Rattus norvegicus
gaagtagacatcctcagcccggcagccatgttgaacctatactacatcgctcacaatgttgccgactgcctgtatctgcgtggcttcccttggccaggcgctcccaaagggaaaagggggaaaaaataagatttaggtggtagaattcaaagcatgccttggtctcaaagaacagaaagtaggagaatgcatttagggtacctcaaggactgcgggcaagcggcctctaacagccaagtagaaacatgtagccactgtacttttctgt

SEQ ID NO: 9422 - DNA, 283 bp, Rattus norvegicus
gtcgccgtagtatttggtgcaaagatattagactatgtcttcaacctgtgtgaaggtaaatttgactacctggagcggctctctgacaaactgctgctgaagatcatgaactacctggacttggaagacatcgccaggctctctcagacatcaagccggtttgagaagctgtgcaagagtgactcgctgtgggagcagatagtccagtccacctatgacaccatcacccctgacatgcgggccctggcgaatgacgtgggctggagacagatgttcttcacca

SEQ ID NO: 9423 - DNA, 299 bp, Rattus norvegicus
gagtgtaacctctatacctttctgtaccttgtgtgcatctccaccaagacacagtgtagcgaagaagaccagtgcagaattaacaagcagatctacaacctgattcacctggaccccagaacacgggaaggtttcaccttgctacacttggccgtcaactcgaacacaccagtcgatgatttccacaccaatgatgtctgcagctttcccaatgcactggtcacaaagctcctgctggactgtggtgctgaggtaaatgctgtggacaatgaggggaacagtgccctccacattatcgt

SEQ ID NO: 9424 - DNA, 175 bp, Rattus norvegicus
  misc_feature (63)..(63): n is a, c, g, or t
gaggaagtggacaacctggttgcctggaccgatggtcttgatgaaaaatctttgaactatganaactatgaaaactttgagaacattgacaactaacacacaaggacttcacatgctgcccagttacagtgcaacctcatgaagcagttttgggggaggctcaaaacctatcttc

SEQ ID NO: 9425 - DNA, 530 bp, Rattus norvegicus
  misc_feature (174)..(175): n is a, c, g, or t
  misc_feature (177)..(177): n is a, c, g, or t
agaatggattacacaggcttactgaaacacaaatgtatttgatagtttcagtcactttaatagtttctatagtaacatgcatttagatagaagattcatagtgtttggttgaataagctaatttgtgaaaacagtattcagttagactaattgataaattgtctttcttctatnntncaggaaaacaaccaaagttttaagtagcattttaagaacagatgaatttgaagataaagaattattcattttatattttggacacctgccaatgaagtggacctagtaacaataactaatggactgtgacgattcaatttatttttacttttgatggttggctatttggcttctcataaaaggagaaagagatattttaaagtataaagaatttttctaatcagtttcagctttgcaggcagctcctgcaaaaattgggaaggaacactcgaaagtagggatgttgttggcgaagtgggaagactgtattataatttgcatgctacttgcaattcttgtttttcaccacttgt

SEQ ID NO: 9426 - DNA, 331 bp, Rattus norvegicus
aatgtctactgacttttattcctagtcaccgttccttaaacaatgtatcaggcacctgacatttgcttcacattggaagtatttttagaaaagggttcaaagtacataggtgtattcttgccggttctgtgtaaatagtccaccacttggtttaaaggatttgccatgcatttcaacattcagtggggtcctggatccagcccaacttaaatggacaactaattattactcttgttaatcacatgaaataccttgtgcccatcccccaccccctagttcacaggtctgagtgaccctgactgcatgaatatcctgggacagctgctggtgt

SEQ ID NO: 9427 - DNA, 180 bp, Rattus norvegicus
gagcctggacaactgatggaccattctgtcctgttccagagggtcggaagacccaggaccttgaactaaagctggatctcaggctttgatcttagctgaatccagcatataacgactccctggcggtacctagtagcgctagcggtataggtggaagacttattttggagctcagcgcag

SEQ ID NO: 9428 - DNA, 189 bp, Rattus norvegicus
gtgtggtcttcagccctggatccttcaatccccgggatggaactcactgcctccaatgcaacaacagcgtggtgtatggagcgaagacatgcatgtaggccagggccttgtgggacccagtcgctcattcagcagaaaagtatatttttgaagtactaaagtataataactcactattatgccgaaatt

SEQ ID NO: 9429 - DNA, 163 bp, Rattus norvegicus
cagtcgaaaagcaaacccggagagaagaaagttgaggaggaaaagaagatcactaccactttagttacaaaggctaaggagaaagtaatggagaaggagaccaagcagtctgacaaggagtctcagcctgccgaaagcatgatgttcgggtcaaagacatcca

SEQ ID NO: 9430 - DNA, 180 bp, Rattus norvegicus
gaaatatttgctgaggatcccaacttaaatcagcctgtctggatgaagccatgtagaatcaattctagttattttcgacgtgtgaaaaatcccaataaccttgatgaaatcaagcacttcataacaactgaggtactcaaactgttcagtcttaagaaggagccaaaccacaaaacagat

SEQ ID NO: 9431 - DNA, 185 bp, Rattus norvegicus
ataaatctcagactccatattccgcgtttgttcagctgcttccggttctgttgattgtgactatttctgtcattactcagctgctggctgctaatccgccatatagtctattctataaatcgaccctgggctacaccatttctagagaaacgcagaacctgcaggtgccttacttcgtggataaa

SEQ ID NO: 9432 - DNA, 253 bp, Rattus norvegicus
ggagatgtttcttcttgtcatccttcccactgattacatcagtgtggggtgtgcaccgtcctcagtatgttgacagacatgttctccattgtgattcgtttgactttatatgtgcgtaccggtccttagttcatcttttattcagtaactttcaactggatgaaacatttgaatatttaataaaaatgaaaatttaatcctgctgggatacagatcagttctgtttatgtgctggcatgtttccacacatgca

SEQ ID NO: 9433 - DNA, 287 bp, Rattus norvegicus
ccagtggccccgaaatcatggagatgagcgaccccacagtagaggaggagcaggccctgaagtctgctcaggagcaggccctggcaaccgctgaggaagaggaggaggatgatgaagaggatgaggatgaggacctggaggactgaggtccccaaggccctccccatagccttcccccttatgtgtagaacagactgtatttttcctattggttttgttccctggccttgcacgacacaggtagaaatccacccagtgctctaaataaaactcccacagcacagccg

SEQ ID NO: 9434 - DNA, 263 bp, Rattus norvegicus
gacagtcacctttggcatcaagcattctgactacatgacacccctggtggttgatgtggaatagctcctgctctccatcccatcagtctgtgactagatcctcccacagaaatgtgctgggctggcaatgattgggcacttcaccaatgggggctgctgccagcctgggcctgcatcacagagcacgctagtttggacggttttgacaagttatttttttctatgctatctcttgtttgttaatcttgtttcttgccatgtcc

SEQ ID NO: 9435 - DNA, 259 bp, Rattus norvegicus
gaactaatgcccaaacatccaagcattttaaaaataaacccatctctacaagaggtaaagttgagacgtttacccataaatcctgagagaataaggaggaggaatttaggtgtctctccaacagaatgaggtatcaactgaaaggaagagggctagtttgggctcctgagagtggaagtgaaaaggtggctttcaaaggcaagatccaacagaagctaaatcagtcttcccacagcaagcttcagacaggaaaacccaa

SEQ ID NO: 9436 - DNA, 262 bp, Rattus norvegicus
gatcggaataataccttcacctgcctattcactgttggtaccttgccctggataacagaattccagctcttcaagaatgtgtgttcatagttcctctgactggagtcatccacggtctggccatgtacttctctgcatccatgaagtggttaatcttgggagaacctctgtgctcatgttccttgttttgcaacattgtatggtatgaagactgggtatgtgaataataactagggaaatgcatatcactgttgtttcatca

SEQ ID NO: 9437 - DNA, 287 bp, Rattus norvegicus
cactctgcccgaggctggacaagaaggcagtccgtcgaaagcaggctagccataaccattctgtgctggatcagtgtgtccccacaagcctgggccctgacctccatggcttcttcctccagccaggacagcaaggaagcagggaacacagctccgacagtagaaagtggcttagctccgtgccagcccgaacccactgatcctcgggaactctggctccacaagttcaaggcctgcagacagtaggcagggcctggatttgggagcttgctttcatggcctggtaa

SEQ ID NO: 9438 - DNA, 258 bp, Rattus norvegicus
gtcaaaccacacttgattttccacccagctttcctgttaagaaagatgctcttataaagaaacactatactgctgcattcccaataggtgtcctaacagctaccatgtcactcttcggtgtgattatgttcctttttgagatgagctctttgaaaccacagagtgaagtggaggtccagtgtgtttctagaccaatcaatcaaaaggcatgaggcaagccagaagactgcttaaagaatttgtccgtatgcacatatt

SEQ ID NO: 9439 - DNA, 271 bp, Rattus norvegicus
gtcacagcagatgcgaggccacgatcagccattggcggtggagcccaaggaagttgggaggcttgaagaagaggggagcctccagtctcagagctgtggtgatagttcagatgactgcagcaccaaggtaggtgctgcagacacacgctctgggtcccgcccttctgactagccctggagataagcagcggttttgtttgcttggttttttcttaccttcttcacttcttaaagtatgtttcttatacaatgtttcagtcagagcggtaat

SEQ ID NO: 9440 - DNA, 274 bp, Rattus norvegicus
ggagactgaaactggagatgaccttgaacaaagaccattcttttccccctttcactggaaacctttcacttcacccaccagcatcacggcctcagaatatattttttaacacaaaatactaggaaagtggtgttgtcagcagggatgacaagtacctcccacagcggtgtggggactggctgggacagcgactagtgggtcttcagctgctccacaggctgcggcttttaatagacttgactcctttctgaggctatacaaggtttagctgcat

SEQ ID NO: 9441 - DNA, 205 bp, Rattus norvegicus
gacagtgagttgagatcctttcttgtaaatgaagagggctttgcagacaaatgtaactggagaagacagtcattcaacgattattcaccaaattcctatacccattcaagtacaactcaatattctcttgtggacgacaaggaacaaggaacaccttgggtcaccaacaagaaggaaccttccattttttcagcaggattcaaag

SEQ ID NO: 9442 - DNA, 289 bp, Rattus norvegicus
agcgagttatttttacacatctgtatacgcacaccagaaaaggaaatgttttggtaggcgcgaatgtaatttctgtctataaaaacccgtgcagttcatggatgatggattttaagcaggagttggtgatgttaatttacagcaatgattactctgtgctgaaaatgaaaccagaccatttctttttcaccatgccacaccttttaacattagcttggatacatctcagctgttttgtcaagggagagtgatcctggtagaggatcgtctcttctgtgacagtgccaaa

SEQ ID NO: 9443 - DNA, 270 bp, Rattus norvegicus
gagtcctgaaggaagttgtccccaagagaggtatatcatctcatactgtggacatcatgaacctcatgatcaatgacatcttcgaacgcattgctacggaagcctgccagaggatgaacctcagaaagcgctgtaccctcacctcagaagatatccagaaggcagtgtatatgttgatgccgaagaagctggctaaacttgctgtgactttcggaagtaaagcagtccacagattcatccattcctaagctccatgttcaagcctaattg

SEQ ID NO: 9444 - DNA, 288 bp, Rattus norvegicus
accagctttgctgagcggcagaaacggctgcaggtggtgcagagccgacgcctgcaccgctctgtgctgctgagccggcgccctggagcccggccatcccctctcgagaatggttcacaccaaccctattttgcagccacacgcaattccaagacagacagaacccatgacagataaaaccacgtgctctcagaaatgaggagactgtattttctctattttactatccctgcatttatgcaaaggccataatagaatgttacgtcctctccctgtagactgaaaata

SEQ ID NO: 9445 - DNA, 276 bp, Rattus norvegicus
gcaaattcacaaactggtgggccatgagagtgaagtgcacactgtgatattttcccaccgtgcagagaatctgtactctggtggttctgacggcaccattcggttgtggctctgatcagcaaaagcataccctgatgcaaagggcattccctccacagctcaaaaatgctccatacagtctgcttacaagccagcaactagctggatataacgaccaataaataaaatatttgttttgaaacaagctttgggtgaatactatataacccctactgt

SEQ ID NO: 9446 - DNA, 268 bp, Rattus norvegicus
taaacccatttaaccatgagtcccttccccccagcagggctggctctcatgaacaggcctgttttctcttttatggggaaacttacgcgctcagggtgagagattgccaaccaaacccctgcttcctttagccccatcagaggtcaggagggagggaggaaaggatgcagctccaacagcccaagggccccggagacccatgtgagaagacatgaggcagattacaggagcaaccacaagtcctacactgactccacatgcttgaatg

SEQ ID NO: 9447 - DNA, 377 bp, Rattus norvegicus
  misc_feature (349)..(349): n is a, c, g, or t
ttcggctcagtatgcagagttctgtgaaagccgacagttaagtttctccaaaaaagcatccaaatttcgagactggctggactgcagcagcatggagataaagcccaatgttatagctatggagatcctggcatatctggcgtatgagacagtggcccagttggtggatctggctcttcttgtgaggcaagatatggtatctaaggcaggggatcccttcagccatgccatttctgcaaccttcattcagtaccacaattctgctgaggggtcctcctgtttgaagtccagcccagactctcctgagaacacacctcctcctacaccaacagctccctcttctgggtcncagcatgcaggtagagctgcgtctggct

SEQ ID NO: 9448 - DNA, 358 bp, Rattus norvegicus
atggaagcttacgtgttgctccctgcaccccgagaacacatggtgcagtgccgcatcgtccgaaacaagcatggagtggacaagggcatgttcccttcctactacctctacctggaggcagaggatggtgtagcagtacgctccagccctttggggcatttccttctggctgggcggaaaaggaaacgaagcaaaacttcaaattacctcatctccctggaccccaaagacatgtctcgcaatgggaacaactttgtaggcaaagttagatctaatgtcttgggcacgaaattcaccatctttgataatggggtgaaccctgagcgtaactactggattccagacagtgcccggatca

SEQ ID NO: 9449 - DNA, 269 bp, Rattus norvegicus
  misc_feature (62)..(62): n is a, c, g, or t
aaagctgttgagtcaccacttgagtgtttactccctaacaactttaatcaccatccttattntcttcgaaatgtctctccatgcatctgtggtagagtaacagctctgtggctccatgttagctaccttatagttactgtgcaattagtgccacttaatgtatgtcaccagaagaactaagatctaccccagactagatgtagcatttttggaatacttggattttctgatactgatatttgtcattcccgcagcaagtatactggttg

SEQ ID NO: 9450 - DNA, 285 bp, Rattus norvegicus
gcaggcctatgagttcatgtgtttgcacatgctcacctctgtggtgaaaggacccagcccctggacagcttcaccactgattggtgtattacatgtagttttgagagcagatacgattttggcagcaaattggataggttgtagacaaagaagggttaaccaccacaaagtctgttagttaagagcccaaagatagaaatgtgggacgttttagctggaccaagattaaacaccagcaggaccatgtacattttgtgtctctagggacaaactggttcatttagc

SEQ ID NO: 9451 - DNA, 395 bp, Rattus norvegicus
  misc_feature (284)..(284): n is a, c, g, or t
  misc_feature (290)..(290): n is a, c, g, or t
gatggtttataagggccaccgcaactcccggacaatgataaaagaagccaatttctggggtgctaactttgtaatgagcggttccgattgtggccatatcttcatctgggaccggcacactgctgagcatttgatgcttctggaagctgataatcacgtggtcaactgcctgcagccccatccatttgacccaattctagcctcatctggtatagattatgacataaagatctggtcgccactagaagagtcaagaatttttaatcgaaaacttgctgatgaanttatanctcgaaatgagctcatgctggaagagactagaaacccatcactgtcccggcctctttcatgttgaggatgttggcgtcactgaatcatatccgagctgaccgtct

SEQ ID NO: 9452 - DNA, 177 bp, Rattus norvegicus
ttccatataacaagagctgccccggaaagggggggaactttagagacagacatacatacggacgtgaactgtcaggacctcttcggacattcatcagagaccctgtggcattgggttgcagcccagcgtggccgccatctttccgctacactgtttcttcgctgtacgtaactatat

SEQ ID NO: 9453 - DNA, 184 bp, Rattus norvegicus
tttcattcccctaatgtccagagactgaagaaacccaggcttgcttctcgattaagaagtatggggggaaaaggttttaccctataataccaatatccaagtcagtccaaagccatgaaatactattgggaaaacgtgctaagaaaaatatccttgttttgtagttttcacagttgggatgtat

SEQ ID NO: 9454 - DNA, 169 bp, Rattus norvegicus
aaatcatggatgcatgtgcaggcatttttatctccaacgctgggtcttcaggacagcagtaccactttaataatgcgggcccctccggatatcagaatcgctatacagatggccgaccagtgaactatgaagcaacttacaggaactatgacatctacacagcaggcct

SEQ ID NO: 9455 - DNA, 186 bp, Rattus norvegicus
gaagtcgtaaacatccagacctggatcaacaagccagacatcaagcaccattttccttgtaaagaagtaaaagaaagcgggcatatgtttcccagtcatctgttggttacggccacacatatgtactgcttaagggagattctttcgaggaaaggactggcttatatccagtctcgacaagcacta

SEQ ID NO: 9456 - DNA, 206 bp, Rattus norvegicus
aaggcttcctacacgccggaggtgatagagaagtcggtgagggatgtggaacactggcacgggaggaagacggatgacctgggccggtggcaccggaaaaatgctatgaacatgaacttgcagaaagcactggaagagaaatatggagaaaggagcaggtccaagggcaagtagttgaaaggacattggaagggacgctcgagaat

SEQ ID NO: 9457 - DNA, 212 bp, Rattus norvegicus
aacagccagcaaaatatttcacaagatagagagagacagagagagaatgaccgtgaaccccctcaagccttcaagaatgcgcctttctctctgtttgatgagatgcctggacccagaaggaatggctaaagaatggggttcacaacccaagagtgggaagcctcacaaactcagctagaaccatgaaggctaatagcagaggaggctgcccc

SEQ ID NO: 9458 - DNA, 236 bp, Rattus norvegicus
aagttctccttacccagaagctggagaggatcttcagagagtgggctaaattttaagcatgggggaatccccaggaaagatcaagacttctggcgtattataacgttgagtagcaatcacgcattaactgaagattaaaggaaaaaatagccaatatttttactcaaattcttcctattcaagttcgattgatttcctgctgatgtgtacatttgctgggagctgggatagtaaaa

SEQ ID NO: 9459 - DNA, 250 bp, Rattus norvegicus
gaggtctcagcgatctgttcctgaggaattttcagctccgctggaactgttgcagcctctctcaggcctggtggatgactacgggctaagacccaagcacccgaggccaggtgggcccagaccccttctctcccaggcccagcagcgcaagcgggacgggcccgacatggctgactattactatgatgtgaaccccgcataaagctattctgggcagcaagtgcttggctccatagcctatgtgcagtaa

SEQ ID NO: 9460 - DNA, 260 bp, Rattus norvegicus
gctttgttccgcatccagagggtggggaatataccagaaacagagataagcgtttcctggatgaggaagctcttgggctgtcttcatacttagaatgcaagccacatgacagcagatggagaagctaaggaaacaaacatgaaagtgatttgctctgggtcacacaactagtaaatggtaaagccagagctgcccaagcacactggctcctacacccacacccttggatagtgtgttgtattcttctccagtctgcttgc

SEQ ID NO: 9461 - DNA, 275 bp, Rattus norvegicus
ggagaatgacaagtaccgaagacacgtaggcagcctgataaacaaggtaacgtcatatgaagaaattatcaaatgtgctgatcaaagacttgagatatcccattcccagattgcacatttggaagaaagaaatagacatttggaagatttaatcagaatgcccagagagaaagccagagggctaagaccaagattagataatcacccaaagtccatgaccttgataagtcatcttgagggccaccataaagaatgttctatttccatgtgaactg

SEQ ID NO: 9462 - DNA, 276 bp, Rattus norvegicus
acaagcagaggaggaccgggccaaagcctatgtcctgaacagtaagttacggaagcagctggctgagttccgggctccgcaggtgatgatgtacgtcagggagaagatcctgaatggggacctggagaagaccatcaagatgtgggagaggaaggtggagatcgcagagatgtccttaaaagggtaccggaaggcctggaataaaatgaagacttcagatgagcagctgcagatggtccgcccccctgggaaatagccaggagcttgcagaccaag

SEQ ID NO: 9463 - DNA, 169 bp, Rattus norvegicus
cagagacccgtgactgcgagttcggacgctgggtgcggctgctctaccgcctgcgattccactcgcccacttgcgcagtgcccttcacacatgaggacactgtgcctgaggagtctgaggatgaggatgaggtcgaggaggggcagttgcagcccccggagtttcatgc

SEQ ID NO: 9464 - DNA, 254 bp, Rattus norvegicus
tcaagaacagactggcgctcctggagctgaagctggaacagaagatgggggaggtctggaaggagctgaagacggagaagctccagtcgccagaggttcagatgacgcagaggaaccagaaatccttcaaacacgcacagacacagacggaaacacagacagaatgagagcaggttcagaccgaacctcagcccaacctggagggacatctatcctgcttgggccaccccggtccttgcacacaactttgagaa

SEQ ID NO: 9465 - DNA, 286 bp, Rattus norvegicus
catcaagagggttgccaaggagctaggggaaaacttaaccgaagatgagttacaggaaatgcttgatgaagctgatcgtgatggggatggagagataaatgaggaagaattcttgaagatgatgaggaagaccagcctttattagctctgctttgtgctgtccaagacagcttgcctgttaagcagttcagtaatgtaataccttagtgtacccatttccatttttgttttggttagtcccttggtgtctactctgtgccagaagttatgtgtccctaccaatgtc

SEQ ID NO: 9466 - DNA, 242 bp, Rattus norvegicus
caggacgacgcctccaaagaaagatgtctctctgtggctgaggaggagcatccagagtccatgacgctggataaccttctagaaaaacaggcaagaacttctcactttagccacgggagttcggatataaaccatctgtgtttgtggagatcgacctgggcgaccatactgaggaggaggtcatcacctgtgccattaaagaagagaagaggcccccccatgacacagggtacttgtctgaa

SEQ ID NO: 9467 - DNA, 159 bp, Rattus norvegicus
taacaccaaccccagttgccgggcacagcaccaccgctgtttccttcctccgttgacctgcgcagtccacgcaggggaaccttcgaccagttgccatcagcaccccagccatcccatccgctctgtctccgaaagtatagacctctactcggccgctgc

SEQ ID NO: 9468 - DNA, 291 bp, Rattus norvegicus
tgagactcgcccatctgttgttgcttccagctgccacagctccgtttctgctccattctcggatgagctcacatgtccccgccatccccccactcccccaagctgtgtgttgatctggtcccggccccacccctttctgctttctagaacggagtgtcaggacacctattctaactatcaaagcctttggccccttctcctccacacaagcctccacagaggcttggaggacagaggtcccatcccagctcgacttttgtcccctagggacccagacaaagcacatcagca

SEQ ID NO: 9469 - DNA, 307 bp, Rattus norvegicus
gactgtgttgctgacacctcggaaaaagagaccatcctatcttgacaaagtaatcgaccttccacctacacataagccaccccctgtatatgaagaacgaattccttctctccctcagaaaaaccgtctgttccaggtatgtgttcctgaagacacttaaatcacctgaactagcttctaaacgtctgcccagctgtggcggcgcacatctacctgagaggctggagcaggaccagaagcttaaagtcggccttggctacacagtgagttcgaggcctgcctgggctactggaaaccccactgcaaa

SEQ ID NO: 9470 - DNA, 305 bp, Rattus norvegicus
aaagaaccgcacattatatccaaaggtcataagtttctcatctggctttcggacaccttattaatgcggaaagctttatttgaccacctcaccgcccggggcattcaagtatacatttgggttttaaatgaagagcatgagtacaaaagagcttttgatttgggggccacgggagtgatgacggactatccaacgaagcttaaggagttcttaaataacatgtcagcatgaagcactccagatcattgagaggagtcatgatcagaaaagatctgaggaaaggtgtgttagccacggttcccctg

SEQ ID NO: 9471 - DNA, 323 bp, Rattus norvegicus
tggctaatacttggcgcacaatccccactatgtttaaccctcgtagcaattttgggatcgaggtagtggacgacctcttgtttgtggtgggtggctttaatggctttaccaccacctttaatgttgagtgctatgatgaaaagaccgatgagtggtatgacgctcatgacatgagcatataccgcagtgctctgagctgctgcgtggtaccagggctagccaatgttggggagtatgcagctagacgggacaacttcacgggattagcactgcgagatgaagtaaagtattccgcttcgacaagtaccctacctgtatgagcc

SEQ ID NO: 9472 - DNA, 305 bp, Rattus norvegicus
  misc_feature (75)..(75): n is a, c, g, or t
gggtacctgatcttccatttaagttttataaatcccgacctcctggtcaatgcactgcccaagattctgagcagngacgtcttgtggaagctgcgatgtttcctctttccatctctcacacttgagacagaagacatgttaccccactgatcccaggctgtacctgagggcagtggaaggcagaagggacacaggctcacaaatgggaggtagcaaaatctgtggagggaagaggtttgcctcagtgtttcccttgagctttgcctacttagtgactgtctgtcaccatgtcacttttccaagat

SEQ ID NO: 9473 - DNA, 325 bp, Rattus norvegicus
aggtgcctcatgttttgtttcatcccatcacgcccggaggaggtgggtgagttctggctcaagaaacgagccaccttcgaccccaaggcctggagggcccaatgtcgctgtaaacacactcatgaagagcacgcagccactggatctcatccctgcaggcaccgtggctgttactgcaactcctttgagtctaatttcctctgtgcggcttgcgaccggcgctgggaggagcacgaaactttctttgagactgaggagaccaagcgaagaggaaaaagaccttatgggacaaacactgccaagaaccggcacaggcccttctgag

SEQ ID NO: 9474 - DNA, 235 bp, Rattus norvegicus
gggtggctccactggtttgaactaccagcaacggcctaacaaccagactttcagtgtcgagatgcctcagaggcctgtgatcaaactgccagagatccctctgtttggcaatgggttcttttctttaggtcgtctgcccaagttctgggaagcaatccgctctggatggaatgttcctgagcccacctctaagcccgagggctggtggtgatttggatgccaggcttgtccagtg

SEQ ID NO: 9475 - DNA, 300 bp, Rattus norvegicus
tatgccagacactcacacagcgttatgtgagcatcatgaacaggctgcagagcctaggctacaatggacgggtgcatccagcactgacagagcagctggtgaacgcatatggcatcttgcgtgagaggcctgagctggcagcatctgaaggtggtacctacagtgtggacttcttgcagcgtgtgctggtggagactgtgcaccccagcatgctcaccgacgccctcctgctgctctcctgcctcaaccagctgtcccatgatgatggcaagcctatgttcatctggtaacaccggtgcc

SEQ ID NO: 9476 - DNA, 370 bp, Rattus norvegicus
aaagcatctatgagccgcccatgggcaccatcattgtcaggtggaccaaaaagaacttgcaaccctcagaggacctcaagtcagtgatccaaagactgtcagcacttggcccaattatctcagtcactccttgtggccgggaaagtgctgtcgtggtgttcagagatgcggcctcagcttgtaaggctgtgagtgcttttcagaccatgtctgcagactcaatgttccactgctcatggcagcatcgattcatgtcaaaaaatgtaagacttcctattgtcaaaaaaccctaatttttcttgaaactatataatttcccctccctttcctctccctaacccctcccttgtattgcttctcattgctctca

SEQ ID NO: 9477 - DNA, 327 bp, Rattus norvegicus
agacctgaatccagatgggcgtggtgagctggaactttggctgtggtcgtcgccaatttccaagcatctacaccagcacctcccacttcacccagtggatcaagagacagattggcgacctgaagtttgccagcatggccgtcccttccttcctgagcccgttcatcctcactggctacattctgctggtatccttgggctccctgtggctcttgtgaactattgtctcttaaacagccactcctggaggctacttctccgtccttctgctcagccctcagaagacgtggacaacggaggctgaacatttcaggacagagggacttt

SEQ ID NO: 9478 - DNA, 367 bp, Rattus norvegicus
tcaacatcgctctgcaggtggagtatgtgcatgagatggacacagctctgaaccaccacgtgttccccgaggctgccaccccttccgtttatctgctctataaaacatcccactacaacatcctttatgcagctgaaaaacactgattattaggccatgccagagcctgtcatctaatggactgcactctgaatggaacatttctgccttggcaactttttaagtgatttagacaactaaaaaacatatagccttttgggtaaagccactgaactgagacctgtgcccactatggactgtgatgacttaataggaattttagtatttattttgatagatatataatgcctgctaactttggaccaga

SEQ ID NO: 9479 - DNA, 423 bp, Rattus norvegicus
atagtctcaagccttacctgcagaaacaggcagactctgtatcaagctggatggctttgaggcaaaagcagaaggcagagttggagcagagaaggcaaaagacacttttggagctgacagaacaccccaacatgagcttggagatccattacaaggctgagctggaggaagaacgcagggagcgtagacggatgcgtttggctctccttaaatcgtatcccacaggggtccaggccccgcctgttgaacgaaatattcctctggacaacggtcttctcgatgaggacaaacagaaccagatgatccgtgaccttcaacagcagatcttagagcaaaacaagatacaccaggagtttttggaaaaagccaggaaacgcttgcaagagtttcagaaaacattttaaaagcagacccacccatgat

SEQ ID NO: 9480 - DNA, 382 bp, Rattus norvegicus
aagatttacatcaagattaccaggggtattttccaaaacacctgatattacccgaagacaggacttgtatcctcaaactttctctggagaagctcaggtttcttgaagacccagaaacctacctaagaaggtctgtgttaattaataatttgctgaggaagatacacctagagacggagaaagagagttatgaatacttcaaggaagctccctgctataagactgcttattctgatacaagaaaacggctgaagtttatggtacaggagtgctgttcccagtctctctactatgaagagctgcattcctaccacattgtgccttacacttcggagaatgccatctatgggatgggctacactggtgaccacttggagcaaaa

SEQ ID NO: 9481 - DNA, 414 bp, Rattus norvegicus
tacgcatgcgcaagggcagcactgtgcagcagttcctgaagcgggcgctgcaggggctgcgcagggacttccgggagctgcgggcggcgggcgtggagcagctcatgtacgtcaaggaggatctcatcctgccgcactaccacaccttttacgacttcatcgtggccaaagcgcggggcaagagtgggccgctcttcagcttcgacgtgcacgatgatgtgcggctgctgagcgatgccacgatggagaaagacgagtcacacgcgggaaaggtggtgctgcgcagctggtacgagaagaacaagcacatcttccccgccagccgctgggagccctacgaccccgagaagaagtgggacaagtacaccatccggtgatgctgagtcccagtttggtgaccttactctcttatac

SEQ ID NO: 9482 - DNA, 437 bp, Rattus norvegicus
  misc_feature (63)..(63): n is a, c, g, or t
ggcagctcgaaagcgtgcatctgaaatttaaccaggagtcgggagccctcatccccctctgcntaaggggcagactcctgcatggccggcacttcacctacaagagtatcacaggtgacatggccatcacgtttgtgtccaccggagtggaaggcgcctttgccactgaggaacatccttacgcagctcacggaccctgtttacaaattctgttgacagaagagtttgtagagaaaatgttggaggacttagaagatctaacttctccagaggaatttaaacttcccaaagagtacagctggcctgaaaagaagctcaaagtgtccatcctccccgacgtggtgttcgacagtccgctgcactagcctgagctaggccctgcaggggccaagaggagcccagctgctcctagtgacttccagtgtggcagcttgtaa

SEQ ID NO: 9483 - DNA, 405 bp, Rattus norvegicus
agcaaggcagcgatgtgaccctggccaggctccatgccatccatatctaggaatgaacactagtcaacagtcagctcagagtggacatgccagccaggctagtttctaatccttctgaaagtggggacttggtggccgaggtgtgggagacctgatgtcaacggtgggaagaaaggcaagggtaacctgagtataatcctatctgtgcttcacttaggccgaagaatcttggagaattcttctcaccaggttttgtatatactaagattatatttacagactttttatgtcctgggcatgctacctgccctcccttcatctgagcactttgtattgtcttttgtgagaacactgaccagagcctttttgctgtactctttatgacttacctgtattgggagtgac

SEQ ID NO: 9484 - DNA, 400 bp, Rattus norvegicus
acgggcctcatcaagggtcctttgttgaaaagagacctggaggcgcgagagaaactgaacagacccttggttcgcatgtatcagagacatgtgggcacccagctgccggaagctactcgccttgcccagggtactgacctgctaacccgccacaacttgcaaatggaaaagaacttaaaagaactccgtacaacacacgacaacctcgcctggagcctcaactgcaaaaagataggacacgatgtggactatgatgtggtgcgtctgcgcctacgccagctccacccgcacgtgtgctatgagcaggcgaagcgcctgatcaacgactgggaccctcgcacaccaccaccgtgcagccgaaccaatacctcctccaagtgatcacagctagccttggccc

SEQ ID NO: 9485 - DNA, 492 bp, Rattus norvegicus
tcttcatctttccacgacatcttaaatccccacagagaccatggctcgagagcggagcccagagacaaagaggaaaccaggcaaacccttccctattcgtacagcatgaaccacccctgctttgctggaatagaagacagcctttccagccagatcaacgagagtctgcgttgggatgggattctcgccgaccctgaggcagaaaaggaaaggattcgcatctacaagctcaaccgaaggaagcggtaccgcctcgtggctctcaagggcttccattcggatccctgtgtggaggagagcgtggagaacctgccctacctctcagacaaagaatgcagccccagcagcaagcagcccagctctaagggcgaccacgcgcacagctactttgaggcctcaaagctcccgcacccagaattagccaccactgcggtcgagtgacatctgtcctccctgctgctgagtacctccttgccacacgtttatatgttt

SEQ ID NO: 9486 - DNA, 291 bp, Rattus norvegicus
aggtgcccaagtactcagccaaggggttagcaggaagcgcagtcggcatctcaagctatacgcagagaatcctggaccacagggaggacacgtccgtcacgtggctatcgagcagctcctcaagaactgttccaagttgccctgcctccaagtgggacggaccggaacaaggccacacctatccactaacaactgagctgagcacagctcccgcgctcttcatctctgtcgctctgctaagcatctggaccgagaaagcatttgaagaacgtcatggtccattttcatggt

SEQ ID NO: 9487 - DNA, 305 bp, Rattus norvegicus
  misc_feature (196)..(196): n is a, c, g, or t
agaatcggctctgtatcctagcagagcagacaagcggtggatacctgagcaggagtggtggccagccattcctggctggtgcgtttcctcgagcaggtgctgctgtccttgccctagggcatctccagggccctgggatctacgggctctccacacatagctgagccccttggtgcttcctcttgcggcatccacntggagccatccagccttcccctgcaatccctcactcgggccctagcacccacctggccatcctgctgctgtgcccagcctctctgtgtacttaccgcatagggcagagc

SEQ ID NO: 9488 - DNA, 341 bp, Rattus norvegicus
  misc_feature (303)..(303): n is a, c, g, or t
ttagcccttctaagagttcctgagctaaaacgtgtgctctgtagaactgcacgcaaactgacagccgagtaaaagggggcggggctgcaattcctgagtctgatcggtcacaaagttttcacctctccagactctccactcctttactcatttgcaactgcaaatgtagcaatttgcaatcctaataccgggccagaacgctgggtaccttaaagctttacttgacatcatctagtgctttctgtccattttttaatgacttttgttttcttgtttctttaaccctatcccctccttctaccntagtatgagacccgtacccctttactgtgtctaaatat

SEQ ID NO: 9489 - DNA, 341 bp, Rattus norvegicus
tgctatactctttgtgttcttcctttttgtcatgttctcaccttttttgcttgagatagaccagcacatcaagaaattctttctcagatgccgatgttctctgcgcaatgcttcccgtaaggataaagacagtattaaggtgaagatgaaccatctgggaggggcaagaagtctccttcagacccctgggagagaagctccaagaaaagagacaactggtgggagagaagacagctcaattctggtggaaattgtaggagagaggacccgggaagtctgcccagtgacaccagtttgaggtgaccatatctgtgaggtgtcttgacatccctgttacagaa

SEQ ID NO: 9490 - DNA, 391 bp, Rattus norvegicus
  misc_feature (304)..(304): n is a, c, g, or t
ttactctgtagttcgctgtgaaaacagtctggcaagatgccactgttccagtaagcagacaaatcgaggatgcttgtctgtatcttaaccccctccagtcaggaggctgagtcccctcctccataccagtggcccaaagagaatgagacagagttagaagtcatagtagtctgtgtttggaagggcagtggctgctctcattgatgtgtagctgggaagttttggggaccaggcagccgtactagcagtgggcaaagcaagagacaatccctggtgcaacacgcaaaatgctggaaggtttttngagtattgttatagctgttgcaacgtgagccatttcctctgcagttaaacacggtttagtttatgctgcagcgcgagcccagggtaa

SEQ ID NO: 9491 - DNA, 385 bp, Rattus norvegicus
  misc_feature (111)..(111): n is a, c, g, or t
  misc_feature (131)..(131): n is a, c, g, or t
  misc_feature (345)..(345): n is a, c, g, or t
aacgggaccgcaaacagtctctggagtcagcttatgtccccgtggtggtggatcctcgcgggcaggagccagacagtagtttcaggttcaatttctacaactcacagtatnccaactctctcaatcccttntacaccctgcagaaacccacctgtggttacctgtaccagagagaaactgaccacacacggaaatgctttggcattcctcccgcaaacctggtcttgtggcgcagcacctactaaatccaaggcatctggaagtccccaccctgcaccttcactctgtggtcctgggtcccagagggaaaagtcattcattcctggagaagcggcgtatacctgngctagccaggtatgctgtgacagctgagggaggcctcttc

SEQ ID NO: 9492 - DNA, 380 bp, Rattus norvegicus
  misc_feature (102)..(102): n is a, c, g, or t
gaacttgaagcttgcacatacccgcctggaatccagaacctaccggcccaatgtggaactctgccgggaccagacccagtatggcctcattgattaagtccnccagctggaggcaaccattagtatcatgaagcagaaacttgcgcagacacaggatgctctggatgccctgttcaagcacctggcccggattcaggctgatattgcgtgcaagaccaacaccatgctcttggacaccaagtgtatggatatccgacgcaagctgaccgtgccggctgagaaatttgtgccccaggtggacaccttcacgcgcacgacaaaccgcacactgagtccactcaaaacctgccagctggagctaaactagactctggcggctg

SEQ ID NO: 9493 - DNA, 466 bp, Rattus norvegicus
  misc_feature (58)..(58): n is a, c, g, or t
  misc_feature (92)..(92): n is a, c, g, or t
  misc_feature (127)..(127): n is a, c, g, or t
atgactcccatcaagttgctggtgcagcctacacagaggccagaaggccgcacctacnccgaatacgggtcggtgaacgaatgcatggaagncatctgtaagatgtacgaggagcacctgaagaggntgaaccccctcagccagtccatcacctatggcgtcagtcagctgtttgagtttatcgaccgcatggtagacctcagctgcctggtgttccgcgaagatacccagacctacaagcctcacagccgagaatgggtcaaagagaggatctacatgcttctcagtcagcaggcgcaacgagacgagtcagagtgatcttctagaagcttccagggctggggctgtctcggaccgccgggaacatttctgatcgaagcagcaggaacaagctggagcgatgagccattttccatggaaggctgcccctaacctgtgaataatttctcttcacgtgagctttgag

SEQ ID NO: 9494 - DNA, 472 bp, Rattus norvegicus
aagcgacactatttcatggcgtacgtggaagcttgctgctcgaagggcccgtggaattcagaagaggctggaggaaaaagaagcgccatctcttcttgttgaatgatcttttggttgtgtctaataatgtacacaagaagaagtttaagataaaatatatcatcccactgagttacctctggatttgtgactatgcagaccttgtgggaggagacaacaggactgcctccaagtccatcttcctttgctggcccatggaaaattttgtggccaccttctgtaccaaggaacagaaaaaatggtggtggtttttcctccaaagatacatcaatgaggccaagatgaatggcgagagtaagagtgctgcactgcagatggtcacagaggacatccgacgctgcaccagcgcatgcgcctagacatctgctgctgtctttgcccaatccagaggaagactcccatttattccctc

SEQ ID NO: 9495 - DNA, 436 bp, Rattus norvegicus
aggaggtccgaaccaagcttcgcatccacgtgctggctgcactcatcacctttttggcctatgcaggagggagcctcacaggagcgctgtttaacccagcactggcactttcgctgcacttcccgtgctttgacgaatcgttctataagtttttcgtagtatattgggttgctccttctctaggcgtactgctgatgatcctcatgttcagcttcttccttccgtggctgcacaacaaccaactgagtaacaagaaggaatgaccactcccaaagactcaaacgaagtcagtggacgatcaggctggatgtgacggtttgggcacctttcaaactctggactcatcctgcttctccttcctttgtggaaggtgtcttactgttttcactacctggacttcactgtgaaaatgaggcagcctgtatttctcagttaa

SEQ ID NO: 9496 - DNA, 531 bp, Rattus norvegicus
  misc_feature (112)..(112): n is a, c, g, or t
  misc_feature (137)..(137): n is a, c, g, or t
  misc_feature (152)..(152): n is a, c, g, or t
  misc_feature (240)..(240): n is a, c, g, or t
aggccccttaagactactagctcagttcttctagctctaggtttggtctctatgatgcaatatcctgcgtttcccccacctttcccaccccagcactccagccggggtggcnttcatggtggcccaatgtcatctcntgctgctactcgtgnttccgcgagcgttcccatcgctgccagctgcacgccggaggtcaccgtagcccgcatatctgtctccagtccaacttggttcggccantgcgaccccactgaaaccaggcgcagtcagatagccgaaagggcccggagtcctcacgaaggaaagacttcggaaaaggttgaagagcctagagaaggtatggctgttgctaagcctgaggctacacccatggttatgactgctgctcatacgcccacctcaccctcgcttagttctggtcatggagctaatcccagcgtgactactgtaaaagcgccaccggaagagtcgacagcgctctgaacctagagacaacactccacgtttgagcaaacggttcccaagggtcca

SEQ ID NO: 9497 - DNA, 468 bp, Rattus norvegicus
aaagatggttgcttccttgcaaagtgagatgatcgaaaaccaagcactccaggatgtgcaaaatgaacaaagagtatatgcaaaaatacaagctacacataagcagagagatcaggctcacaagtcatgggaaaacttcttggctagaacatcaaatgctaaaacattaaagaaagcaaagagacttcaagaaaaggccatagaatcctccagatacagcaaacgaccacaaaatgcaatattccaccaaacagttattaaaggccttaacacaacggtaacttcgggccaggtggtgacagtggaaagcactcctactcgattgctgggaggacctctggctgacacagacattgctcttaaaaaactgcctattcgaggaggagccttgcagaaggtgaaagtgaagccgctggatggccttaaaaagaccgtcccgatctgatgtgttccactgctgctgaaata

SEQ ID NO: 9498 - DNA, 458 bp, Rattus norvegicus
  misc_feature (219)..(219): n is a, c, g, or t
aaggccaaggtcttcagtcgctgtgagctggccaaagtgctgcatgacttcggtctggaaggctacaggggatataacctggctgactggatctgccttgcgtactacacaagcggcttcaatacggatgctgtggatcacgaagctgacggaagcaccaacaacggcatcttccagatcagcagccggaagtggtgcaaaaacctcgccccgaacggncccaatctttgcaggatatactgcacggatttgttgagcaatgatctcaaagattctgtcgcctgtgtcatgaagatagcgcaagagccccagggcctgggctactgggaatcctggaagcaccattgtcagggcagggacctcagtgactgggtggatggctgtgacttctaggaccctctctggatggactaagccacacacagctggctgggaagtgtgggcttgttcctgaccca

SEQ ID NO: 9499 - DNA, 230 bp, Rattus norvegicus
  misc_feature (58)..(58): n is a, c, g, or t
  misc_feature (168)..(168): n is a, c, g, or t
gtcaggcaaaaatcctacccttcaatgcatgggcaacagaggattctgtaggccttcntgcaaaaagggtgaacaggcctacttctactgcagaacttaccagatatgctgcctccagtcccatgtgaggatcagcctgacaggcgtagaggacaacactaactggtnttatgagaaacactggccaagaataccgtgaatgctggtacgccatgcacagacttccagag

SEQ ID NO: 9500 - DNA, 243 bp, Rattus norvegicus
gggtacatcagatactccgggcagtatcttgagctgggtggagctattgactctggtgcagcgtatgtgttagagcaggcttcttctcacattggtaattctactcaggctgccgtaagagatgccatcgctgggagaccacctgctgataaaaaatctcaatagcatcttaatgggaagatccagcaagagcccagtcagcgtctggatttctgctaatgccatcacgggttcagttccagg

SEQ ID NO: 9501 - DNA, 238 bp, Rattus norvegicus
tttaccagaggtcacaccggcccaatgtggagttgtgccgggacaatgcccagttcaggttgatgagcgaggtggaggagctgaacatgtccctcaaagtgctaaaggagaagcttcaggatgcagagcaggcactgcggaacctggaggactcacgcatgagtctagagaaggacatcgcagtcaagaccaacagccttttcatcgaccgccagaagtgtatgacccaccgcaaccg

SEQ ID NO: 9502 - DNA, 300 bp, Rattus norvegicus
  misc_feature (55)..(55): n is a, c, g, or t
  misc_feature (104)..(104): n is a, c, g, or t
  misc_feature (189)..(189): n is a, c, g, or t
gggacatgtgtagacaatgggcttagagcacctcctcctcattccccaaagcctntcacagaacataaggtgtctggaacctcagcatctggttaacctgaccntggaaaatgcctctgagtgtctgacccagcactgacagtggctgccagccccagccttggcaggggccagaactcaactgcgctntggcagcctattcctctggagatgctagcagctgcctgcttcaggtcacctctcccactcccgtggagcccaggctgggcctgggcagggagatggactttgtgtaagata

SEQ ID NO: 9503 - DNA, 384 bp, Rattus norvegicus
  misc_feature (27)..(27): n is a, c, g, or t
tttgttttcaccagtgtgctagtgatntacgggattgtcacacttgtggttcgatcatattggctgcatctggtatactcagcactcggaacactgctcttctccatgtacctggtgatggacgtgcagatgatggtgggggggcgctaccactatgagatagaccccgaagagtacatttttgctgctctgaacatctacgtggacatcatcaaccttttcattttcattttggacctgattgggcgatagctgatggctgaagctggctaagcctcagaagaggaaaggtggggcacccgtggcatggctaccaggctcaggcgtgcggtggtgaccattcatgggccctttgaatagtcactcatttaccaattgatctgt

SEQ ID NO: 9504 - DNA, 379 bp, Rattus norvegicus
tgtcccagggtcatgtggccaccactggtgctgctgtttctgctgcttcctgctgcccatggcgccccccacccagctgccgacctccaggaaaactttccaagtgtactcgaagaaattcaaactgaaggagacagaggcatgtggagggaagacaacctgtttgctggctcccgctgtcctcctggctcataaggtggcttctatgtggtccagaagctggggctgaggacctgtaggctcatgagggcctgccaggcacaggatcgggagtttcccacttcctccttccggtctcctccagggcccttcagctgctgaaggggctgggggtggacaccagtatcctagcaggggacatatatgaaactcaccagac

SEQ ID NO: 9505 - DNA, 406 bp, Rattus norvegicus
  misc_feature (49)..(49): n is a, c, g, or t
  misc_feature (244)..(244): n is a, c, g, or t
aaggccgctcgaccagtacagagattgaagaaagatactcgaaataacntgaaggacacagagtactgggaatcgctggctatggttatccctttctccaagcagaacctctgggatgcgctgttcaaggccttggagaaatactaccttgtgctgacccagagggccaagctgctgatggagaatgactccctggagcagcagaatgcagagatgcagtccctgctgcagcagtatctccagnccaaggtaaatttggaactgcaggtccctccaactcagggcttccggatgccctcaaaatagagaaggctgtgcacagcctggtgtcatagagtctgcacctgttgcctgagagccaggccctccctggattctcctgagctgcatctagctgccaaagcaa

SEQ ID NO: 9506 - DNA, 427 bp, Rattus norvegicus
  misc_feature (253)..(253): n is a, c, g, or t
  misc_feature (331)..(331): n is a, c, g, or t
gactcactggcgactctaacttggagttcgttgccatgccggctctagcgccacctgaggtgatcatggacccagcattagcaaagaaatatgaacgtgacttggaggtagcacagaccactgccctccctgatgaggatgacgacctatgagaaagtgaagcttggaaggcatcgcaagcctagggggacaggaaaatgagctataacatcagctgtgtggcctgtgtgtcaccttgctacttaactaagcngactcggactcccaagtctatgggagccaaacagaagacttcggagtgaatgtggcagttacaaacatactttccgtntggaattcgcagatttagctgcttggtgtgcatttgtttcttctcagttcaaaactaagagtgctgcagttacatcctgtattctgtggcaagatc

SEQ ID NO: 9507 - DNA, 381 bp, Rattus norvegicus
  misc_feature (235)..(235): n is a, c, g, or t
  misc_feature (262)..(262): n is a, c, g, or t
  misc_feature (308)..(308): n is a, c, g, or t
gtgtgtgagagcactgcatgtttaagattcttgtcttgggcaaacactcttgtgggggctttcagactaagacaaaggcacatccggggaatttcagggaacccaggcttgaaagagccaatcagttacctttcgcagatattagaaattgaaaaatcattggagaactctttcgacttatggccacattgcgttttcaacattgatcttaggtatattgataccaggacaaaantgttacacattcgaaagaagcttagtngtgtgtaaaattagagtagaaagattcctaaatctctttttatgtntaccatattcactcaccatggattacacaaaaagtaaatgtattacacgtaaaaatggtattgatttctgccc

SEQ ID NO: 9508 - DNA, 505 bp, Rattus norvegicus
  misc_feature (296)..(296): n is a, c, g, or t
  misc_feature (324)..(324): n is a, c, g, or t
  misc_feature (342)..(342): n is a, c, g, or t
  misc_feature (360)..(360): n is a, c, g, or t
aggcgtttcctagcgaggtgtaccacttacactttgggtagcaggacacctggcttcaagtcaactcccccatggagccagaatccatagaaatttgtccttataacccacaccaccgaattcctctcagcagattccagtaccacctggcgtcgtgcagaaagaagaaccccaagaaagccaaaaagatggccagctgtaaatacaacgcctgccacgtggtccccatcagaaagctggctgaacatgaagctacctgtgtcaacagaagctccatggaggaagaggacgccttnggccctctgcaagtcagcctcccacggnctcagaacgaggacacantacaggtccgttggcttnccagccctgatatttggaatgttgacggtgccaactgtcacccaatgttcgtccttaagagttttgttccccaaaaacttgtttgtgaaagtgacatccaagagtcaccgggaggagaccaatgcccagaagatcctcagactag

SEQ ID NO: 9509 - DNA, 284 bp, Rattus norvegicus
  misc_feature (26)..(26): n is a, c, g, or t
  misc_feature (101)..(101): n is a, c, g, or t
tgaagacttcgtgagacagcgttacntggagtcccggcggataccccacacagatcctgtggactgtgagctccagtggggtccacgagcaaatctggaanccagcaagatgaaagtcctgaaatttgtagctaaaatccacaatcaagatcccaaggactggcccactcaatactgtgaagccttggcagatgagcagcgtaggctcagacctgagccaagtggtccagtcccaacctcttgaagtaaatgtcctagattctcacgctcacgccggaagaata

SEQ ID NO: 9510 - DNA, 283 bp, Rattus norvegicus
  misc_feature (94)..(96): n is a, c, g, or t
  misc_feature (98)..(98): n is a, c, g, or t
  misc_feature (100)..(102): n is a, c, g, or t
gtcctactaggagcagtgacagggtcacctatctggccctataccttcaggggaactctcagagcatggatccctcctgattcctctctggccnnnangnnncttacggtcaagctgctcttgggccgaagatgcagcctgaaggtatctggaaaagaaagtgtggccacgctgaagaagctggtttctcagcacctgcaggtgccagaggagcagcagcacctgctgttccgaggccagctcctggctgatgacaaatacctctcggattacagcattgggc

SEQ ID NO: 9511 - DNA, 329 bp, Rattus norvegicus
atagtactcctatcatatgccatgatgcttccattggccagatgtgcactaaaccatctcaagattcaaagcattccgaaagttgtgggaagacagaaacactcaaagccctcatcaaattttcatgacaaatatggcaatatgatgctgttcagtgggtctgctttctgtctaggtgcatatataatttttatgacccagatgggggtggagtggaacctgtctcctgtgggcagagtcacccccaaagagtggaatgagtaactttctcagtacactaacagaattgtctcaaacctaacttgtcacggacatgttcttctgttcag

SEQ ID NO: 9512 - DNA, 512 bp, Rattus norvegicus
tcaaggatgatctggctgcggcacacgccaatggctgtgaggaaccaagtttccagatgaagctggatgcccatggtttcgctccggaggacttggtggtgcggatagatggccagaacctgatggtgaccggcaagcggcaacaggagtcgaatgacccgtccagaggccgctaccgcctggagcagagtgtgcaccgacaaatgcaactcccgatgaccttagatcctgcagccatgacatgcagcctgaccccctctggccatctgtggttcaagggacaaaataagtgcctacctctccctgaagcccaaacaggcccccaaacaggccaggccttgagattcaagaggggaagttctaagtgccccaacccaccttaacgaactaaacaaccgaggcgtgcagtagccttaaagtccctcagtgtttttccggagggtgaagagttggaaataagtggctacccgactcccccaaagtccaaacaggccagggcatgagactcagga

SEQ ID NO: 9513 - DNA, 227 bp, Rattus norvegicus
aagggcgcagcagtgcagagcatccctgtgtttggggccttgcgttcaacttcatccttgcagcggacactaagagacttgggtgacgagctcgccagacttgacctgcggcgctgggctagcttcatggacgccggggtggagcaggatgacatggaagagctgctgcaggagctacacagcctggcccagtgctaccaggagggcggcggcctttccaactgacg

SEQ ID NO: 9514 - DNA, 277 bp, Rattus norvegicus
atgaccaaggaggtcctgaagctgaaggaggccctgaacagcctctcgcagctctcatactccacaagctcgtccaataggcagacccagcaactggaaatgctacagcagcaggtcaagcagctgcagaaccagctggctgaatgtaagaaacaacaccaggaggtcgtatccgtttacagaatgcatcttctatatgctgtacagggccaaatggatgaagatgtccagaaagtcttgaagcagatcctcaccatgtgtaaaaaccagtctcaga

SEQ ID NO: 9515 - DNA, 254 bp, Rattus norvegicus
atgtatatggactggctgactgtgtgaatcacaccccaatgctgcggctctggatatcctccatgaagcaggaccccgcagtgtgcgctctgcacattgataagaacattttcctgggcttcttgaatctctatttccaaaacaacccttgtgcctttgattttgggctgtgtggcccaatcgtacggtaatccagtcattgcccaggattctcctcatatctgattctgcatcacgggtcatcttggagtcag

SEQ ID NO: 9516 - DNA, 316 bp, Rattus norvegicus
tttgattgccctctgtgtgaagaagtgaacatgactagacagcgtttgctggatcattgcaatagcagccaccgaggtcatgttgtgccagtcatttgcccgatttgtctctctcttccatggggcgaccctactcaactcaccagaaattttgttagccatcttaaccagaggcatcagtttgattacggagatttcgtgaatcttcagctggatgaggaaacccagtaccagattgccatcgaggagtctttccatgttaacatctaggttttcctcatcccgacaattgctcctacgggacaatttacatgaa

SEQ ID NO: 9517 - DNA, 356 bp, Rattus norvegicus
  misc_feature (325)..(325): n is a, c, g, or t
gaatctcaggaaaacgcacccagtttccaccaaaattaaaggtttatacggaataaaagaagaggtgttcctcagtgtgccttgtgtcctgggagagaatggcatatctgatattataaaggtgaagctgagccctacagaggaggcccagatggtaaagagtgcagacactatttggaaaatccagaaagatatcaagttttaagtcacccttgtaaagatattgaagacagaagacgcagtgatgcccagtgtggggtgactggagtctgaaagctggagcgcctccctttaggtctcctgttatgtagcacccagtggctgnggactttacagtttctgggtgacagcattaa

SEQ ID NO: 9518 - DNA, 436 bp, Rattus norvegicus
  misc_feature (202)..(203): n is a, c, g, or t
gggacaagaacctcatgctggccaccttgaagcaagagggtctcctctcccgttacaagcagcagcgcctgttagcagtgcttccctcgggagtgagtaagaagtgcagctcccagcctgtagagccccctgagtctgcagcagcttcaccgtgcaaggagtctatgaaaggctccctgactgtcctgcttgataacctgcnnggcctgagcgaggccatctccagagacgacgctatttgtctggaagataaccagaacactaagagccctccttccaatccactgctgggccggagctgtcaggaggaggagtgaagctagcctggaattggatccccaggagggttggatgggaggacatggggtggggccagcctggccctgctccccagcaagccttgggaccccagcttccaccaagttcaaactctgta

SEQ ID NO: 9519 - DNA, 478 bp, Rattus norvegicus
gtctcccaggtgttttggccaggaaccttcacgcaggaagtcatggttcgaatcaaggagctggccgcatgtaacccaattgtcctggaggaatccaaagccctggtgcgctgcaatatgaagatggagttggagcaggccaatgagagagagtgtgacgcactgaagaagatctggggctcggcccagggcatgaactccatgttaaagtacttacagaggaaaatcgatgagttctgattggcaggctgagcaggacaccagcgactcccacttgctacggtcgttcttaacagtagcttgtgtttggaggcagacctgggaacatccaggctatttattgccgacgcgtttttaagtactgtaactttaaaataactacaaggcttctttgtctaagcgtctttattttatactcatgtatacacaagtataaaaatgtaattgagcactaggctgctcctggaagctctaattt

SEQ ID NO: 9520 - DNA, 483 bp, Rattus norvegicus
  misc_feature (354)..(354): n is a, c, g, or t
gagcagatttatcacctacaggaacaactgaaatgtttcctgaaggagtaaggaaagcctcagcctagcacacaaagtggattaactttccagatgaagactcagggggaccacatacttctgtccctctagttactttgttgggtatttttttctagttagagtaaatttgaggatcatagttatatagaaggagacatatatagaaggagttacataaatgcataataagtttagaaaccccactaaataggggattttgtttctttttgtcaatttgggattatatgtatgcatttctttatcttttactctatggtaccatgagatcatccagccatctttgtcaaaganccataggtgttttacgtaagttagcttttcaaacactgttttaagtatttcctactgtattgaaaataatcaatttgtcagcagaagcagaaggtcaaattgaaggccaggctggcctttattgtaaga

SEQ ID NO: 9521 - DNA, 363 bp, Rattus norvegicus
  misc_feature (279)..(279): n is a, c, g, or t
tacagctcccaaccgtgggaagtttcaagaccgacagaacggggcgacaagggttatgtcccctctgtttttatacccatttcaacaatccgaagtgattccacggagccacagtctccttcagaccttctccccatgtcaccaagtgcatatgctgtgctgagagaaaacctgagcccaacgacaattgagactgcaatgaattccccgtattctgctgaatgataaatcaactcttcaaagaaggaagcagaggaaactagagactgttctttaccntagatcacaatttatttcttcagctttgtaaataccggtttctagaaaatgataggaagttcgaagctctcttctcacttggtg

SEQ ID NO: 9522 - DNA, 430 bp, Rattus norvegicus
  misc_feature (114)..(114): n is a, c, g, or t
  misc_feature (122)..(122): n is a, c, g, or t
  misc_feature (314)..(316): n is a, c, g, or t
  misc_feature (318)..(321): n is a, c, g, or t
  misc_feature (323)..(323): n is a, c, g, or t
  misc_feature (325)..(331): n is a, c, g, or t
gaacgtccaagggattgtacctcgatcttaccattggccccttccctggccggtagtccaccttagtaggcaagttaaatatagccggctggtaaacgacacctaacagcctcnccgcctangggaacgaacgaggaatggtccgaagtgctaagaactccgtgagagaagacgccatagagtaaccacctcccctgctatctctcaagttaccttgactgaacccattgagttatctgctcagcactgtgatctttttttttctctccaaaggacccgcgttggacaacaataaagaaaatttaccatatcannnannnnanannnnnnntgttgttaagcttggggcttctataccgggcagccaccatgtcccttgtgtcatccagccgcgccaccgtgcgcgtctgtatcctaagcgctggccttt

SEQ ID NO: 9523 - DNA, 149 bp, Rattus norvegicus
cttctgggtgctgagatgaaaggaattgtctgagtctcatttctttaccaagggatatactttgcatgtgatcccgtaaagtgtgtaagcaatcactttattaaccactcactttgctaatagtcatacattccatcagggccctttca

SEQ ID NO: 9524 - DNA, 379 bp, Rattus norvegicus
  misc_feature (349)..(349): n is a, c, g, or t
tgaagatctggcatacgtaccctattatttggatttatctgatcacaaatatttgctggaaggtgccactttatttaacaaagaggaacaccattactctgcagctttccagatcgacggacattggatgcactatgatggcctcagaaatgtgaatttaattttgttaaataaacccccagagtttctcctcttgtcatcattggtttatattcgagcaacagagaaataaatatagactgatgctgaattaaattgttctcccgcctgcccgtgctccccagaggaagggctcttgttctgtatatacttggtatccaaggagacagttcaactatactagtttcanagatggatttttcattgttttgccccaggt

SEQ ID NO: 9525 - DNA, 203 bp, Rattus norvegicus
cctcaatccagaaccgtatccggaagcaggattctcctgcaccagaactggaatgcaagcaagctacagaagaaaccaaggcactggctacagaggaactcaaggcacagggcctggacaaactgatagaaaaaatccagatgcacctgaaggacatttcatgcaaagacaacctccgggaaaggttccaagtatacgacaag

SEQ ID NO: 9526 - DNA, 476 bp, Rattus norvegicus
  misc_feature (176)..(176): n is a, c, g, or t
  misc_feature (178)..(180): n is a, c, g, or t
  misc_feature (310)..(310): n is a, c, g, or t
  misc_feature (423)..(423): n is a, c, g, or t
  misc_feature (429)..(429): n is a, c, g, or t
ttacacccagatccagaagttcagtcagcaaaagatgaaacttttggtgaatacagtgacagtgatgaaaagcctctcaagggaagccttcggtccctgaatagaaacatgcagcccacagagagtgctgacagtttagtggaatatggagaaggagatcagtccatattcaacgnannnggatcatttattggcgcctacacaggagctaaggagaaaggatctgttgaaagcaatggaagttcaactgccaccttcccactccgagcataagcacagcacatccatgcaccaaggctggctcacctgnacctctccagtctcttaaggggagcaaggccttttccacaggagtgaaaaatgtgtgtccagaggttgatattctgcaattttgctcagaaaaatagcactgccttccaaaanaaaaanaaaaaagaatcatatgccaagtacttcaaccctgtgtttcattttgg

SEQ ID NO: 9527 - DNA, 296 bp, Rattus norvegicus
ttgccatctatctcaggcagtgagagccagggtgttggttcttctgagctacccaggaagaggaggaaaagcttttgcctgtctgccctctcagatggtaacagtatgactcagctaccacacttcaagagaaaaccctctctcaagaagggggaaggcactcagcttccctgaggaggctgggcccaggagaacaagggcagggacaattcccctgacgatggctcttaaggaaggggacccagcttcctgtctgctctacttcatccctattcaaacttcagtgcattgcacat

SEQ ID NO: 9528 - DNA, 373 bp, Rattus norvegicus
gaaacacaacaaggctaagctccagcagctgcagcagctccagcagatgcaccagatgcagcagctgcagcagctccagcatgcccggccccacgtgcacaggcagccaaacatgggcaacctcggcatgccgccctctcggcctcagagtgcacagatgttagctgacagcaatgcagttccttcagggcaaaagaaagacagaccagtctcttctgaggggcgtctcctgcaggcgaatatccccacagacatgggaagtctgccgggtagccaacccgggatgaacctgcagatggatatgcctcctggggaggggatggaggagcccacccggggaccacggtccaccactgctcactgaacagacaga

SEQ ID NO: 9529 - DNA, 395 bp, Rattus norvegicus
  misc_feature (45)..(45): n is a, c, g, or t
  misc_feature (64)..(64): n is a, c, g, or t
  misc_feature (76)..(76): n is a, c, g, or t
  misc_feature (80)..(80): n is a, c, g, or t
  misc_feature (87)..(87): n is a, c, g, or t
  misc_feature (104)..(104): n is a, c, g, or t
  misc_feature (184)..(184): n is a, c, g, or t
  misc_feature (251)..(251): n is a, c, g, or t
  misc_feature (265)..(265): n is a, c, g, or t
  misc_feature (267)..(267): n is a, c, g, or t
gagacttagacgcagttggcaagcagtcctgcaggcttctgttantattgctcaggcggtatcntgagccccttcntctntggtgtnttggcaacccactgtgnccattggcatgctgcttcgcagtacaagccagaaagccaagcagactcccaaagcctgcagagggcacactacactgagntacttagagtgagggctggtgctccaggcttgtggttgttagccagtaagcgctccttgggaacctnctgagccaggtgcntnctctgaacctaggggctggttgacctaacctttgggcgagaggaagcaagcatggacagaggcagttgtcactagggaacccacattcctcaaagtcagcgtcttggctccgggcatctttcattaaa

SEQ ID NO: 9530 - DNA, 337 bp, Rattus norvegicus
agctgactacagattatgaggcactgaaaacacaacttcaagacaatgagacacatgctcagcttacaaacttggagaggaagtggcagcatctggagcaaaataattttgtaatgaaagagttcatagcaaccaagagtcaggagagtgattaccagccagtgattaaaaatgtgatgaagcagattgcagagtacaataaaaccatcatggatgctctccatagtgccagcagaagctgaaacgaagtccactgaatctacaagaatccacaagcatgctaaaagtaaattagcttcctcttgaagagttagaccccaggtttttaaatgccatg

SEQ ID NO: 9531 - DNA, 350 bp, Rattus norvegicus
  misc_feature (35)..(35): n is a, c, g, or t
  misc_feature (253)..(253): n is a, c, g, or t
agttaatcctacaaatgctttccagggactgggcnccaagctgcctccagtcgttggaatcgccagtaagcttaaagctaacctaatgtcggaaaccagtggtagtatacctctgtgcagtgtattgccaaagctgatcagctaatggaccactcagactcatacatacgtatttttaattaccttacagacatgcaaatggaaaaaaaaataattgaagcccattcaccgatggatatgtttttgttagacntttttttttttaacaaggcagaacatttttatatgactataaacaaatgcttcaagggctaatgtctaaccagcttgtattggccatctggagtata

SEQ ID NO: 9532 - DNA, 378 bp, Rattus norvegicus
  misc_feature (93)..(94): n is a, c, g, or t
  misc_feature (127)..(127): n is a, c, g, or t
  misc_feature (337)..(337): n is a, c, g, or t
tccctcttgacagtccttgacaggacagttggcaaaatgtctgcaactccagaaactgtcccttactctcttctgcctcttgattgtcattcnntggaacttggaatgcaactttttggtctggctnccagctttcaaatttctgatgaacatatccatctagcagtaggttctacatgaggttaagtaaaatatatctagagagtggggtaattaaattgacttctgatgaaaagcctttatagccaagtagccccgtagtctaaaggaactgtttcttgcctatgtctaaggatggcttaaaggttcaacgagtgggcaaggtacagaaaacctntatgcactgatccgatgactcggttgtctttgtactaatta

SEQ ID NO: 9533 - DNA, 410 bp, Rattus norvegicus
  misc_feature (74)..(84): n is a, c, g, or t
  misc_feature (86)..(86): n is a, c, g, or t
tgaggccttggagggacacaccacaactccagcagcgcctgaacagaaggaagaaaaatggctggacaggtacnnnnnnnnnnncncatcgaccaaagtgtccaatggggttgcaaccacttgggttggctgtgagaatggctcatcttgaggttgctgaagaaggggcccatgtgccccacattgctgcttttgacttctctccttctttttcctcttcttcctccgcttgggcaatacttcaaattcacgaagatccagggtccccagtgtcagctctactagctccaactctacttcggagccatcttcttcctgagactcggaacctagaaaaggatatgatctcagatctgtctaaggaatagggagagggtagaaagatgtgggcttcctcagatgggtttaca

SEQ ID NO: 9534 - DNA, 501 bp, Rattus norvegicus
  misc_feature (207)..(211): n is a, c, g, or t
  misc_feature (213)..(213): n is a, c, g, or t
  misc_feature (374)..(374): n is a, c, g, or t
accagtgtgcgacatccttcaaggacaacgacaccaagcatcactgccgggcctgtggtgagggcttctgtgacagctgttcatccaagacccggccagtgcccgagaggggctggggacctgcgcctgtccgtgtgtgtgacaactgctacgacgccaggaatgtccagttagatgtggctgaggcgcaggcagatgatgaaggcnnnnngntgatcgccaggaaggtgggcgaggccgtgcagaacaccttgggagccgtggtgacagctattgacataccactaggcctggtgaaagatgctgccaggccggcctactgggtgcccgaccacgagatcctgcactgccacaactgccgcaaggagttcagngtcaagctctccaagcaccactgccgagcctgcggacagggcttctgcgacgagtgctcccatggccgcagggctgtgccctctcgaggctgggaccatccagtccgagtctgcttcaactgcaata

SEQ ID NO: 9535 - DNA, 517 bp, Rattus norvegicus
taagctcacctatactcccatttttaatgaatatatttccctggtagagaagtacattgaagagcagttgctggagcgtatcccaggcttcaatatggcggccttcaccaccacactgcagcaccataaagatgaagtggctggcgacatctttgacatgctgctcacattcacggatttcctggctttcaaggagatgttcctggactacagagcagaaaaggaaggccgaggactggacttaagcagcggcttggtggtgacttctctgtgtaagtcatcttctacgccagcttcccagaacaacctacggcactagatccctccttcacacagtgggtgtgatggatatgaggtcaccagcccagcaggctcagagaaatatgggctaatgacagatgcatcctgcaagacccactgtgccacagcccttcgttcatgtgaagtattgacgagtcctggaaaacatgactgaccctcctggcccttgtcagaacctccttcctgtagtcagtaa

SEQ ID NO: 9536 - DNA, 532 bp, Rattus norvegicus
  misc_feature (306)..(306): n is a, c, g, or t
  misc_feature (344)..(344): n is a, c, g, or t
  misc_feature (365)..(365): n is a, c, g, or t
ttccaaggttctctggatcctgtgtgggtgttgaagtggtgtacgaagggggagaatctctgggatgggcagggcctttgaagagtgggggctggtgaaacacaagtttaggaatgaatttaaccatcctgagtcatgtatgaaattcacttctagaggtgaacccctgatttcctcaagcctcactcgggacagaaggcaccatccagttcagccttctgcccactttgcctgatccccaggcttgggtaccaggcttgatgtttgatcaaggcttccagactatgcagggcgggtgccagggantgggatgttgacagcaggctctgcagcatccactttgntcagccaccacccctcgctcnacctcttccagcaagtgagcatcctgatggcttcacctccccgtgaagctccagcaatgatgggcgtcctttctcatttaaaaatgtagattttagtattcaatgtttttatggtgggcactgaagcagttcttagagcataacatggcagtttgttctccgaggac

SEQ ID NO: 9537 - DNA, 274 bp, Rattus norvegicus
gggtgtgtgcaaacctctgtcctgcggctgggagatcacagacagcctgtgtgtgggccctgtcttcaccccagcaagcatcatgtgagtgggcctgctttcccagagaatcccagcggggccaaggagatgcctccggagaggtgggcgaggcagcgagctggtaccctctggccaggactctggtgctcgctctgccgccccacgctccacctgtagtgtttctgccctgtaaataggaccagtcttacactcgctgtagttcaagtatgca

SEQ ID NO: 9538 - DNA, 311 bp, Rattus norvegicus
  misc_feature (124)..(124): n is a, c, g, or t
  misc_feature (228)..(228): n is a, c, g, or t
gaagtcatcagcatacaggccacacaggaccagcaacggagtgaggagttggcccggatcatggaggagtttgagatgacagagcagccggagcggaacacaagcaagggagatgacttgctgnccatgatggacaggttataaacaagcagatgggcacaccctaggcctccctcaagagactgactgccttatgatcactgggagagacaaatggcctgcaccttntagtccattttctaagtcagaacaaactgtgaagatctctcagagagcatccatttctgaagccacacatgtttgtgtatttt

SEQ ID NO: 9539 - DNA, 329 bp, Rattus norvegicus
tcaataacatcctttggcaccttccgcccttggggaaaatttgccctcaacttctgtatagaacttcaggggagcagcttgcttacggtgctggcacccaatggcttctacctccgagctgaccgaagtggcacactattggcagacagtgaagaaattaccaaagaatgtatctgggaattttaggtcaatggaacgtcgcctgccaaactgtaaatcctccaggagcaacttctgaactgaaccgagcaggagacccagcgtcacaagaagaatatgtgctgtgcattttttttcctaccgagtttagcaaaacacctctttcaagt

SEQ ID NO: 9540 - DNA, 384 bp, Rattus norvegicus
  misc_feature (54)..(54): n is a, c, g, or t
  misc_feature (106)..(106): n is a, c, g, or t
  misc_feature (228)..(228): n is a, c, g, or t
tcaaggccgcaatcgcagaggagcagaggcgaagtgaaaaggccatggaggaanccgtaaagagaacaagggatgagctggtggagtacgtgagggagcagagaangcttgatcaagtcacccgccagcgtagcctgtccagtctggagctgttcctctcctgcgcccagaagcagctgagtgcgttgatagctacggagcctgttgacattgaatagagacacagcngatccgtcctggtcgttaagcctgcccactctgaagctgttcgtctcctgggcccagaagcagctgagtgctctaatggccatagatcctggtggcattgaataaagggcacgtgatgggctgccttgccctgggccattgcgtcagtcactagac

SEQ ID NO: 9541 - DNA, 403 bp, Rattus norvegicus
actgcccactgtcggcttagaagaggagctgtacgattgcctggactaccactatctgcgtgacttcccggcctccggggctggacacagcaagggccggacgcggcgcgaacagcagctacgcaccaactacacagtgcccggcggccacgagcgcaaggtggcacagatactgctcaacgggcaacgcaagcggcgccagcgccagatgcaaccgcggccacgcacacgcctcgcatgaacgggaacctgagacaggaggatcttgagttggagcccagcctggacaatattgaaacctggaagacctgctaaaagtattttccaactctaactgaggtcctccgtgttggtcaactggactttttgacagtgttttaagtttactgctctagtctttttt

SEQ ID NO: 9542 - DNA, 328 bp, Rattus norvegicus
  misc_feature (91)..(91): n is a, c, g, or t
tatcacagggccaggtcgtgtgttggatcatgacactccactttcacccaagtcaagctgtgaaatcagaacaaaaatatttgatgtgtgntctctccataactatctgtgatgatccaaattggtgagacatatgcccaggccctaccatgaaacacagtgttgtattactcttgcctagtaagaaatgtgtgacatgtaccttatgcacataaaagaaccatcaacagtgcagagcatccaatactcagagtgagagctctaagaaattgtgaaccttaaggatgagatgagtctatgaaacacatacctatgtagtcatctggaa

SEQ ID NO: 9543 - DNA, 544 bp, Rattus norvegicus
  misc_feature (385)..(385): n is a, c, g, or t
  misc_feature (401)..(401): n is a, c, g, or t
gaagccttccatgtctttaaggtgtttgtggccagcccccataaaacgcagcctattgtggagatcctgttaaagaatcagcccaaactcattgagtttctgagcagcttccagaaagaaaggacagatgatgagcagttcgctgatgagaagaactacctgattaaacagattcgagacttgaagaaagcggccccatgaagacggtcctgccctgacagccatttgtctccctggcccttgtgtacagtgttgtttcaaagtctctgttcttgggaaggctttgaaaaccctgaccttctcaactgattgttcaaggtcgatgaaatacaaacatttgagtggaaaaaatcaatctagaataatacattcattttaatcaagnctgtgattgcttatgnaatcaaccattatattaaatattggataaagacagtgtaagttcagaactggaccttaggtcacccaggacatcaaatcagggacacatgtgttttttgaacagaccatggggaggggacccatctgggtttttacacactga

SEQ ID NO: 9544 - DNA, 307 bp, Rattus norvegicus
  misc_feature (83)..(83): n is a, c, g, or t
  misc_feature (258)..(258): n is a, c, g, or t
acaggtgatagtgcgtgtctgcccactcaggccctgtgcgctccgtgttagtgtagcctccacgcattggcatgcagctcttnactttaatgctcaacgtattcccaaatgtgatgtttcagagatgtattcctcagtatccatgtgactacctgtttaaaagttggtttgatgctttaacagcacttcccatgtcctgctgccccttgttctcagagaccctcctctcccacccggtctactgactcattgccaccntagattgtccacagggatcagaggtacttttcttgtaacctgcagggag

SEQ ID NO: 9545 - DNA, 120 bp, Rattus norvegicus
cctggcttcactgggatatctcggggagggggcgcttggggcccccaggtgtcttccaaaatggctaagaacaaggacttgccagaaagttcatctgcacccatcagagtttaataaatg

SEQ ID NO: 9546 - DNA, 311 bp, Rattus norvegicus
  misc_feature (100)..(100): n is a, c, g, or t
  misc_feature (180)..(180): n is a, c, g, or t
  misc_feature (224)..(224): n is a, c, g, or t
  misc_feature (233)..(233): n is a, c, g, or t
  misc_feature (245)..(245): n is a, c, g, or t
  misc_feature (252)..(252): n is a, c, g, or t
gagcatggtccatcagaaaaggcaataaatggtccaactagcgcttctggcgatgaaattcctaagctaccgcgtactccaggagaagaaaagactaaanccttaaaagaagagagcactcaagaagcagcagtcctgaatggtgtttcataactgaaggaagttcctagtttacagttnttttacattacagttacaatagtgcttgtacaagcttgccaaanatagaatanggatcgccagtnttacatngcactttcagttcctccatttggaattcagaaaggggagggatcctgacgaaatcatat

SEQ ID NO: 9547 - DNA, 381 bp, Rattus norvegicus
  misc_feature (246)..(246): n is a, c, g, or t
  misc_feature (311)..(311): n is a, c, g, or t
  misc_feature (315)..(315): n is a, c, g, or t
  misc_feature (333)..(333): n is a, c, g, or t
  misc_feature (342)..(342): n is a, c, g, or t
  misc_feature (348)..(348): n is a, c, g, or t
  misc_feature (356)..(356): n is a, c, g, or t
ggaaacgtcaccctaggagcattaaaacttccttttggcaaaacaacagtgatgcatttggtggccagagagaccctgccagagcccaattcacaaggtcagagaaaccgggagaaaactggtgagagcaactgctgtgtgatcctgtaacatcgtcgccagcgcaggtgtggcagtctgttaccactgcggggacagaggagactcggcagcttccgacacctgtgggacagtcgcccgcacatncagactgaaccactcatgagctctgtgatctctcctcacaaagtaaaaagaaccaagaacatttncagnctgggcctttattcctgnatctcttgnctgtgntgagcagnctgaaatgcacagtggtctccaggg

SEQ ID NO: 9548 - DNA, 420 bp, Rattus norvegicus
gaaaaggcctttgagcgggcttccgacaagctgtttctcttggaccagtgcgagaagtatcggcgctgcaggcagtgccagaggcgcacctccaacacgggcgagagcaacgtgtggcccctgaataagttcctgcagggctcacgactgctcgtgtagaactcaaagtttgaacctatgtttcccgagggacatttatttggagttgttgaatatttagggtgtgtatatttgtacctcagaggaaaaaaaaagattgagtactttctaaccctttcttgaattcacattgactaatgattccctgtgtgtcccatgttactctcacccctgtgtttttattcctcgaacttcgctctgacagcagtgaaggtattggaataattcttagcctagaccccattgctatagcggttgtga

SEQ ID NO: 9549 - DNA, 206 bp, Rattus norvegicus
aaaactgctctggtacaagcgcctcctgctccagtaacagttacagaaaccccggagccagcaatgcctagtggtgtatacaggcctcctggggcaaggctaaccacgacaaggaaaacgccacaaggaccaccagaaatatacagtgacacacagttcccatccctgcagtccactgccaagcatgtagagagccggaacaggta

SEQ ID NO: 9550 - DNA, 261 bp, Rattus norvegicus
tgggctacatacagcgtgtgactatcttaaagacaaaaacaaagcaagccagttgtagtaccacaaagctatgatcctggcacttggaaggaagatatgaagctcaaggtcatccccagctacacatggagttaaaggtgactggcgggcactacgtatggagttattaaaggccagcctgtgctacatgagaccctgtcacggcatcagctgcttcacagaagagcctttctcatgctcagtgattaccacataggttct

SEQ ID NO: 9551 - DNA, 443 bp, Rattus norvegicus
  misc_feature (137)..(137): n is a, c, g, or t
gaagaagtgctcagggcccaggcttatatcttattctatacccagcgagtgactgagaacggacattcgagactcttgcctcctgagctcctgtccaacagccagcagcaccccagtgaagaaacggacacctcttntaatgaagtcctcagctgatccagaccgtgggctctcgttatttgtatatatactttttaaatgggctgacctacgatgctgggcttcattgtttttattctgtaattatgatcagtgcctgctgtttacacattgtgtatttaactacaaagtttttctttttttacagagacaaactataaatatatgtatatcaactataggccaactaaaacttttttcaaatatttgagttttatacttttagtgtttacctcaatattattacctcttatattttgatgtcttaattgcctcaaatcatg

SEQ ID NO: 9552 - DNA, 525 bp, Rattus norvegicus
  misc_feature (220)..(220): n is a, c, g, or t
ggagttcagctctgagtcctcgagagggatgtggctccagttggtgggactctagtaaggactttgagagcacattttgtgaaagtatttatctaaacaaaatacttacccactaatgtccggatgaccatttgaggatgaagacatcttgataattagtaatttttcaattacctgtccgacaccatcatgtgttcttaacatgataacttaaaaaaanttaacatccttggtaatttcttgagtctcgagactaaagaaaacattgccgtttacttattttgtttacattttaaatgtgcccctttagcaattggaagaaggtaaattgttcttaactagaagaggtttggaaactttatttcatttgttctgtccccccatttccagtctcacggtactctattggaaaaatgcagtgccattttaaaactttgctaagattttccagagacttcttttaaagctccttttgcccataaacattttcgcaatacattgctttaatgcccacatttccatatt

SEQ ID NO: 9553 - DNA, 502 bp, Rattus norvegicus
tagatgcccacgcttggaccaaatcacgcaggcccatcatccggcccaacagtggcttttgggagcagctcatccattatgagttccagttgtttggcaagaatacgatgcagatggttaactctcccatgggactgatccccgacatctacgagaaggagacccgtatgatgattccactgtaagccagcccgccagctcctgaactggggtcggccgtacagctcttgtcattaacagcaccccgaggtctaaacctgaacattctacttttgttgctacaggagtacaccagatggtgcttttcataagggcaaggaaaaagcgttgctatgacatttaccctcgtaatccagccaggtttggtggtacatgcctgtagcctcagattgctgaagcaggaagatgacaaggtgagtttgaggccagcctaggctatatatgagaccccgtctcaaaaacaaaaaaccaacaaaagaaaatccccaacaagtgctatcct

SEQ ID NO: 9554 - DNA, 302 bp, Rattus norvegicus
gaaaaccactcagaattttctctggtccttaacagaaaagaatcaaagtaggaagcacagtagctgccacatctgttcaacctctgggcctcccaagtacaccagagaaaacagatcaatgctgtttctgaatgattctgctggttaaagtcatttatagaagattcacgatactgaacaactatgggttaagaacttactgtgttttgtgaattgcccaatggagagagtgtgttcaaggatgactcttgatcagattacacagtatgtgcatccaggaggccacatgaaatcagcatagt

SEQ ID NO: 9555 - DNA, 338 bp, Rattus norvegicus
  misc_feature (62)..(62): n is a, c, g, or t
tgttgtctaagactctgctgctcatcctcggtgtgctgttgctgctgtccctagcccagggnaggggtccagcgaaaacggagatatgaagtccaaagtcgctccgaggtcaaggagtgcgagaggaagcccaaattgtatctgtgcagacgccactgtgaatcggaccaagattgtcaagccaataacatttgctgctccaccacgtgcgggaacgtttgcgtgaacctgctggataatagtgtgtgggagacgcctgtcacccctcccccggacatcgtctacccggagagcggctcccagcccagctttgaaggagatatggttctgcccacgtc

SEQ ID NO: 9556 - DNA, 464 bp, Rattus norvegicus
  misc_feature (266)..(266): n is a, c, g, or t
  misc_feature (345)..(345): n is a, c, g, or t
  misc_feature (359)..(359): n is a, c, g, or t
  misc_feature (372)..(372): n is a, c, g, or t
  misc_feature (376)..(376): n is a, c, g, or t
  misc_feature (381)..(381): n is a, c, g, or t
  misc_feature (389)..(389): n is a, c, g, or t
  misc_feature (400)..(400): n is a, c, g, or t
ctctgccggaccaaaaatttctatctggagaacccctgagaacgaaccgggtgcttccagcgattccaagccagaggggacatgacccaccagctgaagagagcgagtggtcctccagtcccacccatgatgaaaactgactgcaggttgctctgtggaaatatagaagactttaatttttcaactttccaagggtgagattactctagtttatatgagcaaagtcttaattttagtaagctgcgttctacaagccacttacggtnttataattcaaggttcctcatttcaaataaatacacttcctaaatactcacttagaatctccaggtgtgcaaacatcanccagtctatgagtntctgtggaccccngccntcaanacactgtnattcagaaacnaaatacacacctgaaaggaaggtttaggtacgtttcatttatgtttgtgccatgtttgctgctt

SEQ ID NO: 9557 - DNA, 342 bp, Rattus norvegicus
gaagtgtacttggtgctctgggtcattcgcaaacaactaagagagctggctcgcaggcaagagaggcgcagacggcgccgtatgcggtctcatgcctcccatacttcccgtcactccgaatcagtgcagggcctcaaacatgatgcccgaagtcccctctaggcaggggagccccagatcctttgaaagtctccacctcactcttacggaaggttgacaggaagggttcagtggccgtcaggccagaactgctggtgaggagaccatggtgtcatatctcactggaaccccaagaccaggcctggggttgaacacgctccccttctctgtgtttattcaaaa

SEQ ID NO: 9558 - DNA, 442 bp, Rattus norvegicus
  misc_feature (216)..(216): n is a, c, g, or t
  misc_feature (361)..(361): n is a, c, g, or t
gctctgacacacagtcggatgatgtgccggacatcacctcagatgagtgtggctcaccccgcccccacactgcgggctgcccctccaccccccgagtccacggtgcaccgagcccaagtgcccacaagagcctcgctgctccagccgagggccagactgtcttgaagccagaagagtatgaagtggagtgaaggcccctgctctgagaagcacacntgttgtaactgcatcttttggaatcttttttgggggagggtggggatttatgtattttgtttcaaagattctctggtcagggttcccccaggggagttctgagaaatttgcaatttcttaccagataaaaaatgaaatttgcctntagtatccctcccccatcctcttgtttttagttttaatttattggctaaactgatgttggcaatctgtgaggtgtgtcaaa

SEQ ID NO: 9559 - DNA, 418 bp, Rattus norvegicus
aagcagcgctgagtgtcttgagcctgttgaaaaagctacaggaagatcttggaagagggatgctctggctctgtgtgcagaaggatgactgccttgctcgagggaatcccctgaagccttagctgccaaaagaatcattctcagtggccaagattccgtcagcagaaccatttcctcagaccttttcctgatcgtgtcagtgggatactcaagccatgcgctcacagccttcattttataaccttttgatattcatacttggtgatcaaaactaaactcgaggtggttgtggttttttatagttttaacaatgtatcttttgtatagattttttaaatctaggatggtaaattcgatgtgatttttcctttttttaaatctgagattggttgaatttgcatatcatgtactatcctcc

SEQ ID NO: 9560 - DNA, 424 bp, Rattus norvegicus
  misc_feature (137)..(137): n is a, c, g, or t
agtggcttcacaagctgtaccaggagaaggatgccctgcaagagatgtacaagcagagcggcgttttccccggggagcagatcaagcctgcgcggaggccgtggactctcctcaacttcctgtgctgggccacattnctcctctctcccctcttcagcttcgtcctgggcgtctttgccagtggatcccctctcctcatcctgacgttcttggggtttgtgggagcagcttccttcggagtccgaagactgataggagtgactgagatagagaaaggctccagctacggcaaccaagagcttaagaaaaaggaataattaacgctgtgattgaacacccatatcctgacgcggtatccaattaactcaattaaaacagaacacccaagagcgagggaaagagacacttagagactatttttctt

SEQ ID NO: 9561 - DNA, 98 bp, Rattus norvegicus
  misc_feature (38)..(38): n is a, c, g, or t
gaaaaaagccagtataggaagccttgaagagaaagctntgaagagtagagccttaatgcagagaggaacacgtttaatgttgaagcttttgcgaaacc

SEQ ID NO: 9562 - DNA, 129 bp, Rattus norvegicus
gaaccacttcagagtctaccatgacatcactctgtacaaagctaaactgtggagcttgggagaagacgatcaccagaagtaatgttctcttggtggcatggacctgcacactgagttcccaatgcatgt

SEQ ID NO: 9563 - DNA, 162 bp, Rattus norvegicus
tccaccgcggaatgatgagcgttttcgtctggtactagttcatcaagggcgaagaaaaacctttgtttgctaagtgtcttcataacatgcatagccctcgaagtacggaataagcagtttcgctaacaagtacctattcacaggacgtagatttcgtaaccc

SEQ ID NO: 9564 - DNA, 126 bp, Rattus norvegicus
ctcggaaccgtgtggcctactttagcctgtattacaaatgagaagtaggcactgtcttcatgtgttcttgaccacagagtctccagaattgaggacatagctgctcttgtatttctgtgttcctgg

SEQ ID NO: 9565 - DNA, 170 bp, Rattus norvegicus
  misc_feature (66)..(66): n is a, c, g, or t
  misc_feature (114)..(114): n is a, c, g, or t
agcaagaagagaagtgtcatcccacagatcatcatcacccgggcctcaaacgagacgctcatcagntatggcatccccgacagcgatgaacagagaaccattcgggagcatgcngactggggcccatactaccgacacaggagccccagcacaatagcagcctatgaggt

SEQ ID NO: 9566 - DNA, 226 bp, Rattus norvegicus
  misc_feature (98)..(98): n is a, c, g, or t
  misc_feature (187)..(187): n is a, c, g, or t
ctgtcttgtgtaccatctcagagttgattattgcaatcacagtgctccactggttcatgtcatcgcgtaaaaataaagtaccctcaaacgaaattttntcagaaccaccaccttcaaaaccaccatctctactcgacttggaaaatgtctctgaagactcctaaccaaagaaaatagaagatgaaantgatgtgacttaactgaagagcccttcagtcacatcctt

SEQ ID NO: 9567 - DNA, 203 bp, Rattus norvegicus
gaacacctgttcatccgagaaacgtcagcatcactaccagtcccctgcagtccccagttcatgagcagttccttcagccaaactttgatgacaaggaagagaatctcgaaaacatagcaccacctcagggatcatttgcaattctgagtcctactaaatcctcattctctgagattcctccaggcactaacacttgcagtcct

SEQ ID NO: 9568 - DNA, 258 bp, Rattus norvegicus
atgctgtcccaagagtcaggctactcagcactacggcattttgcacagtgcattttgcacacccactggtgggcctggcttatgccctcagaacctggagtgcttgagtgtcccaggtcaaggcaccctagaaaagacaccccgagtttgcctggcctgatccccttctctagggaagacctgtgacgtgagcccaagggctggtgtacacttgtttactatgtaagcaagagtagaatgtctagttacagtggagcc

SEQ ID NO: 9569 - DNA, 257 bp, Rattus norvegicus
gttctgcagtcggtgcttaggtatgagaaggagcgacagctggatgaggcagtgggaaatgtcacgcggctgcagctgctggactggctgatggcaaacctgtgattggggcccacccggtgttcctgcagtgggccgagtccctgccctctcagcccctccctgccgcacagagccctaaagttccctccataccacccacactagacacgccatctaatgctactcactggattttgcagattttcttgtccatg

SEQ ID NO: 9570 - DNA, 294 bp, Rattus norvegicus
atgagagtccgcagaaggctttggattctgaccccggtagcctcaagcaggctttggatgatcagaacattgtggagactgttctggacttggaggaagactacaacttgatgacctctttcaaataccaaatagagtgaggagagtcagcagccacagtggttctcacaaggggttggcagagcctgaagccacccctgtcttaatttctgctgaatcccattttgagctgagagcccaggttttaatattgttattttgaaatgtttggagtgttttggacttgacattttt

SEQ ID NO: 9571 - DNA, 243 bp, Rattus norvegicus
  misc_feature (26)..(26): n is a, c, g, or t
  misc_feature (41)..(41): n is a, c, g, or t
  misc_feature (117)..(117): n is a, c, g, or t
  misc_feature (140)..(140): n is a, c, g, or t
  misc_feature (182)..(182): n is a, c, g, or t
  misc_feature (190)..(190): n is a, c, g, or t
gatccttcggaaggaccaacagcgtnctagctctcctgtgnttgggagccggaagtggggcagtgcctttggtttggctccttgtccagagctgagctttatcacagaggtcttccngcttaccatcaacattgaaactnacctcttcgcttgggtgtattctccctcttttgtgcacagtntggttccnccgaactgctctccctgtgaaggcctgtggaatgcagggagcctggccaacca

SEQ ID NO: 9572 - DNA, 281 bp, Rattus norvegicus
gctggagctgctcacaatcactggggatggctttgactcccagcgctataaattcctgaaggcgctgaaagatgaaaaattacaaggactgaagacgaccaggcaacctggaaagtcggcctccttctcctgaggagctgcccccgccccggagctgggcagccgcctccttaggtgttagtgcttagataatgtgtcctagttgttgtcatttcaaagatggttattttctgttctgtatttactactgttattgttgctctcagcacatgcttcacata

SEQ ID NO: 9573 - DNA, 277 bp, Rattus norvegicus
  misc_feature (26)..(26): n is a, c, g, or t
  misc_feature (118)..(118): n is a, c, g, or t
  misc_feature (131)..(131): n is a, c, g, or t
  misc_feature (154)..(154): n is a, c, g, or t
tgcagaaatctggaaccctcgagagnccgtttttaaggacgtcctgctgcagagacccaagtgcaccccagacatggctgttgagctcaacatccctacgcaggagctgttccctttntagatagcagtgntgcctcctctcctccctcctctnttcccagcaccaggggttttggctattgacttacaagatggcgtctctattataaatctgatccacagccctcctctacccatctcccttgccgcttggactgagcaggaatccccagtccag

SEQ ID NO: 9574 - DNA, 288 bp, Rattus norvegicus
aggcccaccgagatatctgtcccaactcaggcttcctccgacagctccaggttctggacaataggctgaggcgggaaacagggagactctgaattagggagcacttgaagccctgactcctccatccagcgtggcctaacctgacttacctggccctgggaatggcagccttggctgtttccagagtccctgagatggcaccagcaagtcagggctccgctgaagcagaggcagggtgggctgggtggcagccctcaacaagtggagtcccctgacacagcagagaaa

SEQ ID NO: 9575 - DNA, 302 bp, Rattus norvegicus
aacttcattagtggcatatccgtggttagccctcagagagttcagtgacgtactcttatgttcagaagtaaccaacaagatgctcttttgtagggagtgtttaaaaaagaagacgatgtggacatgcttggtgaagagttcaggaaagcatatcagaaaaagagtgaagtctgtgaagagaaggggtcttcatagcaagattgggcgaaacctggagttttcagatgctgccactagatgtcagcacaactgctgtttccagttggtgacagtaggccctggtctactgtctatttgcatgt

SEQ ID NO: 9576 - DNA, 290 bp, Rattus norvegicus
aagttgagagactcactccacttccagtacctgaatctgtgtctcttcacacagaacttctacccagacctctgaaggctgctggctccccacaaccctgcagcatccttgtggctgcacaaatctggttcctgctgttatttatccccgaagctccacagtgggccccagggtgagcaaccaggcctttaggcgtttttcactcagggtttactttctagatacagcccccactccttagtttaccatctgcatcttttcctcagcatatctggccattcattgttact

SEQ ID NO: 9577 - DNA, 305 bp, Rattus norvegicus
  misc_feature (249)..(249): n is a, c, g, or t
tggcccaacagaatcacccactgtggggcagatgcttcataacaccagacagaagaactggtatgaacagaaatgctcctcaaaggggtattcaaaggagacactcattcaacctctcaaacaactggattaagctatgcagcctcaggagaccctgaaggttctagaggcagcaggccatggtctctgagctgtgcagctgctggagggtctccatgaggatgaagaaggcagtggacaggagtcatnaagactgattcagaaactccaccgcaaggagggaagaggtctgagccatccctgtg

SEQ ID NO: 9578 - DNA, 318 bp, Rattus norvegicus
gaactttttctaagactctggatggaaccaatccagaattcttgcagcaccagtgtaccacacagatggcagcaacctcttcccaactacacttgctgccatgggtcctctaaagatcagacctataggtaagccgggcctggtgctggtgatggccagactgtgcctcctgccagccagccacctattcagacctaaagcccttgctgtacctgctccccaggggtctcttccacctgagctttagcagccaacccccaacttcattgtaaacccaaacatgatgaaaaattctagattttatgtcttcctttgatg

SEQ ID NO: 9579 - DNA, 321 bp, Rattus norvegicus
agccttctctcctgatgagctaaagctggccagtgctggttactctcgtatggtcaaagtctgggactgcctcacagggaaatgccttgagaccctaaagggcatgctggatgtggcccatgcctgcattttcactccaaatggcaaactcttagtgtcagggattgctgacgcgacaagatgacaagtctgctgaaagtcaagaacttcatccatgtaacttacccacaggcctaaggtaactaagccaccagatctccaaggcagggactaccctagcctatcccgtaaggtggttgtcacctgctgtaggcaagcgat

SEQ ID NO: 9580 - DNA, 372 bp, Rattus norvegicus
aaataccattggtccttctgctgtggcttcaacaggtagcctggtaatcacctgtcctcctaacctcagtgaccttaaagactccagcagcaccaggaaggccagggtgctgtacgattatgacgctgccaacagtacggagctgtcactcctggcagacgagtaatacacaggttgacgtgtaccgcctccctgatgtgaagcatgcagtacttctgaaacagctcgctggccagcagtgcaccacttgagaatttataagaaatgcaaactctctgatccctgctgaataagaaactccagggtggagtacagcaacgtgtgttttaacaaaccctcagggaacatgatgcatgtagaacctggtgaacc

SEQ ID NO: 9581 - DNA, 348 bp, Rattus norvegicus
  misc_feature (28)..(33): n is a, c, g, or t
  misc_feature (190)..(190): n is a, c, g, or t
  misc_feature (208)..(208): n is a, c, g, or t
atgggacgcactgccctcagagaagagnnnnnngtcgtcgtcatacctgagtcagaagcaactgcctcacgtaatcaacagcacacaagacacctgttcgtccacagccagcactgacaatcgagaatcagaacagacaccatcatagcctacccacaatgcccctttccccgtttttccattctctccntcctccctttcccacagntcttgctgtgttacccaggctggcctctgacttcaggttcctaagtgctgggatgtcaggactgcctaaccctgcagataccacaaccccttctgagatgagctgagggagatcagtacttagtaaattgcagggtccct

SEQ ID NO: 9582 - DNA, 319 bp, Rattus norvegicus
  misc_feature (120)..(120): n is a, c, g, or t
ccggttttgacggtgctgcaagcagttgccggaggcctcttatattatgccttcccatacattgtattggtgacatctttggctaatctggctgtatatctggtttttgtcaaaataganagctacagtgatctgatgaaaaaggacagacttcttgtcctcttcagccactggtttcttcacgcctatggcttaatcgcactctccagagggcagcaacttgaacaagatctgctccttttaactttggtgcctttccccactcttttttactttttcactaccaaatttaccaaaccgtcacggataatctctgaag

SEQ ID NO: 9583 - DNA, 401 bp, Rattus norvegicus
  misc_feature (28)..(28): n is a, c, g, or t
aagttcgtcatctctatcgacactatcncctttgatttcaaggtactgtcctacgcatcatcagagattgcggaaaggcccagtacggggtgctatatctacggactgttcctggaaggcgctcgctgggacccgttcgatttccagctggctgagtcccggcccaaagagctgtacacagagatggctgttatctggcttttgccagtagctaaccgaaaggtccagaaccaggacttctacctgtgccccatctacaagactctgacccgtgctggaacattatcgactacaggccactcaaccaactacgtcattgctgtagagatccccagcaaccagcctcagcgacactggataaagcgtggtgtagctctcatctgtgccctggactactagac

SEQ ID NO: 9584 - DNA, 369 bp, Rattus norvegicus
  misc_feature (316)..(316): n is a, c, g, or t
  misc_feature (334)..(334): n is a, c, g, or t
gaacaggctccatccagcagtgtgtcagccatgggtatgccttttctcaagaagaacatgggtgtgttacacaggaggaagtagtccgttgttatgacaccaccaaagagaagtcaaggaagaagtaagagtcagagtttcctgatggctccaaggaaagagattcggtttgttgcacgcaatgttaacggttttgtcaggaaagactggcgccagcagctggacaccagaaaacacatttctgtggccttagccgaccagtttgttagcagctctctgtccctgtgcggtcccagggcataggcgtcaagggaanccattctcccagcttgtntgcagcgcttggcccaacatctgtttaccttgtta

SEQ ID NO: 9585 - DNA, 451 bp, Rattus norvegicus
  misc_feature (164)..(164): n is a, c, g, or t
tgttggatcagggagcgctgctcatggggaaaacaaatctggatgagtttgccatgggatctggaagcacagatggcgtgtttggaccagttaaaaacccctggacgtattcaaagcagtacagagaaagaagccggcaggatgcacaggaggattcacactgnctgataactggaggaagctcgggcggcagcgcagcggctgtggctgcgttcacgtgctttgcgtaagatgctttggtctgtgcgttaagccccgcccaggcagcggtcacgtgctctgcgtaggctgctttctgtaagccccgcctaggtacacatggtcaaactacatgcaaaacccagtgacactggaattcagaccctggtccctgtatttcttttgggtgagctgtttgtgttcaaaggtatattgaaccgccaagggtactcaactttagcctgccatgtga

SEQ ID NO: 9586 - DNA, 465 bp, Rattus norvegicus
  misc_feature (111)..(111): n is a, c, g, or t
  misc_feature (179)..(179): n is a, c, g, or t
  misc_feature (181)..(181): n is a, c, g, or t
  misc_feature (183)..(188): n is a, c, g, or t
agtgccacatggttaatgctaccccctttaagactgctcggagtcagatcttgaagatactctcagggaaggtagtggtaggacatgccattcacaatgactacaaagccntacagtactttcatcccaagtccctcactcgagacacttcccaaataccgctcctcaaccggaaggcngncnnnnnngaaaatgtcactttgtcactgaagcatctcaccaagaagctgctgagtcgggacatccagactggactaagtggacattcctcggtggaagatgcccaggccacattggagctgtacaagttggttgaagttgaatgggaacagcatctggcccagaatcctccagaaaattagcagtcccagggagacacatgcagtaaaccaacccacagttctgccagcttctcacctgtagaagctggaatcattggggagaggagcttgaccagagacttaa

SEQ ID NO: 9587 - DNA, 453 bp, Rattus norvegicus
  misc_feature (328)..(328): n is a, c, g, or t
  misc_feature (332)..(332): n is a, c, g, or t
  misc_feature (341)..(341): n is a, c, g, or t
  misc_feature (346)..(346): n is a, c, g, or t
  misc_feature (372)..(372): n is a, c, g, or t
gaacaagcacccgtttgccctttatggctggggagagagacagatggacatggggagccagaagacacacaatgtctgcgcatcggcctctgtgcatgagattcatgagtcagcacttcgagccaagaatagaagacaggtggagaaaaggaagctggctgcccagaggcagcgggctcactcggtggatgtggaaaagaaccagagggtaaagccgtcgtctgcggagaacccgtggctgacagagtacatgcggtgctactcggcgagggcgtagatcctggggcatcctctttcaagtgttcgtgccagcgaaggaaaacagaanctanctaatgacnccacntacgggtgggagagactgactggtcntgcaaggcggctccccttaggaaattccaagagatggttgtgctttcctgatggttggtcacctgccttagtggtaggaca

SEQ ID NO: 9588 - DNA, 549 bp, Rattus norvegicus
  misc_feature (285)..(285): n is a, c, g, or t
  misc_feature (316)..(316): n is a, c, g, or t
  misc_feature (348)..(348): n is a, c, g, or t
  misc_feature (368)..(368): n is a, c, g, or t
  misc_feature (476)..(476): n is a, c, g, or t
  misc_feature (510)..(510): n is a, c, g, or t
  misc_feature (522)..(522): n is a, c, g, or t
  misc_feature (524)..(524): n is a, c, g, or t
tccttccgggccatcagtgaagagtaaggagagcccagagagggaagagcctgtaagcagggctttggttacagtcccccaacgaagcactgcagctggcctctctacaggccggcaaggccggcagcactgttggaacctccgccttgcagctctccagttgtcttccctccctgttcccagtggcaagagtacagcagctgctaacacactgctccattacttcagtaaggatttcctttcgcgtcttatgtctgcttgactatatgcttcttcctccatctntaccccaggcagggcctccccctggacggcntagaactcactgcgggcagactggcctcaganttgtaggatagtggatcatnccaggaaatttggtaaggtggagtggggtctgttccccaggcatacacacctgagatggtatgcagctctgctccctgccaaatccctggcctgccagacttcccacntaagaaaacatgaggcctcaacagttctccatgntaatgaggtacntngaggccctgcaaaaggtgtctgatc

SEQ ID NO: 9589 - DNA, 240 bp, Rattus norvegicus
  misc_feature (122)..(122): n is a, c, g, or t
  misc_feature (153)..(154): n is a, c, g, or t
  misc_feature (161)..(161): n is a, c, g, or t
gaacataaggtgtctggaacctcagcatctggttaacctgaccttggaaaatgcctctgagtgtctgacccagcactgacagtggctgccagccccagccttggcaggggccagaactcaantgcgctgtggcagcctattcctctggagatnntagcagntgcctgcttcaggtcacctctcccactcccgtggagcccaggctgggcctgggcagggagatggactttgtgtaagata

SEQ ID NO: 9590 - DNA, 188 bp, Rattus norvegicus
  misc_feature (52)..(52): n is a, c, g, or t
ggcagcagcatgacggatggcactcctttggtgaagattaagcagagcttanccaagctgaagcaagaaactgttcagatggacattagaatcggggttgtggagcacacgctgcttcagtcaaagctcaaggagaagtgtaacatgaccagagacatgcatgcggctgtcaccccagagtcagcaat

SEQ ID NO: 9591 - DNA, 339 bp, Rattus norvegicus
atagtggagacacctgccttggcctctgagcggcagaggacccaggagtcgcctaacatgccagtgcctccactctccatgctgcgcatcaagtccgagaatggggaacaggccttcctgttaatgatgcggcctgaggacaccattggtgacgtgcgaaacctcttagcacaggccagggacatggattcagctgcctttgaaatcttgagcaccttcccacccacagtctaccgggatgacacagtgactctgcaggccgcaggcctggttcccaatgcaacactgctcttacggactcgcagggttctgccagcgaaccccagctttgggactgat

SEQ ID NO: 9592 - DNA, 302 bp, Rattus norvegicus
  misc_feature (236)..(236): n is a, c, g, or t
gtaggcctggtggtcatatcagctctgctctggtgctggtgggctgagacatcgtcctaaccagaacatgtttgggatgtggaagcctatggtattcttggctattgcagcagtagctctgtatgtgttacccaatatgcgaccgcaggaaccagaattctacatgaattgatggcagacctggaccagcccagagggcagatccccagaggctaccaccctcacctttgggcagngtacactgtgccagaaccccccaccccatcagtgtttctccatctcctttgcctcagtattcaaga

SEQ ID NO: 9593 - DNA, 396 bp, Rattus norvegicus
  misc_feature (161)..(161): n is a, c, g, or t
  misc_feature (237)..(237): n is a, c, g, or t
  misc_feature (315)..(315): n is a, c, g, or t
agtgggcctgtctgtggagcaccacacctaccgactgcagggtctgcaagccgtgttggccaaagacggccatgagatcatcctgcaggagatagaagactggaatctggtggagctcgtggtgaacgaggagacagtctttcaatgtgacatccaagacntggagtttgggggtgatggccaactagacccgctgtgtgaagaggccaggatcgccgtgctagacgccttctgatncgggggagcggacggaacgccagcgatgtcctccagtctacagcaccagcaaaagatgctcagtgggcacgtagacgntgggctctaccagttagaacaaggcaaggccacctgtccagtagcctgtcgcgtttgtgtttcttatctggctacataggc

SEQ ID NO: 9594 - DNA, 371 bp, Rattus norvegicus
tttaagcctctggtactattagttaatctctgccactagagcaggatggaggtaaaagcctccctgtcagcctcttaaaagagaatcctgtcttttaaaaggtaaccaaaacgtttgttgacgtgattaaacttgcttttaacaaatgttctttaaaaaaggaaatgaactagacagaggagaagtgcatgcaccctttaagccctcttcctgtcagcggagcctgcaggcctgagttgtttcttgagccttgataccttatgtaggatgagcaaaactgctcttggtgttgtcaagatgcaaagcagagagcaggagagactagagagtcaaaaccaagagggaggcgtgcacacctgcgtacaggaagt

SEQ ID NO: 9595 - DNA, 407 bp, Rattus norvegicus
gaatccatcagaaaggccatcaaggagaagtctgccttcctgaaggtggcgcagacccggctggatgagagaacgaggaggccgaacatagagctgtgcagagatatagctcagctacgccttgttaacgaggtctacgaggtggacgaaaccatccagactctgcagcagcgcctgagggattcggaggacaccctgcagtccttggcccataccaaagccaccctggagcacgacttggctgtgaaagccaacactctgtacatcgaccaggaaaaatgcatgagcatgcgcaatagctaccccagcaccctccggctggtcggcttctgttagggaccctgcgaagagtagttttcatattcctaaaaaaatggtagaagggaactgtatctcagcacctgaat

SEQ ID NO: 9596 - DNA, 445 bp, Rattus norvegicus
  misc_feature (85)..(85): n is a, c, g, or t
  misc_feature (145)..(145): n is a, c, g, or t
ggagccattttccatttgcgacaatttgtctgaactcttgaggacaatgcaggatgagctggaccagatgaatatggagcacagngagctcctgaggcaaatagcgcagaccgggagccattccgactctgaggagctggagcangagctggagcacttagccaggaagatggaaagcaaagaagaccaaatctccaagctccagaagcatcaggacagggtccgtaaactgcaggaaaaagttgagaactcaaggataaatgaatcctcaggtatccatggcaaccctaaaagatcaaagaacttgaaaactagccccaggaaatgtctgagtgaaactagcgcttttcagaaagacagaagttttcaaccggtgaaggttcacagtctgcctccgaggctgaggcgggacgacgtcaagtgggagcagtgaccctgcaaactg

SEQ ID NO: 9597 - DNA, 388 bp, Rattus norvegicus
  misc_feature (54)..(54): n is a, c, g, or t
  misc_feature (98)..(98): n is a, c, g, or t
gacacccctcattgtgacagacgtagaggctttctggaagccagagccctggtntgtggtagtgctgacagcaactggtgcagttctcctcctggctntaggttggctcctcggcaggatccttcggaggttggcccagtcactacaggcaccgagcaaaccagccagagctcagttgttaaacagcatccagggaagtagaggctccattgagaggcaaatggaggcaccaagcatggagatgtccaagcaacattttgatggcagagcccaagatgtctgtacggggagagattacctgttcagcacactcacgggagcccggcgttggctgtgaggccaagtagctgctttactctgtggggaattcccttttctcatgatcata

SEQ ID NO: 9598 - DNA, 323 bp, Rattus norvegicus
aacatctaccctgacggaagagtgtgcatctccatcctgcatgccccaggggacgaccccatgggctatgagagcagtgccgagcggtggagcccagtgcagagtgtggagaagatcctgctttcggtggtgagcatgctggcagagcccaatgatgagagtggagcaaacgtagacgcttccaagatgtggcgggacgaccgtgagcagttctacaagattgccaagcagatcgtacagaagtctctggggctctgaggctacagccgtgtgcacactgagcagtccagtgctgtcctgaagaccacgtggcgacatgctgc

SEQ ID NO: 9599 - DNA, 375 bp, Rattus norvegicus
  misc_feature (98)..(98): n is a, c, g, or t
tttaggaagttactattggccgcataactaggcttccgtcttgtacagcaatgggtggcttcgtaatggctctgttcaaactgagcacattttgcccnttttttcttccttttcttgtggggatgggataaatgggatttttttttaaatcctgcacatgaaagtttatgaggtttactagcacgttctttttaaaagaacatttgtttttccagtgtgatttttaacacatatatttcttctatattcagattggcattcatatatgtatccattctgtagaacacatcatgttaatatagtatacatttttaaaaatactactttttaaatggtagttttaaaataacattgtcttccttgttgccattgaaa

SEQ ID NO: 9600 - DNA, 546 bp, Rattus norvegicus
  misc_feature (211)..(211): n is a, c, g, or t
ttatagcagcaagaaccccaggacaatctgttaaagttttaaagtctctgcagtcccacctggctctgtgttttgtgttctaggttggcccaccttgggggagtggggaccctgagagggggcaggcttcagtatttgagttgttcacatactgcagttatttttgataacaagtacttcctgagctttgttttgttttcttgcctgtacngaggtaaagttgcttcattagttaatttataaaaatacatgccattgcactagctgtatgtgagggaacattcatgaaactatacataggttctgctgttgtggtagacatcacaagtggtcattaacgagagttacactgtttagttttcttagcatcaagcaaaatgtttttgaagacccttctagtgtgatgagattgaaggactctgatcagcatatatgagttcatatttggacacatggcaatctcaaattctggggaaaacaaacattgacagcaaaagagaatttgcagctatagaatttgtaaaagctccctttctgtgaagcatt

SEQ ID NO: 9601 - DNA, 473 bp, Rattus norvegicus
  misc_feature (181)..(181): n is a, c, g, or t
  misc_feature (191)..(191): n is a, c, g, or t
  misc_feature (218)..(218): n is a, c, g, or t
  misc_feature (237)..(237): n is a, c, g, or t
  misc_feature (257)..(257): n is a, c, g, or t
  misc_feature (327)..(327): n is a, c, g, or t
  misc_feature (362)..(362): n is a, c, g, or t
ttaatcttcccgaacatgctggtcctgatctggcactcagttcctctgggaagtgtcctttaattagcatctcagaatgcatgggtaaggtaaaatgcaaagtccaagtggacagcaagaatgaccacgaccttgctttccttctttctcccctccccacttccctccctttcctattctntagcctcctntacacaccagcctccctccttgttaancaatatggagtcgaggccnccttaggactgtgtgtagancctcggcctaaagtgatagtagggctgacaaatgaacttgaataggtacctgcttctgtcaggtgaaatngagagatctcacttggaaccaagcccaggatggcnccatgggcgagcgatccagcttctgggccctcagtaggagtagatctgcctggaatccattgaatgggggtgggaggatgacttccagttcctgctccagaaggacttcgt

SEQ ID NO: 9602 - DNA, 365 bp, Rattus norvegicus
  misc_feature (77)..(77): n is a, c, g, or t
  misc_feature (134)..(134): n is a, c, g, or t
gcatcaagaatgagctgacagtccaggtgtcttcgcttcacgccgcattggaacaagaaagatctaaagtgaaagtnttacaggcagaattagccaaatatcagggtggcaggaaggggaaaaggaactgcganccggaccagtgtaggtgatcgtggccatgggggccagcacagaaagctttcacacttctgcagaaatgtgtgtctaatgctgcaactgcgaaactgcagcctttgttgaaggaactaaagcacctagttcactcatagtctacaattttatgttcttttggcttaaagttaaaagaaaatatggaataccagcagaacttgataattgttttctgtccaaacttcttagga

SEQ ID NO: 9603 - DNA, 513 bp, Rattus norvegicus
  misc_feature (143)..(143): n is a, c, g, or t
  misc_feature (208)..(208): n is a, c, g, or t
  misc_feature (382)..(382): n is a, c, g, or t
  misc_feature (443)..(443): n is a, c, g, or t
  misc_feature (456)..(456): n is a, c, g, or t
tagacatttctacacactcactgagccagacactggaggtcacagatgggtcagacaggactcctgtcctccagggtcgcatgtttaacaggggatccaaacatacgagcaggtgactgctgtatgaagcgaaggggcaggantacaggtgcaaattcatatttactgcttaactttctgaagtgtgctgacttgatttttttttttntgaatcatggagagctgtgtggagggacctgctattattatggtaaatgtcttttaatttctccagattatctagatagtgttttattttgtgtggcttcctatttagtaccatcacagactctgagaaaaaaaaatattctacactctggctctcacatagatgagaaagaantttagtgaagtgggcaaaagcagttgtgaagagaatgacttaattggttttcttggtgttnccatgggacaggntgacagtttagagcattttagttgatagataaggaacttgcgttttaacagtggctc

SEQ ID NO: 9604 - DNA, 313 bp, Rattus norvegicus
accagtgctctggactttttaaagcatcacttaggagctgccaccccggagaacccagaaatagagctgcttcgcctagaattggcagaaatgaaagagaaatatgaagctactgtagaagaaaataaaaaactgaaagcaaagcttgttcagtatgaaccacctcaggaggagaagcgtgctgaataggattcttctcagttgaaaagacactgaaaactggttttgtatcacttgaatagcttgtatagtatatgatctttcctgaaaagatgctataaacttttaatatgttaaattcactcatcacact

SEQ ID NO: 9605 - DNA, 525 bp, Rattus norvegicus
atatggtctagtagctctctgaggcttgctccatcactgggtagggggtttctctcccctggaccatgtgaaacagctaatgttaggacgggtaagggatttcataatgctgacttcactactgatagttgaggcatacttatttgcattcctcacaagttttatacccacacatgtcagtgtgggtacatggtagtccagtttcaccactgaagtgcttcctttacacaggtttgtcatcctgtctgctgacgtcttttagttaagacgtgttttatatccttccaagttcatctgcttacacatatgtctttgagaggctgtccaagccaggatgaaatggccttagtcaaacatatatactgggtactataaactcaccacgtatgcatttgtggtctttgtttaacttcctgaaattgttcctgctttgtgttgcttgcctttaaaagacactgagaaaatacagtgctgccatggtattgaccagcagccctctcatatttgtctcttgcatcttctttc

SEQ ID NO: 9606 - DNA, 291 bp, Rattus norvegicus
  misc_feature (26)..(26): n is a, c, g, or t
  misc_feature (40)..(40): n is a, c, g, or t
  misc_feature (44)..(44): n is a, c, g, or t
  misc_feature (51)..(51): n is a, c, g, or t
  misc_feature (97)..(97): n is a, c, g, or t
  misc_feature (146)..(146): n is a, c, g, or t
  misc_feature (152)..(152): n is a, c, g, or t
  misc_feature (155)..(155): n is a, c, g, or t
atatcaaatttatggctgtatgctangtattattaaatgnagcnttgcaangttatttatgtaattctaaagttggtttccagtgtctaacgtttanccgtttgtatgggtttgctgtcagttgaccttagtgttaaggttccagnttatcntgnactgtgttttatgtatttagtgccatctgtcttcaagccatgtactactttgatacataggagtttgaagtatctttgatgtgatgtctgtgtcgatacattgctgtgactagaactctcactgggagctgtggta

SEQ ID NO: 9607 - DNA, 409 bp, Rattus norvegicus
  misc_feature (123)..(123): n is a, c, g, or t
  misc_feature (380)..(380): n is a, c, g, or t
tccctctcaaagtctctggtatgtggattattattctgtctcaaattttgctgctactcaagaatttttgacttagcgaagaaataaacctagactcccagcctgttcttgcccttaccttanaacctcagatgtggacttggacttggtgtcaaatcgccatcccatctgcttgaagaccatcagtaggacccaccctcagccttgggccacacccagtcagggctcatcaggcttagcaggaaaactgaggccctgagaaggatgtggagccagggaggggggaaagaggcgagactctgtccaggggaaggacaggagggacagtccatctgtccatctgctgggcggagcaggaggaaggtctttaatgaaacatntcagagaacagggtgggtctgcataacca

SEQ ID NO: 9608 - DNA, 414 bp, Rattus norvegicus
  misc_feature (248)..(248): n is a, c, g, or t
  misc_feature (269)..(269): n is a, c, g, or t
ggttatttctgaccgacaaacaccaaaaaaagatgaaagtcttgtgtccagagcaatggagtacatgttcggttggtagtgcagtgagagctggactgagcattagcagaggactgccagtttccttgggttagttgtataaccatgtaaccatgctggcagggttgggtagctatctcagatacatctttacagtcctttgtttaaggagacagctcatttgtaacttgcactttaaaagatggccntgatacacctgaagagaagcngtccagatggcactctgtgctctgtgatacagtgcatgcttagtgccgtgtcctcggcgtctactgcagtaattaaatgattgagcttgaagtgagtctcattggctttcatgggaagatggatgaattccacagagcaacagct

SEQ ID NO: 9609 - DNA, 469 bp, Rattus norvegicus
  misc_feature (33)..(33): n is a, c, g, or t
  misc_feature (40)..(40): n is a, c, g, or t
ggagtagccagttcactctcagaaaaaatagtngacaccnttgggaacagtcggccggccgcaccacttacctctgtccagatccgcttcattcagaacatgatacaagaaaccctggatgacttcagggaagcttgccatagggacattgtgaatctgcaagtggaaatgattaaacagtttcatatgcaactgaatgaaatgcactctttgctggaaagatactcagtgaatgaaggcttagtggctgagatcgaaaggctgcgagaagaaaacaaaaggctgcgggcccatttctgaagcctctggacaccttgatttgttatgagttaggtttctggcaactgaaatacacagaaccagtattgttcgcatggccttgaaaacggattctgcagtgcgcactattccatctctgtcagacatattatatttttatattaaaactgcacggaataccatcttccta

SEQ ID NO: 9610 - DNA, 268 bp, Rattus norvegicus
gaatcttcttttactcctgacgtagaagaaggtctgcctgctactcagggtgctgaggatatttttcatgcttccgcacgagctgaaccaataaaccacagcttgatccttctcagggagagtggatatcttcgggcaacagagataccacgcataccttttttgctcttcatatggcttatatcctcactcttatccatcataacatggatgaaaatccaaattcaacaagcatggcatgaagaaaatggccaaggagctcccacta

SEQ ID NO: 9611 - DNA, 452 bp, Rattus norvegicus
  misc_feature (71)..(71): n is a, c, g, or t
acagtatgtggctcttgcctgtagtcgccatggcagccgtgtatttgatgccatctggagtggagcagctntgggggctcggaaggagattgctgctgaactgggagagcagaaccaggagttgattcaagatccttttggccaccacgtggctcgaaatgtggccctgactaccttcttgaagcggcgacaggcttgggaacagcagcaaaattctgtggccaagcggaggcgggcgttgaactctatacttggagactgaggcctcgaaactgggaataggtgttgatggggagggtgaacggacatgcttatcattcctggtttaaatgggagccaaatgtcttacacaaaactgtaaacccactaccattccagagggtaaagcaagaatatccagaattcaaggccagccttggactgtggcagccagatcctgttaatccctgtgt

SEQ ID NO: 9612 - DNA, 507 bp, Rattus norvegicus
  misc_feature (185)..(185): n is a, c, g, or t
ggcaggcacatttcagagctaagtagttcaaagccagcacctggtctggagcgactagaaacattaatggaacccctcagtggtatccagtgaccagtggagcagacacccgccccagctgaaaccaatggcaggttgcgtcccaaatgccaaagccattcaacctaggacacattacgagtttntaagaacatgaccctcctgcccccccccccaacctccgagagaggatgagaaccagaggcagaatgtagtttgagggtagataatagggtaagtgatggatgaccattttgtcttttgtgtgtgttggtagagtagaagacacaaactgcaaggtggtatgtctggtgggaagggctgtggtggcactcaggacagacttggtggctcatgcaccaagacccaaggctatgggcacctagcaccacagctgggaggttgtggcatctgaccaccttgcgcataagtcgtcaccgctgagagctgctggagtggaccttgtca

SEQ ID NO: 9613 - DNA, 312 bp, Rattus norvegicus
aacttttggagagatgggcatctgcttcagtatttcttggtctttttcatgataccccatgtgaagaggatgttttcctagcatacaaaggacaacctgccaggctactgttggccagaacactgtgccctcctcccacattctgttgaggcaccagtatcccgtctccaggaaacctgcttgcagcacactttttgacatctgtcccgggcccagaggctgagctctagcatggcttacatgtgtgagagaagggtgacaaacattccccctggtgaacaccccacatcacgactcctccttagggtggag

SEQ ID NO: 9614 - DNA, 394 bp, Rattus norvegicus
aagagtttgtatcttcgtgctcgatgcccgtctctccactgggattgatagctaccaggtttctagaagaggaggagctgaggtctcaccacattctagagcgcctggacgcccacattgaagaactgaaaagagagagtgagaagacggtgaggcagttcacagccctcgtgtagtgctgagcagccacacacagaagactggttctaaagatctaagagcaatggctgcaagagcagcactgaggaatctgcagatcgggcacttaggtattttcactggctcatttgaaggactgcttccagtagtaacctgtgagaataaactaccttgcagactttctcacatgaatatttattaccacagagcaataccttttcttcctgacttacat

SEQ ID NO: 9615 - DNA, 309 bp, Rattus norvegicus
atggcttcaacattccacaagtgacaccctgcccagaagtaggagagtacttgaagatgtctctggaggacctgcactctttggactccagaaggattcaaggctgtgcgcgcagacttctttgcgatgcatacatgtgcatgtaccagagtccaaccatgagcttgtacaaataaccatgccaagaccgagcagactccagtgctgtggcttcctcagctggccattctgtctggcgcccattgccggcaatgggtgtctcttgggatgaggcccttcagcaaaggactcctgtgtttccgaacaaat

SEQ ID NO: 9616 - DNA, 280 bp, Rattus norvegicus
  misc_feature (88)..(88): n is a, c, g, or t
  misc_feature (165)..(165): n is a, c, g, or t
  misc_feature (255)..(255): n is a, c, g, or t
catcacagagaaagcggtgtttgaagtggatcggagtaagggactgaagctcgtggagctgtgggagggctcgtcgttggacgaggtnaaggccaccactggctgttcgtttaaggtgtgccccaacctcaagcccatgcagcagattaaatctgatgcttgagnagctctccagggacgatttgcgagttagtgacaactggacatcctcagcagcacctgaccactgtgacacactggctcctcactctggcntcctgctgctagatggtatctatca

SEQ ID NO: 9617 - DNA, 332 bp, Rattus norvegicus
  misc_feature (26)..(26): n is a, c, g, or t
  misc_feature (46)..(46): n is a, c, g, or t
  misc_feature (118)..(118): n is a, c, g, or t
  misc_feature (163)..(163): n is a, c, g, or t
  misc_feature (197)..(197): n is a, c, g, or t
  misc_feature (283)..(283): n is a, c, g, or t
  misc_feature (305)..(305): n is a, c, g, or t
gcacagccgcatcccattggcggagngaggtggcgtcgctgtgagnatgcggagatagattctggatcagaccacagactgaagtgggaacccaccccaggtccaccatgcagaaaanaggcggaggatgctggagacagcagggtctccacctaaccagagntccccacatgccagtcctgcttgccagcttccgntagggatcttccgcctccacctgcctgggctgcaattccaagtagatcaccatgccacctgggatcagcaagggcttctagggatntgaactatggtcctggagcttncaatgtctatcacagccaagcttacct

SEQ ID NO: 9618 - DNA, 341 bp, Rattus norvegicus
ggttcatagccgtgtgtcccttgctgccttgaagaaagctgtgtctatcacagggtacaatatggcccaaaacacctggcgcttcaagcgtgtgctccagaatctagtcaagaaaggcatgctcaagcaggtgaccggcaagggtgcctcgggctccttccgcctgggcaagaagcaggccttcaagtccaagtgcaaggccaagagacgccagcggaggcagaagcctgggcagcgccggactggatcacgccgatcactactaggctccaaaaagagcaataaccggcttttcaaaggagttcgtagggtggctaaaggccgccgccattaatacggca

SEQ ID NO: 9619 - DNA, 308 bp, Rattus norvegicus
  misc_feature (68)..(68): n is a, c, g, or t
  misc_feature (108)..(108): n is a, c, g, or t
  misc_feature (203)..(203): n is a, c, g, or t
aacaggagcaagaactcgacccggaccaagacatggaaccgtacctcccgccaacttagtggctcctntagcctgcagggacagtaaaggaggccaaagatgctgacntcaagaactcataataccccagtggggaccaccgcattcatagccctgttacaagaagtgggagatgttcctttttgtcccagactggaaatccnttacatcccgaggctcaggttctgtggtggtcatctctgtgtggcttgttctgtgggcctacctaaagtcctaagcacagctctcaagcagatccgaggcgacta

SEQ ID NO: 9620 - DNA, 407 bp, Rattus norvegicus
  misc_feature (103)..(103): n is a, c, g, or t
  misc_feature (254)..(254): n is a, c, g, or t
agcatccgtgaccaacatacagtttcctgacgtttccttgcagcacgtgaaccccatagaaagttcagggattgcactgagtgaaagcattgctcagattccntcacagccgaccatctcaccaccacctaagcctaccatgaccagagttgtttcttcgacacatctggtaaaccatccatctagaccttcaggaaatacagcaacaaacatacccaatcctatactaggagtctagaagacattctcacctnataagaaaggaacaagaaacccaacagaagggaaggaaccagatagacgagtccagcttagacactactcagacagcagcttctctgttggcctctcaggaaacacctgggaacagataagcccggtatccctgtttttcctagagatcctat

SEQ ID NO: 9621 - DNA, 396 bp, Rattus norvegicus
  misc_feature (60)..(60): n is a, c, g, or t
ccgcggctctgcagtatattttcaaactgctggacatcgagaacaaggggtacctgaatntcttttcccttaattatttctttagggccatacaagaactaatgaaaatccatggacaggatcctgtttcatttcaagatgtcaaggatgaaatctttgacatggtcaaacctaaggatcctttgaaaatctcacttcaggatttaatcaatagtaatcaaggagacacagtcactaccattctaattgatctcaatggcttctggacctatgaaaacagagaagcccttgttgcaaatgacaacgagaactctgcagatcttgatgatacctgatctctgcaagaatagacttccttcatgaggatgcctgaatgctgcatgcaaaaccctggaa

SEQ ID NO: 9622 - DNA, 376 bp, Rattus norvegicus
ataagcatgactagccccgaagggtttctttcctgtctaaggaatggtttgggattaaaatggaattacttctgactttaatcatgtatgctaaggccccatttcctgtgtaacaggcagcaagaggggcaagtgctcaactccaaatgtgaggaagctgggtgcaggcactgggctgggcacagacgcaggggcttctaaggtgaaagggcgatgcagacacctaagagttgtttccgaagcaaacggataggatatgcctttgccacttttacattctcttttgtagtacgctgtcctaataccaaagacttcgaaagtgcagtgtgcacagtaaaagtcactgtgccagagagccatgctgccactgacaagt

SEQ ID NO: 9623 - DNA, 332 bp, Rattus norvegicus
  misc_feature (109)..(109): n is a, c, g, or t
  misc_feature (134)..(134): n is a, c, g, or t
  misc_feature (155)..(155): n is a, c, g, or t
  misc_feature (255)..(255): n is a, c, g, or t
cactgaacaccattcatgtgctgaattagtagcaaatatctgctgttttgatcacacagcttactgctgctgttttgtcttcttgagacaggccttgagcatgtagccnttcttaaaagtctcttttaatgatnaccgtactgttccaaccattnggcacattagagggccatcaacccctctaaacccaatcattagactcctttttaatgtttacctacccatgtcatccagtctcatgacttcataaacatncccacatgattgccagaccttgcttctctccagctgtaaccttgtatagccagatgcctacttaaaacctattggga

SEQ ID NO: 9624 - DNA, 399 bp, Rattus norvegicus
gcaactgtgttggtcagacttccgtgactgtaacagggattctgagaaaaaaacgatgtggttaaaaacagaaagatggaccccctgctgctcctgtggaagagaagcctgtctgagtatcaatcgggcagagaacaccaggattcataaggaaactacattcatggccgccaagggcacagcccatggtccagttagatggggtacaaagttaacacagctaaaccggttaatctatcgtggcctcggggtggtataatttaagggaggttcttagtcaggaggcatggaataacctggcctgaccaggcaggaaacagtatcactgaaaggacttcctaagttttcctgacttcacaatcatcttcaaaacaaagaactttaacactgcccaggaga

SEQ ID NO: 9625 - DNA, 417 bp, Rattus norvegicus
  misc_feature (81)..(81): n is a, c, g, or t
agaaggcagccttcgcggcagaaatggcagccaccatcgagaggactacggggccggtgggggcaccggagctgctgcctntggaccagctgagcctgatgaagcccaaggacgtggacatcctggatgatgatatggtccagcagttaggcgtcatggacgaggctgaggtggtaggcacggatcttctcttggacaaccaagattcagttttgcttcagggtgatacagaactctaaaccccccgttcatcacctagagacacagaagccacggcctccacctccgtttgtctgcagaacctggacttcctgctcctttggaaacccttttaaactacctgtttaaaaagtggtccttttcttcaggttaagggaggggaaaatccagttctttctcttttaccttcttttgcat

SEQ ID NO: 9626 - DNA, 517 bp, Rattus norvegicus
  misc_feature (72)..(72): n is a, c, g, or t
  misc_feature (166)..(166): n is a, c, g, or t
gaaccatgtgcgactgttaagcttaagttaccagcagaagccaggtttcataatcataatgcaaatacattntgtatgtctagcaaagcattgtgcttcatgtggatattaattaccaaatgaggaaatgaaggctttaaagtgcattagtgcgcgaataacaacntaaaaaaggcatgttttgtgctcttgtcacaaaacactgctggacacacatacctgtgtatttagatagaaatttggcttaatttataatcttatgatactaacactgttctatggcattcttaaggaagattgaggcttagggataagtggttagtgacattttattgaaaccactaagggatggaacgtggcagattactcagtgtatgatctctttgtaacatttctcttcataactgagcttacacttcatttcttcatatgcagtgtggatacaaagcttgatgcagcccattggtaaccatggatacttagacacttgagaagagtgtggctgtgtttgcacaac

SEQ ID NO: 9627 - DNA, 381 bp, Rattus norvegicus
  misc_feature (58)..(58): n is a, c, g, or t
  misc_feature (187)..(187): n is a, c, g, or t
  misc_feature (270)..(270): n is a, c, g, or t
  misc_feature (343)..(343): n is a, c, g, or t
  misc_feature (349)..(349): n is a, c, g, or t
cagcggcgggcccatttgtgcggcccgtgcggcccgctgaggacccgctcggcgcccngacgtgcttcccagccacggtggcgcctatgctacgtggggcaggcgacggcgtggacaggcgcgaaggtgcgcgcgcgagagagatgaaaaggatcctggtgctgctgctgcagctggacgcgaggcngcaggaggaggggcgtcgagtggcaggcaggccggggggcggggccaaggcccagcagtactggcagccgctgtatgcgcacntgctgacccaacgcgaggcctgcggcgaaggcgacccccgcgaggagcagccgcgcaagcggcgccgctgtcntcgccngcggccctgagtgtctggcacgacccctaacg

SEQ ID NO: 9628 - DNA, 389 bp, Rattus norvegicus
  misc_feature (28)..(28): n is a, c, g, or t
  misc_feature (144)..(144): n is a, c, g, or t
tcctgcctttccaagctattctaatccnctggcttagactcaccgggaggagtgtgtgcctgtctgactttgttcttcgccatggcttctcacaagaccttcagaatcaagcgcttcctggctaagaaacaaaagcaaaatcgnccgattccacaatggattcagatgaaaaccggcaataaaatcatgtacaactccaagcggagacactggagacgaaccaaattgggtctataaggaaccacacaccacatgtacttactaagctgtctgagggttatcattaacatactgtaccaggatcacagcattaccattgtctggacagctgagtatgttcattaggaatgttttctttctttctgtgctcttgtgggttcattcagtag

SEQ ID NO: 9629 - DNA, 138 bp, Rattus norvegicus
gaaataattgctaataaggcctctgtagccatggctacttctgacgtgaaaccaaaatcaataagtcgtgccaagaaatggtcagaggagatagaaaatctgtacagatttcagcaagcaggctaccgggatgaaatc

SEQ ID NO: 9630 - DNA, 512 bp, Rattus norvegicus
gcagacatttttgagggatcccattaaagcagatgcagagaacagaaaagctgcagggtacagttctctggaactagtgggtcacttgcaaggaatgccttttgttgtggacctgcctttctggaaattacccagagagccagggaaagggttcagtcagcccctggagccgccttccatcccctcccaactcagcatcaagcaggctttgtacgggaagttttccaaactgcagctgagtcccagcagctttaattactcctccagctcggccgcctttcccagaggcctcgctggtggtgtggtgcagctgagccacaaagccagctttggtacaggccacactgcatcactgtccctacagatgttcactgacagcagtgcagtagaaagcatctctctccagtgtgcatgcagcctgaaagccatgatcatgtgccaaggctgcggagcgttctgccacgacgactgcattggaccttcaaagctctgtgtattgtgccttgtggtga

SEQ ID NO: 9631 - DNA, 95 bp, Rattus norvegicus
ggcaaaacggtgaatgaactccagaatttatcaagtgctgaggttgttgtcccccgtgaccagacacctgatgagaatgatcaagtcgttgtcaa

SEQ ID NO: 9632 - DNA, 397 bp, Rattus norvegicus
ttggtgacctgatccaggagaccctggaagccttcgagcgctatggaggggaggacgccttcatcaacatcaaatacatggtgcccacctatgagtcgtgcttgctgaactgaccaggcaactgcaagagggagcctccctcggtatcacaaccatctgtccccaatgccctagcatctcattatttgtgatttctacagctctctttctacagctgcaaacatagtagtttctgggccaaaagactgttagccccattgagagcaaggctttccaatacataaatagtgcctgtttcttagattacaatagtgtactgtgcttatttttttttccatgaagagaattgcttctttatccagctcagatggaggcaggagtccgagttaaaccttca

SEQ ID NO: 9633 - DNA, 275 bp, Rattus norvegicus
ttaatggcttccaagtggcacccagcccagcagaatggctacaagtgtgcagcctgttgccgcatgtaccccactctgcactctctcaagagccacatcaaggggggtttcaaggagggtttcagctgcaaagtgtactaccgcaagctcaaaaccctctggggcaaggagcaaaaggcccggacaggagataggatctccttgggcagctgccaggccttcaagtagtcttgctgacatctcaggtaaatagggatgaagcctatttatgcctc

SEQ ID NO: 9634 - DNA, 276 bp, Rattus norvegicus
tctccctaccgaaggccaggtatgggtggacccaggcgccggtgtcccaagatgttcaagtgtagccgcaggacataccggcagaaaccccgaggcccaactgccactgatccgtcttctgtggccacaaacatcagtgacacggacactaccaccagtgtgtggatcctctcacctcaagttctcagacacctctgtcaacctaggggctttctgatcctctagaaacacccagaagcttggcctgcacttgacctgctgctccagagggctgtt

SEQ ID NO: 9635 - DNA, 566 bp, Rattus norvegicus
cgctgccgtgcactgggttaaaaacgacaacgaacaccaaccatgaaagatccaagtcgcagcagtactagcccaagcatcatcaatgacgatgtgattattaacggtcattctcatgaagaggataatccatttgcagagtacatgtggatggaaaatgaagaggaattcaacagacaaatagaagaggagttgtgggaagaagaatttattgaacgctgtttccaagaaatgctggaagaggaagaagaacatgaatggtttattccagcccgagatctcccacaaactatggaccaaatccaagaccagtttaatgaccttgttatcagtgatggctcttctctggaagatcttgtggtgaagagcaatctgaatcccaatgcaaaggagtttgttcctggggtgaagtactgacatgtctgagcagccggccgctttgggtggatgtagcacagtttccacactgggaaggcagtgttagaagactccattgtaaaagctctctctcgtcactgtgttacacttacgcattgccaaagtttttgttagtcttgcatgcttaa

SEQ ID NO: 9636 - DNA, 363 bp, Rattus norvegicus
gctctcttaccaaaacctactttaggcagcgagtccttgctagtcctgcagtcctatggccgacagcccacttggtgctattcaaagtacatagaagccttggaacaagagcgaattcttctgaaaattcaagaagaagtggaaagaaagatgttcacaggtacatcgtctttcacaaacttgcttaagccttccacgggctccgctctgtctctgaagaagaatgtgtctcctcacagcatccagagatagcagcattcctgtccaggctcacatcctccagcttcaagtaccaggatttctttaggctaattgttaactaacttgagaagctgaatgcccacggtgtggatagtccgattt

SEQ ID NO: 9637 - DNA, 329 bp, Rattus norvegicus
attgaatcccacattataaagcaggaagacatacttaatggcaaagagaatgagattaaagagttgcagcaagttatcagccagcagagacagagtttcaggtgaggggctgggccaggctgggggttgttgatggaagtggggagcctgacttgtggcccctacccagggctgtccagcctaccaccagctggctccgttgcaggaatcacatgtctgacttccggatccagaagcagcaggagacctacatggcccaggtgctggaccagaagcataagaaaacctcaggaacacgtcgggcccgtagccgtcagtgttccagggag

SEQ ID NO: 9638 - DNA, 411 bp, Rattus norvegicus
gctgatttcagctgggaacttcacataagtgagttgaaatttcaactgaaatccaatgtcataccaattggatacatcaagaaggggatcttttatcaccgagcactgcttttcaaggcactggctgataaaatcggggttggctgcagcctggtgcgtggtgagtacagccgagggtggaacgaggtgaagctggtgaacgaggctcggaagggcattatcgggaaccttcccccaccagacgagtacatcgtggacctcatgttccacccggggaccctgctgaagctacgcagcaaagaggccgacctctaccgctttctgtagtcgtcagaggaacacaaaagcacccaaaccagagattgtcctcctgtgttctttaagggggctttagccgtttagataacttca

SEQ ID NO: 9639 - DNA, 564 bp, Rattus norvegicus
  misc_feature (110)..(110): n is a, c, g, or t
gagaatggaatagctcccttcattaaaggaccaagatctgcggcaagtttctcccttgcagaggtaaccagcatacatgtaagtaggcagagtcttcagcttagccatcnatatatcctttgacagtatgcctctagagtccagcaagatggttaggcaggtaaaggtacctgcagacaacctgaatttgatcccttgaatccacatacatactgtggtacatgtacacacacacagtgtaaaattcttttttcaataaatggttctgaggacagcttcctctagccaggtaggaaatgtttatcttgggacccagaagactgggtccataaagcccagtgatagtgtgtgaaacaaaatatttccagatgaagcttcaaggcccaagaaaagttacctgaagtcctgggcaatagcaagatgcaaagcctggaattgatcaatgactgcttatagctggtgatattgttacttgcttgggtttgtgacaccaagagcccctttgtcaaaatgagttccaagttctcttcccttttggtgatggtttcttcattgctgtgacaa

SEQ ID NO: 9640 - DNA, 520 bp, Rattus norvegicus
  misc_feature (65)..(65): n is a, c, g, or t
  misc_feature (78)..(78): n is a, c, g, or t
  misc_feature (96)..(96): n is a, c, g, or t
ttcctcctcaggatggtgttgctgacatggtgacagcagatgattcaggtgtcctgtgtgtctgnaggtcaggacctnagttcaccttactgaccngaatagcaggattcggggtcccgtgcccctctgtgcagctgtggcaggggatcgtagcagcaggctatggaaatggacaagtgcgtctgtatgacgctggcacaggagccctccacatccagatcagtgcccacgcccggaccatctctgccctggacctagctccagaggtgggcaagctgctgtctgcagctgaggatacctttgtacacatctggaagctgaacagaaacccagagagtggctccattgaggtggaacactgccatggcgaatgcatttctgacacgcaggtgtgcggtgctcggttctgtgacccagggggcagctcctttgctgtgacaggctatgaccttgctgagatcctgagatttggcagtgtctgagagtggagcagcggtcccttctcccttgatatttataa

SEQ ID NO: 9641 - DNA, 547 bp, Rattus norvegicus
  misc_feature (147)..(147): n is a, c, g, or t
atgagcacgactgcgagccgttgaaccctgagcgtgaggcccgcaacaatatgttgctagaactcgcgagaagagtgcgcggggcttggagttgggcccctggcagcagatcactctttaataggatggactttgaggacctgggantggtagattgggaacaccaccttcccccaccagctgccaaggctgtggtggagagcctccccagaacagtcatccgtagctccaaggctgagctcaagtgtcccgtgtgtcttttggaatttgaggaggaggagactgtcattgagatgccctgccatcatctcttccattccaactgcattctgccctggttaagtaagacaaattcctgccctctgtgccgccatgagctgcccaccgatgacgacagttatgaagagcacaagaaagacaaggctcggaggcagcagcagcagcaccgcctggagaacctccatggagccatgtacacgtgaggcagcagctagggctgagagctcagcctctgtgatatcttccctttgcactttgaatcttcatt

SEQ ID NO: 9642 - DNA, 152 bp, Rattus norvegicus
gaaaatccaaagtgtacctggtgaatttctctacctcctccaacccagaattcaactgagtttggaatattctagattctactaatgaaggaagaaaaagacggttccaagactgcgcgttgctcaaggacactaggaaaccattcaaagta

SEQ ID NO: 9643 - DNA, 141 bp, Rattus norvegicus
gatgcacagatagcaagtccaccaaaactcctgcctgagaattttaccagacttcaagagcatctcgccacatcttgaaaaatgccaccgtccgatggaaaacaggagcctgttaaggaacaatgccacctgtcaataaat

SEQ ID NO: 9644 - DNA, 223 bp, Rattus norvegicus
cactactttaacacctggttccatgtttggcagataaagaaccataaagaatttccttttctcagcaatggcccatcaagcccacttcccagtgaaagccaagagctacttattgtgattacaacgtattgtgtacgtattacttatagttaaggaatactgaagaaatactaccctggacaatgtatagttcctcctggcattctgagaaactgtagttgtt

SEQ ID NO: 9645 - DNA, 323 bp, Rattus norvegicus
gtgtgcagcgatctctcttggacctccccgggggcctcagtctgatcgaagcagagttagcagaactgggccagaagtttgtgagcctgacccaccacaaccagcaggtttttgccccttactacaccgagatcttaaaaaccctcatcaacccagtccagaccctcaccacaaaagtcggttccctctgatggcatcggctcggagccctggcacctcagacccaggggatgacgtcaccagtgagcagcagagcagtgggtcccctctgccccacccccggacagccagcaccctggggctgtagggaccaaacatgtaaa

SEQ ID NO: 9646 - DNA, 377 bp, Rattus norvegicus
  misc_feature (168)..(168): n is a, c, g, or t
  misc_feature (306)..(306): n is a, c, g, or t
caagctagcttggaagtccttatataataaccctagcaagcctagtgcctcagcctcccaagcttgggaatggcaggtgtgtgtcactgcatctgccttagacatgctttaaaggatcattcttcctcacagaaaaacctggactgggagactcttgtgcatgagaanctgcctgggctaatggatatggatcaggatgaccgtgttgtttggcccagagattcgcttttccgatattttgagttactggaaagccttcagtataacctagaggagcgcaagaggttgcaagaatttgcagttcangcactgatgaattttgaagacaagtgaaggcacagtgtatgacacctgtgtctttggagccagcaaaagct

SEQ ID NO: 9647 - DNA, 430 bp, Rattus norvegicus
  misc_feature (56)..(56): n is a, c, g, or t
  misc_feature (208)..(208): n is a, c, g, or t
gcagacctacccttcagaggacgtaggctgagagtcctgggcagcttggggcctancctgggtgaggggtctgtcctgggtgagaggttggccttgagagccctggaggtgtcctcagaccccagccatcgagcccagggatgtccagatcccaagccatcactaggcccggcaacttgtcctctagggctccactgcctccatcacntgaaccctatccctccagcccatcctttcccttagcgtagccctcccttgctgacatctcttggcctaggtggggccaaaatgaagtgggtgaacttggggctggactttttagaggtcccaggactctgggtcatctatatggcccaaattctgagcctgctaatcctagggttcaaaatggcacaaccatcctgggaaggtttgcaggttcccttatgtg

SEQ ID NO: 9648 - DNA, 469 bp, Rattus norvegicus
  misc_feature (125)..(125): n is a, c, g, or t
gaagaagcgcatgaccttggtacaattcaggagaatgatggcaaagcgtccagccattaaaaaggccatggacatgcgctccccagttttgtctacactgctgccgtctctcagagaaaaagctnagcatatcgctgagaaaaagtacgtggcaggcatcaaactccaaccccgagtggagaaggacataacgaatctggagtctgtggttatgcccgtagttggcatcttgggggaacctcgaaatctattcaacccgcatactctcctcccccttgaatcagaagaaaatggaaaaacaagcggaagaaattcttctatagtagagagaaataacacaagtattcagaacacactgaatttggtcatgtcaaaactaacttcgcaaaactccttccctaagtaatctagttggttccaattcctgacctaggtctctatatgtggagtaactgcttctccacagcac

SEQ ID NO: 9649 - DNA, 384 bp, Rattus norvegicus
gagaatctggcctggattgacctctccttcaatgacctgactaccattgaccctgttctaacaacattcttcaacctaagtgtcctctaccttcatggcaacagcatccatcgcctaggggaggtgaataagctagctgtcctccctcgtctccggagcctgaccctccatgggaaccccatagaggaagaaaaggggtacaggcagtatgtgctgtgcaacctgccccgtatcaccacgtttgacttcagtggagtcaccaaggccgaccgcagcacagcagaagtatggaaacgcatgaatatcaagcccaagaaggtccggatcaagcaggatgtactctgagattcgcaggacccgagcacacctaatgccctgaggatg

SEQ ID NO: 9650 - DNA, 511 bp, Rattus norvegicus
ggaagctctgtgtctacttactgcagaagaagactttcaaggcctggcttagcactgtcaaagagctggagatggagtcccagaagaagcttaaggttgctgcagaacactgtgacaggaagattctcagggtcacactggagatgtggaaggcatttgtaaaacttaccaaagaagacagagtcagagaagagcggcgagaccagctccgccggaaggtggccgaaatccttccagacttccagatgctggtgccatcgtgatggctgcacaccagcagctacatgcttgtcagccaagggcagtctttgtgcccggatgtgcagacagacggtctgcacccacacccctacctgagcccggctttcttctggatgtgtcgtaggccgggggttatcttgggatttgtgcttcagtcttgctctctcctgggttgctgggcatcagtggtgacggctgtcacagggggtcatgggaacagtctagggcaccaccgctgagtgcattttat

SEQ ID NO: 9651 - DNA, 294 bp, Rattus norvegicus
tctccttggtgtttccctagtaccatgctccttaaaaagtgaagcaaagaaaaccaaagagctaatgacaaaagtaatgaaacaaaagctatttgaaaagaaaaattcaagaattcctcccaaagaacatcatcctaacagctttgaattccttaaagccattttgaactgagtgttaccttcaagtctgacaactgtgtcaacctacctggatactagtcaaccataagaatgcagacaagactgaagtaaagagtcagtgaaagactgtcaagtttgcaacccattttataa

SEQ ID NO: 9652 - DNA, 360 bp, Rattus norvegicus
  misc_feature (259)..(259): n is a, c, g, or t
aaacactggcacattgacccggtaaaggtgtatctcacgtggctggcacccagtgaggaagaccaagccacgcaggagacacagaaggatccaagagaagaattatagggcgagtgtgggacacgcggatacaagagattcgccctgtctatggagcgtcagtccgactgcttgtatgtgccatgtgaagcgggcacttcccagccctcatggatatgtggtattttttggatgggtaaactcctagagggacctgggnaaaaaaatcacttgttttgattgatgtctttattgtaacacaacaattattgtgcctagtatagccaccacgggctgtgacacaacagctctttgactgtc

SEQ ID NO: 9653 - DNA, 412 bp, Rattus norvegicus
ggagagtggcacttcctgcaatgacctctctacttccagctgcgacagccagtcagaggccagctctccccaggagacagtgatctgtgggcctgtaacgcgtcagggcaacatccagactctggaccggcccatcaagaaaggccccgtgcagctgatccaacagtcagagatgaggcggaaaagtgacctgctccggactctgacttccggctctagggagtcgaacataagcagcaaaaagaaagctgcgaaggaaaaggtctccatcgaggaagagctggagaaatgtatccaggatttcctgaagataaaaattccagatcgcttccctgagagaaaacatccttggcagtctgaacttttacggaagtatcatctataggggagggcagtgggtagtcaccacttt

SEQ ID NO: 9654 - DNA, 552 bp, Rattus norvegicus
  misc_feature (159)..(159): n is a, c, g, or t
  misc_feature (177)..(177): n is a, c, g, or t
  misc_feature (207)..(207): n is a, c, g, or t
  misc_feature (210)..(210): n is a, c, g, or t
  misc_feature (232)..(232): n is a, c, g, or t
  misc_feature (259)..(259): n is a, c, g, or t
  misc_feature (262)..(262): n is a, c, g, or t
  misc_feature (265)..(265): n is a, c, g, or t
  misc_feature (277)..(277): n is a, c, g, or t
gacccgcttgagaactttttcggcgatcggaggagcacccggggaagcagaagccgagggtccgtacccttctctacctcctttaccgaattcccagggtttgggggcggcttcgcttcgttagatactggattcacatccttcggttctccgggaaantcaggcctttcctctttntccatgtcctgcggcggtggggcggcaggnaantacaagtcggtgtcaacttccnccgaaataatcaatggcaaaaaaatcnccnccnagagaatcgttnagaatggccaggaaagggtggaagtggaagaagatggagagttaaaatccctgataattaatggcaaggagcagctgcttcgcattgatacccagtaaagacgtaaagtgtgatgtaaggactatcaggactttttttgtttaaacgcgttttcaagggagctctactttcagaacaactgtattcaagacattatatgcagctcatgtcggtgcctcttgttattgttgggatcgcagggataggatctctcttggtctttatgcctgttgtaa

SEQ ID NO: 9655 - DNA, 477 bp, Rattus norvegicus
  misc_feature (86)..(86): n is a, c, g, or t
gtcacacaaatcgagccctggcagtccaccggaatctctccttaaggacctactttgggaaggaagctgaggttgccgctcacacncattttgatccacacagagttgaaaaacccaagaaccactggatgctggttactggaaatcccagaaataagtccaacaccatgctagacatctctaaacctattgcagtggatacccgggccgtggagcaggccatgggcatcaatacatagtgacgtaccaggcattcgtgtggctcttgtcagctgcaggtcttaaaagaaaggaacaatcttcttggttgtaccccaagcagttttacagtaggtgaagaattccatgaatacatcattaaaagacataccacattaaaattactaaattgatgttgggagcctggctctggggagcaaatagtgtttgaaaatgaattgtatttgagattaagtcagcttttgttgatatcccaat

SEQ ID NO: 9656 - DNA, 290 bp, Rattus norvegicus
ggaatacagctctgagagccctccaagttggtttggctatgactctgaaggcaaccctcttgaagaaacccataccaaagttaaaacttactcagaaatgatcgtcaaagagtcactcagcagtgacgatgaaactccaaactccaaacaccactaggagaacaaaacatccagaaccaacaatttcccttcatttgttgtaaatattgttagttgctggttctcaataacaatgccaaaaagcagcacccctctgcttcttatttcaactgcaaatgtcacctttatgt

SEQ ID NO: 9657 - DNA, 307 bp, Rattus norvegicus
aggtgtgccagcgtcgcctgctgctgcttgacctgctagcgctgtacaccccggggggcatcgtaggcccagctcgatgtgaactgctaggagaccggctacgctggcagcggctactgggtgaggacaagttccagtggctagcggggctggcgccaccctccctctttgtccgtgccatgcaggtgctggtcactaccatctcacctggccgcttcccggaggccttggatgagctgcctctgccaccctttttgcagcccttggacctctcgggcaagggttagactcagaggaccctgaccca

SEQ ID NO: 9658 - DNA, 393 bp, Rattus norvegicus
  misc_feature (28)..(28): n is a, c, g, or t
  misc_feature (221)..(221): n is a, c, g, or t
aatgcaaggcaagcgtccagacagcttnttcctgcataaactctcatcggaggccacttaggatatcttcaaggactcaccgtcccttaggtaaagaccttctgtagcagttgatccgataagggcagttgatgctgggggtcctcctttaagcagattgccccaccttcagatggctcagctctcctgcaagagaggaacctgggagtttgactccactncctgcacaacagagagagcaacaaccttagaactaggatagtaaaccagccatggagactctcgagactcttacttggaaacacgggaggaaagcccacaccgagacagcacgtgcgctgtgcgggagctgtcacttcaagctatgctgtcccctttgtctggttgagctaa

SEQ ID NO: 9659 - DNA, 181 bp, Rattus norvegicus
  misc_feature (75)..(75): n is a, c, g, or t
tgacggcttacaatggcggtacatctgcagcagcagcaggtcaccaccaccaccatcaccaccaccttccacacnttcctcctcctcaccttcaccaccaccaccaccctcaacaccaccttcatccggggtcggctgctgctgtacaccctgtacagcagcatacgtcttcggcagctgc

SEQ ID NO: 9660 - DNA, 298 bp, Rattus norvegicus
  misc_feature (133)..(133): n is a, c, g, or t
aggcttccatttctcatatttggcaggaaacagtgcacacaagctccattgccctgcctttccctggacgacagcctgtagtgggcccaccaacactgacaagacgccatctcctcctgtgaaagcctccatnttcactccgcctgttctgctcaagttccagcccgtgcccagacccaatgatgattcagagaatgaccctggcaacgccgagtccactcctgccaaggagaaccaataatctcttccctacagaccatgccccaggactgagtaaagttcatcctggtgttgagct

SEQ ID NO: 9661 - DNA, 311 bp, Rattus norvegicus
aatgatctggaatcgcactgagagagcattccttcccagtgtaccatgatcacactcattgtcccttgcgtgttcaaagatttggatccatcctagtgtgagctccatttgactcatgactctagaagcaagagtcttggctctcaggcctgggacagatcttcctgccaaaatcatcatgacagggtctccagttagcctaggtcctagcccagcctgagccctagccccaggccccatcctcaaatctctctcagcagcagactgtggtggagattatagctgtgtgcctctatttatcatctgatccg

SEQ ID NO: 9662 - DNA, 333 bp, Rattus norvegicus
  misc_feature (52)..(52): n is a, c, g, or t
gcgtgagcagcatccgctacgagaatatgaatgtcatctgcggcaccgcggnccgcagggacaggtggctcatcaccgtcacagacttccagacgcgctcgcgcctgctgcgctcagggctcagcctccgaggagtcgcgtacccacttgtgcgccacgacgatctactgctgggggactaccgtctgcacctgcgccgctccctggtccgacggcgcatgctcgaagccctcggggcggagccggtcgaggaagattgacgcacagcgggggcgggtcccagccgcgccccgcccccaggcccggcgaaacgagagggcgtggcctccctag

SEQ ID NO: 9663 - DNA, 566 bp, Rattus norvegicus
  misc_feature (70)..(70): n is a, c, g, or t
  misc_feature (241)..(241): n is a, c, g, or t
agactcctttcatttctctgtggtgttgcctcttgctttctgtcagattctcgtctgttgtggtgactanagatgttgtcagatatcccagtagttccccatgtaactgtgtttgtaaatggagaccctcttacccccagtgttatgcagatggacatgttcatgcttttgaggtatcaatttaactcaactgatttcagaaaaaaaattattctgtattagaacaagattgttatcgtgngacagaatgctgagtttgtacagattacacgtagaaagtagtttgcttgactgaatgttatttagaacatatctcagaatattcaaagggttggggatttctctctatcatcaggaacattttggcagaaaagtctgtgctagactgattcatcacaggtatagagtgactgagaacaagcggacaaggtgttcctcatatagggaattaggggagtttgtcgtagtgttgcaatgtttcccttagtctagcatagaatttgtagccacttgttttgaattgcttgcatgtggatttattgcaattacttctgtaccttgacctt

SEQ ID NO: 9664 - DNA, 580 bp, Rattus norvegicus
  misc_feature (64)..(64): n is a, c, g, or t
  misc_feature (339)..(339): n is a, c, g, or t
ctctggatcgggaagcctggtgacaagcccccacccctctgtggagccattccagcctcagggnactatgtggccaaacctggagacaaggtggctgctagggtgaaggctgtggaaggggatgagcagtggatcctagctgaagtagtcagttacagccatgctaccaacaagtatgaggtagacgacattgatgaagaaggcaaagagagacataccctgagccgacggcgcatcatcccactgccccagtggaaagctaaccctgagacagaccctgaggccttattccagaaggagcagctggtgctggctctatatccccagaccacctgcttntaccgtgccctgatccacaccccaccacagaggcctcaggatgactactcagtcctgtttgaagacacctcctatgcagatggctattcccctcccctcaatgtggcccagaggtacgtggtggcttgtaaggagcccaagaaaaagtgaatcgggctggcagacttgaatctgccccagccaacctcatgggagaaggcaacaaaggagttcctatgatccaataaatactcttccctct

SEQ ID NO: 9665 - DNA, 213 bp, Rattus norvegicus
tgacgtctgttcttgttgtaaaggttatagctcagtaccatgcggtgatgagtgaccatcacacatcggaggaggagctcctggccatcttcaacaagaagatcagcaggaaccccacctttaaggtgctgaaggacaaagttaagcttctgaagtgagggctctgttgcgtcacactctaccatcctattggctactttcctctctttgtaa

SEQ ID NO: 9666 - DNA, 371 bp, Rattus norvegicus
gaaccggactctgccacagattgtaccccgctgcgggtgtgtggaccctctgccgggacgactgccgtaccgaggatacgaaagcccttgctctggacgccactactgtctgcgcgggatggactactgcaccactggggagcctagcacagaacgccgcctgcggcctttgtgctcgcagcagccgactgagtatgttgcccttagaccaccggccaggaatgcagtgtgttgttacaactcccccgccatcatactacccatttcccaaccttagatgggacacaagtcacttcaagaagaccggtggtccccagagaaacaactatgttgtccatcctgaatttgtgtctgagacttttcctgtctac

SEQ ID NO: 9667 - DNA, 348 bp, Rattus norvegicus
  misc_feature (31)..(31): n is a, c, g, or t
  misc_feature (58)..(58): n is a, c, g, or t
cgggagctgcgcaagtatacctatgcccttntgcgtgtgcgcctgccggatggctgtntactgcaagggaccttctatgcccgggagaagctatctgtgctcttccagtttgtgcgagaggcgctacagaacgactggctgccctttgaactgagggcctcgggtgggcagaagctggaggagaacgaggccctggccctgaatgaatgcgggctggtaccctctgccctgctgaccttctcctgggatgcttcagtgttggaggatataagggcagcaggagctgagccagcaaaatctgtcttgaggcctgagctgcttgcagccattgagcaactctcctgaata

SEQ ID NO: 9668 - DNA, 486 bp, Rattus norvegicus
tcgatgttccgagaagtccttccaaaacaagggcagttgtctgtggaagatgtaaccacaatggtgctgtgtaaacccaagcttttacccttaaaatctctgactttggaaagactggagaaaatgcagcaaacagcacaggacacagttcgccaacaagaaatggcagaaaaagacaaccggcaaataacccactagccactcccgctttaaagaatccctaactgttcagtgactagaactattctgcatctgtaggctaaggaatcctaactgttcagtgactagaactattctgcatctgttcagtgactagagactattctgcatccgtaggctaaaaatgcttaaactggtcattccaaacttaaaacagaaaattcaggtgtttaaacattggtttgtgttaagagaaaaactttgaaccaggttttacggaattttcaaagtttttaaattataaatttctcaccttgtttatcgcac

SEQ ID NO: 9669 - DNA, 327 bp, Rattus norvegicus
cagcagctacaacagttgcgattcttgcagcatcaaatggctatggcagcagccgccgcacaaacagcccagctccatcgtcaccggcaggcaggcagccagtcaaagagtaaagtgaagagaggcatgccaaccactccaaaattctgagcaattgttttctcttttttataaaacaagaccactgaatgaaaagaattgtatttctacttcatttcccccaagatgtcagtattttacattgatatatgtgcacactttatatagaagcaaaaccctgtgattcttacatggaaacatggttcaatgttttcctgtacataccaa

SEQ ID NO: 9670 - DNA, 322 bp, Rattus norvegicus
agactttaacccacgagatcggacacatacttggattgcgacactgccagtggcttgcgtgcttaatgcaaggctccaatcacttggaggaatctgaccgtcgtcctctaaatgtctgccctatctgcttacgtaagctgcagagtgctatcggcttcaatattgtggagagatacaaagccctggtgaagtggattgacgatgagtcttgcggcgagtcaggagcgactccgaaaagcagctctgagcatgtgtatttgccgaagcctgtggaagccttcaaggactggagagagtggatactcagatgcattgctgttct

SEQ ID NO: 9671 - DNA, 461 bp, Rattus norvegicus
taccaaagacacactcaggcgttagtaaatttaactttacataacctcaatttttaacatgtatatctttttgaaccatgaaatcaaaacaatgcagagcttgtaccaagcttattcaaaaggtctacgtgtggctttgtttccttttgcttttgtttacggaggatgatcagctgacacagcagaagttggccaaaatgctggctacactattgacttccccacagctccccggcaggctaaccttacagcagtcaagtactccacctttggtgtttcttttaagtattaccattatggtgctactgagcattttcttttggaaaacaaggaaaatgtccgggctgcagtcttgtaccgccgttctcgctgcgtccattagtctgcttagataacactagtgccagttctgttagctgatactgctcattattgtgtgtacatttgtttgcattccagtt

SEQ ID NO: 9672 - DNA, 451 bp, Rattus norvegicus
  misc_feature (46)..(46): n is a, c, g, or t
  misc_feature (108)..(108): n is a, c, g, or t
  misc_feature (128)..(128): n is a, c, g, or t
cagcctatagctgcggagacctcagcacctatcaacagtggggacncccccaccaccatactggagtgattccaactcagaggacacccagagctaccatctggtatntgccagtttccaactgactntacccagcatccccctcccccctttcccataattcatgacatcaaaacatcagcttttcccttgagactcaggagggccaaagcaacagcctttggcttttttctctttttttcccctctcccctagcatgggttgaaggaagggatccatccttattgttcagaggcatcacctccctcccctaagtcaggctgagaaggaaccagccagctcatacctcctcctgattgtttttcttccccacccatttattttttgtttcccttcgacctccccccatcacctctgaagccattttatgaactgtcatgtgccacctgag

SEQ ID NO: 9673 - DNA, 492 bp, Rattus norvegicus
  misc_feature (47)..(47): n is a, c, g, or t
  misc_feature (49)..(50): n is a, c, g, or t
  misc_feature (52)..(53): n is a, c, g, or t
  misc_feature (74)..(74): n is a, c, g, or t
  misc_feature (78)..(78): n is a, c, g, or t
  misc_feature (99)..(100): n is a, c, g, or t
  misc_feature (108)..(108): n is a, c, g, or t
  misc_feature (111)..(111): n is a, c, g, or t
  misc_feature (115)..(115): n is a, c, g, or t
  misc_feature (129)..(131): n is a, c, g, or t
  misc_feature (138)..(138): n is a, c, g, or t
  misc_feature (141)..(141): n is a, c, g, or t
  misc_feature (143)..(145): n is a, c, g, or t
  misc_feature (149)..(149): n is a, c, g, or t
  misc_feature (152)..(152): n is a, c, g, or t
  misc_feature (158)..(158): n is a, c, g, or t
  misc_feature (164)..(165): n is a, c, g, or t
gtacttcgagatgacgcacaatgtggacgattgtggcttttctttgnannanncgaatcagttcttttttgagngccngcgaatcctaactggtggcanngatatcanganggangcaagccacccagnnncgcctcngcncnnncccngcncccagnagaccnnggatgccacgtctgctctggcctctctagattcctccctggaaatggatctggaggggctagaagactactttagtaaatgacgtggcccctggagcaactggagcaaatacattcctgtttgaaaggtttgcctttgtaaacctttctcttcctacccacgcatgctcacacatgtactgggaaagcaggcttgcttccaccttacttttgacagaatgaaaaaggaagagttcctatggaaacctttcattgaatatttcgttttgaatcctgttccagaaaatttaaaacagtactcagggactaaaatcctcaagcagcaata

SEQ ID NO: 9674 - DNA, 485 bp, Rattus norvegicus
aagtatcggtgctccttgataccaccaccaatctcgatcttggacttccttgttggtagccagccataaggcctaccaaccacttggcttctcaacatctctggccttttcctctgctcttcaagtccctgacctttagcaatctgctgagcagactgggaaacattcatggggcatacccgggaagttgctccttttggccgactcctttctggcaccttgccctgtaccaagtggctactctcatggtcacagtacttcacctgttcaccaagttctcagagcaataaaagtctgaagctgctcacaggccgggtgggagtggaatggtgccatagatcaacatgatggcagtagtgcctgtaacattggtggtgctgatcccaagtctgaataatgaccaggcttggcagatgtgcagccagggatgccctctctgggcagatgctagagaacctatgtgtgttacatttccagcttgtctt

SEQ ID NO: 9675 - DNA, 432 bp, Rattus norvegicus
gcagcagaggttgtttctccagtttgtgactggtagcccacgattgccagtcggaggatttcggagtttaaatccacctctgacgattgtgcggaagacatttgaatcaacagaaaacccagatgacttcttaccatctgtaatgacttgtgtgaactatcttaagttaccggactactcgagcattgagataatgcgtgacaaactgttgatagcagcaagagaaggccaacagtcattccatctttcctgatcacaacaagaaatcaatgtctgcctgttacagcaaaagaaaaaaatcatgatttcttttctgtgtcacctgagtcaaggaaacatgttcctccctcttgttgtaggaaaacggcttgcagatttaaattcataatggccctgtggacttaagtgatcaggccctaaagcattgttgtg

SEQ ID NO: 9676 - DNA, 549 bp, Rattus norvegicus
gaacgccgccaagaagagagaccaagagcaggtggaggcggagggcgagagctcagcgccaccccgtaaggtggcccggactgacagccccgacatgcccgaggacacctaggtcctgtgcatcacccatcgtctgtcagctgtgtccgctcccacccacgtgtgtaagcgcagtccgcctcctacatccagtccacgccctccaacctcataggacccatgtatttattttccttgagtttatttatgctgtaactcgtgtcaagcattggttaaagggacatcaggcccagccgcgaggtgtcggtagatgctttttaaagcacagtggtgtcccccacctgcagcaagacctcgtcgggggccagagcccagggagggctggccccccaacacaccgagcggccttctcgctccttcccacccacaggcccggcacccgggtccctcccgtgcccaggcctcactctgagccctcgccagggcaggaaagagctggcccctctggatctttctctttcatcatttatcatggactagcccgtgctc

SEQ ID NO: 9677 - DNA, 428 bp, Rattus norvegicus
agagcccgacacctttgtgaacaagctggaccccagcaaagtgttcaagagcaagaacaagattttaatcccaaaaaagaaagggcctgtgcagcctgtcagtggccagaaagggcccgggcccttagctccgcctacctctaaaccttctgcaggctgtggaaaccctgtccgaaaataagcgttctgtcacctcccatcagtaatatctgggcacagacagccctgtgcaggccccaccattctcctgagagaccaaagccttaggccttcactcccactgttgttagccaggagttgggacaatcacactgaattctccccaggagtccattcctctgtaggttgtgccaacctcgtctccaaatccaacgacggctttcagatgtacctagagctttcttatgtctgtacccaatccttaactt

SEQ ID NO: 9678 - DNA, 555 bp, Rattus norvegicus
  misc_feature (65)..(65): n is a, c, g, or t
ggcagcagcagggtaccttgtatatgctagacagttgcagtgtggaagggctgggccctggggtnagctgtgtgccctgggcagtgcctgttgtgatcacatccagtctcagctacactcgctgtcctgcgctgggttacttcacgagtgagaatgttaagtgccacattggctcagttaatagcttcagtgaggagtgacgaaccctctagaaatcagtgcctaattctcctgggaaccattggtatccatgtcctatctgcagtccagctgctgtccctctattctgtggcttctctctgtggcccctagtaggtgaggtgagtccccatagagcttgtaactgtcctctattgtcacctgggggggctgccttgctgggtggctgtctctttccctccagggagaaaggcggtgtgtacttggaaaataatgtgtgtttacatctctttgcaaagtcctgtacatagagagatattttttaaagcgtgaatgtaacaacatactgtgaattccatctcggttacaaaggagagtccttcagttacctaaata

SEQ ID NO: 9679 - DNA, 426 bp, Rattus norvegicus
  misc_feature (143)..(143): n is a, c, g, or t
tggtctacgacaccaagggccgcttcgcggtgcaccgcatcacgcccgaggaggccaagtacaagctgtgcaaggtgaggaaggtcttcgtgggtaccaagggcatcccgcacctcgtgacgcacgacgcgcgaaccatccgntaccctgacccgctcatcaaggtcaacgacaccgtgcagatctcgctagacagcggcaaaatcaccgatgccatcaagtttgataccggcaacctgtgcatggtaaccggaggcgccaacctgggccgcatcggcatcatcaccaaccgcgagcgccatcctggctcctttgacgtggtccatgtgaaagatgccaacggcaatggcttcgccacccgcctctccaacatcttcgtgatcgggaagggcaacaagccgtggatctcccttcctcgaggaaaag

SEQ ID NO: 9680 - DNA, 312 bp, Rattus norvegicus
gggctcgggagatatcagatgctcagtgggaagatgtggtgcagaaagccctccaagcccggcaggcatcccctgcctggaagtgaccactcagagagctagctgccttacctccctgcattccaggcccggaccagcacaggactaacagttctggttttaacatccaccttcttcccatgtcctttttcacaccaaggcaagtcagacctctcagagacccactttattcagttctgtacatatggggacattggcccaagcccagcccaccttagcctgtatcactctgtggagaataaagcaccctat

SEQ ID NO: 9681 - DNA, 249 bp, Rattus norvegicus
ggtgcgtgcgctggtgcgggtgtgcggtggcccgcgttggtcacccgaggccacgcagcctgtggacacccgcgaccgggagctgctgcagtggctggagcaacgacatctcctgcacgcgctcgtggccgatgcggatcccgcgctagacccggaccccgcgctggacccgcagcttcctcaccaggcttctcagcgccagcgccgcagtgtggccaccaacgctgtgcaccgctgctgtctcactgg

SEQ ID NO: 9682 - DNA, 534 bp, Rattus norvegicus
agatgtggcacagttcagaaacgttgtaacacagttagaagcagatttggacattacaaaaagacaactagggacagaacgatttgaaagggaaagggctgtccaagaacttcgccgccagaattactcaagcaatgcttatcatttgggttcaatgaagccaaatacaaagtgtcactcaccagagcgagctcaccatcgatctcctgaccgagacctcgaccgatcattggaagagaatctttgctatagagatttctgacatgtgaaaagattctccacagccttgggaaggtcaaagatacaaatggattttttgctatgtgattgcatttatcttttgaatgcttgacagggttaaatgtatttattaactttgtgcctctgagtctgttctccagtgccctaccacagaaatctgggatgattgatgtatgcaaacgaaatgcatatggttctttctatccacacagtgatagtgagtgtaaaatctgcttacttcactactgagcactgttttgttaactgtccgga

SEQ ID NO: 9683 - DNA, 557 bp, Rattus norvegicus
  misc_feature (96)..(96): n is a, c, g, or t
  misc_feature (250)..(250): n is a, c, g, or t
tgacaagtaccaacgctgccaagatattcaacctgtaccctcgcaaggggagaatagctgtgggttctgacagcgaccttgtcatctgggatccanatgccgtgaagatcgtctctgccaagaaccaccagtcggttgcggaatacaacatctttgaagggatggagctgcgtggggcacctctggtggttatctgccagggcaagatcatgctggaagatggtaacctgcacgtgacccagggggccgnccgcttcattccctgcagcccattctctgactatgtctataagcgcattaaagcaaggaggaagatggcggacctgcatgcagtcccaagaggcatgtatgatggaccagtgtttgacttgaccaccacccccaaggggggcaccccagctggctctactcgaggctctcccactcggccaaacccaccagtgaggaacctccatcagtcgggatttagtctgtcaggcacccaagtggatgagggtgtccgctcagccagcaaacgcattgtggcgccccctggaggccgttctaacatcacatcc

SEQ ID NO: 9684 - DNA, 419 bp, Rattus norvegicus
accacatgctgtgcctgattgaggactatgatgccctctataagcagatcagctggggccagacactgcttgccaagatggatattcaaacccaagaggctctgagccccacaagtcagaagctgggaccaaaggcttcattctctgtgcctctgagcaagtttctctccagcatgaacacagccaagctgatcctggaaaaagcctccaggttgctgaagctcttctggagggtctctgtccccaccaacggccagtgttcccttcactgtgaccagattggagaaatgaaggcagagatcaccaaactacacaaaaaattgtttgaacaagaaaagaagctgcagaacacagcaaaacttctgcagcagagcaagcaccaggagaaaatcatctttgatcagttggtcatcacccac

SEQ ID NO: 9685 - DNA, 571 bp, Rattus norvegicus
  misc_feature (337)..(347): n is a, c, g, or t
  misc_feature (349)..(351): n is a, c, g, or t
  misc_feature (353)..(356): n is a, c, g, or t
  misc_feature (360)..(368): n is a, c, g, or t
  misc_feature (370)..(371): n is a, c, g, or t
  misc_feature (373)..(373): n is a, c, g, or t
  misc_feature (376)..(378): n is a, c, g, or t
  misc_feature (381)..(384): n is a, c, g, or t
  misc_feature (387)..(389): n is a, c, g, or t
ggaaggtattcccatctgtcagcagcacttaatttggaataacatggagcttgaagatgattattgcttgaatgattacaacatttccgaaggttgtaccttgaagctggtattggctatgcgtggcggaccaataagtactagaaaagttcctgtggaagacccactcagggagcttgctgagtacatggattccagtcgagatgaggtctgggaaaagacctcttgcaacaaacaagttacatttttggtataccgggaaggagatcaactaaatttctttcgtgtagtagataggggagatggcactttaacaccattatcagaatctttaagnnnnnnnnnnntnnntnnnntgtnnnnnnnnnannangannngannnngcnnnctccttctgggcaacaaatcattgaaaattcaataactatgaacaagatgaagctgctgaaggctaagatggagaacatgaatctcagcaaaaaggtgaagccgttggctgtgcgccaagcctttctctagcttacactggcagggctcgcggctccgaggtctgctgctaactggaaaact

SEQ ID NO: 9686 - DNA, 463 bp, Rattus norvegicus
  misc_feature (282)..(282): n is a, c, g, or t
  misc_feature (284)..(284): n is a, c, g, or t
  misc_feature (304)..(304): n is a, c, g, or t
aactgtaggtgctgttgccttggactgcaaagggaacttggcttatgcaacctctactggggggattgtcaataaaatggttggccgagttggagactcaccttgtataggagctggaggttacgcagataataaccttggagccgtttcaaccacaggacatggggaaagtattctgaaggtgaatctggccagactcgccctcttccatgtagagcaaggaaagaccgtagatgaggctgctacgttggcactggattatatgaagtcaaagctcaaagncntaggtggcctcatcttgatncaacaagacgggagactgggtggcaaagtggacctctgcctccatgccctgggcagcggtgaagaacggcaagctgcaggccggcattgacctttgcgaaaccaagacaaggaacctgcccacttgctagcctggatgtgaagtcaagctgcctgcagt

SEQ ID NO: 9687 - DNA, 429 bp, Rattus norvegicus
acacgtgagctgttctgttacgcacagagcatctcccacattccacacattttatgcttgctatcctcgagagttagtggagttggatttgccggggcgacaggttacagagtcctttcacatcttccagctggaaaatacagggcccttaggaccctgtgccgactgcagtggggagacatggttgttgtatcatctggagaagacatggtctcccagaaggctggccatgaacctcagaccaggctggggcaagtgaccttgtcacacagtgccaggaacttggcttctcatactgaagtgaggatcttaaacagaaatgtccttttctgttattatccaccacgaagctaaaggctgaatataaactgcaaattgctttcttttaatgaaaactcagatccctccttcagccttgcagatttttaa

SEQ ID NO: 9688 - DNA, 530 bp, Rattus norvegicus
tgtcttgtaccgacgcggatatcgacatggctgccgtggagatcctggccccgcccgtgctgacagctgaatgcgaaagcaccggggcccgtgtgaggtgggcgccgcagagccggttccagacggccttcgtgttcactctgcagatcaaccagagttcacagacagagccaaagcttgagatggtatatgagacagaattcaaggtcccgaccctggacacggtttctgtgcgtgtcaaggccacagccctggactcgggcgtggagagcgactggagcaaggcctggagcctggactgtggccccacagcgactctggcaaccccgatgacatcgctgctcctggcgggggcgggcgcggtgctcacagtgatggctgtgctgctgctgtgctggaggaagtcgctgctgagccgcctgttcccacccatcccaaggatgagagtcctacctgggccagagatggttgcatgggtcgaggcacctgagaactgcgaggtgacgctggtgacagacaactgagccctg

SEQ ID NO: 9689 - DNA, 511 bp, Rattus norvegicus
tctcctgcgcgacatgccaagaaatccgacggacaaagttgtcagcactgtttattaacttgatcagtgatccttcacgttgggttcgccaagcagcctttcagtccctggggcctttcatatccacatttgctaatccatcaagctcgggccagtgcttcaaagatgagagcaaaagctcagaagacaaagacaggatcagagacgatggtgttgtacaagaagagcagagcaggccagaggacgcaccttcagacctcagtgcccctcactccagtgccaggctggacggcacacttgaaggctgtgctgccgagacgcctggggactctgcaggtgacatgcgtgttccagcggacagctccttactctgtactttgtcctcagagtctcctcaggaagcagctagtgacgctgagagtggtaaaaagcacgataacaacagcaagtctgcgtcccggccagacgttggcaccagctccccagagcccactcccttagatcaggaaat

SEQ ID NO: 9690 - DNA, 513 bp, Rattus norvegicus
taagcgtcctggagtctacacagccacctgggactacctggactggattgcttccaagatcggccctaccgccttgcacttgattcagccggccacccctcacccacctacaacccagcaaccggtcatctctttccaccctccttcgactccaccctccttggtacttccaacacctgtctcctcggccgctttacctacgccgcctcggcctctgctccatcagccgtcttcagtccatacctcctcagctccagtcatacctctactctccctgctcaccccagtccagcctgtgtcctttacccttgctgcgtaccacacaaggcaccacacaacgctgtcttttgcttcggcgttacagcatctcatagaggccctgaagatgagaacttaccctataaaatatccctcccggtacagtggacctgtgaactaccagcaccgcttctccacgttcgagcccctttccaacaaacccagtgagcccctcctccattcctgagaaaagag

SEQ ID NO: 9691 - DNA, 438 bp, Rattus norvegicus
gacgtgtcacaatgtctgaccggaaggcagtgatcaagaacgcagacatgtctgaggacatgcaacaggatgccgttgactgcgccactcaggccatggagaagtacaacatagagaaggacattgctgcctatatcaagaaggaattcgacaagaaatataaccctacctggcattgtatcgtgggccgaaattttggcagctatgtcacacacgagacaaagcacttcatctatttttacttgggtcaagttgcaatcctcctcttcaagtcaggctaggtggccgaggtgaaggtgtcagtggcggcggcagcgatggcaagcaggcggcgttgctgggactgttttgcactggggccagcatcaggaagtcctctccaatggctgtgctactgcatggactgtatactcgatttcatgtgtgtgtcgcagtaaa

SEQ ID NO: 9692 - DNA, 499 bp, Rattus norvegicus
  misc_feature (438)..(438): n is a, c, g, or t
gaggctatcctgaagtgacgttaatggattgtatgaggctcttcaccaaagaggatgtgttggatggggatgagaaaccaacatgctgccgctgccgggccagaaaacgatgtataaagaagttctctgtccagaggttcccaaagatcttggtgctccacctgaagcggttctcagaatccaggatacgaaccagcaagctcacaacatttgtgaatttcccactaagagacctggacttgagagaatttgcttcagaaaacaccaaccatgctgtttacaacctgtatgctgtgtccaatcactccggaaccaccatgggaggtcactatacagcctactgccgaagtccggttacgggcgaatggcacactttcaatgactccagtgtcacacccatgtcctccagccaagtgcgcaccagcgacgcctatttgntcttctatgaactggccagtccaccctcccgtatgtagcattgaggagctacaacccttcc

SEQ ID NO: 9693 - DNA, 571 bp, Rattus norvegicus
  misc_feature (404)..(404): n is a, c, g, or t
cctttcttaatgttcaggctgcagaggaagccctgcccaagattgttgagttaatgggaagagaattgaactggagtgaattgaggaaacaggaagaacttgaaacagccacgaggtttctgtactatgaaatgggctataagtctcgaacagaacaactcacagatagtactgaaatcagcctgctgcctccagacatcgatcggtacaagaagagatttcacatgtttgatgaagacgaaaaaggcttcattaccattgttgatgttcaacgtgtgctagagagtatcaatgtacaaatggacgaagacacactacatgaaattctctgtgaagtagacttgaacaagaatggtcaggttgagctccatgagtttctgcagctgatgagcgcagttcatacnggaagggtgtctggaagccggcttgccatcctcatgaagactgccgaggagaacttggaccgtagagttccaatccccgtggatcgtagttgtggaggattgtgagtctgaccaataaatccacaaccaacaagcctaggacagtcagcactatgtacaaccagaga

SEQ ID NO: 9694 - DNA, 529 bp, Rattus norvegicus
aactaatctttttcgacaacagcaaaagatttttcagcagactagaattgttcagagccagagaatgaaagcaatcaaacagctacatgagcagttcataaagagtttggaggatgtggagaagaacaatgataatctatttactggcacacaaagtgaacttaaaaaagaaatggctatgttgcaaaaaaaagttatgatggaaactcagcagcaagagatggcaaatgttcgaaagtctcttcaatccatgttattctgatgagtctttgaagaaagaacttgaacctatgtaatatgatacaattaaaacattagctaagaggcatgcctttagtaattagtttaaactataacatcggaagtcattagcttgtttaagtggaaggtttttgttcctgtcaacttctaaataaatctaagtaactgtgtaagtagcagctattccaatgtatcaagctttctggggtttgtttgtttgtttgtttgtttgtttgaatagttgttctctccactattgtgtcaataa

SEQ ID NO: 9695 - DNA, 503 bp, Rattus norvegicus
aaggagtactcccatcgaagctctctgtgagaactttccagaggagatgatgacctaccttcgatatgtcaggagattagacttctttgaaaaacctgattatgagtatttacggaacctcttcacagatctgtttgaacggaaaggctatacttttgactatgcctatgattgggttggaaggcctattcctactccagtaggatcagttcatgtagattctggtgcatctgcaataactcgagaaagccacacacacagggatcgaccatcacaacaacagcctcttagaaatcagccaagatctttaacagcagagtggtttgtgctggctcccctttcccaccctccagcacccacataagcaggagtcatgtgctggcagtgaaagcaggtggcaggagcggctgcacaacaagacaagcctgatcgggtccacactaaccagatgacaggagtgggagacagagccttcattgacagttcgggaccatcagtgagca

SEQ ID NO: 9696 - DNA, 574 bp, Rattus norvegicus
gacagggtgcttaagtccccagaaaatggcttctgggtagtgcagctgtccaaggggaagaaacatctgcccctgctacccaattccattccagtcacactcacggagcctcccagccacatgggtatcttcctggacttccaggccggagaggtgtccttctacagtgtgaacgacgggtcccatttgcacagcttctcccaggttgccttccctgggccgctgctgccgttcttctgcttggggtctccaaagtcgggccaaatggtcatctccacagtgaccatgtgggtgaagggatagaggcttggagaagggcacagacactgggtgtgctatggttccccagaaggcagggcgcttcaccaccgtggccacctacctaggattctctggattctctggggtgctaagagttaatacctgtgctggcagggcaactaagcaaaatacaatcaagattaaaatgctcaagtgagaaagacgactacagataaaatgctaaatggggggggctttggaaagagtcttgatgatcaactcatttctaaatatatacgtgctcaccctgcag

SEQ ID NO: 9697 - DNA, 563 bp, Rattus norvegicus
gtcaaaactcccaaacagactcctttatctttatcaactcctgcatcttttacgaagtttggaagtctgaaaaaaatgagagaagaccgttgggcaacgattgctaaaattgataggaaaagaagactaaaggaagcagaaaagttatttacttaatttcagaaaatcaatgttggttatagagactaatagttaactttattatttcccagagagccaaactttactgaggaattcagactttaaaattaattacataaataatttgtttgttatgtttgtggtctaaatataaagtaactatatttgaatttttttattgtattcagatacttagattttgttgcttttacttgcaatggatattgaaattcaaaggttttttttgtttttgtttttttttttttttgtcttctcctccctacccccaagagctgaggaccaaacccagtgctttgtgcttgctaggcaagcgctctaccactgagcttaatccctaaccctgaagttcaaattttttattttgagcttttgaccattagaaatgcattatcgagacttat

SEQ ID NO: 9698 - DNA, 245 bp, Rattus norvegicus
agaacaaaggtgttatctggacagaagaaactttgatggaatatttggagaacccgaagaaatacatcccaggcactaaaatgatttttgctggtatcaaaaagaagagtgagagagaagaccttattcaatatttaaaagaggcaacatcctcatgagttagtattacagtttcaaaaatatgtgaccaatttcaaatgttgtgtttagtaagaagcatatctgactttttgatcagcctaaag

SEQ ID NO: 9699 - DNA, 440 bp, Rattus norvegicus
  misc_feature (44)..(45): n is a, c, g, or t
  misc_feature (69)..(69): n is a, c, g, or t
  misc_feature (73)..(73): n is a, c, g, or t
  misc_feature (78)..(78): n is a, c, g, or t
  misc_feature (269)..(269): n is a, c, g, or t
attcattaacatgcccagcgtgcagcatgacagactacatgagnnggggtacaagacttagttgagacntganagggnaaacctataggagagtagtgaaacagtgcatcccaaatgacaaggcttctttccttcctggatttatatagaaatgtctttcatacaagccattaagaaaggtgtcatttaggataacaactctggattttgaccaactttgctgcttcaaatgtagtgaagcgaatcaagtggagaattttgaaagttgnaccataactggtcattcacctctagaactttgaaaaggagagaactgtttgtgtgtcctaaaccaacctgcaatggaagaatgggctgtagttacatcaccatcaacctacttcatagtgcctaccaggatgaatcttgacatctagatttgtcttatgtcttcttacttt

SEQ ID NO: 9700 - DNA, 519 bp, Rattus norvegicus
  misc_feature (28)..(28): n is a, c, g, or t
tttccagttcagctagtatacctatcancttgattatcctccgaactttacctacaagtttacattcactgggcctagctgtgacctatacaatattgagaatatttggttccatccctggaccactgctttttcgaatagcatcaagtagttcttgttcttactgggacattaataaatgtggactcagaggacattgttggatatataataagtttaaaatgatgtccatattgatgggattatgtatttcttgcaaattaatctcaaccttgctctccctcttggcacttttaaagtataatgttttaagagttggaagtgagggcgtaaagaaaacaaaagaaagcaaaacaagaaaaacgtaattcttaactgatttcttctttggtttcctgagctccgaggaacaagatttgattgagacatcccatctaaaggactggagaacctgtgagggtccaggttcgaaggacagcagcctatcctttggagatttcctaagattgtggcagcact

SEQ ID NO: 9701 - DNA, 219 bp, Rattus norvegicus
cgcaaactaaagactcatggcatgaggagaggcaagaaccgagctcctcacaagggcgtcaagagaggaggaagcaagagaaaataccggaagagcagcctgaagagtaggaaacggggcgatgatgcaagtcgcaattaccgatcccacttgtaatgcggcaatgagctctagcctggtggtcttcaaactacaccaggcagcaacaagacatcagag

SEQ ID NO: 9702 - DNA, 483 bp, Rattus norvegicus
  misc_feature (156)..(156): n is a, c, g, or t
  misc_feature (391)..(391): n is a, c, g, or t
  misc_feature (393)..(393): n is a, c, g, or t
  misc_feature (413)..(414): n is a, c, g, or t
ctgtggcatttgctcttgctgaaatgctgaaggtgaacaaggtgttgaagacgctgaatgtcgagtccaacttcatctccggagctgggatcctgtgcctggtggaagctctcccccacaacacttctctggtcgaactgaaaatcgacaaccagngccagcctttgggcaacaaagtggaaatggagatcgtgaacatgttggagaaaaacacaacactcctcaaatttggctaccactttacccagcaggggccccggctgcgggcatccaacgccatgatgaacaacaacgaccttgtgaggaagaggaggctcgcagacctgacggggcctattattcccaagtgccgcagcggtgtctagtgcgcaaagggacgcccacgcctatnanctggacgtgttctaccgatnntgtgtgttccccagtggagaccaggaggcaaatgttggcgtgaactcttgtggttcagttctttgtgca

SEQ ID NO: 9703 - DNA, 510 bp, Rattus norvegicus
gtgttatcaatgcttccagtgccacctacagtcggcccaaccttcagctttgaattggatgtggaagatggagaagttgaaaattacgaagccctgttaaacctggcagagagactgggagaggcgaaacctcggggactgactaaagcggatattgaacagctccctttttacaggttcaaccctagcaaccaccagtcagagcagactttgtgtgtagtatgcatgtgtgattttgagtcaaggcagcttcttagagtcttaccctgtaaccacgagttccatgccaagtgtgttgataaatggcttaagggaaatcgtacttgcccaatttgccgagctgatgcttctgaagtgcaccgggattcagagtgaccagcctaagagcacagatttagtttgggtgttcctcatcacatgtatatatggactatccactgaacttaacctgtgtggcttccagccctccctttaccaaaagggtcaatggacctttctttgcactgtgtg

SEQ ID NO: 9704 - DNA, 478 bp, Rattus norvegicus
gaagttcttggcaagcccgaggttaaagacttggaatacttttctgaacattttaaatgcagctgttttagcaaaatgacatgtgaggagacatctgatatgcgaagtatacaagatgtgaatgtgtgcatgggtgacaatgtttgtataaaagccacgctaggacccaactcagcattccacctcctacctggcaaaggcctcctccttatgacaacacttgctcacatcttgcaccatctaccacatgatatttttgtttttccgtggaagatgctagtcagtactccttagttttctctatccagagcatttgctatattatttttttgcaggcctcggtaatttgggattatgaatgtgattctattttgcaaaagcaattcaattttaataatcaagattctatttttgagtttcaaagacaaattatatactcttccaccaaagactgattgcaagcaaggctactgaactt

SEQ ID NO: 9705 - DNA, 513 bp, Rattus norvegicus
  misc_feature (130)..(130): n is a, c, g, or t
  misc_feature (402)..(402): n is a, c, g, or t
agggaaccttgggagctacagcgcttacagccagacgggatgcgtgccttcctttctcaagaaagaagtgggatcagctggccagaggatccacttggcgcctctgggtgcgtcggctgccgactatacntggagcacaaaaactggccgaggccagttttcaggacgaacttacaatcccacagccaaaaatctcaatattgtgaaccgcacacagccagtcccctcggtgcacgggaggacagactgggtggctaagtacggaggccaccggtaggagaagtggaagcctgaagcattgctccgtagaggacaatcacgccccttgatcctgggagacgtctacagagtctatttctaccgagttccacaggacgcacacaaccgtgggcgcctcagagnccggaagtcagctcccgatttcttccttttccggaaatgcaatgcattttcttaacttgtggccagcagtgctgatgcagcaccgtgctgaaacttttgagcgggactttt

SEQ ID NO: 9706 - DNA, 535 bp, Rattus norvegicus
aaggctgcctatgagagtctgatactagatgggctttttatggaaattctcaatgactgttctgatgtggatgagatcaaattccaggaagatggttcctggtgccccatgagacctaagaaagaagctatgaaagtaaccagccagccctgtacaaaagtagaaagttcaagtgtctttagtaaaccttgttcagtgactgtagccagtgatgcaagcaagaagaagattgatgttattgatctaacaatagagagctcttctgatgaagaggaagaccctcccgccaaaaggaaatgcatctttatgtcagaaacacaaagcagtccaaccaaaggggttctcatgtatcagccatcttctgtaagggtgcccagtgtgacttcagttgatcctgctgctattccaccttcattaacagactactcagtaccattccaccacacgccagtgtcgagcatgtcatcagatttgccaggagaacaaagaagaaatgatattaataacgaagtgcagcttggaacatcttctgata

SEQ ID NO: 9707 - DNA, 548 bp, Rattus norvegicus
  misc_feature (67)..(67): n is a, c, g, or t
gaagtggctgtaacctagactccgctcgtttccgttacctgattggagagaagctgggtgtcaaccnttcgagctgccatggctgggttcttggagaacatggggactccagtgtgcccatatggagtggtgtgaacattgctggcgtaactctgaagtcactgaacccagcaataggatccgactccgataaggaacagtggaaaaccgttcacaagcaggtggtggatggtggctatgaggtccttaacctgaagggctatacctcttgggccattgcgctgtctgtgactgatatcgctgcatcaatcttgaagaatcttaagagggtgcatgctgttactacgctggttaagggcttatatgggataaaggaagaaatcttcctcagtatcccgtgtgtcttgggacaaagtggcatcacagaccttgtgaaagtcaacatgaacaccgaggaggaagctctttttaagaagagttgcgacatactctggaacatccagaaagatctgcaattataaagtctgcaccttcgactgtttgataac

SEQ ID NO: 9708 - DNA, 568 bp, Rattus norvegicus
gtggaatacattgtcccctatgtcgcggaagtgtgactagaagagaaagagcatgtccggaacgggccatagatcttgaaaatatcatgaggagggtttctggtagctgcagatgctgttcaaaaaagattaaattttatcgcatgagacatcattacaaatcttgtaagaagtatcaggatgaatatggtgtctcttctgtcattccaaatgttaagatttctcaagattcagtaaggagcagtaataggagtgaaacatctgcatctgataacacagaaacttatcaagaggatacaagttcttctgggcatcccacctttaagtgtcccttatgtcaagagtcaaatttcaccagacaacgtttattggatcactgtaatagtaaccacctgtttcagatagttcctgtgaatcttcagctagatgaggaaacccaatatcaaactgctgtggaagagtctttccaagttaacatgtgatgtgtgtagacatctctgcctccttgctacctacaagtgccatctttaaggagaagacatgaagtcaccgttttcagtaatttgct

SEQ ID NO: 9709 - DNA, 474 bp, Rattus norvegicus
  misc_feature (27)..(27): n is a, c, g, or t
  misc_feature (93)..(93): n is a, c, g, or t
aaaggaccacctccacaatgtgatggnccatctgcagcaggagaacaagaagctgaagaacgagattgaagagaagaagctaaaggctgggancccgaggatctgtgccaaggtcctaggcccgtgcaaactggagccgtcccagaagggaaagctgtgcggtgcactgggctggagaggagtatgccaggacccactgccgaaaatggacctcaccaagtacaccggggtgcctcactgctcaggatcctcctattgctagacttggctcttcaccctaagcgtctcttctacacgtatacagaggaccgtgagttcccgcccctctttcttgaccggaatcagctcctacagtcgtccgtcaaggcccctgcctcgtttgcaccatgctcatgcattattgttttgcctacttcctgaagtggagttgtggtacctcactccccccagactctgggcccagactctgaaata

SEQ ID NO: 9710 - DNA, 521 bp, Rattus norvegicus
  misc_feature (164)..(164): n is a, c, g, or t
gacctgtaggaacacatctggcattctaggattttctgtaactgttgggactcaggcaaccaaatacaactctgaaactgttgacaagaagatagaagaatttctttccagctttgaggagaagattgagaacctcacagaggatgcattcaatactcaggtcncagctctgatcaagttgaaagagtgtgaggacacccacctcggggaggaggtggacaggaactggaatgaagtggtgacacagcagtatctctttgaccgccttgcccatgagattgaagcgctgaagtctttctcaaagtcagacctggtcagttggttcaaggctcacagaggacctgggagtaaaatgctcagcgttcatgttgttggatatgggaagtatgaactggaagaggacggcgctcccgtttgtgaggatccgaattctcgtgaagggatgcagctaatctacctgccaccctctcctctcctggcagagtccaccacccccattactgacatcagggccttcacag

SEQ ID NO: 9711 - DNA, 528 bp, Rattus norvegicus
  misc_feature (257)..(257): n is a, c, g, or t
gacaaccccaaccagagtgacttgattgagcaggcggccgagatgctctatgggttgatccacgcccgctacatcctcaccaaccggggcattgcacaaatgttggaaaagtaccagcaaggagactttggctactgtcctcgagtatactgtgagaaccagccgatgcttcccatcggcctttcggacatcccaggagaggccatggtgaagctctactgccccaagtgcatggacgtgtacacacccaagtcctntaggcaccaccacacggatggcgcatacttcggcactggtttccctcacatgctcttcatggtgcatcccgagtaccggcccaagcggccggccaaccagtttgtgcccaggctctacggtttcaagatccatccaatggcctaccagctgcagctccaagccgccagcaacttcaagagcccagtcaagacgattcgctgagtgccctcccacctcctctgcctgtgacaccaccgtccctccgctgccaccctttcaggaagtctatgg

SEQ ID NO: 9712 - DNA, 551 bp, Rattus norvegicus
  misc_feature (39)..(39): n is a, c, g, or t
  misc_feature (58)..(59): n is a, c, g, or t
gcatgattcaagttcgacctggccatgcattgcccatgngtgaacgtagcggcacccnngtgcgtctactgcagatgtccagctaggaaagagtcccctctcttggacagtcttctgggcccttccaagcccatccgtggagtcggcctctcctcccctctcccccgtgtgaagtgtgttatcaccagcagacactgccggactcctgcccacaggggcgtggcctgaagggcgagtgtggacatggcactgctgttccgttcccttcccctcccagcacccgccgcagcctgccatcccgtctggatgtatcgatgccacagaattgtgaattgtgtgtccgtccgtggagccagtcctagccacattattgacagtcttgcattttgttttgtctcctggtggtgggggtggaggtggtaggggtgcgctaaggtgggcagtcctgtgggagaacatcttgctagaaggaaccaacccacgaaacaacaccatcactggaatttcccatcgcccgaattctttagtgagccattgttgtacgtctagta

SEQ ID NO: 9713 - DNA, 191 bp, Rattus norvegicus
  misc_feature (42)..(42): n is a, c, g, or t
  misc_feature (82)..(82): n is a, c, g, or t
gccaaagaaccatgaaccaaagccatgaaccaaaataaatcntcactcatttcagttgtatcaagtgttttgtcccaacagnggatactaacactcatgggtaatggcttttgtctatatgtatgtatgtttgtaaaagtgaatattatatatctatatgcatactgtgtgctcacaatatcatatacatt

SEQ ID NO: 9714 - DNA, 180 bp, Rattus norvegicus
tctccaaaagccaggcggacatcctggatcctactcaggatgaccaaaagccattaagttcagataacatcgccttaccacccaacccagacaccactgactaggtctacactcatcataacaaaggacgagaagaggaggatttggggaccagctttgctctcctctgcctcagcatgg

SEQ ID NO: 9715 - DNA, 120 bp, Rattus norvegicus
agagaccctagacttgggacaaagagcaactcgaaggctccaggctccacaaatgacaaagtgcttgaggttacagaaagaagactcatattcttgagtcgtcttgagagactcaagagt

SEQ ID NO: 9716 - DNA, 215 bp, Rattus norvegicus
gatggcgtttcaggtatcagtgacaggctgaacccagactcccagggcccatacttccacctgatgaatgatggcctgaactatgagcaaacgggactatatgaacacttcggtgcaggagcctcctcttgactactccttcaagagcgtccaaatgattcaagatctgataagcgaggagccaaggacaggtctacgaccagtgaagtattcaa

SEQ ID NO: 9717 - DNA, 216 bp, Rattus norvegicus
gacttatcccgagcaagtgtcgagaacatcaggagcccatgttgttgtcaagctatctaccaccgaaagtgtatccagaaatatgcccacacgtcagcaaagcacttcttcaagtgcccccagtgcaacaaccgagaagagtttccacaggagatgctgaggatgggaatccacattccagacaggcggtggcgcctcattttgtgtgcgacatgt

SEQ ID NO: 9718 - DNA, 452 bp, Rattus norvegicus
gtacatggaccagcttcatcgatatacaaagctttcttaccgggtggtgtttcctttagaactccgtctgtttaacacttcaggagacgcaaccaaccctgacagaatgtatgacctggtcgctgttgtggttcactgtggaagtggtcccaatcgaggccattatattgcaatagttaagagtcatgatttttggttgttatttgatgacgacattgtagaaaaaatagacgcacaagctattgaagaattctacggactgacatctgacatctccaagaactctgagtctgggtacatccttttctatcagtctcgggactgaaaggtgccgcagtggaaagaagcttctgcttgcttctctggttgcttccgaaaggatcgagctgatgtttaagaagagagaaagagagacagacagacgcaggacgctcagggcagtagctcacttt

SEQ ID NO: 9719 - DNA, 298 bp, Rattus norvegicus
gaaagtatggaatccagcttctctctgaacgccatcgagccatgtgtgatttgccaggggcggcctaaaaatggttgcattgttcacggcaaaaccggacacctgatgtcatgtttcacgtgtgcaaagaagctaaagaagaggaataagccctgccccgtgtgcagacagccgatccaaatgattgtgctcacgtacttcaactagacggcgggcagacgcagacctttacacttctaatgtatgacccccaaattagacaacatgggtattattttcatacattaaagccggagca

SEQ ID NO: 9720 - DNA, 337 bp, Rattus norvegicus
  misc_feature (30)..(30): n is a, c, g, or t
cctttgaagcccgattactgtgtgaagcangccatgaaggccatcctcactgaccagcccatgatctgcacccctcgtctcatgtacatcgtgacattcatgaagagcatccttcccttcgaagcagtcgtgtgcatgtatcgatttctaggagcagacaagtgtatgtacccctttattgctcagagaaaacaagccacaaacaataatgaagcaaaaaatggaatctaaagtgcttttgtacggagtgccgtttctgtcaggatggttggtccgtgtgcatcagcagtactgaacgtctggattcgaaccccatgccgactgtttttctaatcaa

SEQ ID NO: 9721 - DNA, 273 bp, Rattus norvegicus
ggtgcatctgctcatggacttcggagccaatgctcaaaccaagaatgcagatggcaaacgtcctgtggatctggtgcctctggagagtcctgtgattgagatcttcttacagagagaagggcccctctctttgatgcagctatgccgtttgagaatccggaaatgctttggcattcggcagcatcacaagattactggacttcttcttccggaagacctgaagcgcttccttttgcacctttaattgtggagggactggatccacaagcaact

SEQ ID NO: 9722 - DNA, 267 bp, Rattus norvegicus
aaattcaagtttctgcgggagctggtgggagacacaggatcccaggaaggagataatgagcagccttcagggtctgaagcagaagaagacccttcggcttccccacacaagatgagatctgctcgtcagcgaaggccgccggttgacgatggccactgagtggagagtgagcagcagcttccgagtgtggtctggggcagttatgagctccgtccttagtgacctagcttcgaaagttactaagtgaccaaggaacatttgcaattg

SEQ ID NO: 9723 - DNA, 466 bp, Rattus norvegicus
  misc_feature (43)..(44): n is a, c, g, or t
  misc_feature (186)..(186): n is a, c, g, or t
  misc_feature (218)..(218): n is a, c, g, or t
  misc_feature (220)..(221): n is a, c, g, or t
  misc_feature (223)..(223): n is a, c, g, or t
gaacaacattccagctgacatcgtctttgttttaaaggacaanncacacaatatcttcaagagagatggttctgatgtcatttatccagccaggattagccttcgggaggctctctgtggttgcactgtgaatgttcctactctggacggcaggaccattcctgttgtattcaaagatgtcatcangcctggcatgcggaggaaagttcctggagaangnntncccctccccaaaacacctgagaaacgtggagaccttgttatcgaatttgaagtcatcttccctgataggatccccatctcatccagaaccatcctggagcaggttcttcccatatagctgcctgcattcctcaaggactgagccagggacctttccagagctgcagatttccagaccgttccactggttgcatactgcgggagggcccagggagggcttttgctctgccgaatgttttccaca

SEQ ID NO: 9724 - DNA, 367 bp, Rattus norvegicus
  misc_feature (251)..(251): n is a, c, g, or t
gggcaacccacgtctaccgttatcacagaaggaagcctgcagaagtgcacgtgtgctcagactcggggcacagggaagcgcaaagaaactgcagaggagagacatctgttggtccaggaagcatctatcaaacatcagagcattctcaagagtcatcttggcctattgagaacatctctaaggacctctacatagaagtctatccagggacctattctgtcactgtgggctcaggtgccttaagcaagaanacgcatgtggttgcagttgactcggggcaaagtgtggacttggtgttccccgtatgatgttgacatcactgccatcatttcactctaagaagaagaataaaaccaccctataactg

SEQ ID NO: 9725 - DNA, 72 bp, Rattus norvegicus
agaggagagacatctgttggtccaggaagcatctatcaaacatcagagcattctcaagagtcatcttggcct

SEQ ID NO: 9726 - DNA, 495 bp, Rattus norvegicus
  misc_feature (112)..(112): n is a, c, g, or t
  misc_feature (175)..(175): n is a, c, g, or t
  misc_feature (280)..(280): n is a, c, g, or t
aaatcctcccattctgtttgcaatgttcaacatgagctttcattgccaaacccagtgcagaaggaatcacgggaagaaaactggcaagagtggagacagagagacgagcagntgacctctgaaatgtttgaagccgacctcgagaaggcgctgctgctgagtaagctggagtacnaagagcacagacaggattatgaaaatgctgaaaacgcttcaactcagacaaaagttataaataaaaaagataaaagaaagaaccatcagggaaaggacaaacctntcacggtgtcactcaaagatttccagtgtgaagatcatattagtaaaaagacagaggaatcgaattcttctcagcctttatcacatgatggaggcttcttcaatagactggaagatgatgttcataagattcttgttagagaaaaaaggagagagcaacttacagagcacaacggaacagacaactgtcctgccccagagcacaaccaggaagtg

SEQ ID NO: 9727 - DNA, 44 bp, Rattus norvegicus
gacagaggaatcgaattcttctcagcctttatcacatgatggag

SEQ ID NO: 9728 - DNA, 388 bp, Rattus norvegicus
gagggagagtcaaaccagccactgccaccccaaagctgtgcaagtgaccccacacttgcccagtctagtgaaggtggagacagtcagctgcctgcagccactccactaggagatggagctgagaatgaagcacagtcttcgttgtacccagaggagcccagcacccggataggcctggaagatattgaatttggcttggactgaaccccaaggcagtctacactgttagtctagcagtggtgcagcggatgcagggcaccctcttctatgtatccctgctggtttgctccggcaccctgcatggcaggtgctgtgcagctacaccagtgtgcctgccgtgtacccaacacatcggtttcccctggttacagatcccacgagaacataa

SEQ ID NO: 9729 - DNA, 383 bp, Rattus norvegicus
  misc_feature (269)..(269): n is a, c, g, or t
  misc_feature (308)..(308): n is a, c, g, or t
  misc_feature (357)..(357): n is a, c, g, or t
aagacggtggagtgtattcatcttctggcttaaagcagattcccattaaatggacagcaccagaagcactgaattatgggagactttcagcctgggagtctgtccgtaccctgggatgacaaaccagcaagcacgggaacaagtggagagagggtatcggatgtcagccccacagaactgtcccgaggaaatttttacaatcatgatgaagtgctgggattacaagcctgaaaaccgccctaagttcagtgaccttcacaaagagctcncggccatcaagaagaaaatcacatagtgccacccagggntagactccacctgcgggactctgtcctcagtcaccctgactttataccnccttactgcaaccatctttgaaggtt

SEQ ID NO: 9730 - DNA, 368 bp, Rattus norvegicus
  misc_feature (79)..(79): n is a, c, g, or t
tacagtgcggtccacaacgaccagttcggcctttcgcacttcaattggccggtgccgggcgccaactaccacgtcctgngcactggctgcttccccttcatcaagtaccattgctccaaggcgccctggcaagacctggccgcgcaaaaccgcttcttcaccgcgctcaaggtcatcaacatgggtattccaactttattatatggacttggctcctggttatttgccaaagtcacagagactgttcataccagttacggaccaataacaatctattttctaaataaagaagatgaaggtgccatgtattgaaaatgtgcattggaaaacactaatgtcaatgaatttgttcctctctgtgtgtatat

SEQ ID NO: 9731 - DNA, 413 bp, Rattus norvegicus
  misc_feature (40)..(40): n is a, c, g, or t
  misc_feature (42)..(48): n is a, c, g, or t
  misc_feature (261)..(262): n is a, c, g, or t
  misc_feature (264)..(267): n is a, c, g, or t
  misc_feature (269)..(269): n is a, c, g, or t
  misc_feature (271)..(272): n is a, c, g, or t
  misc_feature (274)..(275): n is a, c, g, or t
  misc_feature (278)..(279): n is a, c, g, or t
  misc_feature (281)..(286): n is a, c, g, or t
ttggtgggcctagagcaagttgactaagcctctgcaaacngnnnnnnngaaaatttacgaaaaagcctattggagttggaaataatcgcctgtggaaatgtcacggacaacggcgtcattgctttgcgacactttaagaacctcaagtatttgttcttaagtgatcttcctggaataaaagataaagagtaccttgccgaagtctttactaaagcactgccttctctggaactaaaattaaacctgaagtaaaataagtgnntnnnntnannannaannannnnnngaaattgctgatactagatagctacaaatattacataatcagcagtagaactgtgaaaatgacttagaaatggagaatggatcaggaagagaataaataatcagaagtcactcactgaagtcactta

SEQ ID NO: 9732 - DNA, 433 bp, Rattus norvegicus
  misc_feature (45)..(45): n is a, c, g, or t
  misc_feature (323)..(323): n is a, c, g, or t
aaaccagtcagttttggtaccactgaaggtacagttgtgaggacnctcagttacaggtggcagcatgaagtgacactgtgtgtcctactgcaggatactggaaaggttccctcctctgcactgagatcaccctgcagcatcactgtgagttgcttgctctgtgctgctacttgggcggcactgcccatttatttatatttagattgtaaacactgctgctggtgattgttggtttaagggacagaacttttaagtgttcaagccacctgtacaattggactttttattttaacctttcccacacaagcaagtttttatatttntaccagaaaagtaaaaatcttttttaaaagtgttgtttttctagtttgtaactcttaggagttctttttgtgccagatacattccgccttcccagtattgcaggactgaa

SEQ ID NO: 9733 - DNA, 290 bp, Rattus norvegicus
cttttggtgatgatcgtgctgggctggatactttttgttggccttgcgtcctacatgggcacatttccagaggcgatgcctccaactctaaagtggaaagagaggctgtctgttcgggagaacaaggcacgacgaagggctcaagctttggaggaggagctgctgctctgagtgagtcaggaacgatgtggaagggatataaatatcccccaggagggacccctctggaagtaaacaaagatgaccctggtgaacccatgcagctgtgaagatcgcccaactgcacagtt

SEQ ID NO: 9734 - DNA, 292 bp, Rattus norvegicus
atggtgagatagctctttggcctttgcttgtaattgagaaacttcaacgttaagccttaactacctttcctgtcataagacaccttagtcaactacgtggtactcctaaatcttttaaggtgatctctgctcactgctaaacagtccatgatgtacttggggaaggctctcagggattcaggatacccacagaacataaattatctttactgtatctaccagtaggtgtggctgacctttctcttaactgtaaatgttatgaaatataatctggtggccagcgagggtacct

SEQ ID NO: 9735 - DNA, 472 bp, Rattus norvegicus
aagaactctattcagctgggaacctgacagtgctatcagccgaccccctgcttcaccaagacccagttcagttagacttccactttcgtcttaccccccattcctctgctcattggcacggccttctgtgtgaccaccaactcttcctggatatcccatttcaggccttggagcaaggcaaccgagaaagtttgacagcaacactggagtatgtggaggagaaaaccaatgtggactctgtgtttgtgaacttccaaagcaatcataaggacagaggtgccctgcttcgagcctttagctacatgggctttgaggtggtcagaccagatcatccagccctccctccctgggacaatgtcatcttcatggtgtatccccttgaaagggaccttggccagcctggccagtgagcctccctaaacatgttctctctctgtgaggggttgaaaacctcaacacacgggactctggg

SEQ ID NO: 9736 - DNA, 260 bp, Rattus norvegicus
  misc_feature (141)..(141): n is a, c, g, or t
tgcggagcagcagcaggcacagactgagctggcctccgccttccactggatccaccaccagctggaagccagcaactgtgtgggtgcagctagcgtggccccacccctcacactgcctagcccaggccctccctccccacntacactttgtcccctggccagcccaaacctgcaggccctgctggaacactactcggagctgctagtgcaggcagtgaggaggaaggtgaggggcgactgagaggctgcagcccctctac

SEQ ID NO: 9737 - DNA, 329 bp, Rattus norvegicus
  misc_feature (89)..(89): n is a, c, g, or t
  misc_feature (94)..(94): n is a, c, g, or t
gcctttcaggagtcaagtggaagtcatcttcccttttcataatacttcagtgtctgataaaaaaagtacttggtttactcaaagtattnccatntaaagtcataggaatccagttcccagaaattttaagcaatggcaaatctatttggaaatttttgctttcactgatacagagagcagtctatattttgaacacttacagaaagtcattaatagaaaatggactgtactgtgtgctgttggatctttcaagattttcaccatggctttttttttcctccagaatactgtaatttagataactgagcacttttccttacattgactgt

SEQ ID NO: 9738 - DNA, 439 bp, Rattus norvegicus
  misc_feature (92)..(92): n is a, c, g, or t
  misc_feature (110)..(110): n is a, c, g, or t
  misc_feature (164)..(164): n is a, c, g, or t
  misc_feature (277)..(277): n is a, c, g, or t
  misc_feature (346)..(346): n is a, c, g, or t
  misc_feature (356)..(356): n is a, c, g, or t
  misc_feature (369)..(369): n is a, c, g, or t
  misc_feature (402)..(402): n is a, c, g, or t
  misc_feature (411)..(412): n is a, c, g, or t
  misc_feature (414)..(414): n is a, c, g, or t
gtgtctgcttgcttcaaccgaggattctgtatctgaaaacttgggtgacaccccctgttgcagcagcaccttctgcccccacgagcctttcntaagggccaccagcctgnaagagaatccaggctcttcctggaccaactggctacaaccttccctgttagaanagcctgagtcctctagtggaagcagctgccagtcctggcgatccaaaggaatcaaagtcactaaggattgcaaaaagtccaagtaatagcctcagagtggttcctgcccaggncagtgaggtacgagagacccttgccgcatcagtttggagaggtagcactttgaaaccatgagacagaangggccaggtnaagaggtctcagnggtcactgtgtgcgccagcaggggagtgtaagngcctgtccnncngaatgtgattctcctgtgctttctc

SEQ ID NO: 9739 - DNA, 281 bp, Rattus norvegicus
aggaccacggacatgagcttttacaactgggacagtcatattgctgtttgcaattcaagtccaaattaccaggtgattgctgacaaccccgaaggcttacttttcaaatataagagagacagaaaaatcctcaatgtggacccaaaggcccatccaggtgacaactcgacccggatccctatccagacagacctctacacacatgctgttctctttgaccacgtttcccgaaggaagacttaaacactgcacagtaaatggcttccttattgtttgctaca

SEQ ID NO: 9740 - DNA, 486 bp, Rattus norvegicus
  misc_feature (35)..(35): n is a, c, g, or t
  misc_feature (45)..(45): n is a, c, g, or t
  misc_feature (54)..(54): n is a, c, g, or t
  misc_feature (57)..(57): n is a, c, g, or t
aaacaagcctcgagattgcagagctgaaggagagnttaaaagcangtcgtgaanctntaaattgtttaaaaaatgaaatcagaaagcttgaagaagacgatcagacaaaagacatatgagtcaactgcagagcagtgggcgccacaggagggcaagctgcagatgctggggcgtttctgggaggagctctcagagagcactccaggtcctcactctgtcaggccgtcgtccctggagcacatcagtgctctaagacttgatgctgtgtagcagtccactatgttaagcacaacttttaaagttttgtttttgttttttaaattgaactatatgtatagtttattttccttcgggcaggattgaaaattctgttataaagtcttacttgtgcagactttgtacttctctactatagaattagtgattagtatggtgtgttagttcttcaggctcacgtctgccccggctacctcttttgtatatgat

SEQ ID NO: 9741 - DNA, 527 bp, Rattus norvegicus
  misc_feature (188)..(188): n is a, c, g, or t
  misc_feature (267)..(267): n is a, c, g, or t
acctcagctgtctgccaagagatggccctggaggccaaaaggatcaggcccaagaagatactgggggatcacaaactcagaggaagaagcacatcaaactctgggctgagaagcagaatgccctaaatctaggggaccctcttgggacacggctcctccctggtatgggccagctataggcaactcangtaaaagacctgagaagcaggttgggtggcagactttctacccacacagctctggtggtctctacagtctgcctgtttntaacagcatgggcctcaggggctgggacccccagtctagaccccatgcagccagtttaagccagtttaagttaacagttaaacttttgttgttgcggtgttgggaactgcatccagggcctcttccgttcccatatttaaacacatttatagtttcctatagaaaatgtccccaggttcctggattcctggtattttatgtacacacccatacagatctgatggaaaaggaagcagaacctgaaatttgctttctctctc

SEQ ID NO: 9742 - DNA, 481 bp, Rattus norvegicus
  misc_feature (53)..(53): n is a, c, g, or t
  misc_feature (62)..(62): n is a, c, g, or t
agagccacaattgatgctacccgcaccactcgtcatctggaggaaactattgncaattttgnaaagcagaaaataaaggacataaagaacatattatctgagtttatcacaattgaaatgctatttcatggcaaagctttagaggtcctcactgccgcctaccaaaatatacaaaaaattgatgaggatgaagacttagaggttttccgaaattctctgtatctatcagattatccatctcgtttagatattgtaagagcaaattcaaagtcacctcttcagagaccactgtcaactaagtgcacatctggaactggacaggtagccacctgtcgaacaaaaaaggatcaacatgtagaagatgaggatgatgaagaattagatgttacagaagatgaaaactaatttataaaagaattcacatttctgttttcatgtcatatgacttgaaatgtaggatcactttatactgacttgcaag

SEQ ID NO: 9743 - DNA, 278 bp, Rattus norvegicus
  misc_feature (65)..(68): n is a, c, g, or t
  misc_feature (252)..(252): n is a, c, g, or t
atgaggagccggcacaagtctacgccgaaggaccacgacgacactatccttcagatgtttctacnnnncagtctatggagaaacgtatcaattacatgcaaaacctaaagaaagagaagaggaaattggggaaaaggtttgcaaggcctaccccgattccagatccaggaatcctgtggccataggcctggagtcttctagaagaaaccaggctccagaccaaaatatgtggacttctgacattgaccaacnggtcatggcttgacttcatctgaaaa

SEQ ID NO: 9744 - DNA, 436 bp, Rattus norvegicus
gctgaattcctgagaaacaccgaaatgggggtgataaattcgaagttacaggaatttcacacggctgattcaaaaagtgccaccacccaagttgggaagaaggaggagaaatcgaaatttaaggtcaaggtaactaagaaaccagtggctctgaagagattcgatcaagcctttgtgaaaaagccactccccacaagagctcagacacccttggttaaggtgaagaaattaaaaaagccacaaagattaggtctttaccatcggctcaaccagaagcttaaccagaatgtacaggatgaagttgaccaaagcgaggacagcagtaccagcagcaccaccagtgccgacctggatagtcagtgaagcaggccagaaacctcagaaccacctgtcacatgtccagaggtcttctccccgaccaatgggcaactgtaaa

SEQ ID NO: 9745 - DNA, 394 bp, Rattus norvegicus
  misc_feature (40)..(40): n is a, c, g, or t
tagctgagctggctctgaaggccactctggtcgagagctntacttcaggtttcactcctagtggagctggtgcctcggtatccatgattgccagtagaaaaccaacagatggcgcttcctcatcaaactgtgtcactgatatttctcatcttgtcagaaagaagaggaaaccagaggaagagagtccccggaaagatgatgcaaagaaagctaaaccagaaccagaggtgaatggaggcagtggagatgctgtctccagtggaaatgaagtttcagaaaacatggaggcagaggctgagaatcaggctgagagccagacaacagcagaagggacagtggactctgcagctacagttaaaagcactgcatgttaagaggcgagcagaaccttcct

SEQ ID NO: 9746 - DNA, 200 bp, Rattus norvegicus
tgcagctccaggaggcactgctgaacctcatccagaatgacgacaacttcttaagcataatctacgaagcctatctcttcagcgtgacacaagccgccatgagaaaagccacgtgaccagctacctgagagcaaagactgagaactagttttccggggtcttcctgtgaactggtgtgaccaaacacatttatgcctttt

SEQ ID NO: 9747 - DNA, 70 bp, Rattus norvegicus
attcaagaattcctcccaaagaacatcatcctaacagctttgaattccttaaagccattttgaactgagt

SEQ ID NO: 9748 - DNA, 478 bp, Rattus norvegicus
agcgtgctggtctgctgcctagagacagatctgagaactgttttcatctctgtcaaatgttatctccttttctagtaagtttttgtgagatttcaaattattaaaattacttcttaaggagtagctactacctcatcctccccaactgactctttcagtccccatcaaaacctgctctaactgctattccagttaacactctatggcttgcttgtttaataacatcatgcacttgtgctcaacccaagtatcagaaacgcgactcgcggctttgagaggtgattgtgataggtctgcttctcatctgcagatacaatgcagcaactccaaagtattaagatcacactaagctgaagatgcacctttgccctggttagcaacgcaaaaccgtatcgtcatacatgccaaggccttagcgtgtagatgtctgtacaccggcacagcgaatgagctcactgctaatggctgagttgcttat

SEQ ID NO: 9749 - DNA, 289 bp, Rattus norvegicus
gtgagaatttatacaaaccgctatgaaacaaatgaagaggacaggaccctacgggaaatttacaggaaatacagaaagctgatcgattcagaacttaactattttgtcatcgcctaccccatgatgtaaagcgtgctctccggaggaagacatctagatgcactttgaacctgaattacatttggggctcccatgcccgaatcccttttccttctctctcctttagccagttccacaccatcacgaccagaattgcgaaggctggactgttggtgatggccaggcccca

SEQ ID NO: 9750 - DNA, 295 bp, Rattus norvegicus
  misc_feature (50)..(50): n is a, c, g, or t
  misc_feature (81)..(81): n is a, c, g, or t
  misc_feature (177)..(206): n is a, c, g, or t
gtgttcaagcccagatgcctgctccaggccaatggacaacgccgcccttngacccgcgcttccctaaccaaaaccagacgngtaactgctaccagaattttctggactaccaccggtgtgtgaagaccatggatcgccgcggaaagaacacacaggcctgcgactactatttccgtnnnnnnnnnnnnnnnnnnnnnnnnnnnnnngtgcagcgctggaatgagcagatcaagcagggaactttcccaggcaaaatctgaccttgcacttgagcgctgctccttggtggcatcaa

SEQ ID NO: 9751 - DNA, 399 bp, Rattus norvegicus
  misc_feature (48)..(48): n is a, c, g, or t
  misc_feature (130)..(130): n is a, c, g, or t
atcgagccaggctgcacagtgacggtcgccgccatgctgcagccctcntgctgcggccccagccaggaggtcaagcacaagttcatggtgcagacagtgtttgctcctccggacacttcagatctggagnccgtgtggaggggggtaaaccccggggaattaatggattcgaaattaaggtgtgtatttgaagcgccgacagaaagtgacaaactggaagatggcttgagactcagaaaggtagcgcatcctgacaagccaggaccctcctcctgcacgtccttgaagaagggttataccacgcctcttcctgttgttctgctggtgatcggagcagttttctttggattctttctagggaaactcgtcttgtagagtgaggcacgcacagcactatac

SEQ ID NO: 9752 - DNA, 407 bp, Rattus norvegicus
  misc_feature (80)..(81): n is a, c, g, or t
  misc_feature (85)..(86): n is a, c, g, or t
  misc_feature (88)..(91): n is a, c, g, or t
  misc_feature (93)..(93): n is a, c, g, or t
  misc_feature (95)..(95): n is a, c, g, or t
gtctggaccatgctgatggctgcaaagtcagagatggctgatctccagcaagagcatcagagggaaattgaaggccttcnngagnncnnnngncngctcagccgtgagctccgacttcagatgctcatcattgataacttcatacctcaggactaccaggaaatgattgaaaactacgtccactggaatgaagacataggagaatggcagctgaaatgtgtggcctacacaggaaataacatgaggaaacaaactccagtccctgacaagaaggagagagacccatttgaagtagacctttcccacgtgtacctcgcctatacagaggagagtttgcgtcagtctctgatgaagttagaaaggccacggacctccaagggaaaggccaggccaaagaccggtagaag

SEQ ID NO: 9753 - DNA, 393 bp, Rattus norvegicus
gtggacagtgtctagctcaggagcttcagtggcaccagcagcaagcagaggggactgctctacagcctcacttcaggacccctcaccccagtggcctgcagacctcaatctgtccctctgaacttcaggtctccagaggagagctcactgaagttaggggtgcaggcagggagaggcttgctctcctcatttgctcaggagttgcttgggcatccccatctccttttcccacgaagaggaccctgatctggtttttatcttgagaagggcatgaggtagtcttcatgtctgtgcccatgaaagatgaaggatctccttcccaaccctttgtcaccatgttcttccggggccaggctctgccgaaatgctaggatagccagattctcacccagg

SEQ ID NO: 9754 - DNA, 543 bp, Rattus norvegicus
gtgtgtggagcttatagtctgtactaaggacggttaatagatggtattttttctatttctgaagaaagtggctttattttactctcttttaaacatatacacaatagtcacaaatgtcgaatgctgaagagccctctccccctgctgtcagcaagtcatacagacactcaatgagttcacgattcaactccacgcacaaccgctactatggctaaggaaggcattactgctggaggtgtaatggacgctgatactgcctaacaggagccctgaagaccaccttcatccgagagggcccagcatggggttcatgcagagctgagctgccaaagccttaagcaagtgcatgcttgaacccagttgtgatgagcctatgcgtgtcaagttgttggaggagctttgtgcgagcatgaagatcaacctaattaggcatctgaaaacgggagaggaaccctataaacttggttgtggtgtgttaaggacgccaattgaagactacttcaaatgcaagaaataaaactggctttattttctcaacaacaa

SEQ ID NO: 9755 - DNA, 474 bp, Rattus norvegicus
  misc_feature (355)..(355): n is a, c, g, or t
tagagagcacttgagcccaacacgtgccacctctcgagtcctcagggtcacttggttggctggcccaatagaaacagggttgacagtgacctttcgagtgtggagaaggcctatctatgtgcagccccatgggagttaggtgcccagaggaacactggcgaaatggcaggagactcagaatcacagatgagcgtgtccccactgttagatcccaattcacctctgcaagtggctctgggtcctggtcgcgagagttggattgttatgacttgtatctctctgtagccttcatttcgtccctgtattcaagattctgccaactttgctgactatagggtgtttgctctggtcatgngaacccagagttagacgagcctgggtttgagggctgcattgcttctcagtctgtttcatttcctgccttggttctcggatgcggccccagcactgtttacctcacacacttttgagcac

SEQ ID NO: 9756 - DNA, 530 bp, Rattus norvegicus
  misc_feature (60)..(60): n is a, c, g, or t
  misc_feature (63)..(63): n is a, c, g, or t
  misc_feature (129)..(129): n is a, c, g, or t
  misc_feature (162)..(162): n is a, c, g, or t
  misc_feature (195)..(195): n is a, c, g, or t
  misc_feature (211)..(211): n is a, c, g, or t
ggcggtacagctgaacggagtcctctgaggcagggtctgattcagccagtgaggaagatnagnagagtggggccttgcaagggacaagggggccaatcatgtgcaagccagtttttttcctctccaacngatagagcttccattgccaaatcttcagttgtnaccactttcacctctcacgtgattggtggcgtnctggttcctggttccntagcctgctctagatgacagactctgggggatgttctcgagaactcttccctaacctatcccatccattcacttcccccaacaaatgcactgatgttctgggagcatcatcctgacttctgaactggctgccaccctagcttctttccctgcccacctggacaaatcctccgtagactcttgaagagcggagggaggccagagatgcccctccagtgtcctgacgttcaggctcttaggccaccttacaccaagtgccttatggacctgtggcctaggccatgtgatgcccaccaagtatttttcattctcctacctca

SEQ ID NO: 9757 - DNA, 352 bp, Rattus norvegicus
  misc_feature (73)..(73): n is a, c, g, or t
tactgaccagaaccggcagccatttgaggtgcgtcagggtccctgggcccaggcccgcctgccatggccgtgnactagaggtgctgcccatggcggccggcagcacctggcgggccccaggctgcgggcggctcggacttggccatggccgctcctgtttggaggtgtgcacgtgggtcccatgtccccagcaggcaggcgccttcagtccgtctttaacctcaccctccaaatgttcaacggcagaagggtttttatgattttaaattattactgctttgaaataaatggacgtttgagccacgtgcggccatgcatgatctgtggagagtcagcagaactgtcgccaggc

SEQ ID NO: 9758 - DNA, 305 bp, Rattus norvegicus
gagtaagtcatccaagccctcagaactcatgctgaaagataccctgtcagagactgtgctacctgtgtgggaaagctccaccccaaatgtgagtcccatatttgtcccagaacctgaacaattcgaaatggaagccagagaggggcccacatcagactataacaagatcattttctccaggatgcctgtgatgaagaaactcccatatgacttactatgggccagcaaggagacacataccaaagtttagcaaagagccctgtagccatggcctgagaacgtacaacagttactctccatttgct

SEQ ID NO: 9759 - DNA, 432 bp, Rattus norvegicus
  misc_feature (48)..(48): n is a, c, g, or t
  misc_feature (102)..(102): n is a, c, g, or t
gaaacgaccgcgactcgtagagaaccccgagcggcctgaggagagcgnccggtcgaagcagaagagccggcgccggtgctgtgggtacgtgttctgcatgtnacatcgcctcccagagcagcacgactgtacgttcgaccacatgggccgtggccgcgaggaagccatcatgaaaatggtgaaactggaccggaaagtggggcgctcctgccagcgcatcggggaggggtgctcctgaaggccaggcacggccaccacacgacgctgttcttagttcactaatgttagccttatttaggacaaagtcagccagacaccttgtactgggcacgcgtcagactacagccagccgtcttctttctttagccagccatcctggtactgtagtttaggggttgatggtggatgaaattgatgtctggctggttacta

SEQ ID NO: 9760 - DNA, 201 bp, Rattus norvegicus
gtccacgattggcaggagccacttcatgactaaagagctgcagggatacatcgaagggatgaagaagcgccggaacaagaggctgtactgtttgtctcagtgaacctccagctcaagtggccgacgagacgtcctccccatgtcctttccgtccctcgaacccaagctcgaacccaagctcgaacccatctgcatgaaatt

SEQ ID NO: 9761 - DNA, 495 bp, Rattus norvegicus
  misc_feature (181)..(181): n is a, c, g, or t
  misc_feature (188)..(188): n is a, c, g, or t
  misc_feature (439)..(439): n is a, c, g, or t
tctttcttcattttaccgtcaatcctaaaccccgagtcgagtacattgaccggccgcgatgctgcctcagaggaaaggaatgctgtatcaataggttccagcaagtagagagccgctggggttacagtgggacgagcgatcggatcaggttcacagttaacaggagaatctctgtagttgnattcggnttgtatggatctattcacgggcccacggactaccaagtgaacatacagatcattgaatatgagaaaaaacaaaccttgggacaaaacgatactggatttagttgtgatgggactgctaacacattcagggtcatgttcaaagaacctattgagatcctgcccaatgtctgttacacagcatgcgcaacactcaagggtccagattctcactatggcaccaaaggactgaagaaagtggtgcatgagacccntgctgcaagcaagactgtcttcttgttcttcagttcccctggcaataacaacggca

SEQ ID NO: 9762 - DNA, 256 bp, Rattus norvegicus
aagacccttgatgaccggctgctcaacatccccatcaacgacattgtccaccccaagtacttcaagatggtgccaggtgaggggatgccgctgcctgaggaccccaccaagaagggagacctcttcatcttcttcgacatccagttccccacccgtctcacaccccagaagaagcagatgctgcgccaggcactgctgacctaattccgggggacctgagcaggaacagggatggagagggctagctgggccttgc

SEQ ID NO: 9763 - DNA, 371 bp, Rattus norvegicus
ggcgagctgttaacttgcactgggatgtattaaattatgacaaagccacagacattgaagaaagcagccgaggagagtcatccacaagtaggactttgtggttaccattgtcagctctgaggaacaggaacttggtccacccaacgcaactaacctcaccacggtttcagtgtggctatgtgctattacatctattcaatcggatgagggcccatgaagatgtttcggaagataatggctctggtgaggtagtgatgagagtgacgtctgtgtgacagatgtacatggcagcagagtgtggaaccctgcacatttcggaatgtaattgcaatgaatggcaaaaccatagcacttctaattgtacatccatg

SEQ ID NO: 9764 - DNA, 399 bp, Rattus norvegicus
  misc_feature (147)..(147): n is a, c, g, or t
  misc_feature (265)..(265): n is a, c, g, or t
agctgctctccgtgggttgcagtgatggggatgaaaaatacgagaagaccaaagttagcagtggagatccaacgttttacaagttcatgaagaggatctctgtttgccaggggcagattctgaggtattcatggagtggagagcctntctttctgtcctgccccacatttgaagtctcggaggtcccagtctgcagtggctgcggaggccagagggcgtttgagtttcagcttatgccagcactggtcagcatgctcaacagtantaatctaggtctcactgtggaatttgggacgattctggtttacacctgtaagcagagttgctggcctccaaatcagcagatgcccatggaagaattctgtgttatacaagaagacccagatgcatttttattta

SEQ ID NO: 9765 - DNA, 321 bp, Rattus norvegicus
  misc_feature (70)..(70): n is a, c, g, or t
cagtgctgatgtcctctgtttatgggaaacgcattaatcagcccattgagcccctaaacagagactatgnccgtgtgaaccatgtacggaccgacttctacaggaagaatgacatccccagcatcaagacacctggctttgggcacatcactccagcctgaagcagttgtgtggtttatagggcactctgaggtaccctgtcagcaagtaaggtagtattggaacccattttcctgttcatgtcacctgtagccgcaaggaggataagcacacacatatctaaggtggtcctggctcagaacctgggcaagcacctttact

SEQ ID NO: 9766 - DNA, 506 bp, Rattus norvegicus
  misc_feature (142)..(142): n is a, c, g, or t
  misc_feature (240)..(240): n is a, c, g, or t
gatgagcatttttgttctctacgaagagaataatacaaaggtcatgaacaaggaaaaccacctatgaatttctatttctattatttattttactcacaatattttgttatatgaagagaaaacatccgtatacaagaacccntgttaggtggtttggagtctataaatttgatactaagattaatagttaaagagaacacttttatttttatccattttcatttgaggaaaagtgctctntagtcaaaatacatcagtgaaacaaaaccttggcttaatcttctgtgaaagtaatttacttatttaacatatattttatgagtataatcactctatacgtaagcctgtattttgagataagtagttgaatattttacttttattgtctacttttacctgttaactgcataatacaagaaaagaaactgtaacagataagcataaatctgcatcgcacgccatgaaacaaggcaaacagtggaaatgtcacgttacatgcttcctcc

SEQ ID NO: 9767 - DNA, 393 bp, Rattus norvegicus
  misc_feature (252)..(252): n is a, c, g, or t
  misc_feature (259)..(259): n is a, c, g, or t
  misc_feature (313)..(313): n is a, c, g, or t
accttcatggttctcatctttcttgctatcctctatgaccggagatctactcagactgccattctagcaggtcctcaatgaggttcaggctcaaaacgagaaccaaggatagtgactgatggtgctggaggatagaaaacatccaatagccagcaacatagaaacttcacaggactctgtggattgtgtggatgacagtgcacatcctttaaatctaatctccaggtttcagtgacttctgtttgctacagngaatggngtgagccttgtctagtttactaccaggcacagatggagttcttagaactccctntgaaaacatttagacatgtgtagaaatcaggaagtaaagattgagtgttttgaaagacacgagtcctgccaatggaacta

SEQ ID NO: 9768 - DNA, 278 bp, Rattus norvegicus
gagctacaggtgatgttcgcagcatctgtcttactgtttaaacagaatgccctcatttttcttgtcttgagaagctgcgggatgcctttacccttgcaacctgcaggatctcacagattcatttttcatttctttgccacggaataaacctcgaatggccggttggctttttaaccctcttagacatcttttagtcatcggctgaccacacacagaaaaggtccgttttgtcatttgttccactctgtgtgccttgagaaccactcctgtgatacgac

SEQ ID NO: 9769 - DNA, 513 bp, Rattus norvegicus
  misc_feature (319)..(319): n is a, c, g, or t
  misc_feature (321)..(321): n is a, c, g, or t
  misc_feature (323)..(324): n is a, c, g, or t
aagctggatagctctgttgtcatcagcccacctgagttctatcacacacccggttccgttgagagtcttcggcggcaggcctgtctcgctgctgttgagaatgcatggcgaaaagctcaagaagtctgtgccctcgttggccaaactctgggaagacctttactaatcaaggaggaggaaacaaaagactgggaaggccaagcggatgatcatcagttgtccagcttgccaggttccttaactatacaacagaaaatcaaaagtgcaaccatccatgcagcttcaaaagtgttcattacttacgaggtgaaaggaaaananannaaaaaaaagcatctgtaaaattctaactgaaacataatgtatttgtacttataaatctgtttttatacattttacagcactgctttttgtctcaaatgtagctgttgtctggtactggtaatctgtaagatctgccacttgttgaacatatccctcagaatatgtgtgatctctttctagttcccagaa

SEQ ID NO: 9770 - DNA, 153 bp, Rattus norvegicus
gcagtagtagatagcataagacccaaacccataactgcttgaaggtgctgcgaattccaagcggaggaagagctaccagcagctgcggagcgaagactgcctttcttcctccttgcctttctcactcagtggccctgttaaacaagattgtga

SEQ ID NO: 9771 - DNA, 502 bp, Rattus norvegicus
tcttgggctcacgtgtcataggcaaagtctcagctccaacttactccatctacggccgcagcgctgtgggcagctgcttcgaggacctcagcaagaccccaggcccttgtgcctaccacgttgtgaacccagggatctacaagactcgagccccgcagttcacgatgctggggcggactttgccaccaaagagccccaaagatccaggacccgcatcctacgccgtggacaaggtggtctggagtcgagggttaaggggcaggggatgagggtctgaggtctaaggcatgggtcaaagtccctggggaactggtatccctgtatgaagccgaacagctggctcggtaaggtaagcggcgtctcccggacccgcagcaccggaagcctcctcctggctggaccttcgggatcaggcattcagactacctggcccccatgatacggtaccacgtggacgactgacgccagcaagcacgcatgcacgggccctcggttgtttatt

SEQ ID NO: 9772 - DNA, 504 bp, Rattus norvegicus
  misc_feature (27)..(27): n is a, c, g, or t
  misc_feature (233)..(233): n is a, c, g, or t
  misc_feature (267)..(267): n is a, c, g, or t
actgtgtgaagcctgcggcctgtcacngcagccatccacgcactgtgagcgccacagggaacctcgcccacatcttcctcgcctacccatgccaaatgtttcctcctgttgaagcctggctcctggctccatagtgacagtgctacaatggtgtccccgctgaagatatttactggcactgtggccaatgcctgcatgccaatagcttgcttccagccccacgccatgagatntcggcacactcttatatggccatggctgaatcantacgccacacagaatcagaatcgcctgaagtcgaagcaaaaataaggagctctctctctctttccctctctctctctttctctccctccccagttccagggcacctacgagagcagagcagcagcttctgcttccccctggagactcctgccttgcacagtccctttacaagcagctatgtctcatgatcttagcaagatgacctcaaccctgatgtcgccccaacctgaatgtgtg

SEQ ID NO: 9773 - DNA, 575 bp, Rattus norvegicus
  misc_feature (162)..(162): n is a, c, g, or t
aactgcgggacgtcattgaatctcaggaggaattgatccaccagctgaggaatgtgatggttctccaagatgaaaattttgtcagtaaagaagagttccaggaagtagagaagaagctggtggatgaaaaagctgctcacgccaaaaccaaagccctcctgnccaaggaagaagagaagttgcagtttgcccttggcgaggtggaggtgctgtctaagcagctggagaaggagaaaatggcctttgagaaagcgctctccagtgtcaagagcagagtcctgcaggagtctagcaagaaggaccagctcatcaccaagtgcaatggtaggcgggaggcccgtgctgccccccaagttaacatacacgggctcttttccaacagcccaatgatggtgccaaaagcagggctgtaccccaacttctgcccccggctgaggatacaggcaagtccaggcgggtcacaccttcgaaagtgccttcagggaccaggcaggccacggaagtgatggacgcgaacagtgtgcggtattcttcacagccataaaggaacgggctcgctcccatttttcttgaaa

SEQ ID NO: 9774 - DNA, 456 bp, Rattus norvegicus
  misc_feature (82)..(82): n is a, c, g, or t
atgaagcttaccaaggccgtgcggtacctgcagcagcccgactgtctgctcgtgggcaccaacatggacaaccggctcccgntagagaacggccgtttcattgcgggtaccggctgtctggtgcgagccgtggagatggccgcccagcgccaggcggacatcatcgggaagcctagccgcttcatcttcgactgcgtgtcccaggagtatggtatcaacccggagcgcaccgtcatggtgggagaccgcctggacacagacatcctcctgggctccacctgtagcctgaagactatcctgaccctcaccggagtctccagtcttgaggatgtgaagagcaatcaggaaagtgactgcatgttcaagaagaaaatggtccctgacttctatgttgacagcatagccgacctcttgcctgcccttcaaggttaaagatctcgtgtctttaatctctgg

SEQ ID NO: 9775 - DNA, 456 bp, Rattus norvegicus
gagggcccagtttgatcgacgtacgtctagcaaacactgcaggcggtgtttgaagatggcccagaactcggtgtcgctgtccgccggcgatcaagccaacaggatggcccaccgatcctcccaaggagatctcaacccgtcggccatggcttgggcgatggtctccggagacagcttcctggttactagacttgatccgaatcagccaggacctcggccaccagcgcgacccagcgttcggaccgacagacgtcgagtgcccgtcggtggccgcagccgtagccgaagccgccaaggcagattctcgccctacccgatcccaggcgtcaaactcgacctcttaagaagtgtgctgcagcagcgtcttgttgcgttaggatctgctctcgcaacccgaatctcagcgtagagcaaatgcctcccctcacttagcttgcaaacaaggcctttccaaaa

SEQ ID NO: 9776 - DNA, 353 bp, Rattus norvegicus
gcagtgcaacgggaggctcgcctctggaaggtgggcaaccctgagggacgggagctgctgacccagccggacatcacgctggaggaggctggcatggtggatggtcagcatctgctcctggaagagatggacgagatgggaaactggccccctccggagtgaggcccgtgctggcaggagcccaccgtgcccacacccctgcgaccccagtccgacgtgtgtctctccttgggacacacggaaggagtccctggggccctgggtttgggggatgagtagcatcctgtgtgtgtgtgtgtgtggtgggcctgcccagcacccgtcattagactccctcagatgatgttattaat

SEQ ID NO: 9777 - DNA, 273 bp, Rattus norvegicus
  misc_feature (70)..(70): n is a, c, g, or t
  misc_feature (129)..(129): n is a, c, g, or t
ctgctgtcactgaagagcccgggaaggaggcagcccctaaagctacctcttcaacccagatggcctcttntaccaagaaacaggttcccaggaaccagaaaggctctgtccaggcaaggaagggggctntagcagccacagcatccaagacctctctggctgcagctcccagcatgacaaaaagtacaaacaaaagaggcacaaagtaacgcacagcctctactcacaggcctccttcccaggtcctgccccaataaagcgtctctgggcttg

SEQ ID NO: 9778 - DNA, 213 bp, Rattus norvegicus
gacatgaccatgctgtgcaacccagattctctgtggtatgaatctccgcacttgacagtggatgggctgccccctctaaggcttcaagcccggccccgcccttcagaagatacctttctcatgcatcagatgctgaggcgctgggaagcatagccctcaaaactccggaatgctagtctgtattttttgttcgaactgttttttcatagaata

SEQ ID NO: 9779 - DNA, 493 bp, Rattus norvegicus
gatcacagaggatctcgccaagattatgatggactacttgggaatggagaacttctggaagagatacaacaaggtgaaactggaggttctgagtctccagcacaggcggctgcagctgctggatatcagcagcaagctgcgggagatgctcaagcagtacttggacggcatctcggtgagcgacgaggtgctgagccgcctcaacccgctcttcatagtaaaccacaaaagcaacctgccccagctgcccccatccgcagcgcagcctggcggtgacagaggacctggtggcgacagaagactgacttacaacgtcatcgaggcggcccacattgcctcccatatcctgtgacccgaggaggaggaggaagcgttccaaaccccagagactttttttcctttcttgaagcccgagtgctttgctctcatgcttaggtggacactccagcactgttccagttacctaccaccgccctatgtggcataaccaatt

SEQ ID NO: 9780 - DNA, 521 bp, Rattus norvegicus
  misc_feature (126)..(126): n is a, c, g, or t
  misc_feature (131)..(131): n is a, c, g, or t
  misc_feature (157)..(157): n is a, c, g, or t
  misc_feature (462)..(462): n is a, c, g, or t
aacgccatcgttcttccagaagggagatctggccccccggtcttggattctgagatcagtgcgagatcccggctctgcgccctgtccgccctggaactggatttatcatcagtttagaatagcatngctancgatgtgtggtgtggatggatggacnagccccgcaagtgcaaacaggacagtccaggttacctgacaaagcagccaccggtgcaccagctgtccaagatcagacctaggtcaatcactgacatggctaaaagcaccaagaaggtctggatcattgtgctgcctcactccaaaaaatggtgacaaaaattaaaatcaaccagcacgccaggatcctctgtggcaagaccaagataatgtgggccactgtcatctggcactgtggttccttcatgacaacaatggctggtgggtcctgggtttactacaccacttctgctgtcagtcaaactngccatcaggagactgaaggaaatgaaagaccatagaagtgctactgtctgagcagccct

SEQ ID NO: 9781 - DNA, 457 bp, Rattus norvegicus
  misc_feature (146)..(146): n is a, c, g, or t
atgagcggtaccacactgagagccttcagggccgcagcaagcaggagctggtgcgagactacctggatctagagaggcgtctgtcccaggctgagcaggaaactcggaggcttcagcagcttcagggacgccccagcaggcaaccntgccagcaggtggaagagctggcggctgaggtggagaggctccgaactgaaaaccagcgacttcggcaggagaacgagatgtggaaccgagagggcagctactgtgaccgggagaagacagccgcagaagggacccctcggcccaaggatgaggccccacttcagacccgctcgggccagctgggtcacagggaggcaggtgacagatgaaagctactcccagcatacctgtctccactgagaactgctaagacaaggtcagagtttccctgccattttcactgttgggtctttattgtcatctcactttt

SEQ ID NO: 9782 - DNA, 461 bp, Rattus norvegicus
  misc_feature (280)..(280): n is a, c, g, or t
  misc_feature (283)..(283): n is a, c, g, or t
tgttcagtgaccacgctgtgttgaaatccttgtctcctgtagagccagtggaatctgtaagtaactcagagacacccatgaattcagatacagaacaggcccatagcgaggctacagaagaggagactagtaagccctgtgcgagcgacaaggaagacactaggactgagtatatgtgtgatggccctccaaaggggcagagcaaagacacctctggagaccaaggccacctcctccaaggagcccaccagtgtgagagcgaggccaagcctcctcaggntgntgctgcaggggccaccgcccctccaactcccagggactcaccccggctctccattaagcagaggctggctcgactccagttgtcaccagaatacaccttcactgctagcctggctgcggaagtggccgccaggtctctgtcctttaccaccatgcaggaacagacttttggcgacgag

SEQ ID NO: 9783 - DNA, 240 bp, Rattus norvegicus
atatccacgatgctttggctctgtctgacgtggggaacgacaggaagctcttcttgtttggaactcaggtgactaggaatggttcagagatcccctccatcatgcaagatgccaaagacctaattacacacctggccataaatatgtagaagtgactaagacccgcccggccctactcagctcccacccaaccatcatcagagagggctgaaaggcaggcttacgccaaaatttccactt

SEQ ID NO: 9784 - DNA, 285 bp, Rattus norvegicus
gttggagggctacataaggacactagaagaagatttgcatttctttacctgcttgagcttacttgccagcacatttgttggaatctaccagcctcgtgggactgagcaactcttagatccttggacttccattcacaggtgactgttgttgggagttgaactacagactgtaagtcatcataacaaatcccctgactgtacagtatatcgtagactacccataagtcctgtgactctagagaaccctgactaatacagcctgcctacaccatgctcggagtaaac

SEQ ID NO: 9785 - DNA, 390 bp, Rattus norvegicus
  misc_feature (83)..(83): n is a, c, g, or t
tgctggtcctgggaacagatggcttatgggatgtgaccaatgactctgaggtagctgccactgtggacagggtgctgtcaacntatgagcccaatgatcccagcaggtatacagctctggcccaagctctggtcctgggggcccggggaatcccccgggaccgtggctggcgtctcccaaacaacaagctgggttccggggatgacatctcggtcttcgttatccccctgggagggccaggcagcagttactcctgatgggctcagccccagccctctcactgccaccccagcatctccattaccactctcctccagcccaaacatggaagttgtgcccctgactctcaagtggccatttgacacagggatgcccactagttccaaaatt

SEQ ID NO: 9786 - DNA, 509 bp, Rattus norvegicus
gatgtgtaaatgctttctccctcatcgtcatgtgttttaacctgttgtggagatgctttggaatatcagactgccttttcaatgcttgtcgtcatcacctgtcaaatcagcagtctgttactacatgaagtatcttcaaaccattgcaattgtcattttaattgcaaaagaatttataaaagatagctgaatcatagagcatcataaagaattcataacatcatttatatatttgtcatgttacggccacttgtcccactgcgatcatcctggtcatacgctggatggtctttggtttgctgtgacctcaatcccagcacccctgtcctgggtcagtcagtgggatccactctgtaggaatccttatatcctttggtactactgctttccacatcccagtctttcaacatcaatgtgcttttaaaaccttaccgctccgctgtgcccatcaaccagtgaatattaaataatggccatcatcctgaaactgagtccaactgggccatggt

SEQ ID NO: 9787 - DNA, 508 bp, Rattus norvegicus
  misc_feature (26)..(26): n is a, c, g, or t
  misc_feature (115)..(115): n is a, c, g, or t
  misc_feature (267)..(267): n is a, c, g, or t
aacagcagcggcaagcccaggagcantacaatgccacccagaaaggccatgttccccattacttgttggaacgcagggacctgtggcggaaggaagctgaagctcgaaagcgtanccagccagacccttccatgcctcctggccacacgctcatgcctgagaatcagcggctagagacactgaacaatctgcttcagagccagagcaagctgcttcgtgagctagtgctgttacctgctggggcagactctctgagagctcagggtnaccgtgcagaactggaccggaagttggtgcaaatagaagaggctatcaagatcttttcccgacccaaagtctttgtgaagatggatacctagcccctccccccctttgtgggtagattaatagggagatccatgtttaggatcagctcatggctgcaaagggcagactcaagccctgttatagctccaaagcattggggtgggcagaatcgaaagcacttcgtagttaccagtggctgcag

SEQ ID NO: 9788 - DNA, 546 bp, Rattus norvegicus
  misc_feature (37)..(37): n is a, c, g, or t
  misc_feature (89)..(89): n is a, c, g, or t
  misc_feature (130)..(130): n is a, c, g, or t
  misc_feature (290)..(290): n is a, c, g, or t
tgctgtctagatccactgtgtaacttccaagttaganagggaaagtgaagcacaagaccaagctttaaactgttagaagctctaagctntccaagtcttatttctccaggataaggcccatcctttctgntctcctctcttcccatggttcatattaaaatttacatggagtatggtaggcactagtttgaaagggcttgccaaattttaactacattcaaggttaacttctggggaaacacccatgctcagagtactgcatatgcccacagctcctttgatagtgactntggcaatggctcatatgttgtacagagtagtcctgaaaggaagacttcttagaaacaggtcctgcatggttcatttgaggctatccatctttgataaatgatgccaagctttgcctgtgacattgcatggatggcactgtagctctcaagggacattgataattaagaacaggaaacaggttgctacaaggaataaagtagaagccagagacaggctgaagacaactccctaaccctgtgctttctaagtgtggaa

SEQ ID NO: 9789 - DNA, 572 bp, Rattus norvegicus
  misc_feature (30)..(30): n is a, c, g, or t
  misc_feature (129)..(129): n is a, c, g, or t
  misc_feature (134)..(134): n is a, c, g, or t
  misc_feature (139)..(139): n is a, c, g, or t
  misc_feature (168)..(168): n is a, c, g, or t
  misc_feature (231)..(231): n is a, c, g, or t
taaaatgtgcgtcttctcctcatggactanttatggttggagttgcagggactgtccaccgcggaaattcttgtttgggcatatttgaacaaatttttggacttatccgtagcccttttgtagaaaatncttgnaaaancaaatttattaacctgagaatcgttgganggaagttcccttgctcctggatcatcgctgaaaccatctgtaacatttgaacagagtgatttngaggccttttataatgtaatcactttgtgtaatacccctgaggtaagacctaatgtaaggcagatattggatagtggaactggagaccaggttttatgtagtggagatgaggccttgttgaacaaaaaggaaatgaatttgcctacccctctaaagcattgaacactgtaccacagcctgaagaagctgcagaaacacaacactgaccatctctaagccactgcaggtctgagaattgacatattttagctcaaataactttttggactacagactaatgtgaatacttgcctatttctacctgagttacagcaaatgttctgtgaacttattgcggtcca

SEQ ID NO: 9790 - DNA, 538 bp, Rattus norvegicus
aagctgcagcatatggccttggcgtcatggcgcagtacggtggagataactaccgccccttctgtacagaagcactcccgctgcttgtaagagtcattcagtctgcagattctaagaccaaagaaaatgtcaatgccacagagaactgcatctcagcagtgggaaagatcatgaagttcaagcctgactgcgtgaatgtggaggaggtcttaccacactggctgtcgtggctccccctacatgaagataaagaagaagctgtccagaccttcagttacctgtgtgacctgattgaaagtaatcatccaattgttcttggcccaaataataccaatctaccgaaaatattcagtataattgcagaaggagaaatgcatgaggccatcaaacatgaagacccctgtgccaaacgcctggccaatgtagttcgccaagtacagacttctggaggattgtggactgaatgcatagctcaactcagtccggagcagcaggcagccatacaggagctcctgaactctgcctgaagggccttaat

SEQ ID NO: 9791 - DNA, 481 bp, Rattus norvegicus
actcgttacagaagtccagtgcggagaagagggagatcgaggagaagctgcacgcactcttcagccaggagcatctcgtgatatataagggctatgtcgacgaccctcggaacactgacaacgcatggatggagactgaggcagtgaactaccatgatgagacaggggagacgatggacaacctcacgctggaggctggagatgatgcggggaaggtgaagtgggtggacatcagcgaccagctcaagctgtatgccagtcactcacagttcatcaaactcgtggcagagaagcgagatgcccactggagcgaggactgtgctgctgacagccgcgggctatagcctgtccccgcgagccagccggcaggggctgcgctgcagaagcagtgctgcagaactgacactcaaaggccgcctggaaatgcttgcaacaaggcgaggtgcctgaaccgatgaggaacactgaagttccgccttct

SEQ ID NO: 9792 - DNA, 229 bp, Rattus norvegicus
  misc_feature (29)..(29): n is a, c, g, or t
agtacaacccttggcaagaaagatggagntgttgcctgaaacttcctcactcacacagaaaggtctgaagatccctggcttagagcatgcaagcatggaaggaccaatagcaaatttgtcagcacttggaacagaagagttacgtcaacgagagcactatctcaagcagaagagagataagctgatgtccatgagaaaggatatgagggcaaagcagatccagaatact

SEQ ID NO: 9793 - DNA, 297 bp, Rattus norvegicus
aatactgttacaccaagagaccattgaggatatgcagggaaccaaactccagtttcctggagaatgtttccactctccttcagcccccatcacttcccggactaccatccggcactggatcaaccctaagaaagaatccatccatagcattcagggatccatagtgtcccctcacactgcggctactaatggaggttactcccgaaaaaatgatggtggcttcttttccacctagtggtgacaactgggctaattttgccatggtggaacatgcagtcacccatcttcattaaatag

SEQ ID NO: 9794 - DNA, 414 bp, Rattus norvegicus
  misc_feature (76)..(76): n is a, c, g, or t
tagaccaagattagggcgggctcgcccagtgagactgccaacctagcacaacagccagaaccggagcccttcactntgcagtgtcacctcccaggcctgtccacccacacaggccatgccagatcatgatatggcactgtcctggggcatgagacagtaccctagacgctgcccagggatgcagagcctcagtgggatgtccatgtcccagctactgtactgaagcctttctagggaaaggcccaggcacaccatggtgaagctcaggctcaccaccttggacgtgtgcctgagggcaccctctctccggcttttctgatgtcacagctggcctcaggtgctctgttctgcctttctgaacctaaaagtgaacatgattctttccttccttaggatctaagtctttgccgcctt

SEQ ID NO: 9795 - DNA, 432 bp, Rattus norvegicus
cgagcttctggccaatcaatacaacatcaaggttcaagtggaagacctgtctcacttccgaaagcttttcatggacacattctgtttcctcccatcctgccaggttggggagctggtaataccaaacctcatggccaattttggacctatgtacttctgcaaattgcacagggtgccatagtgtcaccccatccctgaagtaggaaggtgatgactccatcagaggcattgtaacaggctggcggcaggtgtgtcccaggcctgtctccatccattacatctaaagatcgctgtacacggcagtgggtagggaccgctgcccagctgagttagcagcaggcttctaactcatactctcacttctagcttttagcctctactaaggccccagcttcagtacggattaagacagaccctgtgaataagcccata

SEQ ID NO: 9796 - DNA, 500 bp, Rattus norvegicus
  misc_feature (30)..(30): n is a, c, g, or t
tcggatcatccaagtgtttgagcatggcanaaggggacaccttggtctcagtggattacgaaatttttggaaaggttcaaggggtgtttttccgcaagtacactcaggctgagggcaaaaagctaggtttggtgggctgggttcagaacaccaacaggggcacggtgcaaggacaactgcaaggccccgtctccaaggtccgctttatgcaggagtggctggagaaaagaggaagtcccaaatctcacatcgaccgagcaaacttcaacaatgagaaaatcatctcaaacttggattattcagacttccaaattataaaataatgacacgaattttaattttttcaaagtaatctcactcctttttttatcggtatatataaaatagaacgattctgtgctcagtattagaatttgttagtaagttattttagttgcatgtttgaaagttaccaggtattacatgtatgacgaaagacaaatgtgtacagttctaaccaa

SEQ ID NO: 9797 - DNA, 439 bp, Rattus norvegicus
  misc_feature (135)..(135): n is a, c, g, or t
aagaggatcccttaggtggcttcaccattgatgacgtaaaattagccctggcacgagtgacggatgaggtcttgataagcattcagaacgagataaacgaaaaactgcaagtacaggaagagtcctttaacgcgngaatagagaaactgaagaaagcctgagaatgcagtacaagttaatcttccgagaaaccaacaaaaccggccagaataataatgtctctatagcactatgtcacctccatgaagccctggaaggaaaacccacttcccgttatcctgagtgattgacaaggcgtcgtcccgcccctcccattccacacccacctctgagtttacagggccaaaagcaagaagagcattgctttgtatgattttggaagttctatacgaaagtactattgttttgactaatgaatactattcctctttctcggaaa

SEQ ID NO: 9798 - DNA, 399 bp, Rattus norvegicus
  misc_feature (208)..(208): n is a, c, g, or t
gatcttactcaagtacctggactcagacacagagaaggagctgcaagcactttatgcactacaagcatcaatagtgaaacttgaccaacctgccaatttgctccggatgttttttgattgcctgtatgatgaggaggtgatatcagaggatgccttctacaaatgggagagcagcaaggaccctgctgaacaaaacgggaagggcgtngccctcaaatctgtcacagcgtttttcacgtggcttcgggaagcagaagaggagtcggaggataactaatacttcaaatacacaaacgaaacaaaagaaacaatttaagtatttttttaaaaagtttcacgtcttcgccaatcacagtgcagcaaggccaactctcgcagaaaccccacgtgtgcgcgagt

SEQ ID NO: 9799 - DNA, 298 bp, Rattus norvegicus
  misc_feature (169)..(169): n is a, c, g, or t
ttgtctgtaaagaggcctgtgtgcctagagtgcggcccttacaggtccatggtgtctgaggaggcaggttagagcagttggctgcacaggcctcctgctaataggccatatgcactgtatagccatttaaaggactatttaacctgctgtcagaaacctgactcatacngcactccttgcacagcttctaggggagaaccttgaagccattctcctcctagcttatagtctaacagagcatcacatagaagagaaaagtcctgcattgctgccgttttcccatgtctatcttcagata

SEQ ID NO: 9800 - DNA, 372 bp, Rattus norvegicus
  misc_feature (96)..(96): n is a, c, g, or t
gcagatctacccattcgtgtttgaaagcaggaaggagattttgtaactcagacttcgttggttagagtctctaactgagcaccatttgaaacctgntgcacattggactcgaaacacaaggaaaactggaccaacagtgactgaggacagagactcgtactcacggctacagtgtaagctccagtctctttggattttacttcaacctttgctgtaatataaaaaggaagtttacaagacatgacattgctgcttttacaaaaggacgttctatttattttcgcagtgatctcatgtccccacaggcagagctgtcgcagtgtgcactaccttacagttgttttattgatgtcattatttttccagttggag

SEQ ID NO: 9801 - DNA, 479 bp, Rattus norvegicus
  misc_feature (26)..(26): n is a, c, g, or t
  misc_feature (441)..(441): n is a, c, g, or t
gctggtgacagtggcttttcggaacncaggaatccaagatgagcccccaaagattcggggggaaaactacttttggtggaaggtactggaggaagacttacaaaaacagcttctacacagactccaggaatcttctgttgtccccctgaccagatagataccagcagtgaccaaaagctgagcagccaccctccctctgaggcagtgaagagactggcagtcaggggtctcattgcacattactcaggtacaggaactacacattgagcccaaagggagggtgccatgaatccagtcattctgagggcacacgatgcttctctttaagtttgaaaggagcttttcgaaccgtaaatggcaccatcttctctgtccactttggaaaaggccgcatgtcaatccttccaaccccacagcaatgtagagggggatgggacaagngggatgcatccctcagggcagagtcctcattgctgagt

SEQ ID NO: 9802 - DNA, 460 bp, Rattus norvegicus
  misc_feature (47)..(47): n is a, c, g, or t
  misc_feature (55)..(55): n is a, c, g, or t
  misc_feature (89)..(89): n is a, c, g, or t
  misc_feature (144)..(144): n is a, c, g, or t
  misc_feature (149)..(149): n is a, c, g, or t
  misc_feature (158)..(158): n is a, c, g, or t
  misc_feature (171)..(171): n is a, c, g, or t
  misc_feature (184)..(184): n is a, c, g, or t
  misc_feature (190)..(190): n is a, c, g, or t
taagaagacccacgccttcgtcagacttctcgctatcaggaaaaagntgcttttnctgaagagattaagatggcgggagagacagactncgacttggataagaaaacttctttgacttcagatgcagaaatgagacctgaaccnccagntccatgcanaaaccctggcaanccccgtgttttcntgtatnttggaccctaagacattgcacacgtccacctcactgtccaaaccccagatgattatgtacaagaccaatgccagccagtacggggccttctcacccaggccctacttcctgccctgtaagtacctgccacaggagcaaatgttcacagagcacctcagagcaaccggcttttatcaaaacaacagcctgaacattgggcctgaccgaaccagaactgtcgattctcctaattatcaacacacactgtgaaatccatccttctgacagaga

SEQ ID NO: 9803 - DNA, 412 bp, Rattus norvegicus
  misc_feature (104)..(104): n is a, c, g, or t
  misc_feature (107)..(108): n is a, c, g, or t
  misc_feature (110)..(110): n is a, c, g, or t
ttcctggtccaggatgatgcgtctaggatctatgtttgggatcttcttgagaatgacctgggtcctgtggcccagcagcccatctctccagataagcttgtggncannantatcgtgggggaacccgagaagaccagtggtagctttgtggccctggtgttggccaggacctctggtacagtcgacatccagaacctgaagaggcggtggaccaccccggcagcagatgagcatagccagctgcatctgcttcttcagaaatgaagacctaatgtcaggagaatgatgggtacatgagccttgattacagatggatcccttcactctgtgtctatgtgactttgtgtacatagagtgtgtatattctgtacataatttgctttagaagagcagtgctttggtattcccagga

SEQ ID NO: 9804 - DNA, 226 bp, Rattus norvegicus
  misc_feature (28)..(29): n is a, c, g, or t
  misc_feature (37)..(37): n is a, c, g, or t
  misc_feature (46)..(46): n is a, c, g, or t
  misc_feature (59)..(59): n is a, c, g, or t
  misc_feature (109)..(116): n is a, c, g, or t
  misc_feature (122)..(122): n is a, c, g, or t
  misc_feature (128)..(128): n is a, c, g, or t
  misc_feature (136)..(136): n is a, c, g, or t
  misc_feature (180)..(180): n is a, c, g, or t
acacatgtaggaagaagttggtcccacnnaagcaggngagcaaggnggtacatcttgantgtgcactgaaccagaaatatttggttgacttcaacaagaaagataaagnnnnnnnncaatgnccaganccagcatnatcaggtctcagaaagtgcaagagagctggaattggacacacancagtaagagagcttcctgaagaataagttgctttctcaggagtccc

SEQ ID NO: 9805 - DNA, 565 bp, Rattus norvegicus
  misc_feature (387)..(387): n is a, c, g, or t
aggtggtgagcgacactggctctctcttggcctgttgcctgaatgcagcctgcatggcattggtggatgcaggcgtgcccatgcgagccctcttctgtggggtcacctgtgccctggaccctgatggcaatcttgtgctggaccccacaaccaaacaagaaaaggaggcccgggccattctgacctttgctctggatagtgcggagcagaagctgctcatgtccgccaccaaggggctctattctgatgcagagctccagcagtgtctggccgccgcccaagctgcctcacagcacatcttccgcttctaccgagaatccctgcagaggcgctactccaagagctgaggcccgccagggcagggcgccctccaccacgcccaccgcntacccgccagcagccagcactccactgtgcctctgtctgtgcccaggtagcctctggtcctgtcgcagcaggggctgctgaggcaggctagggaggggcttagggacattctaggcctgggtacaaccctctcttcaccaggacaccattaaaaagggctcacctgtgttgagcgagt

SEQ ID NO: 9806 - DNA, 341 bp, Rattus norvegicus
aaatactcagcctttcagactttggatggggagattgacctgaagctcctcaccaaagtgctggccccagagcatgaagtgcgagaggatgatgtgggctgggactgggaccatctatacactgaggtgtcctcagagctcctcacagagtgggacctgctgcgggcagagaaggaggaccccgttggaccatcgaggcacatctgacccaggaacgccactgtgcatttggacaaatgcatgaagtctaaaaccatgggagcttgtgagcagcttacaatttttatacagaatattttgtaatagaatatttattttcagtaggacacattggagcattc

SEQ ID NO: 9807 - DNA, 500 bp, Rattus norvegicus
  misc_feature (110)..(110): n is a, c, g, or t
gagtgcacggtgaccagagaccataggatgcttgagtgcatggtgaccaagaccataggatgcttgagttcaagcaggggttaaactgaacatgtgcggtcctgcccctntgcagcctcaacaggacaaccaaggacccagtaatgcagcctaatcaacgtgcagctctgtcagcagtcctgagccgccacctccaagaggtaccttccagagtggaggcaggtggccttactgtcatctgtgcctttccctgcacattcacatccagctgcacttcaaagagagcctggcaacctagaaccagcctccagaagccaagacccaacctggacctcctcagcttccccttcacctccaggagaaggccataggaagtccacaggaagaacaactctggctcctggtctgctgagcaccgggcaggacaggagcctgtcctacaccgagaccgctttgggagcagcagggctctaagggtttcatctgccttatttatatta

SEQ ID NO: 9808 - DNA, 365 bp, Rattus norvegicus
  misc_feature (75)..(75): n is a, c, g, or t
caaggctccggttgagtcagggaatgcaggtcccaagatcggcaagcgtaaccagaagacacaggcggctggcancacctctgtgcccgagctgttggtcccctgtcactctgacacctctctggattatttgtccgagtccaccacggagatcacctgcaaatggccagactacggtcaccagctgcgctgccctagacactgctggctcctgccacacctggcatactaacgccacgcctggacacccgtgggccatgagaccgcaagagacacctacccaggggagccacaagaagcactagacctccggagcaccatacaagagccacgttgaataactgcccgtcgtgcaaatagtttaa

SEQ ID NO: 9809 - DNA, 448 bp, Rattus norvegicus
  misc_feature (369)..(369): n is a, c, g, or t
atcacaattagcctctgtgctgatagagaagagtcagagaagagtggaaactatggccttagggctttttaagcctaatgattttaccatttactctacatacgacagcagcactgttgacagtgtgttttgagactgcacttctgtgcctattagactattgatatttgtttagtcatatctaaccagtagtctatcttttcaagctcatctgctaatagaaagtatgccatttgcaaaactgtcacgacactgagttgaacctatgttgcactgtggagttctccacttacacagcctatttatgacatccaaaagcagtgttttttatatttgtgaaagttactggttttactggtattacctcantatacatgcactggtatcatacaaatctctctactatgtttctatattctcaaagttaaataccggttttcatgcaaat

SEQ ID NO: 9810 - DNA, 478 bp, Rattus norvegicus
  misc_feature (54)..(54): n is a, c, g, or t
acgtatttgttttctgcaccagaggggaactgtcaaaatatagagtcccaaacnttctggacctctaccaacaatatggaattgtcacccatcatcatccgatcccagatggagggactcccgacattggcagctgctgggaaatcatggaggagctggccacctgccttaaaaacaaccgaaaaaccctgatacactgttatggaggacttggaagatcttgtcttgtagctgcttgtctcctcctatacttgtctgactcaatttcaccacagcaagccatagacagccttcgagatgtcaggggatctggggcgatacagaccatcaagcaatataactatcttcatgaattccgggacaagttagctgcctatctgtcatcaagagattcactgtcaagatccgtgtccagataaggaagagcccagacacgcagccgcagctgaagttccaagttctctagcgtaatctgtat

SEQ ID NO: 9811 - DNA, 518 bp, Rattus norvegicus
  misc_feature (35)..(35): n is a, c, g, or t
  misc_feature (385)..(385): n is a, c, g, or t
acgacaagcacctgagtgtgcccaacatcatcatnacacccccaaccccgacgggcatggggctttcccgggattccaacagccaagtctggatggatgagttggggtcttatcaagatgatgaagaacttgagcccgaagtctgagaagttatcttgtagtgagacctgtgtggcagccaccagccccgctgcccctagtcccaggtgttgggggcatggctctctgagcagctggatggggacagccaaatgggccctggactaagacagggatgaccagaagagcacagcaggtcgctgaccccagtggagcagacatctgtggcctccatgtccacaccaacccagacccgggcttggtgaagaggaggcccatcccactntacggtcaggtcaccgtgaccatggaccttggccctcaaggccacagagcacaaggacttctcgccagagcagggcttctgttttttacaagttgttttacaggtatggaacctacgtcctgagcgagattta

SEQ ID NO: 9812 - DNA, 481 bp, Rattus norvegicus
  misc_feature (74)..(75): n is a, c, g, or t
  misc_feature (77)..(80): n is a, c, g, or t
aggagactcgactaggaccgcacagcaaggtcagagctgatcaggaagcattcggaagccaaaccatggatccnncnnnncggaaagaaaaatccaaagttaaagaacctgccttcagagtggagaaggctaaacagaaatctgcccagcaggagctgaagcaaagacaaagagcagagatctatgctctcaacagagtcatgacggagctggagcagcagcagtttgatgagttctgtaagcagatgcagccccccggggagtgagccagcctgcatcccagtcagtcagagggactgggcctttgtctgtgagctcattcccactgtttcgccgctgccgccgagctggcccattggagccttacagaactgatcaggacttgtggagacctctgcactgaatttcctataggtaacttccacctcactggtttttactctcaaaactggcccagtgcttgctgggtagacttttcatc

SEQ ID NO: 9813 - DNA, 452 bp, Rattus norvegicus
  misc_feature (33)..(33): n is a, c, g, or t
  misc_feature (104)..(104): n is a, c, g, or t
  misc_feature (154)..(154): n is a, c, g, or t
  misc_feature (173)..(173): n is a, c, g, or t
ctcctgaagagccagctgtggacagagggagtnaggctttatttaaagtgacaggaagaaacatggcgttttggtatattgggagcaatgccaagattccctcntgccctacataggtcacagacaccttcccaaccatcccctcctccacttnccataaatgaagacagccntgatgaccctcaccccttttgcataggtcactggatcccactgtccttcctcggtgcttacacactttacagaccctttaggcgagcccttgcatagagcgttatctcagtgctccattccagtcctgactccctgtggccattgagactttggatttaagaactcacattgctagggagaggggctttgctgggaaaggtgactcctctgtaacctagcctcttgtgctcctccatgacagaaatgctgggtggagttttacatttgccaatggccag

SEQ ID NO: 9814 - DNA, 456 bp, Rattus norvegicus
  misc_feature (185)..(185): n is a, c, g, or t
  misc_feature (218)..(218): n is a, c, g, or t
tgatttaattagtcaccccgtgctggccaccttccctctgctcctggagcagcccgatgtgatggatgctctcaggagttcctgggctgagaaagaaagcacactaaagcgatcggagaagagagacaaagagctcctaaaggccgagttcctcctggtctaccatgactgcgtgctccctcttntgcattccacattgctgcccccctttaggtggnccgaggaagagacagaggctgctagatggaaagccatcgctgacttcctcaagcaaagccgagagaacgagggttccctgaaggctcttctgtcaccagatggagttcacaaaccatttgacctttcagagcagacctatgacttcttgggtgaaataagaaagaactcaggctaatgatggccatggctcccgattcccactggacccagtgagttccccaggatgacttggctcaa

SEQ ID NO: 9815 - DNA, 361 bp, Rattus norvegicus
ccgccgtgacactttctacaaggagcagcaggaacgcatccaagagaagaatgctgagctgtataaactgtcttctcaacaattccacgaggcggcttcaaaagcagagagcacaataaagccccgcagagtggagcctgtatgctctggcctacaggcccagatcctccgctgctaccgtgaccatctgcatgaggtacttctatgctccgacctggccaaggcataccagcactgtgtgagcaccgcccgcaagggctgaggagcagcatccttcctggagccttgaagaagggaccgatcatgagaccacagaccatggtccccatgccctgcagtctctgactgagcacccatatgc

SEQ ID NO: 9816 - DNA, 334 bp, Rattus norvegicus
  misc_feature (52)..(52): n is a, c, g, or t
ccactggagcactgaacacaatgtacaagtaccacacagaaaagcagcactngaccatacttcagtttgacacttccctcccccctggacgcctggaccactccatgtgtgtcatcccatggccagtgatgtctgcctctgacactgaagactcaggttctgtcattctcagcctccaagatgagaaaggggacgctgctgagaaaccagagacccggagtggagggtcccgtgaggagagtccgaccacactgctgctctgttttgtgttcggtgggatgaatacagaaggggagatctatgatgattgtctcgtgaccgtagtggactaata

SEQ ID NO: 9817 - DNA, 497 bp, Rattus norvegicus
ggcctggacagctgacctggaagaactcggagagggacttggactgggctgggcccagctttgcttcagcaacaccgatgtgggcagccctagatgagcaaatgctacaggaagggatccaggcctcacttcttgatgtgtcagtccagggttcccagaacactctgtggtcaccaaagccctctgtgtcttctctaaggcttcagcagctacagcatatgggattccccactgagcaggctgcggtggccttggcagctacagggcgtgtagagggggcagtgtccctgctggtggaagggctagtggataccgaggccctagtgactgaggagaggagtggtccagcccactgcaaggacactggggtctcatagtctaagaagagagtagacctggcctgagtccttacctggtctcctgagggcttggtggggtcttgaaagcatcctggggcaggagcaggccccaccatgttcccctggtactttgtaaga

SEQ ID NO: 9818 - DNA, 563 bp, Rattus norvegicus
tggaatggactcctgccatggctcgcactcccttggctcccgtgccctccaggctgactgagccagataagcattctctagcagggccccgaggtccaagccaagtgccttccaggccttgtcctcagcacctgctgtagtatgtatagggctgagcccagaggctgaacaagactaaggcccgggtccccagcatatcatccatcgatgtgaatcatggggaagggaacccgtccagcccacccctcctcagcaggagctgtgaagagtccctttcctccgccctggccagtctctttcatctccacagccaagccagaatctgtcttcatgaggaaatacccagggaccaggagtcagaggactatctatcgatgaggggcctcagcctctccatagtaagggttaagggacacctgaggcctagcctccaccctgcacctcgaggtgccatctcccagctgccactctctggtgactcttgagccccagacttcctgcttccattcagtgtggttcttgctgcagtcatggttgcataatgtgattctgccaggcgatca

SEQ ID NO: 9819 - DNA, 354 bp, Rattus norvegicus
tctgggcgagggtcctatcaatcagaaaggctacacgctgatagcattggggcacctggctcagaccctgggtcgagcccggaaacaggctgtggttggtgaagagcgagatcgcctttaccgggctcggaagaagtgccagttcctgctggcttggaccaatgaaaacgaggctgctctcacacccctggctctagactgtgccagagcccaccgagcccatgctgtgacagttgaggagatggcaacccttactggggagctagaacggctttggggaggcccagtaccacctgcaccaaggattctcattgaggagcttcctggctgagctgggcatccatgtcattacat

SEQ ID NO: 9820 - DNA, 352 bp, Rattus norvegicus
aagaccaggcagactgttcttgctaccagtttcttctaaggattatcagccatgcatgaacgatgagacaaaggaagaggatctactgaatgagtgcatgcagtccatgtccattcaggaacaaggctcatctcatgccagcctgacagtctcgtgtcccacaccaagttcagccatcccctaatacccacatgttgagcctgaggggacagtgaagagttggaaccatgtatgggatagtgctagtagctgctggtatgttattttagttattgagaaatttataatagccttcttcgtctaatatatttccgtgttatatctgtaatgtatgcttgtttctagctagaac

SEQ ID NO: 9821 - DNA, 456 bp, Rattus norvegicus
  misc_feature (385)..(385): n is a, c, g, or t
gtgggtgtggccagcaacttcacattcctcagtgtcatcgcgctcttcagctatatgcagtgggtgtggggtgctgtctggccccgacaccgcttctctttgcaggttaatatccgacaaagggataattcaggacacggggcccagcgtcggatctctcgccatcagccaggtcaggcgtctacccagcagtcagatgtgacagaggatggcgagagccctgaggatccctcaggaacagagggtcagctgtctgaggaagagaaaccagagaagcagcctctgaatggagaaggggagcaggagccagaggctagtgacggctcctgggaagatgctgctttgctgaccgaagcctcaacgtctgccctcgcccctgagactntgggcagcctcaggcaacgccagacctgctccagttcctgaacaaaagggtggagtcttcacattccagca

SEQ ID NO: 9822 - DNA, 299 bp, Rattus norvegicus
tgtcaagatgcctggttcctttctggcaagcagcaggtagctaaagaaaaccaacaggtagcaaaggatgtcacactgcatcaggccttgcttcggttgccccagtatcagactgatcttttgctcaccttcaatcagcccccgtgtcacagcaggcctcttggccctgaaaatctgtcatgtccaccttggagcctgggtaactttgagcagctggtaactagtttgactcttcatgatcccaacctctttggtccccagtaaagatggttgaaacacagcgtgctgctgaggactca

SEQ ID NO: 9823 - DNA, 479 bp, Rattus norvegicus
  misc_feature (54)..(54): n is a, c, g, or t
  misc_feature (243)..(243): n is a, c, g, or t
gagaacgacaacttccaggatgacccccacgccggcctcccccagctgggcaanagactacctcagttcgatgatgatgcagacacaggaaagaaaaagaagaaaactcgaggcgaccacttcaaacttcgcttccgcaaaaacttccaggctttgctggaggagcagaacctgagtgcatctgagggccccaactacttgacagcctgtgcgggtccgccatctcggccccagcgtcccttntgtgctgtgtgtggcttcccatccccgtatacctgtgtaagctgtggtgcccggtattgcacggtgcgctgcctgggcacccatcaggagacccggtgtctgaagtggactgtgtaaacctggcatcagggagaagtacccccaactctccccaacccaccccagctcatccacaaaggacagcgagaaaggatctacccattcacccagcaaagctgtaccctgccgaccaagga

SEQ ID NO: 9824 - DNA, 360 bp, Rattus norvegicus
ttctacatcttcaacttcctcaaatttacactctggccatgcctggtcgtggccctcgtgccctggatggtgcatacattgagtgcccaggaagccccacccattcgctcttcttgatgagttttgcctccctctccccaaagacaacactccttgaccaccacaggagcaggcccgctcaccttgaactccatttctgcctcatgctttgcagtcttaccccccttttaaaaaaggacctctgtttccaggaggctaagcctttccccaggtccccacaaagcaagaacaacgggaggcctggtgggatggggagctgggttcctgacactgacaagctgctcaggaaggccccaataa

SEQ ID NO: 9825 - DNA, 462 bp, Rattus norvegicus
  misc_feature (50)..(50): n is a, c, g, or t
tggcctggtcgcaaccagttttagttgagaagccatggtggggcggcggnccggggacggtggccacaatgtgcaataacgtggtgtcccggggccgggcgcggcggcagacccgggtggcatgggggggtgtcgtttctagccagctacctcggtaactccaattcattcaggttaacttccccatggggcagccggccgcgggcttgggcgctgtcgctctgctcttgtgtggcccgcggcatggggctccccggctgcctccttaccctccggagcctcgctcttccaacgccccgctgccaggcagacctcggggcatcctgccgccctccccacccgactctgtcaggaagcaataccgggtccggtctggagctgggcggcctggcggtgtcaccgcatgaactcgctgggaggccggggccctggccagccacacggcactcttttctaatattt

SEQ ID NO: 9826 - DNA, 330 bp, Rattus norvegicus
gagtttacagggtctggactcagattatggctcaggctatcccaatgatcccaagaccaaagcctggctgaggaaacatgtggaccctgtgtttggcttcccccagtttgtacggttcagttggagcacagcccaggccatcctggaaaaggaggcagaaagtgtcacctgggaagactcagcagctgaggaggatcctgagggacccggaagaatcacctcctacttcagccagggcccgcaggcctgccgccctcaggtctcccacaaatacttccaggagcgaggcctggagacagccaccagcctctaggagccaatgtgtgtacc

SEQ ID NO: 9827 - DNA, 239 bp, Rattus norvegicus
agaacacgggtcacagccgtggccacgagtcctccatgaagaaactcgtggcctgtgtgagtcaagacaacttctccctgtcatcagagggtgaggaagaggaggaggatgaggaagatgaggaggaggaagatgatgatgaggaagacgaggaggaggagcagatcccggtgaaaggcaagctgctgctgctggagcccgaaaagcaagatggtgctgaggatgctgtggcccagcca

SEQ ID NO: 9828 - DNA, 492 bp, Rattus norvegicus
ttagctgtccagaactccttttgttacttgaactactaattgaagattgacgtgtccaaagcctcaggtttggctctggcagaggagtggacagcagctgattgagatacaagcccatctggagacaggactgccactgacagaagacatgggctgtgtctaaatccaatctgggacccggccgcatggctgccttcacctgttgtaattcttcatacagcatcttggcaccacctctccgtggatcttcactatctacgtaaaacaacccaaagacagcgtttccagacactgcatcagtttgcccttccccacattccatcatcaaagccacaaagacaatcagtgtgaaaactggtcacttttcttttctggtttcataaatgtcttccatacactgaaggtcccttttgactttattcaacccaaagttactgatttttccttaaaataagatctctcccatagtatgctacctgaccttaaacaagt

SEQ ID NO: 9829 - DNA, 526 bp, Rattus norvegicus
tcccggcggcccagagagagagcaagtcgtgcttggtgtggacggaggaaccacgcggtgttgtcatgggccacttttcttgtacggttcccaggccccaaaatccagccagtgagattactttccagtgcatcaattatgggtcagctcaaaagttgaattttaacagaccacaaaagtctttcacctgctttaaatctgggcacattgttacttaactgctcccctcccccatatacactctatctttagccatttctcacagtgcatttggtaatgaccgggggaggggggaatgaatgcgcttttgtaaagctatttccaaaccaacggtggaatatttttgtagattccaaaacccaaacggtttatttttttttaaaaaaaataggggggtctcttttttctttttttttttttccaaataaaagtcggggggggatcatatgttggcaagatcagaggacaaattgtaggagtcagttttttcctttccactaagttgaccctggtaacgacacattaa

SEQ ID NO: 9830 - DNA, 560 bp, Rattus norvegicus
  misc_feature (129)..(131): n is a, c, g, or t
atccactcagggttcttaatggtgctgtatgtgatcttgataggatttgcttaaatggcgtgtgcgtggaatcgagatttcttaaggctcaatcaacatcgtgtgcagaagccaagtgcaacgggcatnnngtgtgcacttcccgtggtgactgccattgttctgagggctttcaacctcccagctgtacacctaaggaaggaggagactcatcttggtatggcaggcaaggtctgcccatggaaggagcttctaggaaccgtgagaagaagtggctcttaagtttgtacattgtcttaattatcctcacgacagcagtcgtcctaggcacagggtggaaaggcttgaaaaagtgtcgcttcaaggaggaggaatccatgagcagcgaaagcaaatcagaagacaacactcaaacgtacaacagcagatcaaaatccgaggcaagcagtggatcacctacgagcagttaactgctaccccttcaggaggaagaggatggcacccaggggctcactgagaaatgaagagtccacggtcttcccttggtcacagctgaagga

SEQ ID NO: 9831 - DNA, 555 bp, Rattus norvegicus
  misc_feature (176)..(176): n is a, c, g, or t
tcccaaactaacttctgcgatcgaggagcttgcaatggaagtttatctcggttggattatgactgcaccccagaaaaatgcaattttagaggagtgtgtaataatcatcggcattgccattgtcatttaggttggaaacctcctctgtgcagagaggaggggcctagcgggagcanggacagtgggtcccctccgaaggaaaggcgcacaataaaacagagcagagaaccactgttatatttaagaatgctctttggtcgtctttatttattcattgtctcgctgctctttggagtggccactcgcgcaggagttattaaggtctttaagtttgaagacttgcaagctgctctgcgggctgcacaagccaaggcgacttaaagatgaacgaggtcctcgtaagataaagagaatgcaaaaatgcatgtcaagaggggacaaggtagaactccagtccacagttctggagagccttcatctatatcgtggggacgcaagaggttttggatttggataccacctgacattggtgggttactgatgctcacactcgaa

SEQ ID NO: 9832 - DNA, 507 bp, Rattus norvegicus
  misc_feature (59)..(59): n is a, c, g, or t
  misc_feature (68)..(68): n is a, c, g, or t
  misc_feature (330)..(334): n is a, c, g, or t
aggaggttgagattgcccactgccataaggggcagtactttggagaacttgccctggtnaccaacaanccaagagctgcttctgcttatgcggttggagacgtcaaatgcttagtcatggatgttcaagcatttgagaggcttctgggcccctgcatggacatcatgaagaggaacatctcacattacgaagaacagctggtgaagatgtttggctccaacttggatctattggaccccgggcagtagatgtgatgaatctcggagccttctcagtgtgataccaaatccttccagtcagccacaagaacacacccagaaaacagacacnnnnnaactgcgcctgctgctgtctctgctgctgccatcgctgtggtaaagggcacttagaagtcttgaaagatggacagaggctctacccacacccaccttccactttgcttctgaacgccgtcattagaccacttatgtcacgattactccagcccaggtttcacgtttggttcag

SEQ ID NO: 9833 - DNA, 496 bp, Rattus norvegicus
  misc_feature (146)..(146): n is a, c, g, or t
tcctcctaccgagtacagacagaagcccaggaagagggttggcatgactgtcacagggaaacaaacgcgagttcttcagatccctaccaggattatgaggagtactggagagcgtattacagggcatggcaagaatattatgctgntgcttcccattcatactattggaatgctcagagacatccgagctggatggctgcctatcatatgaatacagtttatctacaagaaatgatgcgtggtaaccagtgaggttagcatgtgcctgagactgttgactgtcaacagatcattagatacacattcttcacctagagcaagtaggattcggtggcattttggaggaacttgagaggacttgaggctttctactgggacacaattatttttcagattatttttagaacttggctctaaagacccccccaaggtgccacttcatgtaggctggtcccaaaagaaacctttaaataggtgacatatgccactccttact

SEQ ID NO: 9834 - DNA, 544 bp, Rattus norvegicus
ggcgaatgtctaaatccccagttgacagctctgtcctggaaggggtgaaggacctgtacctggaggctgcccaccaaaatggtgacatgatcgacccagacctgcagacgggtcttggagttctgttccacctgagtggagagttcaaccgagcgatcgatgcatttaatgctgccttaactgttcggccagaggattactcgttgtggaaccgacttggggcaaccttggcaaatggagaccgcagtgaggaagctgtagaggcctacacgagagcactggagatccagccaggtttcatccggtccaggtacaacctgggaatcagctgcatcaacctgggtgcctacagagaagcggtcagcaactttctcactgccctcagcttgcagaggaagagcaggaaccagcagcaggtccctcaccctgccatctccgggaacatctgggccgccctcaggattgcgctgtcgctgatggaccagccagagctcttccaggcagccaacctcggcgacctggatgtcctcctgagagctttcaa

SEQ ID NO: 9835 - DNA, 409 bp, Rattus norvegicus
gagtaacgccatcttgcggtacatcgcacgcaagcacaacatgtgtggtgacaccgaagaagaaaagattcgagtggacatcatggagaaccagataatggacttccgcatgcagctggttcggctctgctacaattctaaccacgaaagcctgaagcctcagtatttggaacaactgcctgcacagctgaaacagttctcgttgttcctggggaaattcacatggtttgcaggagaaaagctgaccttcgtggattttctcacttatgacgtcttggaccagaatcgtatgtttgagcccaagtgcctggatgagttcccaaatctgaaggctttcatgtgccgttttgaggctttggagaagattgctgcattcctgcagtctgaccgctgcttcaagatgccaatc

SEQ ID NO: 9836 - DNA, 316 bp, Rattus norvegicus
tgaggcagagtctcatgctgttctgcttaccgccgttgaatctaggtacgacttcgttgtcactgcctccgaaactaacagcgtcgtcgtggaggaaccacacgttgacacaaagaattcgcctgaaaaggatgcagcagagtctgtcactaatgtcacagaggaatttccttcagtgacctctgtagtagaacagagtgggaacaaggaggacttatctaccaatgactccggtatctttaaactgctcaaagaagaaccagatgaactcatgatgtaaaaccagtaacataagggaagccacatagacacacat

SEQ ID NO: 9837 - DNA, 395 bp, Rattus norvegicus
tgctagcttacgacgctgcatgttaccttcctgtaggattgtgtgaacttgcagaatctgtgcttatttttactttatttttggtccatttagtagcctatccagtactcttctgacctgtgaaatggagaattacttatgtctggattccagccatatccttgatgtgaccagcatgaagggtgtctcacatgtatgccagggcttgctgttgaaatgtaaaatactaactattctcctaacgtctttgcctcagttgattcaagtttggctttcaagatgtacacccctaaattcctaactaatatagttcttttgttcaatcaacttgggagtttaaatggttcttattgaattaaaagatctaattgtgccccaaaagtgctttaccatgc

SEQ ID NO: 9838 - DNA, 436 bp, Rattus norvegicus
atgactccctctgcaacaacaggaacaacttagcttcaatcttgcaagcaccagagcccacagcaacctccaacatgtcaggagcccgccactgcccaacatgcttggccctggagccctgttccagtgccccctctatgccctgtgccaatggcacaactcagtgctaccacgggaagagtcgagctctctggaggaggcatggactccgtcgtgcatgttaaaggctgcaccactgcaatcggctgcagactgatggccaagatggagtcggtgggacccatgacagtgaaagagacctgtagttaccagtcattccttcacccccgaatggcagagatcggggcctcctggatgcccacctcactgtgggtgctggagctcctgcttccggcgctgtcgctgcccctcatctacttcccttgagaggacaccg

SEQ ID NO: 9839 - DNA, 348 bp, Rattus norvegicus
  misc_feature (26)..(27): n is a, c, g, or t
tagctgcggacagaattgctggcctnntagaagctttggaacgagcagtcaagatgagtgataaaccagacttatcagaagttgaaacatttgacaaatcaaagttgaagaagactaatactgaagaaaagaatactcttccttcgaaggaaactatccagcaggagaaagaatataatcaaagatcataaaatgagattctcctctcaagagcaacttcaactttgctggatagtcttggatttagacatgtttctgtaaacctatccaatatgtagacattttaggcggttcctgataggttcttaagtaccctgactgaaaggtcagcatttaacaccaatcatt

SEQ ID NO: 9840 - DNA, 469 bp, Rattus norvegicus
  misc_feature (33)..(33): n is a, c, g, or t
  misc_feature (38)..(38): n is a, c, g, or t
  misc_feature (40)..(40): n is a, c, g, or t
  misc_feature (52)..(52): n is a, c, g, or t
  misc_feature (54)..(54): n is a, c, g, or t
  misc_feature (71)..(71): n is a, c, g, or t
  misc_feature (73)..(73): n is a, c, g, or t
  misc_feature (82)..(86): n is a, c, g, or t
  misc_feature (89)..(89): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (122)..(122): n is a, c, g, or t
  misc_feature (139)..(139): n is a, c, g, or t
  misc_feature (153)..(153): n is a, c, g, or t
  misc_feature (226)..(226): n is a, c, g, or t
  misc_feature (316)..(316): n is a, c, g, or t
  misc_feature (325)..(325): n is a, c, g, or t
ggaagtcggtcctgcccgtggcactcattgtgntgggnantcatgattgcancntcaagtttatagagatngncaagaatgnnnnngantttgncatgtntntggagcatgtcctgttccanttcaatgaaaaccagantgatgattttgccnacaagttcctgagagtccggagaagtcttcgtaagaaatatacgcagaagtatttagtagacctggagatggnccgtacactttgtgggaaatatgatgaagacattgacaattgtccattgcaggaaggcccaggagagaaaaaggtacgctgcacttacantgtggagantagagtatgggtcactgagttcaccatcttgaacagcacctgtgtgcagacttaagtggggcaagggtctttctgtgcctgtagctgaaggctcctttcctctagagggtcactgtctgtgtccttgggtctttttagtaccag

SEQ ID NO: 9841 - DNA, 447 bp, Rattus norvegicus
  misc_feature (78)..(78): n is a, c, g, or t
gaacgtcagcagtaccaggaggcactgaacatgctgtcatctgtgccaaaggacgaaaacaagatgttctctttcccnggtgaatttctgttacctgcccataaagtcaagcattcagaaggtgttatagtccaacaggtcaatgatgaaacagatttcgaagccttaccctgggacggaaacaatccaagtgtttctgacagttttatagaccaggagacctctgtggatgtcattgaaggtgacagtgactttgaaatggttgagacttccagggaactctgctgtctgagcacatcactgtccccatctgttccactccccagcattgaaggtggcagtaatcatgataaggaattatcgactctaaaaatcatggaaatgagcattgaagactgacctttggatcttcattaataaatactccatgtggccagtaactcaata

SEQ ID NO: 9842 - DNA, 477 bp, Rattus norvegicus
  misc_feature (365)..(365): n is a, c, g, or t
aagcagatgtgcacctgtctgcagaaagggccaaagccgagggccgcctccagaacatggacttcctgaaagccaaggcggcggagttccggtttgggatccgagctgcagaggagcaactttcatccagaggcatggacgcgtccctgtctcatcggtcactagtggcactttcagacaaactttcggaattaaaacagcagactatccctctgaagaagaaattggagtcctatttagatctaatgccgaatccatctcttgctcaggtgaaaattgaagaggcaaagagagaattagatgccatcgaggctgaactcacaaagaaagtagatatgatggagctgtgaggacgccaagtagangcctctcctgagaaggagatgacagttcttagagacaataatgtctttattggtaaaataacagggcttggttctgcatttacattttgtggcctgaatacagttttcctat

SEQ ID NO: 9843 - DNA, 447 bp, Rattus norvegicus
  misc_feature (74)..(76): n is a, c, g, or t
  misc_feature (80)..(80): n is a, c, g, or t
  misc_feature (93)..(93): n is a, c, g, or t
  misc_feature (123)..(123): n is a, c, g, or t
  misc_feature (129)..(129): n is a, c, g, or t
  misc_feature (198)..(198): n is a, c, g, or t
  misc_feature (224)..(224): n is a, c, g, or t
  misc_feature (232)..(233): n is a, c, g, or t
  misc_feature (367)..(367): n is a, c, g, or t
gagtggccggcgtggcacactgcggccaggctggcctgccgctccatgtccatctgagactagggctcggagcnnncagnttccccatgaggnacctctcctgatccatccgcactttactantccagnctgaaagcccagagttccctcggccccttcccctgactatgaaggacaactgattccatctactacccnatatatcagagatcaacactaagggnccagtgtnnccagagggccctcccaggctccctggccactgctgcccaccccctctcccacttcctgatgtcagggattagagaaatggggttccaccccgtcatcaggtgaaatccaggctaatgaaacccagcgccattcngccattcgactttgcccctcgcacctgcagcctctccaccctgcagccgccccacaaggagcgctcctagctcccaaagg

SEQ ID NO: 9844 - DNA, 445 bp, Rattus norvegicus
gtacgagctggactatggcaaacatgagctagtcaacataaggaaggtgcagcccctagtggacgtgttccggaagctgccattccaggcagtcactgctcaacttgcaggagtgaagtgcagccaatggtcggaagaggcttcaatggtgtttcgaaatcacgtggagaagaaacccctggtggcactggtgcagacagttattgaacacgctaacccttgggaccggaaagtagtggtctatctagtagacacatcgctgccagacactgacacctggattcatgactttatgtcacagtatctggtagagctttcaaaagctaattaatcactgcttgagaccttgaccgttaatgcagattgttctctaagcaataatacaaaatgtgtagtagggtcttaaaacatcttatttttactacatggctctgactgttgtgga

SEQ ID NO: 9845 - DNA, 356 bp, Rattus norvegicus
  misc_feature (62)..(62): n is a, c, g, or t
gccaaggtagatcaggtcctgcacacacagacagatgtagacccagctgaggaatatgcccngctctgccaggagatccttggggtgccagccacaccaggtaccaacatgccagccacttttggccacctcgctggtggctacgacgctcagtactatggctacttgtggagtgaggtgtactccatggacatgttccacacacgcttcaagcaggagggtgtgcttagccccaaggttggcatggattaccggaccagcatcctgaggccggggggctctgaggatgccagtaccatgctgaagcagttcctgggccgtgaccccaagcaagacgccttcctcctgagcaaggg

SEQ ID NO: 9846 - DNA, 536 bp, Rattus norvegicus
tcatcagaggtatcctggagtgcgttgttcagggcatccagatgactgactaggaacttatttcacagttcagggacaagacttcataggataggtagcgattaagtaggcaggaattagaactcttccctgcccatactcccctgctcaccaaacagtacccgtcggcatcatgaaggctgttggctggttaagcttcaccctagaaaccctctgcagtttcactttgaaacactctgaattcctttctggtagaggccgagttccaggcatactctccctctccacaagaattgcctgtttttgtcgtctgccattaagtcacctggggtgaatgtacacaagcccacagcagtgtgcttaacacagagatggggctctgttccgtcaccagaattctcggtgaccggttcaccctatgccatagcagctcagcttccttcacggtcctttggaaggactgtgtctgcctgggtgacaagatgtcctggctgggagaacatcaaggcagggctttgctccagacctgttatgaa

SEQ ID NO: 9847 - DNA, 450 bp, Rattus norvegicus
  misc_feature (280)..(280): n is a, c, g, or t
  misc_feature (348)..(348): n is a, c, g, or t
ggcacatccttggacgaaggtctttcggccccgaactccaccagaggcaatcgcactgtgtagccgtctcctggagtacacgccgaccgcccggctaacaccactggaagcttgtgcacattcattttttgatgaattacgggacccaaatgtcaaactaccaaatgggcgagacacacctgccctcttcaactttaccactcaagaactgtcaagtaacccacctctggccaccatccttatccctcctcacgctcggattcaggcagctgcttcaccncctgcaaacgccacagcagcctcagatactaatgctggagaccgtggacagaccaataacgccgcttntgcatcagcctccaactctacctgaacagccccaagtagccagctgcgcagggaagaccagcacttacttgagtgccactcagcaacactggtcacgtttgg

SEQ ID NO: 9848 - DNA, 445 bp, Rattus norvegicus
aatccggagaagtaccagtgcacaagctgcagtctctcaaaaaggtgcttcagagtgagttttgtacagcaatccgagaggtgtatcaatacatgcatgaaacgattactgttaatggctgccctgaattccgtgcgagggccacagcaaaggcaacagttgcggcttttgcagccagcgaaggccactcccaccctcgggtagtcgaactgccaaagactgatgaaggcctgggttttaacgtgatgggaggaaaggaacagaattctccaatttacatctcccgcatcatccctggaggggtggctgaaagacacggaggcctcaaaagaggagaccagttgctatcagtgaacggagtggcccttgaagaaaagctagcaggtcaatcatccaacagtcacaaatttgggaacccgtgctccggaatcccagcacatagaaa

SEQ ID NO: 9849 - DNA, 505 bp, Rattus norvegicus
agtcctcaagtgaccagtcttctgatgtatcttcaggcgaacaagtttcaggtgaaaagcttgaagaggcaggtgaacaggtgtctggcgaagacaaaggaaacgaagttataagtacaccacttccaagcacgtcttcaggtgggataataaattgccacacatgtgcttatatgaatgaagatgcaaaatgtctccgtggagaaggaatatgcaccactcaaaattcccagcagtgcatgttaaagaagatctatgaaggtggaaagctccagttcatggttcaagggtgtgagaacatgtgcccatctatgaacctcttctctcatggaacaagaatgcaaattatgtgctgtcgtcatgaagctctctgcaacaaggcctagaagcctgtgccctacttcctgctctggctcaggcagattcaccactctacttggctcaatttatattcaacttcaacaactaatcaccagataagaagctcaaccctaatctttattaa

SEQ ID NO: 9850 - DNA, 451 bp, Rattus norvegicus
aatcttcttgaagggctgacacgggagattctgagggagcaaccggacaatataccagcttttgccgcagcgtattttgagaaccttctagagaaaagagagaaaaccagctttgatccagcagaatggggggctaaggtagaggaccgcttctataacaaccacgcattcaaggacccagaacaagctgaaaaatgtgaacaagaaatagccaaggcatctggaagagaagaaacaccagtcactcccttcgaggagtctactgaggaagaaagagaacaagaggaggcagctgtcaaaatccagtctgccttccggggacacgtggctagagaagaggtaaagaagatgaagtcagataagagtgagaacgtgaaagaagaggagaacaattgagaccacaggttttacccccaggaaacatgaaaagtaatccaaagccatcagtgtt

SEQ ID NO: 9851 - DNA, 311 bp, Rattus norvegicus
  misc_feature (179)..(179): n is a, c, g, or t
gacacaggcgctgcaagaggcttcacaggatccacaagaggcgccggtcatgcagaaggcggaggagacactcctgccgccacaggaggcggcatcgcagaggctgcagaagatcccgaaggaggaggagctgcaggtgcaggaaatgcaggtggcactattattaagcctccccaggncgatccattctgcctggagctaaggaagtcacctgcctcaggaagtcacctgcccaagcaaagtcatgtaaggccacaacaccattccatgttgatatctgagccctgagctgccaaggagccacgaaatct

SEQ ID NO: 9852 - DNA, 463 bp, Rattus norvegicus
  misc_feature (154)..(154): n is a, c, g, or t
atggacaccaagatgcagagccttcccaccactcatccccacccgcacagctcctctcggcctcaaagtcacaccaataaccagtgtgcctgcagccaccactgccggagctgcagccaagcaggccacccgagctccagttccagccccagcnctggcccgccgacgaagcaccccaaaacacccatgcactctcgttactcaccttcaagacccagccaccgcggcagctgccccaagaacaggaagaccttggaagggaaagtgagcaagagaaaggcggtcaggaggcggaagcggactcacagagctaagaggcgtagctcaggacgaagatacaagtgacacactccaggatgttcctgtgtccatttgatcccaaaaggagatagccatcactaggggaatgttgggatgacagtacaggaacatgtcactgcagcaatttctatgcaacatggat

SEQ ID NO: 9853 - DNA, 457 bp, Rattus norvegicus
tcactgccaaggtgcagggcttacagcagagctgccggcacatggaggctgagctgaaggaattaacaagtgcgctgaccactcctgagatgcagacagagattcaggagttgaagaaggagtgtgctcgctacacagagagactgaaaaacatcaaagcagctaccaaccatgtcactccagaagagaaggagaaggtgtacagggagagacagaagtactgtaaagagtggaggaagcggaagagaatgaccacagagctgtgcgatgcgatccttgaaggttaccccaagagcaagaagcagttctttgaagaagttgggatagagacagatgaagatcataatgttacgctcccagacccctgaggggcccttgatggaggtgggaacagaccgtcctgctttggccaccttactgaggtggcctttttattcttgctgttctccacctttga

SEQ ID NO: 9854 - DNA, 449 bp, Rattus norvegicus
ttgtgcaagctcactacttcagatgtgtcaaccttcatgttgaagtctccaaggacctcaaggagagcttggaggtggtcaaccaagcccagttggctctcagtttcgcaaggcttgtggaagaacaagaaaataagtttcaagctgctgtaatagaagaactacaggagttgtctaatgaagccctgaggaaaatattacggagggatcttccagtgacacgcactttgattgactggcaacggatcctctctgacttgaatctggtgatgtaccccaaattaggatacgttatttactccaggagtgtgctgtgcaactggataatataaaaggttgctgctccacattatcgtctcaagccaaagtgctttctgggaagtcagtgcttagatagtgctgagaagctcttggactagtactaagcctgtctttagcctataccagtt

SEQ ID NO: 9855 - DNA, 532 bp, Rattus norvegicus
ggacaataacctcttgggcaagttcgacctaactgggatccctccagcaccccgcggcgtcccccagatcgaggtcacctttgacatcgatgccaacggcattcttaacgtcactgctgcagacaagagcaccggcaaagaaaataaaatcaccatcaccaacgacaagggtcgtctgagcaaagacgacattgaccggatggtgcaggaggcagacgggtacaaatcggaagatgaagctaatcgcgatcgcgtggcagccaaaaacgcggttgagtcctatacctacaacatcaagcagacggtggaagacgagaaactgaggggcaagattagcgagcaggacaaaaacaagattctcgacaagtgtcaggaggtgatcaactggcttgaccgaaaccagatggcagagaaagatgagtacgaacacaagcagaaagagcttgagagagtgtgcaaccccatcatcagcaaactttaccaaggcggtccaggcggcggcggctcctctggaggacccaccattgaggaa

SEQ ID NO: 9856 - DNA, 501 bp, Rattus norvegicus
ttgaactatgattgcaccccagaaaaatgcaaccaccatggggtatgtaataacaagaagcattgccactgtgagcccacatacttacctccggattgtaaaaatacggaggatacatggcctggtgggagcgttgacagtggcaaccagcaacgggctgaatccatccctgcacggtcctatgttgcaagtgcctaccgctccaagtctgcaaggtggccatttttcctgatcatccctttctacgtggtgatccttgtcctgatcggcatgctggtaaaagtctattcccaaagaaaaaaatggagaatggatgacttctcaagtgaagaacaatttgaaagtgaaagtgaatccaaagactagtctggacagcaaagattccagtgtcatgtaattctcttcagtggacagaaaaaaaagtggaaaagaaaaacctatgcatcatctgtttgcctgaaagtcaagcctgcatgttgtggtttccatctggccagaaat

SEQ ID NO: 9857 - DNA, 442 bp, Rattus norvegicus
caatgtgaagctggtttcgctcctccagaatgtgacatgaccccttcatctccaggagggagcatggacgatggattttggctgcccttagataaaagcacaccgttggttatcaagcggcctggcactcaatataaaaagggacttttgatcagtttctatgtcttcctgccttttctcattgtgacagccattatggttgttaagcagaatatctcaaagatgttcgggcaaggagaggaagagtttagtgaaggatccatatcagaagaaattaacgacagcaagcagtcatagagccaaagcatttatgcaacagcaaagccacaacagaaaaagatcaccaagaaagtcaccattccttggtcttatttcgagaacaagaaccagtccatctctttctccgtggcttactggtttcagttatccatgcctccaaata

SEQ ID NO: 9858 - DNA, 420 bp, Rattus norvegicus
gtccatctgcagcatgttacttaccaaggatccaagtaaaaggctgggctgccagagtgatggagcctctgctgtaaagcagcacccaatattcaaggatattaacttcagcagactggaagcaaatatgttagacccacctttctgtcctgatcctgaggccatttattgtaaggatatcttggatattggacagttctctgtggtgaaaggagtcaacctggacaccaatgatgagatcttctacactcaatttgcgacagggtgtgtcaccattccctggcagaatgagatgattgaatctggatgtttcaaggacctcaatgaatatgaagataaaggtctgtcaccacttgaaaaacacaagatatgttcctgtattcttagaccaaagagaaacttcttccatagactcttcag

SEQ ID NO: 9859 - DNA, 560 bp, Rattus norvegicus
  misc_feature (454)..(454): n is a, c, g, or t
gtgaaggctgtggtggcctcttctcggctgggaagtgccagcagcagtcacaccaacatccaagaaagcaacaaagccagctcggaggcacagcccgcccaagacggcaaggacaagacagatcctctggaaaacaaaatgcaagcgggggaccacgaggcagccaaggctgcagccgatgagacgatgaagctacagtccgaggaggtggaggaagaggaaggtgtaaaagaagaggaggaagaggaagaagaggaagaggagacctccaggatggtacctcaggagccagaggacaggctggagacagatgaccaggaaatgaagagaaattcagaggagacgttgaagagtgtggaggaagaaatggacccgaaagctgaggaggaagccgctgccgtgggacttggggtccctccacagcaggatgctattctgccagagtactaacccngcttcctttagggccccaggccaaccccagcattttatgcactttgtccttcagcaaggtggggaagcatgataagcactatagtgattctgttttgaggtgcaaa

SEQ ID NO: 9860 - DNA, 368 bp, Rattus norvegicus
tgctggcagaaccagttcctggcattaaagcagaaccagatgagagcaacgcccgttattttcatgtggtcattgctggtccccaggattccccctttgagggagggacttttaaacttgaactattccttccagaagaatacccaatggcagcacctaaagtacgtttcatgaccaaaatttatcatcctaatgtagacaagttgggaagaatatgtttagatattttgaaagataagtggtccccagcactgcagatccgaacagttctgctatcaatccaggctttgctaagtgctcctaatccagatgatccattagcaaatgatgtagctgagcagtggaagagcaacgaagcccaagccata

SEQ ID NO: 9861 - DNA, 491 bp, Rattus norvegicus
ggtgggtacaagatactgctcagaaggggtaaaggtccccaacctataagacaatgagatggcttttcagtggaagccatttacagctaaatgtttaaatgaatgaaaagctaggtgaagaacatgaatgttcctgtactcattttattccaaaagacctagagcttaaatgaacattaaagccaaccagactaagccaacccacctcctgtattttaaagtctaattggtcaacaaaaatagatcggcactatcggtccataaagtgtgcctggctttgttcccaaatcctttatacacggatgactcaacctattttctttcacactttctctccatattctttggtttacttgcggtttctcagttgattcatcactaatagctcttatttttattatattaactgcttaatctatttggatgtaaaggtagacattcaacttgatgaaaaaagcttgtgtatagagacctaattgctcctcttggag

SEQ ID NO: 9862 - DNA, 460 bp, Rattus norvegicus
taggcaaagtcatcccagagctcaatgggaagttaacaggaatggcattccgggtgccaaccccaaacgtatcagttgtggacctgacctgccgcctggctcagcctgcttcctacactgctatcaaggaggctgtgaaagcagcagccaagggacctatggctggcatccttgcttatacagaggaccaggtggtctccacggactttaatggcgattcccattcttccatctttgatgctaaggctggaattgccctcaatgacaacttcgtgaagcttgtttcctggtacgacaacgaatatggctacagtcaccgggtagtcgacctcctccgctacatgtttagccgagagaaataaaggcccctccttgctcccctgcgcacctcgcgtacctgccttcggctccccttcaaaagagggcgcacttcgcgctgccgccgggtcaacaatgaaat

SEQ ID NO: 9863 - DNA, 423 bp, Rattus norvegicus
agctgtgcagaatatcattaccgagttacctgtgaattctcacaagatagtactggagtgggcttcacccagaaattttacttcagtttgtgaagaactggttagtaatgttgaagatttgaatgaagaggtctgcagactgaaggagttgattcagaagatgcagaatgaacgggaaaatgatccaactcacatcccactagtagaagaggtgtctccatggaagactcggattttgaagaggtcagcagttacagtatgtggattcgggctgctgcttttcatctgcaagctaactttccagagaaaatgatactaatatttatttaagttatacatgtacatcttattcaaagtgtcctagcattgcttttaatcatttgtgatacaacatagctttatttccttgcctatactccatag

SEQ ID NO: 9864 - DNA, 390 bp, Rattus norvegicus
acagtactgacatgtgtgaccacttgacgagtgaaaaagtctagcaataggcacatggtctgtacatgactcctcctgtcacagaagaggcacactgcactgtagaaatgctttagagtctgttcacagagtgtgaaatgttaaacactgtccttctcctgtaagaacttttttttttttttgagcattcgtttgggggctatttggctagttagtaagaaacatttgtcagtcatcccacagcaactttacagataagcttatacccaaaagaataagcctgtttcataaatcaatgtatctgaaacccatttcttggcctaaatattgtgtacctatgagtacctaaacttgcagcaacattttaggagctccattttgcaactgact

SEQ ID NO: 9865 - DNA, 403 bp, Rattus norvegicus
agcagccagtactgattaccacaagaaaggctttgttatccctggactgagggtgaatgggatggatattctcagtgttcgtgaggcgaccaagtttgcagctgatcactgcagatccggaaaggggcccattgtgatggagttgcagacataccgttatcatggacacagtatgagcgatccagggatcagttatcgtacacgagaagaagttcagaacgtgaggagtaagagtgatccaataatgcttctccgagagagaatgataagcaacaacctcagcagtgttgaagaattgaaagaaattgatgcagatgtgaagaaagaagtcgaggaagcagctcagtttgctacaactgatccagaaccacctctggaagatttagccaattacctctaccac

SEQ ID NO: 9866 - DNA, 386 bp, Rattus norvegicus
gaagagcaagcagccctagcaagcaatggccccagatgtggccgtgaggctgtgatgtcacaaagttatctggaaactcctggccctgaagttatcgtcaacaatcagtgctctacaagcaacttgcagaagcagctgcaggctgtcctgcaatggattgcagcgtctcagtttaatgtgcccatgctctacttcatgggagatgatgatggacaactagagaagctccctgaagtttcagctaaggcagcagagaaaggttacagtgtaggagatcttcttcaggaggtcatgaagtttgccaaagaacgacaactggatgaagccgtgggcaacatggctagaaagcaactgctggactggcttctcgctaacctgtaagctga

SEQ ID NO: 9867 - DNA, 544 bp, Rattus norvegicus
ttcatcagcatcgtgatcgtgcagtgggctgacctcatcatctgcaagacgcgcagaaattcactcttcaagcagggcatgaaaaacaaagtcctaatatttggactccttgaggagacgatcctggcagcttgcctgtcctacattccaggcatggatgtagccctgagaatgtacccactcaagataaactggtggttctgcgcacttccctacagtgttctcatcttcatctatgatgaagttcgaaaactcatcatccgcagacggcccggtggatggctggagaaggagacgtactactaattgcatcagagaaagatcttcacatgacatcagtctcgaagccaagactgagtataacaatgacatctgagataaagctgagcagggggcgcgattgtatgggttgaatttactttggatgaggcgagttctggggctggagcaagagcatctggtaggagatggagtggagaggaggcccagcctgctctgcctggggcccagcgagtaggtgcagttttgttatatccagcagccg

SEQ ID NO: 9868 - DNA, 513 bp, Rattus norvegicus
atcagcattccagcagcagcatttgaacctgagccaggttcagcatttcggaactgggcatcaagaatggaatggaaactttgggcatcgaagacagcaagcatatattcctactagtgttaccagtaatccattcactctttctcacggaagtcccaaccacacagcagtgcatgcccatctggctggaagtgcgcacctcggaggacagcccactctgcttccgtacccgccatcaactgccctcagtagtgctgcacccgtggcccacctcctagcctctccgtgtacctcaagacctatgttacagcatccaacttataatatctcccatcccagtggcatagttcaccaagtccccgtgggcataaatccccgcctgttaccatccccgaccattcatcagactcagtacaaaccaatcttccctccacattcttacattgcagcatcgcctgcatatactggatttccattgagtccaacaaaactcagccagtatccatatatgtg

SEQ ID NO: 9869 - DNA, 432 bp, Rattus norvegicus
tagtgactcgaagaaccccaacggtcctttactacgaaggaatttctaggtatatggaagggcaagtcctccatcttcagaagcaaatagaagagcaggccgagaatgctcaggacagtggggtggagctacttaaggccttagagacccttgtggctcaaaataccactggccccgtcttctaccccaggctctaccatttgatggcctatgtctgtatactgatgggagacgggcacagttgtgacttcttcctaaacacagccttggagctctctgagacacaggggaatttgctggagaaatgttggctgagcatgagtaaggaatggtggtactcagcccccgagttgacaggagatcaatggcttcagacagtcttgagtctcccatcgtgggataaaattgtatcaggcaacgtaacccttcagg

SEQ ID NO: 9870 - DNA, 186 bp, Rattus norvegicus
gatttaaggttttattgccgagcaaaatgggagatgctgaagcaggcaagaagattttcattcagaaatgtgcgcagtgccacacagtggagaaaggtgggaagcacaagacagggccaaatctctggggcctttttggccgaaagactggacaagcaccaggattttcttacacggatgcaaaca

SEQ ID NO: 9871 - DNA, 290 bp, Rattus norvegicus
aagggccaaggagctcaaagtcagagtcattaaggccaaagggggaaaaggagacgtcccagacctgaagaagacagagagtgaaggtgaacaccgccagcagggcacagctgaggacacacaccccacatcactggacaggaagccttctgtctcggaactaacaaaccctgtccatcccagtgcgaattctgacactgtcaaagaagacccacactctgggggctgtatgataatgccacctatcaacctgacaagcagtaatttgttggccgcaaatcccagttcaa

SEQ ID NO: 9872 - DNA, 474 bp, Rattus norvegicus
  misc_feature (261)..(261): n is a, c, g, or t
tatctttgcgaacgccaacgactcacgccacatcccctcggctgcgccagattttattagagctactgccgcgcctcctcggcttgagcccacccccagaggatcccggagctgcctcaccagcgaggcgtgcctcatctgtgggcattctgcttagagcggaggagctcatcttgaaaaagccgcggagcgaactcgtgtttgagggacagaggcatcggcatggaacttggaccgcagccgccctctgccagaacctgngtgctgcagcccctgaagtccgctgctgtgtggatgctgtgaactttgtggctgagagcacaagggaccaggaagccactggagaggaactgtctgactgggtgcgtatggggaaggccctcgacaatgtctgtttttgggcagcgttggtgctcttcagcgtcggttctacgctcatcttccttggaggttacttcaaccaagttcctgatc

SEQ ID NO: 9873 - DNA, 501 bp, Rattus norvegicus
  misc_feature (330)..(330): n is a, c, g, or t
gtgagctgtgagcatctgtcatctcagatcgaggagtgcatcttcctggatgtgggaaacactgacatgaagtacaagaaccgtgttcggagccgaatctctaacctgaaagatgccaagaaccctggcctacgccggaatgtgttgtgtggtgccattacaccccagcagatagctgtgatgacatcagaggagatggccagtgacgagctgaaggagatccgcaaggctatgaccaaggaggccatccgagagcaccagatggcccgtacaggtggcacacagaccgacctgttcacctgcaacaagtgcaggaagaagaactgcacntacacgcaggtgcagacccgtagctctgatgagcccatgaccacctatgttgtctgcaatgagtgtgggaatcgatggaagttctgctgagtccttgtactgatgtagccctggccatggctaaccctgaacctcctgcaacgctcttggtggacacagcttctctggaga

SEQ ID NO: 9874 - DNA, 351 bp, Rattus norvegicus
  misc_feature (103)..(103): n is a, c, g, or t
  misc_feature (105)..(107): n is a, c, g, or t
  misc_feature (111)..(112): n is a, c, g, or t
  misc_feature (114)..(117): n is a, c, g, or t
  misc_feature (120)..(120): n is a, c, g, or t
  misc_feature (122)..(125): n is a, c, g, or t
  misc_feature (128)..(140): n is a, c, g, or t
  misc_feature (142)..(144): n is a, c, g, or t
  misc_feature (147)..(148): n is a, c, g, or t
  misc_feature (151)..(152): n is a, c, g, or t
  misc_feature (154)..(157): n is a, c, g, or t
  misc_feature (173)..(173): n is a, c, g, or t
tacaggtgcgcctggagcagatccgccaagcagacactctggagcaagtacgtagcattctggacgaggcacccctcagggacattaaggacattaaggactngnnngggnncnnnnganannnntcnnnnnnnnnnnnncnnnccnnttnncnnnnagaactgtgaggtgtngactgcaggtctcagaatggagtccgtcagctgcaaacctggacagtggtgtcccgggccactacttccacccagggtggctggccctgccctcagggatgatacctggaagagggtcctagcctcctcccagaaccaaagctttcaggctgccatgctccctcatggatccagttct

SEQ ID NO: 9875 - DNA, 417 bp, Rattus norvegicus
gcaagtgagtcagctggccgtgtttgtagaggcggcgttagactatcacaggcagtccaccgagatcctgcaggagctgcagaacaagctagagctgcgaatagctcttgcatcccaagtccctaggcgagactacatgccaaagcctgtgaacacgagttccaccaatgccaacggggtcgaacccagctcttcgtcaaagttaacaggtactgacattccctcggaccagccctgctgtcgtggtctctatgactttgagccagaaaacgaaggagaattgggatttaaagaaggggacatcattacattaaccaatcagatagatgaaaactggtatgaaggaatgctccgtggggaatccggcttcttccctattaattacgtggaagtcattgtgcctttacctcggtaaat

SEQ ID NO: 9876 - DNA, 500 bp, Rattus norvegicus
  misc_feature (54)..(54): n is a, c, g, or t
aaaatgactggagccggttctcgatggaagagcaaagtcctatgacagagttgnttccccaatatacacggaaagtcaaaaccttcaaccctcaccggtcctcctcctcctggggaagattcacaaacccaggcgtctcccagaagaaagcaacacacacttgggaatctcagtcactgcccaactatcagcttaaaaaggaggagctgcttccgaagacaggagtgcattcataccacggtggcaagccctatgtgaagagtgtaaaatttcagaagaaaaacactgacaaaatgagtaccttcagcggcttattttgggggaaccatccccagaggaagcgcagaggtttcgcagataaatgctgtgctatagggtgctccaaagaggagctggccgtcgcatgccttccgtttgttgatttttaaaccttaacgattaaacaaacatcactggtgacagagatgtacaaactgccgtagaaaccatgctcacttaat

SEQ ID NO: 9877 - DNA, 566 bp, Rattus norvegicus
  misc_feature (526)..(526): n is a, c, g, or t
gacagacctacagtggctgcttcattgcagctcaagccccaaggagacgtggaggacatcacttgtaccttttgactgagggaccatgacaaaacccttgttgctctccttgatcttcttcatcattccagcggccctggcagttgatgtggatcagtctaagaatgaagtgaaggcacagaggtactttggatccattagtatctccaatgccaatgtgaagcaatgtgtttggtttgccatgaaagaatacaacaaaggaagtgaggacaaatacctcttccttctggacaagacactccatgccacacttcagatcacagaccgcatggaataccacattgatgttcagatctcccgcagcaattgcagaaaacctttaaacaatactgaaaactgcatccctcaaaaaaatcccaaactggaaaagaaattaagttgcagctttctggtaggagcacttccctggaatggtgagttcgacctgttgagcaaagaatgcaaagatgtctaagggtgtcttggngtgcgcctcccccttctgggtctgcttttctctgtaataa

SEQ ID NO: 9878 - DNA, 522 bp, Rattus norvegicus
acgagttcatgtcgctgcctgagctgcagcagaatccactggtgggccgagtgatcgacatctttgacacagacggcaacggggaagtggacttccgcgagttcatcgtgggcacctcccagttcagcgtcaagggtgacgaagagcagaagctaaggttcgccttcagaatctatgacatggataatgatggcttcatctccaacggggagctcttccaggtgcttaagatgatggtgggaaacaacctcaaggactggcagctgcagcagctggtggacaaaagcatcttggtcctggataaggatggtgatggccggatatcctttgaagagttccgtgatgtggtcagaaccatggagatccacaagaaattggtcgtgtttgtagatcacggtcaagaagactaaaagcttaaaaataagagaggtgtacatctgtgcctttctttctcgaggttgtgtacatgggagaagacaacaattctcatggagtattaggaactcctttcgtttacctgtg

SEQ ID NO: 9879 - DNA, 511 bp, Rattus norvegicus
  misc_feature (343)..(343): n is a, c, g, or t
  misc_feature (381)..(381): n is a, c, g, or t
  misc_feature (405)..(405): n is a, c, g, or t
accgaatttcttcgcctgcaagatattcttcaagaggacaaagtcagcagtaccaatgatagcgacacttgccaagctgggtataccgaagaaaatgatgaggccagccacagtgacagcgacattgacgataatgtgaacgtcatcattggtgacattaaagcaaactcctccatgtatatggagatgttcactaatatgaactcacaagctgaccaagacctgaaactaactgaatcagacaatgccatgtacccaactgattaaacaagcaaggatctgaaacgtgtcaccatcatcatccttattggcctcatgcattacaaattaaatggtgatgggnaaataaaaccttgtttttaaagaaaatgacatcatctntacacaccaacctaaaagcaaatntataccaaactgctacaacaaatggagagtacttaatttgagacctgactgttttgaacgttggaaatcctaacattctaaggtcatctacaagccaactagtgga

SEQ ID NO: 9880 - DNA, 543 bp, Rattus norvegicus
agaacgtgctagtcatttgccaccaggctgtgatgcgttgcctcctggcctacttccttgacaaggcagcagaagagctgccctacctcaaatgccccttgcacacagtcctgaagctcacacctgtggcttacggttgtaaagtggagtccatattcctgaatgtggcagctgtgaacacacaccgagacagacctcagaatgtagacatatccaggccttcagaggaagcccttgtcacagttcctgctcaccaatgacccatggcaggccctgacctctgcggaggggtcactccaggccacttcttcctgtttgctgtatgaacggtcaccatgcaggaacactcatgggtggctggtaacactcagaaccctcagcctaacccacctgcctccttggtgacaaccagtgacggggttgagtgtggctgctgacctgctgctgagaatctctgggctacgtgctctgctgctggcccctttgctacagctctcaagcagtccgccccccgggctggctgctttgtgacatttgcaacat

SEQ ID NO: 9881 - DNA, 498 bp, Rattus norvegicus
  misc_feature (244)..(244): n is a, c, g, or t
cagagacccatggtggtggacatatgtattcgggaaattgaagcaagaggattaaaatcagaagggctttacagagtctctgggttcacagaacacattgaagatgtcaagatggcgttcgacagagatggtgaaaaggcggatatctctgctaacatctacccagacataaacatcatcaccggagccctgaaactgtacttcagagacttacccatccccatcatcacatatgacacctatnccaagtttatagaggcagcaaaaatctccaatgcagatgagaggcttgaagctgtccatgaggtcctgatgctgctgcctcctgcccactatgagaccctgcgctacctgatgatccatctcaaaaaggttaccatgaatgaaaaggacaatttaatgaacgcagaaaatctggggatcgtgtttgggcccaccctgatgagaccccctgaagacagcaccctcaccaccctccatgacatgcggtaccaaaag

SEQ ID NO: 9882 - DNA, 499 bp, Rattus norvegicus
  misc_feature (97)..(97): n is a, c, g, or t
agaaatatgctctcggaggccacgccgcaccttccagacggtcatcgaagatgaagaccttttttcaggagattatttattcactggtcccatgacncattccagaagaggttcttccaacttctttacagtcacccccattatagacacagggttttctacttttgtgtcccaagaatccaaatcgagtcccgatgactctgaagcctttgtgccgtatataagccatggaatgggaaagttcagactggtcaccacttgtagccagataatgaatggtaagagagttgtcacaaagagagttgtagagaacattcaaggaccaaagaaaatagagaacgaacggctatttcgttggaatccctcacgtggttggaaattgatggaaaatccctgctcttgatgacgagaaatgacgtgttgacgggacttcagttaaaactggggcctgctctgaaaatctatgagtatcatgtaaaacctcttcagaccaagcatt

SEQ ID NO: 9883 - DNA, 539 bp, Rattus norvegicus
gataagcctccatttgtgattagacatgttgatcccccaagtcccagggctgacaatttttttggatcacctggcagagactgtgaacgagatggatgggtcaggatgcacagtgatcatcctcatcttggctgctgcagagccaaggactacaaggttatcaggtcaccacatgggagagacttcgaggatccctttgaaagatgtgaggactatttgagcccaaggacatgcagcaagccccagcattcagcaaggaccttactagtccattcagcaccttcaacaactccaaagcattgtgcaagccctgtgctaaacagagcctctctcagggaaagattccattctgattggtgttcacctccaaactgtgatgagatccatgaccgggtaaaagatgtcttgaaatcacatcaagctcatggaagacatttatgtgaagagcgagacccagagaaagaagacgaactggaactgaaaagaagtcttttatatagagactccgcctatgacagtgaccctgaatatagctcctt

SEQ ID NO: 9884 - DNA, 462 bp, Rattus norvegicus
  misc_feature (427)..(427): n is a, c, g, or t
gaacccagcatatttcttcaaatggtaacttatcacagccaagcctttattacagaagaatgtgctgcttccaatgtcaaaactctacaatatagtcacaacttccagtttgtgacaaggctatcctgccacgatcctgtcaccattgacaaactgaagaataggttctttctagaatgttcttccactattactctcttaactttccacctgcttggctaattatcttatctgggtaatatttaatatcagcttcctgttcttagtaatgagcaaaacaacattctctgcagaaacaaattttaagaatttgaacctgtgctaacaaatattatctactttttcaccttagaagaggctattgtatttcttaggtcctaaaaaccagttttctttgtaaagctcacatatgcactcactccttctntagaaaaccagttgagttaccgcaacaactatgta

SEQ ID NO: 9885 - DNA, 410 bp, Rattus norvegicus
agatatccattaacgacccttgcacccagggacatgacatacatgtgaccagagatttggtgaagcaccgtctctcaaagtgtgacatgttaacggacccgaatcaagaagtcctggaggaaagaacaaggatccagtttataagatggagccacacccgtatcttccaagtgccaagtgaaatgatggatgacgtcattcaggagcgaatagatcaagtgagacggagcgtctctcatctcaggtgtgactcctccagtgatccatgctacagaaattcttgctcagaatgctaaggttgaaggcctccagagtcgatgaatagcctgtgtccaatgagtgtccatctcatgtttgacctgaagggtgaccagacttgaacagagagactctaaattctgagcccttgg

SEQ ID NO: 9886 - DNA, 467 bp, Rattus norvegicus
tttccaacaagctcgcggcgtcgaagccgccctacccacagcgccctctctcggcgtaggctttccagccgtctactcacagtaccaggtatcacttataacacagaggcacggcttctggtataccaatgagccaagtggagtttgaaatggcctgcgcttcactcaagcagctgaagggtcctttgagtgatcaggagaaactgctggtgtacagcttctacaaacaggccacccagggcgactgtaacatccctgtccctcctgccacagatgtgaaagcaaaggccaaatgggaggcatggatggtaaacaaagggatgtccaagatggatgccatgaggatctacattgccaaagtggaagagctgaagaaaaacgaaacttgctaaagaacattttggcagacacaaggaagtagcatggctccactggtaggggatgggcttaagagttcctgacggctg

SEQ ID NO: 9887 - DNA, 446 bp, Rattus norvegicus
actggtctccagtgaaaacttcgagaattacgtgagggaactgggagtggaatgtgaaccccggaaagttgcatgtttaataaagccaagtgttagcattagtttcaatggggaaaggatggacatccaagcaggaagtgcatgcaggaacacggagatctccttcaaattgggggaagagtttgaagagaccactgcagacaaccggaaagtgaagagccttataacttttgaaggtgggtcaatgatccagatccaaagatggcttggcaaacagacaacaattaaaagaagaattgtggatggaagaatggtagtggagtgcaccatgaacaatgttgtcagcactaggacctacgaaagggtgtagcagatgggtagacgccagtaagaacttggccaccacagagaacttgctgctgaagaaactcagctccagggacagt

SEQ ID NO: 9888 - DNA, 512 bp, Rattus norvegicus
  misc_feature (454)..(454): n is a, c, g, or t
gtgcgcaagcctgactatgcattgagctctgtgggagcctccatcgacctggagaagacatccagtgactacgaggaccggaatactgcctacttctggaaccgattaagcttctggaactacgcccgcccaccctctgtcatattggagccagatgtgttccctggaaattgctgggcttttgaaggtgagcaaggccaggtggtgatccgactgccaggtcatgtgcagttaagcgacatcaccctgcagcaccctccacccactgtggcacacaccggaggagccagcagtgcgccccgggacttcgcagtctttgggctccaagctgatgatgacgagactgaagtgttcttgggaaaattcatctttgaagtgcagaaatctgaaattcagactttccacctccagaatgaccctccatctgccttccccaaggtgaagattcagattntaagcaactggggccacccacgcttcacatgcttatatcgagtccgtgcccatggtgt

SEQ ID NO: 9889 - DNA, 525 bp, Rattus norvegicus
agacgcgtcggaatgccaagtggctgacagtggagatgatgcaggatggccaccaggtgtccctgctaagtggagaactcacggtggagcagcgggcttccatcattcagaggttccgagatggcaaagagaaggttctcataacaaccaatgtctgtgctcgaggaatcgatgtgaagcaggtcaccatcgttgtgaactttgacctccctgtaaaccagtcagaagagccagactatgagacctacctccaccgtatagggcggacgggacgctttgggaaaaaaggtctcgccttcaacatgattgaagtggataagctgcccctgctcatgaaaatacaagaccacttcaatagcagtattaagcagctggacccagaagacatggatgagattgaaaagatcgaatattgaagagagagaggcctttgttgtttgtgggctgtcctagttgatgtgagaatgtttgagcagagtttgaagataatggtctatgttgaggctctgtcacgtgaaactgtca

SEQ ID NO: 9890 - DNA, 527 bp, Rattus norvegicus
agaggccacttgattgctccaaggtcctatcaccatatttgtgacatagttatgcccagacctcagacctctcttgctcagtctagcgctacaaagctctgcaagaggctggtcagcatagataaaggccaccaggaagcacggttataaacctggtctcacacctattagcaccatggttgagaaaggacattggactgagattctgaaatggtgctaatagctatgtaactcgaaaatgaaaatgttcctctctgcctgtgtttctttgagtatccagtcaatgatcagaacaagtagcccattcagtgatctgtgaaattgttacacaagggttggctactctatgctagccatggttgatgtaagaactcagtttaatagcatacttgagcaatcagggtaaaagtgttccaccatgaacaaaggtatcaaatcacaaacctggctgactgcagttggatgttagaggtctgttgtaaatagtagaacatagattgcagactgacttgttgatttctactttg

SEQ ID NO: 9891 - DNA, 521 bp, Rattus norvegicus
tgcaccgtgtttccagattcgatgtgatccttctggctctggcttgggcaagcagatgacccgactcagccttatggaagaagatgaggaagaagagctgagacttctggatgaagaatggcaatgtggagacaagctacttcatagcccttcttctcccagtgagcatgggctggacctattagatacaacagagctgaacatggaggatttctgatgggacttaggcttctccccttctccacttaccacactgcaaggccatgagtgagcaaacgaaggagtaaaatgaagcattctttgggtcccagccaagtactttaagggaatagagaaatggccttattcaaacctccatttctttctgaagtgggtgctgtatatagatgctatgagccctgtgatccttaattcaccctagctttatgcttttgcctgtttgaagtggtgggagttgggtagggagctttacctcagtattgaagtttaataaaccttctgtttgatatctcttccccaaa

SEQ ID NO: 9892 - DNA, 459 bp, Rattus norvegicus
tgaaactgactcaacaacatctgttggcaatggcctgtcaagctcggggacacagggatgaaaatattgacaaattccaagtcactctcctagatgagctggaaaaagttgaaaaagactcacagactttacgagacttggagaaagagtttgtggacatcgaagaaaagatagttcacaagatgagggcatttcaccaaagtgagcgagaaaggtttcgtgctttgaaaacttcattggataaaagtttgcttgtctataattctgtttatgaagagaatgttcttacatctgagatgtgtttgatgaaagcaaacatgaaaatgctacaagacaagctactgaaggagatgcatgaagaggaacttctcaacatacgcagaggactggagtcattattcaaggatcatgaaggaaacaatgcatgaaatctggctgctgtcaacacactttatctga

SEQ ID NO: 9893 - DNA, 534 bp, Rattus norvegicus
  misc_feature (149)..(149): n is a, c, g, or t
atcgctccgcagcttagagagactcagaaggacgacaaatagaattctggcctcctcttgctgcagcagtaacattttaggatcggtgaacgtctgcggctttgaacctgatcaggtcaaagtgcgcgttaaagatggaaaggtctgcntatcggccgagagggaaaacaggtacgactgcctcggatccaaaaagtacagttacatgaacatctgcaaagagttcagtctgccgccgtgcgtggatgagaaagacgtgacctactcctacgggctcggcagttgtgtcaagatcgagtctccatgctacccttgcacgtctccctgcaacccctgcaacccctgcagcccctgcagcccctgcggcccctgcggtccttgcggtccctgtggcccctgtggtccctgcggcccctgcgacccttgcaacccctgctatccctgtggaagccgattctcctgtaggaagatgatcttgtaaggtgtatgataagaactatgtcttagcagaagtcagtattccaaccaggcagc

SEQ ID NO: 9894 - DNA, 413 bp, Rattus norvegicus
  misc_feature (70)..(70): n is a, c, g, or t
  misc_feature (214)..(214): n is a, c, g, or t
agactgcaccggcaaactgctgagtattctgccttcaagctagagaacgagaggctcaaggctagctttncccctatggaggacaagctcaatcaggctcacttggaggtccagcaactgaaggcatcagtgaagaactacgaggggatgatcgacaactacaagagccaggtgatgaaaacaagattggaggctgacgaagtggctgcgcagntagagcgctgcgacaaagagaacaagatgcttaaagacgagatgaacaaagaaatcgaggcggcccgtcggcagttccagtcacagctggctgacctacaacagctgcctgacatcctcaagatcacggaggccaagctggctgagtgtcaagaccagctgcagggctacgagaggaagaacatcgacctcacagccat

SEQ ID NO: 9895 - DNA, 506 bp, Rattus norvegicus
atgttgcacaccaaaggtctgtccctgtccgactccctgtccctgtccagccacctgtccagctgcctgtgcttgtccttgtccgatgaaaccatgctgcccaacgaagtgtacatgctgccctaaaaagtgcacctgctgcccacagcccacctgctgtgttcaacccacctgctgctcttctgaaaacaagactgagtcagattctgatgggtctggtcaaactcaggataggggtgctcaaacacagcagtcccctcaaggtggtcaaggcaattggaaccagaagaagaccaagtaaactgtccctgacaccatgctcatcctcaaatggtgtgggggattactacaggcaaggttaagactatgttgtagcgatgctgttttcatgataaccaacaagaccactcaaccataagctaccatttcgacctaaccataggctactattgcaactggaaatggaaagtagaaaaggatagaaacatcttgtctagtgatcctga

SEQ ID NO: 9896 - DNA, 532 bp, Rattus norvegicus
  misc_feature (136)..(136): n is a, c, g, or t
  misc_feature (476)..(476): n is a, c, g, or t
tcagtgaccacagtttgagcccaggggccccctgactcctcagatctccgggccagctttgtccagatctcaacccagatccacacccatgagcttcaccagattctgaggctctgcagcctgcttgcacacacancacatctgcggagccatgcagtctcgccctaacccacgggtctccttccctaagaactaaagcaacctggacgagaactgcgggctcctggctctagtgctctggctgggcatctttggggtgcttggtcctaagcaactggcccataacctcacttgactgggggatgagaaagggacttagccacataagatttgggctcagaaacaaggtcaggtgagtccaggaagaaaagagaatgttcttgtcttgtcaaccaagtccttctcagagtgcccagagacctccggattcaccttggggttagccagcttacccatcacttacaggttctctccanctcttccctggtctcagtgtcctggatcattagtcaccaggtcttgttgagtttca

SEQ ID NO: 9897 - DNA, 581 bp, Rattus norvegicus
aactcgatggcgctgaagaccctggtggaccagatcctgtcccagacagctaatgacctgcgcagacagtgcgaagtggtagacacggcattcgtcaatgggctgaaggagaccaaggacgccaggaacaagctggctgatcatctggccaaggttatggacgaaattgcttcccaggaaaaaaacatcgaggtccttgaaaatgccatcactcagcaagaaggaccggctaaggtagcacacacacgcctggagaacaggacctaccggcctaacgtggagctgtgtcgagatgtcgctcagtatcggctgatcagggaggttcaggagatcaagcataatgttgccaggttagaggagaccttggcccaggctcagatacagttgaaggctctgttccgcaggcagctggccctgcaggaggagatccaggttaaggagaacaccatctatatcgaccaggtgctgtgtatggagatgaggaagtccatcccacctcgagacggcgacgaccatggggcctgggaggggggcatccgcgcagaggccatctgctgatacgagccattcagatccttatt

SEQ ID NO: 9898 - DNA, 499 bp, Rattus norvegicus
tcaggccgtatacatcgacagctacaatagcagaggtttcactatcaacggaaaccgcgtgtttggaccttgtgcgctgctcccacagaccgtggtccagtggaacgtgagccctcccctacactgcaatttataacaggtgggatctcatcaggatatcactgaagagagcttctcgattttctggatgctggaacctaggataggtatggggcagagggagcactgggtcctattagagattgttgtggtgggcaccggaaacaagactgagcggctgcactctcaagtcctgcaggccatgaggcagcggggaattgcggtggagatacaggacacgcctaacgcctgtgccaccttcaacttcctgtgccacgaaggtcgagtgacaggagctgccctcatccccccacctggagagactgcacttgcctcttctggtcaaaccacagagtgaaccatccagaacagtcaaggagggcactgagcttcgtgatct

SEQ ID NO: 9899 - DNA, 443 bp, Rattus norvegicus
aagtctccgggaaatggccgagcgcttagctgacaaatatgaagaagccaaagaaaaacaagaagatatcatgaacaggatgaaaaaagtgcttcacagttttcacactcagctcccagtcctctcggacagtgagagagacatgaagaaagagctacagctgatacctgaccaacttcgacatctaggcaatgccatcaaacaggttactatgaaaaaagattatcaacagcgaaagatggaaaaagtgctgagtcctcagaaacccaccattactctcagtgcctaccagcgaaagtgcattcagtccatcctgaaagaagagggtgaacacatacgagaaatggtgaagcaaatcaatgatatccgaaatcatgtcaacttctgacaccacctgaagttaaggacagctgaaggcttacaagcccgtgctgcagaacaag

SEQ ID NO: 9900 - DNA, 550 bp, Rattus norvegicus
gccatggctgaccagctgaccgaagaacagattgcagagttcaaggaagccttctccctctttgacaaggatggagatggcaccattaccaccaaggagctggggactgtgatgagatcgctggggcaaaaccccactgaggcggaactgcaggacatgatcaatgaggtggatgctgatggcaatgggaccattgacttcccagagttcctgaccatgatggccagaaagatgaaggatacagacagcgaggaggagatacgagaggccttccgtgtctttgacaaggatgggaatggctacatcagtgctgctgagctgcgtcacgtcatgacgaacctgggggagaagctgactgatgaggaagtggatgagatgatccgagaggcggacattgatggagacggccaggtcaattatgaagagtttgtacagatgatgactgcgaagtgaaggcccgggcagctggccatgcccgttctcctgatctcttcttgcgctctcctctcttcaacactcccctgcgtacccggttctagcaaacgccaat

SEQ ID NO: 9901 - DNA, 511 bp, Rattus norvegicus
  misc_feature (46)..(46): n is a, c, g, or t
  misc_feature (49)..(49): n is a, c, g, or t
  misc_feature (64)..(64): n is a, c, g, or t
agctcacttccggagagacgagtttctgggaaggatcaatgagatngtntacttcctccctttntgccactcggagctcatccagctggtcaacaaggaactgaacttctgggccaagagagccaagcagagacacaacatcacactactgtgggaccgcgaggtggcagacgtgttggttgatggctacaacgtccactatggtgcccgctccattaagcatgaggtagagcgccgtgtggtaaaccagctggcggcagcctatgagcaggacctgctaccagggggctgcaccctgcgtatcactgtggaggactcagacaagcagctcctcaagagccctgagctgccctcgccccaggctgaaaagcgtccgcctacactgcgactggagatcattgataaggacagcaagacccacaaactggacatccaggcaccactccaccccgagaaggtgtgctacaccatctagcatccacctgcctgtctgtgccctgaacatctaata

SEQ ID NO: 9902 - DNA, 554 bp, Rattus norvegicus
gaaggtggctcagcgggcactaaaactccccagcactggggaagggacccagttctacctgttcgagcatgtggacaatgcccagcaattcaagcagttctaccgcgccaggatgaatgccttggacctgagtatgaagaccaaagagaggattgtggaggaggccaacaaagcctttgaatataatatgcagatattcagtgaactggaccaggctggctccatgctaacaaaagaaaccctggaggatgggctcccagtacatgatgggaaaggagatgtacgtaaatgccccttttatgctgctcagccagacaaaggtaccctgggaggcagcaactgccccttccggacagccatggctgtgctgaggaagcctagcctgcagctcattctggctgccagtgtggccttggtagctggactcttggcctggtactacatgtgaaggacctgtcatgttgtttgcatcctatcccaagtgacctcttccatccccatctccacctctgcccaaaactaccacctcaggtgacttttctaatgctgggttt

SEQ ID NO: 9903 - DNA, 530 bp, Rattus norvegicus
atttatgcaactcctggcacaggctttgaagcggaagccagatttgttccagtgtgagcgattggatgtcaaagctgtgttccagtgtgctgtgctggccctcaagttccctgaggcacctactgtcaaggcctcctgtggcttctttactgagctgctgcctcgatgtggggaaatagaatctgtggggaaagtggtacaggaagatggccgtatgctgctcatagcagtgctggaggccatcgggggccaggcctcccgtagcctcatggactgttttgctgacatcctgttcgccctgaacaaacactgcttcagcctcctaagcatgtggatcaaggaggctctacagccacctggctttccatctgcccgtctcagccctgagcagaaggacaccttcagccagcagatacttcgtgagcgagtgaacaagagacgggtgaaggagatggtgaaggaatttacactgctgtgccgggggctacatggcacagactacacagctgactactgagggacacgtgtgt

SEQ ID NO: 9904 - DNA, 545 bp, Rattus norvegicus
  misc_feature (202)..(202): n is a, c, g, or t
tgtggacaatactggctgctggacgagtagccttaagcagtcaccgtttacggccactaactaagaatgcactcttgagagacccctatgcactgcggccagtacggcgcctcattgacaactgtgccttccggctctatggacactgggtgaagaagggggagcagcagaaccgggcggccctcttccagcaccagcctcntaggcctttccccatcattgccactgacctggaaggagactccagtgctatcacagaggatgaagttaccttggtacggagctaggaccttctccctgggcaagccacgaagtaggactccccaggaggagattttctttttctatcattccaaccacttgggactcagatcttagccctgccttgccaagtctacaactgagaatgctgcttgtcacagaaaccagccctttacccctacctacctactctggacttggagatcggggcggagatggaagggaacctcttcccagcattgtgcctggccttgccatcaccgcctgtgctgcatctgaaataa

SEQ ID NO: 9905 - DNA, 490 bp, Rattus norvegicus
atgtgtttgggcaacgtcatcccctggcaggctaaagtgagggggaacaaaagatatcctctggtgagattggaggtagcatgccgaagtaaaagacactgacctcactgtttattaacctgtcttctgtttagatttccttaagacagtggctcttacagtgtgcgctgggctttgaaatgccggaaatgcccagagaaacatggggtttggatttgccgtgttgagaaaatagcacccgatagaattgaaacggatggtggtaatttgtgatttttctagagacttttcattttttaacaccctatttctttgaaggtggatttctagctatatatcgcatgtctgaatatgtctggctgttttgtggcactcactgtgtttgaaaggaatgtgtctagtccacttgggaccatgcaaagttattttatttttgaactctgtctcttcattcccattttaaagtaagtgttgacttcctaattcccct

SEQ ID NO: 9906 - DNA, 506 bp, Rattus norvegicus
atggagaattctggttgggcctagagaagatctacgctatagtcaaacagtctaactacatcttacgactggagctacaagactggaaggacagcaagcactatgctgaatattcctttcatctgggcaatcatgaaaccaactacacgctacatgtggctgagattgctgccaatatccctgaggccctaccagaacacagagacctgatgttttctacatggatcacagagcaaaggacagctctactgtccagaaagttattcaggtggctggtggttcagtgacatgtgtggagaaaacaacctaaatggtaaatacaacaaacccagagccaaatccaaaccagagcggagaagaggaatctcctggaggcctcggggcggaaagctctactctatcaaatcatctaaaatgatgctccagcagaccacctaaggaagcgtcagctgaactgagacaaattaaaagaccaacacattcaatattaaaatccgcccgcacac

SEQ ID NO: 9907 - DNA, 248 bp, Rattus norvegicus
  misc_feature (81)..(81): n is a, c, g, or t
  misc_feature (121)..(121): n is a, c, g, or t
  misc_feature (193)..(193): n is a, c, g, or t
  misc_feature (216)..(216): n is a, c, g, or t
gattacaactgtatctatttttaattcatctgaaatacagtacatttgtttatattagatcacttccaaagggtgagaganttcttcaaaaataatatatttttaatatcaatagaagaantcaaatggcccaaagagaaacaagtttttgagaaattatcacttaaaaaatgtgatcaacatgaaccatttntgttcaatactgttcaatattgntaacaatgctgttctctggaaaatattttatt

SEQ ID NO: 9908 - DNA, 213 bp, Rattus norvegicus
gtttgacatgaccatctcgagctgtaaccatcccaattgcctcagaataagtcaagttcttctacttagtttcccagcagattataagtggataaactgtgagagtggcccttagggctttgggacatgtctagttctgatagtcacttatgacaacctggatacattcaactaggatgaaatccattctgccttagcccattaatatgcctg

SEQ ID NO: 9909 - DNA, 213 bp, Rattus norvegicus
gatttatccagatcgttgcttcagttctccactccgtgccctgccgacactagccttggaagattccaaagctcccaccgagttactcgactcttttccgtttactaggagagagttgggggactggcagtgactgtaaaaggcactgaaaggcggggacggggactttcgttccactgtggtctttcatttcccacttcatttgattcacct

SEQ ID NO: 9910 - DNA, 287 bp, Rattus norvegicus
atgtccccacccaagatcaggaagtcatattgctttgggtctctggcaacagtgccaaatggcagtggcagggcacacatggcagaacaaactgcttacactgtgaggcaggaagaaagaaaagacgcttggacccaagtgctacaatccctcaagggcatgttccaataacctaaaggcctttcccccagctctactgctaaaggattccatcaccctttgaataagcctttagcccaatcaggagccataccagaggtcaaaactggctttctggcattttggtc

SEQ ID NO: 9911 - DNA, 508 bp, Rattus norvegicus
  misc_feature (213)..(213): n is a, c, g, or t
  misc_feature (338)..(338): n is a, c, g, or t
aaggcacattcaaggcttcctgtctgtttgggcagatccccaagttccaggatggaaagctcactctgtaccaatcgaatgccatcctacggcacctgggccactccttcgggctctacggcaaagaccagcaagaggcagcactggtggacatggtgaacgacggactggaagacgtgttcaggcgcattgcatggcactatctccatatcngtaaggaggacaagggccaatataggaaggagcttccaggacacctgaagccatttgaaactcttctggcccagaacaagggtggccaatgcttcattgttggtgaccagatctccttcgccgantaccgcctactggatttacttctgaacctagagctcctgttccctggttacttgaaagacttccccctgctctccgcctatgtagcgcgtctcaaagcccgacccaagctcaaggccttcctggagtctcctgagcatgtgaaccgtctccttgctgcttgcataaagat

SEQ ID NO: 9912 - DNA, 274 bp, Rattus norvegicus
tgcccctgcagaaagtttaccctggcatacagtcgcatgtacacattgaaaactgtgactccagtgatcccacggcatacctgtaagcagagacagaggccagatcttctcaaattcccagaaactggaacacgtcctgctcctgaagaaacgtgcattctaacagacgtgccatcagtgtggacacaattctgattccgactcagcgtcactctgatgggcgggctctgatctgcctgctgcctggagggccagggagttttatgtttccgat

SEQ ID NO: 9913 - DNA, 401 bp, Rattus norvegicus
  misc_feature (56)..(56): n is a, c, g, or t
  misc_feature (67)..(67): n is a, c, g, or t
  misc_feature (73)..(73): n is a, c, g, or t
  misc_feature (82)..(82): n is a, c, g, or t
  misc_feature (277)..(277): n is a, c, g, or t
  misc_feature (287)..(287): n is a, c, g, or t
  misc_feature (314)..(314): n is a, c, g, or t
  misc_feature (343)..(343): n is a, c, g, or t
gaagccttcagaaacagagggcaactgtataaatgaaaaagaggaggatcttgggntactgggaatnaattanttgacatcnacatatgtagcatccaagtgattgctgagggagaacaagtcaagagagtgcagtcttcacatgttatatatacatcaggggcagcaagtgcagggtctatctgatctggatggacttttaacagatcagcagggaggagacttttgaagaggaaatccatcttgatacaaagccagatggtgagacagaacatgngggaccgggnactcgcaggtgaatgtgttggacattngggactgggaaaaacagtaacaaagtcanggtgtgtaagacccacctcagtgcctgccacatggcaaatcattaccatcattgttgt

SEQ ID NO: 9914 - DNA, 444 bp, Rattus norvegicus
  misc_feature (89)..(89): n is a, c, g, or t
  misc_feature (113)..(113): n is a, c, g, or t
  misc_feature (158)..(158): n is a, c, g, or t
  misc_feature (339)..(339): n is a, c, g, or t
gtttcagccagttttgaacctcgaaccagctgagctttctagaaacacttcaacggtttatcttcggctttctccagtgccaaccaccntaagtcgtctctcacagcaggccncaggatgcaagagtaaatggcgaactgaattgcccagttctggtnttctgctccccagtgaactgtgttatcataattaacattgttatgctgaattttctagaggggtgctgaccacctgacccatttttcatctgtgatttgatgaactggcattttaatacttttctggatctttgtatgaacttgtttggaattgacccagtcacctcacacttaatgatgnataaatcgtttgaaccccttgtcactgtcacctgtccccaccatacaatatcctactttattactgctgactctattaatgttccactacttactgcctcttttg

SEQ ID NO: 9915 - DNA, 458 bp, Rattus norvegicus
  misc_feature (393)..(393): n is a, c, g, or t
  misc_feature (416)..(416): n is a, c, g, or t
aagttctaactactcttggcccatgttacctaagaagtggctatcatatcaccatttcttggctttattctaaaggaaagtcttttgatctaaacgaaagtctacttcgtgctccagaaggggagcaagacacaacatcactgagcaggaataaatgtattaatttactcacaaagcaaacacattcttttaggggaggtcatctggtttgtaggaccagaaggtactgatgaagagggagagtccagtccagagggaataactgccatgccaaagccaggtccctaggtggaagaccaaccccaaaggagtagaaacattgcttcctcaaagaaacagaagtggggaggaggaaggagcccatgggatcgaggatgaggaacttggggattnaacctgctcttgtcacgtgttgntacttttagagtttggcatactttgctatcttggcctacctg

SEQ ID NO: 9916 - DNA, 533 bp, Rattus norvegicus
  misc_feature (146)..(147): n is a, c, g, or t
  misc_feature (286)..(286): n is a, c, g, or t
acagttacgtgcacagcccatggaaactggacccaattgccagaatgccgggaagtaaaatgtcccttcccttcaaggccagacaatgggtttgtgaattaccctgcaaagccggtgctttcttataaagataaagccgtatttgnntgccatgaaacatacaaactggatggcccggaagaagtggagtgtaccaagacaggaaattggtcggccctgccgagctgtaaagcatcttgcaaactctctgttaagaaggccaccgtgttgtaccaagggcagaggntgaagatccaggaccagtttaagaatgggatgatgcatggtgacaaggttcacttctattgtaaaaataaggagaagaagtgcagctacaccgaggaggctcagtgcatagacggcaccatcgagatccccaaatgcttcaaggagcacagttctctggctttctggaaaacggatgcatcagatgtgacaccgtgctgaagacattttcagaatcaaaattgaatgtctcatttgtatctctgctt

SEQ ID NO: 9917 - DNA, 490 bp, Rattus norvegicus
  misc_feature (123)..(123): n is a, c, g, or t
  misc_feature (350)..(353): n is a, c, g, or t
  misc_feature (356)..(357): n is a, c, g, or t
  misc_feature (359)..(360): n is a, c, g, or t
  misc_feature (363)..(363): n is a, c, g, or t
  misc_feature (423)..(423): n is a, c, g, or t
gagttcagaggataccacattcccaagggcacaagcgtaatggcatgtctgacttctgccctgcacgatgacaaagaatttcccaacccagagaagttcgaccctggccactttctcgatganaaaggcaacttcaagaagagtgactacttcatggctttctcagcaggaagaagagcctgtattggagaaggtttagcccgcatggagatgttcttaatcctgaccagcattttacagcattttactttaaaacctcttgtcaatccagaggacatcgacacaaccccagttcaacctggtttattgtctgtgcccccaccctttgagctctgtttcattccagtctnnnncgnnanngtntttcacacagatgactgagaccctgcttctacttgtgagcaaacaggtcctcctgtcctngtgtacctgtaactggcagtccttcctgaatggcagggatgctacctctgaactgtcctacattttt

SEQ ID NO: 9918 - DNA, 568 bp, Rattus norvegicus
  misc_feature (188)..(188): n is a, c, g, or t
agctgcccaagaatacgcctgaagagagggacaggcgcacatgtgctctgcaagaggggctgagacaggcggtcgctgtgccactgaaactggctgagacggtgtcccagctatggccggcgctgcaggagctggcccaatgtggcaacctctcttgcttgtctgacctgcaggtggcagccaaagcnttggagacaggtgtgtttggtgcgtacttcaatgtgctcatcaacctgaaggacatgacggatgatgtatttaaagagaagacacgccatcgaatctccagccttctgcaggaagccaagacccaggctgcgctggtgctgggtagcctagaagctcggaaggagtgaagagatcgctcctcagtgaatggtccaacttccagaattccttacctatcttgcttggggagaagactcagccatgatatcagcagggtcaggttggggctctatagacagctgtaggatcagaagacccaacagaggtggtttggggtagggtatggtagggcctgattgggggtggtatcccgacactctctgttatctgtggcttctag

SEQ ID NO: 9919 - DNA, 542 bp, Rattus norvegicus
  misc_feature (363)..(363): n is a, c, g, or t
  misc_feature (458)..(458): n is a, c, g, or t
  misc_feature (460)..(460): n is a, c, g, or t
atctgtgccacctgggagtctgctacaggaattgtagagctttggcttgacgggaaacccagggtgcggaaaagtctgcagaagggctacattgtggggacaaatgcaagcatcatcttggggcaggagcaggactcgtatggcggtggctttgacgcgaatcagtctttggtgggagacattggagatgtgaacatgtgggactttgtgctatctccagaacagatcaatgcagtctatgttggtagggtattcagccccaatgttttgaactggcgggcactgaagtatgaaacacacggtgatgtgtttatcaagccgcagctgtggcccttgactgactgttgtgagtcctgaggcacntcctgggattacattctctcccttgtccctccttatgaaccttttaaccccagcagatgttgtagatctgttttgtgaatatggcctttcacttntntgctctgtggtcctcagcactagagcatggaatttaaatgtaaggcttccagcatgtgcatcccactactctttatcaaaga

SEQ ID NO: 9920 - DNA, 521 bp, Rattus norvegicus
  misc_feature (368)..(368): n is a, c, g, or t
cagctcggctgaaggcttacttgatgagccacgccctggcctaccacacccctgactgtggcaaacagggatttattgatctcccagaattcccctttggattggaacccagagttgccaccagatgggatattcaaaaatacgccagagaggcctacaacctgggggtcaggtacattggcggctgctgcggatttgagccctaccacatcagggccattgcagaggagctcgccccagaaaggggatttttaccaccagcttcagaaaaacatggcagctggggaagtggtttggacatgcacaccaaaccctggatcagggcaagggccaggaaagaatactggcagaatcttcgaatagcttcnggcagaccgtacaatccttcgatgtccaagccggatgcttggggagtgacgaaaggggcagcagagctgatgcagcagaaggaagccaccactgagcagcagctgagagcgctcttcgaaaaacaaaaattcaaatccgcacagtagccacag

SEQ ID NO: 9921 - DNA, 458 bp, Rattus norvegicus
  misc_feature (26)..(26): n is a, c, g, or t
  misc_feature (109)..(109): n is a, c, g, or t
  misc_feature (285)..(285): n is a, c, g, or t
  misc_feature (407)..(407): n is a, c, g, or t
  misc_feature (430)..(430): n is a, c, g, or t
gggcaggtcacctgattgagcctccntactccccactgtgctcagcctcaaggatgccctttgtaatcccaagcatcaactggggaggagaggttatcccacacgcagntgcgcaggaacattcttggaaggagatacagaaatttctcaagcagcatcttaatccaggtttcaacagtcagctgtgagtggacttgattatattactggaaagaggagctgggcatctcctggccagctccactcctcacttccatagaggaatgtctttaatctcttatcacntgaggaagaagagtaccaccagaaaatgccgaaggacagagagtgataacctcatgactttggaaggggagacatgttttccatggaataaaatgtccctcagtgagagtcctatatctgtntaaataaaatcttagggttttcntaaaatgttcaacaccacagcaactttc

SEQ ID NO: 9922 - DNA, 304 bp, Rattus norvegicus
  misc_feature (83)..(83): n is a, c, g, or t
  misc_feature (89)..(89): n is a, c, g, or t
  misc_feature (136)..(136): n is a, c, g, or t
  misc_feature (210)..(210): n is a, c, g, or t
  misc_feature (224)..(224): n is a, c, g, or t
  misc_feature (230)..(230): n is a, c, g, or t
  misc_feature (232)..(232): n is a, c, g, or t
  misc_feature (258)..(258): n is a, c, g, or t
  misc_feature (266)..(266): n is a, c, g, or t
tcggtcaaagcctcaactgcaatgctaacgtgtacatgagaccttgggagaacaaagtcgtcccgactgtcagatgccaagcnctaganatgatgatttctaggcctccaggattttcacctttccggctggtgcnagtacaagaaactaaagaaggaacaactaggctcctaaactcatgtgagtacaagggcagactctcaaaggcangggcaggcccagcncctgancntcaggcagaagcttcaaccgtgacancatagccnggcaaagacccggagtggaaggaccagaagactcctgg

SEQ ID NO: 9923 - DNA, 533 bp, Rattus norvegicus
  misc_feature (40)..(40): n is a, c, g, or t
  misc_feature (44)..(44): n is a, c, g, or t
  misc_feature (55)..(55): n is a, c, g, or t
  misc_feature (100)..(100): n is a, c, g, or t
  misc_feature (139)..(139): n is a, c, g, or t
  misc_feature (181)..(181): n is a, c, g, or t
  misc_feature (449)..(449): n is a, c, g, or t
gctacagggagtctgacactctcaagatccgtgaacactngcgntcatgagtacnaacctacacacatacacagagttaaaaagaataaaaataaatcgnaaaaaagaagcacccattaactttctttaagtagatacnggcactgatttgctggttggttgttggtggtggggaaagcangtatttatattcgatgaaaagaagccagactctggtgacctgtgtgtgtcaggtgtaaacattgtacatctgcggggggcaggaggccgcatgtcgattcttttgactttagccattctcgtaggtgtaaagtgatactgtcccccatttttattctatttctctggtgtgttacgacaatgaaaatatttcacatggtaactgataacctaaataccttttgtgagcgacctgttcaaaccttttgtagtttgtttaacatcgaccngaacttttcatattgacaggaatctttgcattcagaatacaaatggctactgtccacgtgcactatacgcaccttttcagggtt

SEQ ID NO: 9924 - DNA, 386 bp, Rattus norvegicus
  misc_feature (68)..(68): n is a, c, g, or t
agatggacactgtcatcgctgcacttagtcgggacacaattgataggtggggcaagcttatgaccccnaggcaggtgaacctatacatcccgaaattctccatgtctgatacctatgaccttaaagacgtgctggaagacctgaacattaaggacttgctcaccaaccaatcagatttctcaggcaacaccaaagatgttcccttgacattaacgatggtccacaaggccatgctacaactggatgaagggaatgtgttgcctaattctaccaacggggctcccctacacctgcgctctgaaccacttgacatcaagttcaacaagcccttcatcctcctgctctttgacaagttcacatggagcagcctgatgatgagccaagtg

SEQ ID NO: 9925 - DNA, 372 bp, Rattus norvegicus
gtatggcaaccatcaggatcgatcctggacgctgactgcaccccctggcttccgcctgcgcctctacttcacccacttcaacctggaactctcttaccgctgcgagtatgactttgtcaagttgacctcagggaccaaggtgctagccacgctgtgtgggcaggagagtacagatactgagcgggcacctggcaatgacaccttctactcactgggtcccagcctaaaggtcaccttccactccgactactccaatgagaagccattcacaggatttgaggccttctatgcagcggaggatgtggatgaatgcagaacatccctgggagactcagtcccttgtgaccattattgccacaactacctgggcgg

SEQ ID NO: 9926 - DNA, 464 bp, Rattus norvegicus
atctgtatgtctctcaagtggtccacaaggctgtgctggatgtggatgagacaggcacagaagcaactgctgctacaggggtcgctacagtcatacgtagacaacctcgaactctgaatttcaaccggccattcatggtggttatcactgacatggatagtcagtctatcctctttgttgccaaaatcactaaccccaagtaagcccaaagctccccaagatctgacagttctgcccaggaccctgggactgagcctgcatgtggatctctgtatatgtcctgacattcatgctctgattggctgtttcaaagttgtcttagacagtgacatcgactatctctatggcccccatgtgcacaggagcctttagactgtcagtgtcaggctcttaggccccttgggagcatctacccatgtttctgaacctggaatctatctttatttttccctagtgactcctct

SEQ ID NO: 9927 - DNA, 528 bp, Rattus norvegicus
  misc_feature (189)..(192): n is a, c, g, or t
  misc_feature (195)..(198): n is a, c, g, or t
  misc_feature (216)..(216): n is a, c, g, or t
  misc_feature (437)..(437): n is a, c, g, or t
agcatgctaattggactttaacgccattgaaggtcctcagctttgacacccttgtggataacatctctgtggatcctgtgacaggggacctctgggttggatgccatcccaatgggatgaggatttttttctatgactcggagaatcctcctggctcagaggtgcttcggatccagagcattttatccnnnnacnnnnaagtaactgtagtttatncagagaatggcacggtgttgcaaggtacgacagtcgctgctgtgtacaaaggaaaactgctgattggaacggtgttccacagagctctttgttgtgacctgtgacaagctggctacacccacatcatggaaagtgaggccatcatttcagccctttgccatattgtaaggtgcctatcacagtgatctccgctcaccaacgaatgttgaccttaatctcanacataagaaggtctgagaatgtttcctggcaatagatcctaactagcaaagatttcttgagtgttagtttcagactacttaaagaccccat

SEQ ID NO: 9928 - DNA, 546 bp, Rattus norvegicus
  misc_feature (376)..(376): n is a, c, g, or t
gcatgggcatcctcaaaaggctctccctcatttacactcaagcctggccagaggctgtctttatccatgaaggctacactcacggagctggttttgacaatgatatagcactgattaaactcaagaacaaagtcacaatcaacagaaacatcatgccgatttgtctaccaagaaaagaagctgcatccttaatgaaaacagacttcgttggaactgtggctggctgggggttaacccagaaggggtttcttgctagaaacctaatgtttgtggacataccaattgttgaccaccaaaaatgtgctactgcgtatacaaagcagccctacccaggagcaaaagtgactgttaacatgctctgtgctggcctagaccncggtggcaaggacagctgcagaggtgacagcggaggggcattagtgtttctagacaatgaaacacagagatggtttgtgggaggaatagtttcctggggttctattaactgtggggggtcagaacagtatggggtctacacgaaagtcacgaactatattccctggattg

SEQ ID NO: 9929 - DNA, 191 bp, Rattus norvegicus
agaatttggcagtaagacctctgattctgacatcttcacagacatcgagaaccctagctcccatgtacctgagttttcttccagtagtaaaacctcaactgtcaggaaacaagtaaccaagagctataaaatggcagatgaggcagcaagtgaagctcaccaagaaggagacactcgaaccaccaagaggg

SEQ ID NO: 9930 - DNA, 436 bp, Rattus norvegicus
  misc_feature (140)..(140): n is a, c, g, or t
ggtccagaggttcattgacctcattcctaccaacctgccacatgcggtgacctgtgacattaagttcaggaactacctaatacccaagggaacaacaataataacatcactctcattccagtgacatgcatgacagcaangaattagaccccgacccagagatatgttgatccctggccactgttttagatggagcataatttggaaagtttaagaaaagtgactggatttcactgcctttctcagcagggaaaacggatgtgtgcaggagagggcctagcccgcatggagttatttttattcctgaccacgattttacaaaactttaagctgaaatctgtacttcacccaaaggatatcgatacaactccagttttcaatggatttgcctctctgccaccattttatgagctgtgcttcattcctctctaaagag

SEQ ID NO: 9931 - DNA, 463 bp, Rattus norvegicus
cagggtcaggatgtgtgtacctccagacatctctaaagtacaacatccttccggaggcagaaggagaagcgcccttcactctgaaggtcaacactctccccttaaactttgataaggcagaacatcacagaaagttccagatccacatcaacgtaagctacattggagaacgacccaactccaacatggtcattgttgatgtgaagatggtgtcaggcttcatacctgtgaagccatccgtgaaaaagctccaagaccagtctaacattcagaggactgaagtgaacaccaaccacgttctaatctacattgaaaagctaaccaatcaaaccatgggtttctccttcgcggtggaacaagacattccagtaaagaacttaaaaccagccccagtaaaagtctacgattattatgagacagatgaattcgccattgaagaatacagtgcccctttcagttctga

SEQ ID NO: 9932 - DNA, 507 bp, Rattus norvegicus
gacccacagaactcctaatcgaaatggaggactggaaaggagacaaggtgaaggcacactatggaggcttcacggtgcagaccgaggccaacaagtaccaagtgtcagtgaacaagtacaaagggactgctggcaacgccctcatggaaggggcctctcagctggtgggggagaacagaaccatgaccatccacaacggcatgttcttcagcacctacgacagggacaacgatggctgggtaactacagatccaagaaagcagtgctcaaaagaagatggcggcggctggtggtataacagatgccatgcagccaatccgaatggcagatactactggggtggcctttacagctgggacatgtccaagcacggcacagatgatggtgtggtgtggatgaactggaagggatcgtggtactccatgagaaggatgtctatgaagatcaggcccgtcttcccacagcaatagtcccccaagcatagactttcagccttctatgtctgac

SEQ ID NO: 9933 - DNA, 468 bp, Rattus norvegicus
ctttgcagacattgtcccaatgaatttgccacacaagacttctcgtgacattgaagtgcagggcttccttatccctaaggggacaaccctcatccccaacctgtcctcagtgctgaaggatgagactgtctgggagaagcccctccgattccaccctgaacacttcctggatgcccagggcaactttgtgaagcatgaggccttcatgccattctcagcaggccgcagagcatgcctgggggagcccctggcccgcatggagctcttcctcttcttcacctgcctcctgcaacgcttcagcttctccgtgcccactggacagccccggcccagcgactatggtgtctttgcctttctccttagcccttccccctaccagctctgtgcattcaaacgttagaaggaaagaaattctagtccagcctctaccttagtgtcatacacagattaaaacagttctgtggctgc

SEQ ID NO: 9934 - DNA, 424 bp, Rattus norvegicus
aatgtgaagctttcatgcccttctccataggaaagcgtatgtgtcttggagaaggcattgcccgaagtgaattgttccttttcttcactaccatcctccagaactactcagtgtccagccctgtggatcctaacaccattgatatgactcccaaggagagtggattagccaaagtagccccagtgtacaagatttgctttgtagcccgctgattgtgctgaggcagtcagccgactcacttctgttcaaaatggccccatttttctgattctgggagacctgctggagaccaggcccaaggttgctgagtcattcctcacttcttcccaacagcctcagtccccatttatcaggtctccatgctctgtgatctatgctattggactatgtataaggtctgaattctatgtctacaggtttgcct

SEQ ID NO: 9935 - DNA, 47 bp, Rattus norvegicus
gcctgagcctccaggtgggcaatctccagtgagagcaagtgctgagt

SEQ ID NO: 9936 - DNA, 548 bp, Rattus norvegicus
  misc_feature (138)..(139): n is a, c, g, or t
  misc_feature (141)..(142): n is a, c, g, or t
  misc_feature (145)..(151): n is a, c, g, or t
  misc_feature (173)..(173): n is a, c, g, or t
  misc_feature (196)..(196): n is a, c, g, or t
  misc_feature (247)..(247): n is a, c, g, or t
agatgtctaggtgatccttaggcaaattcagggtgaatatagtctagtatgataggaattggattttaaaattccattcagcactcttggaaatgaagtcccaccagtgggttagattaatggttgaggcatcgtgtnncnntgnnnnnnntcagatgtgaaagcctcgattntacaggactttgtcgtgttggangacgtatatgtcagacttatcctgatgagatttgtgcctgggttgtagtanccactcgagatggaaaatttgtatatggaaaccagagctgtgctgagtgcatcggtacgactgttgagcatggaagtcttataatatcaacaaactgttgctcagccacccctttctgcaatatggtacatccctgatacttaattgtatggaaggattttagtgctctttattgagtcttgacagtggagcatgccagaaagaataatctactgaccatgtctggacaactcactatgatttctacatcgtgttttctgactacatgtatatcatatgttcttgggtgatctgtaataaa

SEQ ID NO: 9937 - DNA, 526 bp, Rattus norvegicus
caatggctctgaaaggatctgctgccccatcaactgggtggagtatgaaggcagctgctactggttctccagctctgtgaagccttggacggaagctgacaagtactgccagctggagaacgcccacctggtggtggtgacttcctgggaggagcagagattcgtccagcaacacatgggccccttaaatacttggattggcctaactgaccagaacggaccctggaaatgggtggatgggacagactatgagacaggcttcaagaactggagaccagggcagccagatgactggtacggacatgggcttggagggggtgaagactgtgcccacttcaccaccgatggccactggaatgatgacgtctgcaggaggccctaccgctgggtctgtgagacagagttgggcaaggccaattaggagcctccattcccctgatttatttcctgagtgccttgagctgtgaggcttagagttgggaggtcctactcaagggtctccccatctttgggaactttcatctag

SEQ ID NO: 9938 - DNA, 497 bp, Rattus norvegicus
  misc_feature (212)..(212): n is a, c, g, or t
catctcctgctggtattcacaatggacaccagcagctccacagtgtaaagctctatgtcggaaaccagagataggaaatggagtactgtctactaataaagatcaatatgtcgaaactgaaaatgtcaccatccaatgtgactcgggctttgtcatgctaggttcccaaagcatcacttgttcggagaatggaacctggtacccaaaggtgnccagatgtgagcaggaggtccctaaagactgtgagcacgtgtttgcaggcaagaagctcatgcaatgtctgccaaattcaaatgacgtgaaaatggccctggaggtctacaagctgactctggagattaaacaattacagctccagatagacaaggcaaagcacgttgaccgggagttatgagcgggtgttctctcaaggaggaagaagtacctcatgggctttctgacttcagtgccaagcagaacgtctgcatttttagcaacctttgtaactttggcaccaa

SEQ ID NO: 9939 - DNA, 317 bp, Rattus norvegicus
  misc_feature (37)..(37): n is a, c, g, or t
tgcaatggttgcactgctggtcaccatctgtagcctngaaggagctttggttcggagacaggcagcggagacggatgtgcagaccctgttcagccagtatcttcagagtttaactgactatggcaaggatttgatggagaaggcccagccctcagagattcagaaccaagccaaggcttactttcagaatgcacaggagagactgacaccctttgtccagagaactgggacgaatctgatggacttcttaagccgtttaatgagccccgaggagaaaccagctcctgccgctaagtgaggtgtgtcaggactcgtct

SEQ ID NO: 9940 - DNA, 457 bp, Rattus norvegicus
gtgacacctgggtgttcattcacctgccatgtggtatcacaaacagaagtaggatctcagctggcatcaaaacttcttctttcttacttaccccatattaagtaatgtttataggaagtaatgtttgtaggtggggcttgagctcccacactagagtcaggaggcaaaaccatgctgaagttctatatagcaaaccaaacctgagagtactttcctgatcactacaatagcaagagagcaagagcgagagtgagagcaagagcgagagagggagggaggaagggaggaaaggggatggagggagggaggaagggaaggagagagagagagagagagagagagagagcatcaccatttcacatagggtgtgaacagagtaggaaatcactttgtttctcatttaccaagagaccatctgaaagaatctgcctttctttgcccctgtcataccaagaaa

SEQ ID NO: 9941 - DNA, 561 bp, Rattus norvegicus
agaaacacccagtaggcagcagtaacaacaactgagactcatggggcaaaggtggctcacctctgcagaagctgtcctgcccttctctcactcagtcctctacacaagagcagcatgtccccaagcccaacgtacaggttcaaaagatagaacttaaaaaatttgaacctaaactgaggtggaaaagacacagttagctaggattgacacattggactctatcaccagcattcaggagggagggaacatggctccctaggaggcctgccagaattacaaagtgaaactcatctcaaaaaaggaacaacagaaaataaaatttcaaattgatttctcttagaccataagagtccagatctgtatccaaagctatttggttatattttttgttattgttgttttgtttacacattgtgtttttctttcggtttgtaagtctgtttgggatatttaatttacatttactgattagtgtgggtggtagggcataccatggctcaaatgtggaaaccaaagaaaagcttttggaagtgtcatctcccttacaatacgtgtgtccaa

SEQ ID NO: 9942 - DNA, 374 bp, Rattus norvegicus
aggacagagggcttcaccttgaaccctcccctagctcagccagctgttatctctcgtggttttcaggactcaggtttcactgaaggtgtgatagctaccacatcaccatatgacacggagacccatgatgatttgatccctgatatccatgtacaaccagatagcctttcatttaagctgatatctgactttccagaagcaacttcccacaagtgtcctgggcgcccatggaagccagttagtaggaaggatccaaccatagaaacaacagaattttctgattttgatctcctcgatgctctttcttaacttatacagcgtaggaatctttacaaatgctttcccagcctctttttctactgcccaaacacaaa

SEQ ID NO: 9943 - DNA, 491 bp, Rattus norvegicus
aaggcgaaggacttgcacaccagcatccaacgcaacctggatcagctgcgagatgagctcagtaccttcatccgtgtcagcacagacggggcagacaacagagactccctggaccctcaagctctctctgacgaggtccgccagagactccaggcttttcgacatgacacctacctgcagatcgctgcattcactcaggccattgaccaggagaccgaggaaatccagcaccagctggcaccacccccgcctagccacagcgccttcgctccagagttgggacactcagacagtaataaggccctgagcagactgcagagccggctggacgacctctgggaagatattgcctatggccttcatgaccagggccatagtcagaataaccctgagggtcactcaggttaactctgcagctcgttgtctggaccctgagccttcagcatggcctaataggcagagggtggagggtcctgcatactattggcgag

SEQ ID NO: 9944 - DNA, 547 bp, Rattus norvegicus
  misc_feature (99)..(99): n is a, c, g, or t
  misc_feature (503)..(503): n is a, c, g, or t
agtcaaaaactgtcccctatctataatctcattcctttgacaatgaaagatgcatacgcaaagaaacagaatatggaaaaggctattgaagactatgtnaatgaattcagtgctagaaagtgctacccatgtcaaaacggaggcacagcaattcttctggatggacagtgcatgtgctcctgcacaatcaagtttaaggggattgcctgcgaaatcagtaaacaaagatagccttcaggaaacaaagcaaaacctggttcacatggaaggtggaaaaaaggacaaaaaaagaagaagagagaggagagagaagagagagagaaaagaaaaaaccccaggactttccaacttagcatcctaccctagagcgaatcctcactgccaagtagaaagcagcttgcttcatggaaatcctaccaacctctgatgtcgtctctgtttcaggtctacagtgcctttctcccctctttaatgcctataatgcttccatttttttttttatnccctaatgaagaatcggcagtgagatatgccaggactgcctttt

SEQ ID NO: 9945 - DNA, 515 bp, Rattus norvegicus
  misc_feature (259)..(259): n is a, c, g, or t
  misc_feature (287)..(287): n is a, c, g, or t
agagagacccatcagcagagctagtagacagaatcattcaacatacatcattccaggagatgaagaacaatccatgcaccaattattcaatgctgccagagaccatgatagatctaaaagtatcgcctttcatgagaaagggaattgtaggagactggaagaaccacttccctgaagccctgagggagagatttgaggagcactaccagcagcaaatgaaggactgccctgtgaaatttagagcagagctctgagacanttccttgtgtctgaaattggagtagtcnccaatttatccttcagtttttcttgttttgaattcagtagaagtagaagtcttttgaagactgagggtttaaattcattctggtttttttaatctaacttttatatcaatctagtttctgaatgttttgttggcaaaataacatttttcatatatacatatatatacatatatatatatatatatatatatatatatataacacaagcattgtcctctaatagtgttc

SEQ ID NO: 9946 - DNA, 556 bp, Rattus norvegicus
gagaccccgtgttcaagcaggcagttcaaacgatacagacggaatatttttaccttacccccaacttgataaacgacacaattgaacttcgggagtttcagaccacagacgaccagtgtgtctataacttcacccatctaggagtccagagagagaatgggaccttatccaagtgtgcaggagcagtgaaaatctttgcccatttgatagtgctgaagaaacatgggaccttcatgcttgcctttaacctgacagatgagaaccgggggctgtccttctatgctaaaaagccagacttgtccccagagctgcggaaaatattccagcaggctgtcaaagatgtgggcatggatgaatcagaaatcgtatttgtcgactggacaaaggataagtgcagtgagcagcagaagcagcagctggagctggagaaggagactaagaaggagaccaagaaggatccttaggccaagcatgaactcagctctctgaactccggggactgtccccatgcccactctacccccactcctgtgcacctcgattctattttccacaa

SEQ ID NO: 9947 - DNA, 478 bp, Rattus norvegicus
tttatttaacctctcatcgtacctggttccccgacactggataccaaagatgaatccgatcattcacaagttcctttacacagctgagtacagcgacagctcctacttcagcagcgatgaatcagattgagttcttctgaacatcagtccaggctacaggattcccagtcaacttttattttataaatttttacaaatatgtgattggtgtaacatatttatatttgtagttcagagacgtgatgttgtggtccaatcctggaaaaaattatgatttcgcatatcatgatgatgtatgattaagcagattaagcattatgataaaaataacttggtaaaatgttagcatcatcatacatatgatgtattctggttataactcaatttaccctgacacttacctccatagaaacactttaagtaattagttccttattgcttcatactttataaagcttggtgagcagttcttttatac

SEQ ID NO: 9948 - DNA, 562 bp, Rattus norvegicus
  misc_feature (158)..(158): n is a, c, g, or t
  misc_feature (226)..(226): n is a, c, g, or t
  misc_feature (257)..(257): n is a, c, g, or t
gatcgaagtgaccatcctgaagcctcacctgcaggtccatgcaacgcctgaacgactggtggtgacaaggggccgaaaaaactctgaatacaagtggaagaagacactgttctctgtgttacctggcttaaagatgaccatggataagacgggactgntacagctcagtggcccagacaaagtcaccatcagcctcttgtctctggatgaccctcagagaggactncatgctgcttttgaatgacactcatcacttntccaacgacattacaggggagcttggtcagttttaccaggatatcatctgggatgatacaaaacagacagtcagagttctaggaatcgactacccggctaccagagagctcaagttgagttatcaagacgggttcccgggaacagagatttcctgctggacggtgaagatatagaactgacaggagcattgtttgctacctgccatgttgtcctcgtatgcaggcggatgacactgtgtgccaacagggccgcctgtgaggcctagaccttgatggggaagaggatgctctcttgttacaaataa

SEQ ID NO: 9949 - DNA, 534 bp, Rattus norvegicus
  misc_feature (62)..(64): n is a, c, g, or t
  misc_feature (66)..(66): n is a, c, g, or t
  misc_feature (68)..(68): n is a, c, g, or t
  misc_feature (118)..(118): n is a, c, g, or t
  misc_feature (209)..(209): n is a, c, g, or t
ggtagagtccacttcatttgcaagagcccggcgggcagtgctgccccaagagaatgaagggnnngngngtgagccactcataactgggaccctcaagaaagaagactcctgccagctnaactactcagaaggtccctgcctggggatgcagcagaagtattactacaatggcgcctccatggcctgcgagaccttccagtatggcggcngcctaggcaatggtaacaacttcgcctccgagaaggaatgcctgcagacgtgccggaccatagcggcctgcaatctccccatagtccaaggcccctgccgagcctttgcagaactctgggcatttgatgcagcgcaagggaagtgcatccaattcatctatgggggctgcaaaggcaacggcaacaagttctactctgagaaggagtgcaaggagtactgtggagtccctggtgatgggtacgaggagctaacacgcagttgaaggagccggtctgcaagccagagggtagccacggtccgtcactgtgcagtccagcttagatg

SEQ ID NO: 9950 - DNA, 542 bp, Rattus norvegicus
  misc_feature (274)..(274): n is a, c, g, or t
aactgaggatgctactccagcagctctggaaaaaggtacccacaatgggaatattcctcctctccaacctggtccttcccctaatggcctgaattctggtcagatggcaaattagaatgtgaaacttcgaagcagcaagaaaaggaacgaacgtcgacgttgccggaatgtttgtctagcacttcgggcaaaccatcagaaccatggagccatgaactgagacagaagggcatctatctatccagtaactgtaacccataccaatttgcttttngtttaaattttctatttaaaagataaacaagaattaggcaaaaatgttcctgcctataatcccgatgctcagaaactcaagatcaaccttaagtatacaaaacaagactgtctcaagaaaccaaaaacacttttcagtggctatgaactctatgaaagctgaaccaaacagcttcatctgataaacattaacttcactatttccaaactttccagtaagcaggtgttttgttcattaaacatccacaacctgcttcatgttactcaaa

SEQ ID NO: 9951 - DNA, 312 bp, Rattus norvegicus
aggatgaggctcttcatcgcacttcctgtcctgatcgtggtcgtagccatggctttggaaggcccagcccctgcccaggcggcccctgacttttccagcgcaatggagagcttaccggataaactaaaagagtttgggaacactttggaagataaggcccgggcagccattgagcatatcaaacagaaggaaattatgatcaagactcggaactggttttcagagacgctcaacaaaatgaaggagaaattaaaaaccacatttgcctgagtgcctggcgagccacctcgcagcagcaaagagggccacgtg

SEQ ID NO: 9952 - DNA, 520 bp, Rattus norvegicus
  misc_feature (211)..(211): n is a, c, g, or t
  misc_feature (235)..(235): n is a, c, g, or t
  misc_feature (342)..(343): n is a, c, g, or t
gaacatttttgaactcctcttctggggcagatcctctgatggcgccaaaggaccccaattcatcagcagggattggcatggtgtaccagggaaagtggacgctgctatggccggccgcatctacatcactggctccacattccgctctgtccaggccaaaaaacagaagtctgggcgtcgaagtcgaaaacgctaccgttcacgccgaggncgtggccatagccgcagccgcagncgcagcatgagctctcgtcgcccatcgcgttcagtctggttctctttgctctccagcgaagagagtgggctaggaacctacaattacgattatgatatgaactggcnnatacctgccacctgcgagcccattcagagcgtctatttcttctctggagacaagtactaccgagttaaccttagaacacggcgagtggactctgtgaatcctccctacccacgctccattgctcagtattggctgggctgcccaacctctgagaagtaggaatcagcacccacacag

SEQ ID NO: 9953 - DNA, 532 bp, Rattus norvegicus
agggaccaagaacctgcatgtctctcaggtggtccacaaagctgtgctggatgtggatgagacaggcacagaaggagccgctgccacagcagtcacagcagccctaaaaagtttaccgcaaactatacctcttctgaatttcaaccggccattcatgctggttatcactgacaataatggtcagtctgtcttctttatgggcaaagtcactaaccccatgtgagtctgaagctccccaaaatctgacaattctgcccaggatcctggaacagagcctggatgctgatctctgtatatgccctgacatacatgctctgattggctattgcaaagttggcttagacagtgacatcaactatctctatggctcccatgtgcactggagcctttggattgtcagtgtgcaggcacttaggacccttgggagcatctacacatgtttctgaacttggaatctttctttattcttcttccctggtgactcctctttctgtgttcataccccaaaccaagccattgataagtcccagta

SEQ ID NO: 9954 - DNA, 454 bp, Rattus norvegicus
  misc_feature (30)..(30): n is a, c, g, or t
ggcatttctctgtcaggctcactgtctgtntagactctatctcttctgctgctggctactgtcttttcctttacttgatttcctggtggatgctcacagatgactcttccccctgcccctcattttgacaggacggataatggcgccatgcagccttttactgactgacagactacccacaggttgcttaacattttgtgcttcaaagccttatcccaccccaggatgggatgtttcaaggctgcatctcagcacagagctgggatcctcaactcccgtgccccagagtgaaacacttcttttcattcgtcagaaaatctgaaataaaactgtgctaattgagacacattgggatatgcatgtaatatcagcactagggaagttaaggcaagaacatcatgaattcaaggctagcctggattacatagttgcagactaacttgggctacaggga

SEQ ID NO: 9955 - DNA, 547 bp, Rattus norvegicus
atgtcataccacacccatagtaggggctttgtccagagaggcagtgttgctggtgacggtggtggtgattccaggtttgccaaagccattcatcccccagcaccttaagcagtaagcagtcctgcttaaatcaagttaaccaggacttcccagcataaccaggaatgtagtatttcccgtcctcctcttctgtaaatgaaggaacatgaggggaggggccggctcacacatacatgagtggaaaactgtcagagtctgaggctctggttctttgctgacctagaggctgggctcagcagcttgagaactccacagctgttcctgtctctgaggagcttctgttccccggttctgtcagtcagctaggtctgcagtgctgactctgggattctcttatgaatatgcctgatgggcaagccagaggaagatctagaaacaccgagtaattcagagcagcctgcttagtaaatggtgggaagaaaagccgacgctggctcctctctctggggactgtgaagtgatgatccggatttaccatgtccctgaa

SEQ ID NO: 9956 - DNA, 552 bp, Rattus norvegicus
gggaataactcatcttctttaacgacaaacttaatcctaagggctatttctaagacagaagaatcagctttctttttatgttaaacgtttggggagcacgggatatgcacagcattaaataacacttgcttcaccttagaaagtacttaaggaatgatggacaaataatggacaggatgagaaccctggcaagtggtgttccagaaacgttccaccaaaaacctacataggcttggcattcccatgtacttaggaaattctgtgctatatatatatatatttttctaataagttgattctttaccaccccttaaagaattttcactctcagtaacaaacagcattagaggtactttattttgaagaatagactaatattttttatattttaacaatggacaattgtagatgattgtaatgatacgtcagaaggaaacagaaacgtagatgagaacacagatgacgcggggacagttaaattaataccgaaataatccaatacagcaccttcgatggcttttatacaaaagttcaatgtgcatttcactcaaa

SEQ ID NO: 9957 - DNA, 394 bp, Rattus norvegicus
ggagttttcctcaagaccaagatgggggagaggcagaaggcaggggagatgaccgaggtgctaaccagccagcgctacaatgcccacatggtgcctgaggatgggagcctcacctgcaccgaggctggtgtctatgtcctgcgcttcgacaacacctatagcttcgtccatgccaagaaggtcagcttcacggttgaagtgcttctcccagatgagggcatgcagaagtacgatgaggagctcacccctatctaggtggaccccccacttctcagagaccccacgctctgttttccctcttctctcctttcattcctaaacctgatcattagtcgggcttactctgtgacaccagtgcgcagaggaagagattgcccggagaagatttatctgc

SEQ ID NO: 9958 - DNA, 330 bp, Rattus norvegicus
gaagttactgaagagcccctccctgtgacactgaagagttacgatgtcagtgcattcaaataacgtccgagtcgatcccttgcaaattcattaaaaccatcgaggtgatatacgagaatatttactgcaacagaatggaagtgatagcagtgctaagagacgggaatgcaatttgtttgcatccgaattctacgtgcgtgaggactcttatcgacaacattcctagcagacctttcatacctaaggactacgcatcagcgaacaatctacgtggaatgaagtttatgtacagtgttgagtttgaaaagctcctatatctttcatttatgg

SEQ ID NO: 9959 - DNA, 556 bp, Rattus norvegicus
  misc_feature (99)..(99): n is a, c, g, or t
tggataaaagatggcacacccctgccccttgcccccagccctgtgctgctcctccctgaggtagggcatgaggatgagggcatctacagctgcgtggcnacccaccctagccatggacctcaggaaagccctcctgtcaacatcagggtcacagaaaccggtgatgaaggacaagctgcaggctctgtggatgggtctgggctgggaacgctagccctggccttagggatcctgggaggcctgggaatagccgctctgctcattggggccatcctgtggcgaaaacgacaacccagactcgaggagaggaaggccccagaaagccaggaggacgaggaggaacgtgcagagctgaatcagtcagaggaagcggaaatgccagagaatggtgcagggggaccttaagagcgcccaggcaaaccctgtctccttcagcttccgacctcagctgtgctggctccagacgagctcccccactctacgatcccaattcaacctcgagccactttcttctccaaccagagcccacatgatccatgctgagtaaacacctgac

SEQ ID NO: 9960 - DNA, 556 bp, Rattus norvegicus
  misc_feature (108)..(108): n is a, c, g, or t
  misc_feature (279)..(279): n is a, c, g, or t
  misc_feature (391)..(391): n is a, c, g, or t
gatcaaccaggcctggaacaccagtgaacaggctatgccacaggcaatgcaccaggcctgccttcgcttctggctagacaggcaaaagtgtgagcagtttgtggaacngcacatgccccagctgctggccctggtgcctaggagccaggatgcccacacctcctgccaggcccttggagtatgtgaggccccggccagccctctgcaatgcttccaaaccccacacctctgagaacccaggctccagcaacctgtaccaaaggaccacaagtctcagcntgcacccccagccctgtgccagcctgtatgtcccagctctaaccacagcccaacaacaccaccagagtggtttctggctcctctgatgatgaggtgcagcagaaccatgtcntctagaagccttcagagggggcttcaggccttcacccccaccagagccaagcccagctccaacagctcctacagccccaggactgaaaaggaactgtcgtgggtccacagagagtgggtagaagtggggctagccacagcaaccccttgctaacacttctgtgaa

SEQ ID NO: 9961 - DNA, 320 bp, Rattus norvegicus
acactagctttcattcggcatgcttaggtagcattgctgttttatcaggagctgcatgctccctcagccctcactgcaatgtttaacacctcacagacaccttcattcccttccactgccatcctgttccacactgtgccattgttcaatgcagcctacccaggtaccctgcattctgttttgccttagagtccccaaagttgtaccatgatgctcgacacagctggacagtttgtccctatttgtgtgtgttccaatgtcctcctgtttgtatgggacttgttttgtcaatgcctgtgtgtgtatccaagctcttccac

SEQ ID NO: 9962 - DNA, 284 bp, Rattus norvegicus
  misc_feature (214)..(215): n is a, c, g, or t
gaatttacatcaataactgctcatgggttaaagtctgcactgacatttcctcgtctgccgttggcatacacgcaaggtgttaatgacctgcaacatggtagagtgccctgaaccctaacttccccagaactgggactgtctagcgacaggcactgaatagcaatgcaggctgaagacctccatgtttagagtttaacctcaaaagttaacttgnntttttttttttaaatgtgaattactgtaacataatctatttttggattcgtgtgttttccaggtggaca

SEQ ID NO: 9963 - DNA, 376 bp, Rattus norvegicus
cccaggttccatcacattttttcatagtctattgacctggaaccttcacagtcttccagtagcttatataatttcctcacaggatgagttgaggaaacaacaggtttttcttctctcttccctctgattcctttgtatcccactttcatcttggcttttaagttgttctagattcccaaaaaagccattttgcattacagttgaacacacaaagactgaaatgtaagatgttagtgtgtaagttaaaacataacaagttttgtttcgtgttgtttccagttagagaaagttcccagaacagggaagttctaaaacagaactctgatagtgagctaccttttaaaattgaaagctgtcatagtaattcctgatcttt

SEQ ID NO: 9964 - DNA, 544 bp, Rattus norvegicus
  misc_feature (321)..(321): n is a, c, g, or t
tgttccaggcattcctcaactactaccttctcaacagcctctaccctgatgtcaacgatgagctggccaagggcttccccctccctctaccaaggcgtattaagctccacgacctcgacttccagatccacaagaacttcctatacttgggtgccaatgtccagtacatgagagtctgaggacaagaagaaagatgggcctcagaggccacagcgggacctgccatttgtaattccagatgcgtagcacatctccagagagtctcaaaatacaaagaagtttctgttcctggctctggtggatcctgtccccacagtcctnttcaccaggtgcaccctcagcctggacttgactctgacctctccagggagaagccctccccccaccaacctctccagggagagcccctccccccaccaacctctccagggagacccctctcccaccactgacctggaatcacttaaagagcaggcactgtggttttgagtgcaccttctcaccttcatgtctgacggagtgctggcacttagtaggtcctcaa

SEQ ID NO: 9965 - DNA, 496 bp, Rattus norvegicus
  misc_feature (167)..(167): n is a, c, g, or t
ggacctgtgttttattccacaccagtggctatgactcacaagctatcgtcaagaacaatggcagcacagagtatggactcttccagatcagtaacagaaattggtgcaagagtagcgagttccccgagtcagagaacatctgtgacatctcctgtgacaagttcctngatgatgagcttgcggatgacatagtatgtgccaagaagatcgtggctatcaaagggatcgactactggaaggctcacaagcccatgtgctctgagaagctggaacagtggcgctgtgagaagccgggagctcctgcccttgttgtccctgccctgaattcagaaacacctgttccctaaggctacctcagtttggctctttctatcgtgaagatgatctgtctctgagccttgtatcctgtagtgacaccatcggactctagaggacttttgttcaacaggagtgcgactggcacactggactgcaaacccttgcttagtgacggcga

SEQ ID NO: 9966 - DNA, 387 bp, Rattus norvegicus
  misc_feature (94)..(94): n is a, c, g, or t
  misc_feature (249)..(249): n is a, c, g, or t
  misc_feature (332)..(332): n is a, c, g, or t
  misc_feature (340)..(340): n is a, c, g, or t
  misc_feature (353)..(353): n is a, c, g, or t
agcccttgctcggaacctacaggaacatgtcttcaactcagttcagtccatgtgccctgatgacagctccagtgaggacacagaatgtatcaantgtcaaaccaacgaggagtgtgcccagaatgacatgtgttgtcccagttcctgtggtaggccctgcaaaactcctgtcaacattgaggttcaaaaggctggccgctgcccctggaatccaatccagatgatcgctgctggaccatgcccaaaggncaacccatgctccatcgacagtgattgttctggcaccatgaaatgctgcaacaatggctgtatcatgagttgtatggacccanaaccagantctcctacagtgntatcctttcagtgatgaagcctgccctgggatcc

SEQ ID NO: 9967 - DNA, 353 bp, Rattus norvegicus
gcatgagggcctcgaatgagacattgttctgtgccatgacccgggctggggaatccatctgcgctcctccttctgggcagtgtgtctgaagacaccaagcgtcacttcaggctgaggtcccagatactcagggaatcatctgcaaaccaggctgaaacggaaatgtcccgccatcagccaaggacagccctggtggctgagggggcctggggcgagtggagaaaagttgctgttctgggggatgaagagttctgggcaaggtccttttgctgtggaggacagcctagactgtcgctcgctgctgccctgaccacttgggtgcgccgaagaggctaccgggagatctgcaaaat

SEQ ID NO: 9968 - DNA, 545 bp, Rattus norvegicus
  misc_feature (44)..(44): n is a, c, g, or t
aatggaggccaatgcaagcacctgccagatgggccccagtgcangtgcgcaaccttcagcatctacacatcctggggcgaacgctgtgagcatctaagcgtgaaacttggggcattcttcgggatcctctttggagccctgggtgccctcttgctactggccatcttagcatgtgtggtctttcacttctgcggctgctccatgaacaagttctcctaccctctggactcagaactgtgaggcctcgtcccagatgggcagctgcacctagaatacctcaggacccgcccaccggtctgcccctgctctagggagactggaaagggccgactgcatgaagatgatttgagattcttcaagcatgaataaagggagtgaaaccagactctaccattttagtaggccatgggtataggaaaaggccagatgaccaaatgtagagatggatggattcctatacagcacatgggaaaggatattgcctatgtacacacacacacacacacacaccagagttaatggatgactggctttatattcaccaa

SEQ ID NO: 9969 - DNA, 452 bp, Rattus norvegicus
tatttactaccactacaggacctctgtgcctgttagcccatacgcgtatttcccagttggtctaaaactacttctacttcggtctccagcccaaatcctcaaatggcaaccaatgccaaatttcccccagcctgtcggagtacctcatcccattccaaacccatcctttcttgccattcccacaaatgaaaagcatgataacaccgccattccagccagcaataccattgctcccattgtgtccacaccagtttctaccacagagtcagtggtaaatactgtggccaataccgaagcttccacagtgcctatcagtaccccggagactgccacagtcccagtgacctcacctgcagcataaaagcgcaaaggaaacattgaagaagacagtcaaggtctgaaaccaaattccaacttcaaactcttcttcagggatttgtctaccaccattc

SEQ ID NO: 9970 - DNA, 584 bp, Rattus norvegicus
  misc_feature (78)..(78): n is a, c, g, or t
  misc_feature (506)..(507): n is a, c, g, or t
  misc_feature (558)..(558): n is a, c, g, or t
agcccagctccaggcacaaattgtgcaggcttttcctcagactcccgcggtggtttcttctcagccccagctgtctcntcctcagtccaaaagtcagtaccttgtgcagcaactagcccccctcttccaacaaggtatgcctgttcaagaccttctgcagtacctagatcttctgcttaaccccaccctccagttccttgccactcaacaacttcattccacttctgtctaagaggatttccgggttatttctctcctcatcattttttttttgaattgactgaaactggaaatgtacaatcattttcatcttgggatcatgctacaaaagtgatatatttctgaatgaaactacatggaaaaaaagaaattttattcttttatttattctatgtattatatgatattcatttgaatttgacccatggactctatatgtgtctcaattatatttcatataatactacaaatgttcaatattgagtttaaatgaaagtcaataatgnntacaaaatagctcatgaaaaattggatttactattatttctttgggaaccnatttcctttccagtcatttcaataaa

SEQ ID NO: 9971 - DNA, 504 bp, Rattus norvegicus
  misc_feature (383)..(383): n is a, c, g, or t
aagtttgatgtccacatgctgccaggcgaccacttttatctgatgaagcccgacaacgagaactttatcaagaactacatagccaagtgcttggaactctcgtcactcacttgactacttttagatgagctttctttggggctgtggatatgcagacggttcaaaagctgctcctctgggtccagcttttagttcttagaggttggaaaggtgcatattaatgaatttcttcgtggagcatttatctctctggggaaaggacacggctgaagaggcgcacaggcactattgggagctaacagaggggagaggggggtggttttctttggggggatgttgccctcagtaggtacccatgctccagtaaatgacactacaccctngtggcacatgcaggcagctctaatgcagactcagtgggaagttgggaggcatacatgttgggggacatctgtcacggggcttggaaagacaagtgagggtctgatcaaaacctgctgttta

SEQ ID NO: 9972 - DNA, 155 bp, Rattus norvegicus
  misc_feature (76)..(76): n is a, c, g, or t
  misc_feature (110)..(110): n is a, c, g, or t
atggctcagttgttaagacctccgactgctcttccagaggtcctgagttcaattcccagcaaccacatggtggctnacaaccatctataatggaatctgatgccctcttntggtgtgtgaagaagacaactacagtgtactcactctacagtgta

SEQ ID NO: 9973 - DNA, 232 bp, Rattus norvegicus
aagaaaagcataacgaaggtccaagcttctgaacactttatcctgcatttttttgcatcaagctttattgtactatgctcatagaatttaaaaaaatcttcttttttaatataacgagtgtgaatttgccgggttatttgttgtgtgtgttttgacagagagccctggctgctcctcaagaagacctaggtttgattcccagctcccacaaccaccgggaactctagctctg

SEQ ID NO: 9974 - DNA, 516 bp, Rattus norvegicus
  misc_feature (411)..(411): n is a, c, g, or t
ctgccaattggcctgagtctgtggaagtggcaagaagcttctggaagaccagcaaagagcggcagggcgagccaatgccactgtcagttcagttatacttataccctttctaaacatcacatgtcctctcaagtgtccaccccagcaagacaccacatgccctttctccaggcagcttccagaagaacaccacgtgtctgttttcagcaaaacgtcctccacgtgtctccctcagcaaaacattctctgataagaagacagtttccagaaaaacatcacaggacacagctgaatctccacagaaatcagagattcccacttctcctgtgatcttcccagaggtttcacactgtgttgttaaccttctttaccccagaaagttagctaaagagactgtaactatcccttcanttcccaacatcagatgggtaaatagaagaggagtccagagaatccttaaactgcctcatggcaaaagacaggatagaaaaaaatactctgttccacctaacaggc

SEQ ID NO: 9975 - DNA, 161 bp, Rattus norvegicus
tgtccccaggttctgtggataccaagatgctcaaaggggagtagtggcaaagggctgtggcctatgggtaccagggcagcagccactggggatctggatgagctgccttgctcactgaagcttcagtcacctcccgagtcttctggtctaccctccacaaa

SEQ ID NO: 9976 - DNA, 38 bp, Rattus norvegicus
ggctaactgttatggacgcctcatctctgagctcaaac

SEQ ID NO: 9977 - DNA, 439 bp, Rattus norvegicus
  misc_feature (362)..(362): n is a, c, g, or t
agccaccactaatgctcaggcaggtcttttctcaccgtgagaggagaccttagaatgcagttgttatccctgctccttggattctgatctacaacagaggtcaccttagtttattgtttgtcagatttcagtgccactgaagtagcttcctaagttattgccttggaagtaactgagtaaaaatggtcaccactcccatgaggctttaagtaaagggtaaaagacatcattgtgaaataattttaatatatacaccatgtagttttattctattgcaaagaagaagtcatggatggaaaggtgtttagaagcaactagcaaattctgtcctggttaaataacaatctgcaatccttgcttcntcgaggacagagagaagacagcagagataatgtggaaataaaaaccatctaatgttacgtcctcctcttaaaaattg

SEQ ID NO: 9978 - DNA, 330 bp, Rattus norvegicus
tttgagagtccttctgttcttcagtgtctggatgctccagtcctgtctgattctgtttgtcacaaggcctacccacgtcagatcactaacaacatgttctgtctcggcttcctggaaggtggaaaggactcttgccagtatgactctggtggccctgtggtttgcaatggagaagtccagggtattgtttcctggggtgatggctgtgctttggaagggaagcctggtgtctacaccaaggtctgcaactacctgaactggattcatcagaccattgctgaaaactaagtgcctctatctcataaggagtcactctgtgatgaccttttt

SEQ ID NO: 9979 - DNA, 284 bp, Rattus norvegicus
  misc_feature (221)..(223): n is a, c, g, or t
aaaagagtctcagctgccagctctggccatttacgaatctgtggatgacaagtgggacgccctgaccatcacagaagttacggtggagaaggtccaaagcttctgcaatggattcctaaagggtatgctgttgagagatcagaaagctgaaaacgactctgggaaggaggagctctgaccgctccctggaacttgaactcgctgttctctgtctattccgnnntgaataaaaaggagccgttccagcctctgcaacactcaggatcactgggtgttctgacaag

SEQ ID NO: 9980 - DNA, 204 bp, Rattus norvegicus
  misc_feature (58)..(58): n is a, c, g, or t
cattggatttagctaccctgtggtcccgaagggcaaggcccggatccgggtgcagatntcagccgtacacagtgaggaagacatcgaccgctgtgtggaggcctttgtggaggtggggaagctgcacggagctctgccctaggctcagaccagaggctctgactcaacccagagttctagagcctggttaaaaatgggcctgta

SEQ ID NO: 9981 - DNA, 185 bp, Rattus norvegicus
ttttccacatgtggcgcttctacaactctgccaggatgaggaaggtggctgactttttcctcctgcagtctaactacagctatgtgaactggtggtccacagctcagagccttgctattgttctttccggggtcctccagctctatttcctgaaacggcttttcaccatctcaactgacacaaag

SEQ ID NO: 9982 - DNA, 335 bp, Rattus norvegicus
  misc_feature (150)..(150): n is a, c, g, or t
catcaatgtctttgagggcaataagcagtttgtcaatgctgccaagatcatcaagcatcccaactttaatgcaaggaacctgaacaatgacatcatgctgatcaagctctctgtccccgtgaccctcaattcccgagtggccactgtggntctgcccagctcctgtgcacctgcaggcactcagtgcctcatctctggctggggcaacaccctcagtcttggtgtgaacaacccagacctgctccagtgcctggatgccccagtgctgcctcaggctgactgtgaggcctcctatcctggaaagatcaccaataacatgatctgtgttggcttcc

SEQ ID NO: 9983 - DNA, 453 bp, Rattus norvegicus
  misc_feature (42)..(42): n is a, c, g, or t
  misc_feature (187)..(187): n is a, c, g, or t
  misc_feature (275)..(275): n is a, c, g, or t
  misc_feature (283)..(283): n is a, c, g, or t
  misc_feature (290)..(290): n is a, c, g, or t
  misc_feature (295)..(295): n is a, c, g, or t
  misc_feature (320)..(320): n is a, c, g, or t
cagcggccagtcaagactcttgtgagcaagaattttgagcangttgcctttgatgaaaccaagaatgtgtttgtcaagttctatgccccatggtgcagccactgcaaggagatggctccagcctgggaggcactggcagagaagtacagggatcgtgaggacattgtcattgctgagatggatgctncagctaacgagctggaggccttctctgtgcatggctatcccactctcaagttcttccctgcaggacctgaccgaaagattatagaatncaaaagcnccagggncctanagacattctccaagttcctggacanaggaggtgccctgcctgaggaaaaatccaaggagcctgcagtctttgccccagaagcacaacccaattcccccttgggtcccaaggaggagctgtagccattgggacactgtattccaaaaagtggtgtcctc

SEQ ID NO: 9984 - DNA, 146 bp, Rattus norvegicus
gctcaatttagcaggtaacactacagctaaggtgattgggaaaaaggctaattgccctaatacacttgttggatgccccagggattatgatcctgtgtgtggtactgacggaaaaacttacgccaatgaatgcattctatgctttg

SEQ ID NO: 9985 - DNA, 407 bp, Rattus norvegicus
  misc_feature (31)..(31): n is a, c, g, or t
  misc_feature (35)..(36): n is a, c, g, or t
  misc_feature (216)..(216): n is a, c, g, or t
  misc_feature (301)..(301): n is a, c, g, or t
  misc_feature (306)..(306): n is a, c, g, or t
  misc_feature (333)..(333): n is a, c, g, or t
  misc_feature (369)..(369): n is a, c, g, or t
  misc_feature (378)..(378): n is a, c, g, or t
atgtgggttcctctcttacatggaccttttnctannatcatagaccatcagcaagcaggtcattgttccaacatggccctgtggatgcgcttcctgcccctgctggccctgctcgtcctctgggagcccaagcctgcccaggcttttgtcaaacagcacctttgtggtcctcacctggtggaggctctgtacctggtgtgtggggaacgtggtttnttctacacacccaagtcccgtcgtgaagtggaggacccgcaagtgccacaactggagctgggtggaggcccggaggccggggatnttcanaccttggcactggaggttgcccggcanaagcgtggcattgtggatcagtgctgcaccagcatntgctccctntaccaactggagaactactgcaactgagt

SEQ ID NO: 9986 - DNA, 501 bp, Rattus norvegicus
ctggcagcagcacccgatatgaggatagtgatggctgttacttgcagaagtcccggcccccgaggaagctggagcttcagcagctgtctagcggcagcggtggcagcagactcaaccggatcaggagcagcagttcagctgccaacctgatagccaagaagcgcgtgatccgcatgctcattgtcatcgtggtcctcttcttcctgtgctggatgcccatcttcagcgccaacgcctggcgggcatatgacacggtttctgccgagaagcacctctcagggactcccatctccttcatcctcctcctctcctacacctcctcctgtgttaaccccatcatctattgcttcatgaacaaacgctttcgcctgggcttcatggccaccttcccttgttgcccgaatcccggtcccccaggggtgagaggagaggtgggagaggaggaggatgggaggaccataagggcattgctgtccaggtattcctacagccacatgagca

SEQ ID NO: 9987 - DNA, 476 bp, Rattus norvegicus
  misc_feature (291)..(291): n is a, c, g, or t
  misc_feature (315)..(315): n is a, c, g, or t
  misc_feature (342)..(342): n is a, c, g, or t
  misc_feature (382)..(382): n is a, c, g, or t
  misc_feature (387)..(387): n is a, c, g, or t
  misc_feature (394)..(394): n is a, c, g, or t
  misc_feature (416)..(416): n is a, c, g, or t
acactatctgttattgctgccactgcccactgaaagggatcttgagacatgaggtgcatctccaggctgccagctgttctcctcatcctctcggtggcactcggccacttgagagctacacctgtcggaagtggtaccaaccctcaggtggacaaacggaagtgcaacacagccacatgtgccacacaacgtctggcaaacttcttggttcgctccagcaacaaccttggtccagtcctcccaccaaccaatgtgggatccaatacatatgggaagaggaatgtggcaganggatccaaatagggaatccctggnatttcttactcctgtaaagtcaatgtnactcccgtatctcttattacttcctgtgtaaatgctctgnatganttcctgnaataatgtaacagtgcctttgnccattcccgcccaagtgagaatgtacaacaacgtgcctgtgcttgctgtgtttgtaaatt

SEQ ID NO: 9988 - DNA, 476 bp, Rattus norvegicus
ggagctacaagtactacgccagcagcatcctcaaccccgacggcttcctggggtacccttgctcttcctatgagaagttccagcagaatgactgcttcccttgtccagaagaagggtgtcccaaaatggggcactatgctgatcaatttgaggggaaaaccgctactgtggaacaaaccgtttatctgaatacaggagatagtggtaactttactcgttggagatacaaagtatcagtcacactgtcaggagcaaagaaactgagtgggtacatcttggttgctctgtacggaaataatggaaactcaaagcagtatgaaattttcaaaggatccctcaaaccggaagcaaggcatgttcgtgacattgatgtggacatcaatgttggagaaatccagaaggttaagttcctctggaacaacaaggtgataaatctcttccggcccactctgggagcttcgcagatcacagtgcaa

SEQ ID NO: 9989 - DNA, 76 bp, Rattus norvegicus
gtcccaggatttatgaccctgtgtgtgggactaacggaattacttaccccagtgaatgcagtctgtgctttgaaaa

SEQ ID NO: 9990 - DNA, 564 bp, Rattus norvegicus
gaacagatgcccaaaccaacgtgattccaccatcaatgtggaggagaatggggtgtcctcggaaagccgattttcagtgcagatgttcatgtttgctggaaattatgacctagttttcctgcattgtgaggtttacctgtgtgactccactactgaacagtgtcaaccatcttgctctacaagtcgacttcgcagtagtgaaccagccatcgacttaactcgggttctggatataggacccatcactaagaaaagtgttcagaatcctgatacctccaacgggactccccgcaatacagggttcctgttggcctggcccacgttcttcctgcctgtcttcctggcctggctgttctgagagtccagctgggcacctggccttaaagttcttccctctggcaacggctcatatccaccgttcagtagaactgaatccctctgtgaatcatgtgaacagcccaggagatgcaatgtgtattggtaactcctggttagagttgtcctgatagtgggcagaaaagggcaaatcccatgattctttcaaaatctctcttgtcctgacag

SEQ ID NO: 9991 - DNA, 506 bp, Rattus norvegicus
  misc_feature (235)..(235): n is a, c, g, or t
gatagtctgcttctactacatagatctgaaaaagcagcatagctttttaacagtgaagcgtcaatgtgttgacagcaaatgtccacctagcatgccatgagctgcacaagataaaaaaccctgcacgagaaggcaagtgttttttgccaagcaggtgtagggcaccacagaactgtgtccttctcagtgagactgggaaacaaggtttctaatttaactactggccccccagtanttcaggaaccacgacatgatttctccgtttcttaaagggagaagtttagctaaagacacattccaggtgtcactaatagttccaaagctaggtgactaagtgttcagtgagagccgttaagaaggaaaaccagctaatcaccattccagttcgacgttatttttgaattactatctacttaagatttctcataatttgtgctcaggcagcacaatcaagaggggggagagggcaaaattactaagtgacagttattctacatctaagtctg

SEQ ID NO: 9992 - DNA, 509 bp, Rattus norvegicus
aaagatcattcgacaccctgagtataacaaggacactctggacaatgacatcatgctgattaaattgaagtcacctgccgtccttaactcccaagtatctacggtctctctgcccagatcctgtgcatctacagatgctcagtgccttgtgtctggctggggaaacactgtgagcattggtggtaaatacccagcactccttcaatgcctggaagcccctgtcctctctgctagttcttgcaaaaaatcctacccaggccagatcaccagcaatatgttctgcctgggcttcctggagggtggaaaggactcctgtgatggtgactctggtggccctgttgtctgcaatggagagatccagggcattgtctcctggggttcagtctgtgcaatgagagggaagcctggtgtttacaccaaagtctgcaactacctgagctggattcaggagactatggcgaacaactgagttctcttacctttcgtaaatcaccggttcactatccatt

SEQ ID NO: 9993 - DNA, 435 bp, Rattus norvegicus
  misc_feature (43)..(43): n is a, c, g, or t
cacttctgctcggtgttgaccaaaaatcgttctctgtttgagntgcaaatgagcagcaacccgctgggagactcgggagtcgtggagctttgcaaggccctgggctatccggacacagtgctgcgtgtgctttggctgggagactgtgatgtgacagacagtggctgcagcagccttgccactgtcctgctggccaaccgcagcttgagggaactggacctcagtaacaactgcatgggggacaccggtgtcctacaactgctggagagcctcaaacagcccagctgcgcccttcagcagcttgtcctgtatgacatttactggacggatgaggtggaagaccagcttcgggccctggaggaggaaaggccatccctgaggatcatttcctgagatgtacacctctggacacaagatattaatccagccccagag

SEQ ID NO: 9994 - DNA, 492 bp, Rattus norvegicus
caagcatcccaacttcgataggaagaccctgaacaatgacatcatgctgatcaagctctcttcccctgtgaaactcaatgctcgagtggccactgtggctcttcccagctcctgtgcacctgcaggcactcagtgcctcatctctggctggggcaacacgctcagcagtggcgtcaatgaaccagacctgctccagtgcctggatgccccactgctgccccaagctgactgtgaagcctcctaccctggaaagatcactgacaacatggtctgtgttggcttcctagagggaggcaaggattcctgccagggtgactctggtggccctgtggtctgtaatggagagctgcagggcattgtctcctggggctatggctgtgccctgccagataaccctggtgtgtacaccaaggtctgcaactatgtggactggattcaggacacaattgctgccaactagagctctccaatccctctacagtcattatgtca

SEQ ID NO: 9995 - DNA, 382 bp, Rattus norvegicus
  misc_feature (273)..(273): n is a, c, g, or t
  misc_feature (300)..(300): n is a, c, g, or t
  misc_feature (303)..(303): n is a, c, g, or t
  misc_feature (357)..(357): n is a, c, g, or t
acagtcggaaaccatcagcaagcaggtcattgttccaacatggccctgtggatccgcttcctgcccctgctggccctgctcatcctctgggagccccgccctgcccaggcttttgtcaaacagcacctttgtggttctcacttggtggaagctctctacctggtgtgtggggagcgtggattcttctacacacccatgtcccgccgcgaagtggaggacccacaagtggcacaactggagctgggtggaggcccgggggcaggtgaccttcanaccttggcactggaggtggcccggcanaancgcggcatcgtggatcagtgctgcaccagcatctgctctctctaccaactgganaactactgcaactaggcccaccact

SEQ ID NO: 9996 - DNA, 549 bp, Rattus norvegicus
  misc_feature (284)..(287): n is a, c, g, or t
gcccaggtaaccaggcccagaaggtcatcatctgccatcgaggcacccgttcgccctcccccagcgacccggactacggtctccctcctcttgcagggcactccctttcctgggctgatgaaaaacagctcaaagaacaaaatattattcgtacagctaaagtgtggaccccagaggaccccagaaaactcaacagtaaatcttttgacaacatagagaacgaaccaccttttgagtttgtgtcctgagaaagctctcacaggccggctgtgtctttgtgcatnnnnattgtacgtgtaaatacctataatgtaaatgtaatttaaagaccacatttttctaatggcaatcaactgtttgttatttatctatttattatgctgttgagttaatggaaatagattgtctttttaaaaatatataatttatataatttatcgtgatattctataatatgatttccccagaacctttggcagaactctgaactggaagatctctgtccgtgcttatttaatgtcggaattggtttacttctgagtgttgcta

SEQ ID NO: 9997 - DNA, 491 bp, Rattus norvegicus
aaagcgtgtgcaaggccagtagccagaaggactgttttctgtcagcaatgtcaagctgcagaagggagggtgatctatacggtgtaatctctcctctgtatctaaccccacaacatttttttttacctcaacttaatttcgtgtgttcacctgtatttcctcctttccagaaacacctccaggtaagaagggatatgtacataccagggcaagggtggtaacatgtgtagtcagtccccaaggaacactggcatgctgggactcagttaataagtagctttgaatgccaaaactatgtatgcttttaagtactgttgatgtagctcttggtaatttggctcagtgtgtgtgtgtgtgtgtatgtgtgtgtgtgtgatctgaacatatggctacattatgtgtgtgttaataacttgtaagtggatattggaattcaacaaatgtcatcattcttccataaaagttggagtatcgtgtgagcttcatttctt

SEQ ID NO: 9998 - DNA, 368 bp, Rattus norvegicus
tttctggcctcgctgtggcaggaaacagatgagccgggtggcaatatgtcggcggacttggctcgtaggtcccagctccgagatgacagcaagctggaggctctctatatcctcatggtgctgggtttcttcggcttcttcaccctgggcatcatgctgagttacatccgatccaagaagctggaacactcgcacgaccctttcaacgtgtacatcgagtcggacgcctggcaggagaaaggcaaggccctcttccaggcccgcgttctggagagcttcagagcttgctatgtcattgaaaaccaggcggccgtagaacaacctgccacacaccttcctgaactgaagccactgtcatgaaccccata

SEQ ID NO: 9999 - DNA, 524 bp, Rattus norvegicus
  misc_feature (301)..(301): n is a, c, g, or t
ggttatttttccgagtcatccatgacatatcaagttttggaattgccttacaaggctgatgagtttagtttagtcatccttcttcccacagaagatgtgaacatagaagaagtggaaaaacaagttactgctcgtcatgttcagaaatggttctctgagctgcatgaagaggaagtggaagtcagcctccctcgatttaaaatagaacaaaaattagacttcaaagaagcattattttctttaaacgtaactgagatatttagtggtggctgtgacctttctggaataacagactcatctnaactctatgtctccagagccatgcagaaagttttctttgagataaatgaagacggaagtgaagctgcagcatccacaggcataaacatccctgcaatcatgagtttgactcaaactcaatttctagcaaatcatccatttctgtttattatgaagcacatccaaacagaatcaattttgtttatgggaaaggtgacagatccggacatccatacagtgagaga

SEQ ID NO: 10000 - DNA, 494 bp, Rattus norvegicus
  misc_feature (197)..(197): n is a, c, g, or t
  misc_feature (206)..(206): n is a, c, g, or t
  misc_feature (209)..(209): n is a, c, g, or t
  misc_feature (406)..(406): n is a, c, g, or t
gtctgctaattccattcagtccaggtcctcctcttacagtggagagtatggcggtaaaggaggaaagcgattctctcactctggcaaccagctggacggccccatcactgccatccggatccgtgtcaacagatactacataataggtctccaggtgcgctacggcacagtgtggagtgactatgtgggtggcaacnagggagacntgnaggagatctttctgcaccccggggaatctgtgatccaggtgtctggcaagtacaaatcttatgtgaagcagctgatcttcgtgacagacaaaggccgctacctgccttttggaaaagactcaggcacaagtttcaacgctgttcccttgcaccccaacactgtcctccgtttcattagtggccgatctggctctgcnatagatgctatcagcctgcactgggatacctaccctagccactgcaacacttgttgaaacccaccatcctctgctgtggtgggtatga

SEQ ID NO: 10001 - DNA, 505 bp, Rattus norvegicus
  misc_feature (166)..(166): n is a, c, g, or t
tgagttcatttcatccatggaaggatataagtatccaatatatgctgtccagtggcatcctgagaaagcaccatttgagtggaagaaactgcgaggcatttcccatgcaccgaatgctgtgaagacttcattttacttagcaaaattttttatttctgaagctctnaaaaatgatcaccactttgagaacgaacttgaagagactgaatccttgatttaccagttctgtccagtttatactggaaatatttcttcatttcagcaagcttatatgtttaactgaaagacttcaatatggtaacagagcaactttgagtaattccgtgattgaattgctaacactgctcagggcagtgtgagaaagccacacagatgcctttgctgtgtgcctggttctgattcatggcttaataatgattatttttatcagatttgataacccgacaatgaaaaagataaaaaaaaatcatagtgtttttagtgaaaatgccttcttaggtctgaa

SEQ ID NO: 10002 - DNA, 150 bp, Rattus norvegicus
gctcagtttagcaggtaaccctccagctgaggtgaatggaaaaacgcctaattgccctaagcaaattatgggatgtcccaggatttatgaccctgtgtgtgggactaacggaattacttaccccagtgaatgcagtctgtgctttgaaaa

SEQ ID NO: 10003 - DNA, 522 bp, Rattus norvegicus
  misc_feature (471)..(471): n is a, c, g, or t
  misc_feature (474)..(474): n is a, c, g, or t
  misc_feature (476)..(476): n is a, c, g, or t
  misc_feature (479)..(479): n is a, c, g, or t
gggagattccagttcaatgcctttaaattcttgagacatctgagttctgtgtatctcaagtgtaagattttgatctgtgataccagtgaccacacatctcgctgcaatcaaggctgcgtctcaagaaggaaacgagatattccttcatacaaatggaagactgattctgttataggaccaattcgcctgaagagggaccgacttgtaaatggagattcaggacttctgcctcaaacacacgaagcagagatttcgaagcagcctctcagccatctgcacctgttttccttcatggttcttgctctgaatgtggtgattgtggtcacagccacagtgaggcattttctaaatcgatggaaggatcacggataccagaagctgcaggtctactagctgtggaccccaagaaaggcctcttgtcctcttctgggtggccgatgaaaaagttctctgtgcctacgagggttaggnctntnccngaaaggcctaaaagcagcgtgtgtaccgtcatgctcgtatcac

SEQ ID NO: 10004 - DNA, 401 bp, Rattus norvegicus
aggacctcatatggaaccacacccgacaacctggggacgactacagcaatgatttgatgctgctccacctcagccagcctgcggacatcacagatggtgtgaaggtcatcgatctgcccattgaggagcccaaggtggggagcacctgccttgcctcgggctggggcagcatcacacctgacggattggaattaagtgatgatctccagtgtgtgaacatcgatcttctgtctaatgagaagtgcgtcgaggcacacaaagaagaggtgacagatctcatgctgtgtgcaggagagatggatgggggcaaagacacttgcaagggtgactcaggaggccccctcatctgtaatggtgtgctccaaggcatcacgtcctggggctttaacccatgcggtgaa

SEQ ID NO: 10005 - DNA, 391 bp, Rattus norvegicus
atgctgaattctgctcagcccaagaaaaaggacagacacttcagcaatcaagtcttttgctgagagcctgatggaaccctgttgagttcctggtaaggagttcacattggaagaccaagtgacatctggctaaatttctacagacagatgtgatggaatcatacgctttggagatgcactgtaggggtcgtttgacacttggagctcttcctagccagctgaaagatgctctgataacattcagatttcgagactctgtctgaagcactggcaagaggcctacaaccgaggaatggatcttaggagtccaaccttttagccaatttggaaggatttgaatttttgttggaacaatgaagccgagttctaaaccctttcaccacatgttata

SEQ ID NO: 10006 - DNA, 348 bp, Rattus norvegicus
  misc_feature (65)..(65): n is a, c, g, or t
ggacatgaaggtgtttgtaaccctataggaggaataaaatatcaaccaaccagatgccaccaganctcacagggattaaatcaccaccaaatgagggcacatagagggacccattgctccagccaaatatgttgcagcagatgccattgtacagcatcaataggaggaaaagtccttgggagcatcctagtagaagcagggagaggaagaggggatatggaacagaaggaaaataggataacatttgaaaaaccattatgtaattgtatgaaatatccgacaaaaatttaaaaaaatctgtgcatataattatgtattaatatgaatatatcatctgtcttacttaat

SEQ ID NO: 10007 - DNA, 376 bp, Rattus norvegicus
gtcctgtgattcagatagttgctcaattttctggacattaccaattaaattttatctagaatttctgaataatcatgatttttaaacataaaacatcattcttcttcaagaaagagacacagtcttaatgctcagtaaattgtgttgatgttttccttaggaatggtttttagagagcaacactttgtctcagcaacagtgagggttgtttagggatttccatggattcccttggccaacagctcaattgaaagcaactgaatgttgccactcgtggcttcacctggcatcaagagacagtcaaattcatgtgaaagattttcctttcttttattgtttcttaactctatcgatctccattacattcttatacctt

SEQ ID NO: 10008 - DNA, 445 bp, Rattus norvegicus
gtgatgcagttaatcctgttccttttctaaagcggactcctggcgaaacaatgtactatatatcattgcctggaagcgtcagatgcaggaagctcctatctaaactggacaactgtcccttcgaagaacaaacagaacagctgaaggtatgaacactaagtgactcctcttgttgaaagaaccctgtgaaaatgaggactgatgtataatatctgagaagggtttgtgctagtgtgttatgcttttggcaagttaataaaaatgaagtgcacaggaaaagatcatgtgcaaacatttgaagagagaaagtggagattatcaataaataaaatagatacacttgttgagtgagtccattcctcaaaagtagcactgtgcacagaagaggaggaagagttcaaaacaatattctccattccctacgaactttactaccaagggtatg

SEQ ID NO: 10009 - DNA, 233 bp, Rattus norvegicus
tacccaaaagggattgattgtcttaaattaattaaggaagtcctgtccactctgggtggtcccattctccaggcttgggtcctggactgtataaaactgaaaaaactacgtgagcccacatttgctctcatagctctgctcttgactgtgcaatgcaatgtgacaagctacctcaagctcctgtggttgtgacttccgcacagtaatggattataacctcataccgtgagctg

SEQ ID NO: 10010 - DNA, 420 bp, Rattus norvegicus
  misc_feature (156)..(156): n is a, c, g, or t
  misc_feature (192)..(192): n is a, c, g, or t
ggctttaacctggacatcataaagaaccacacccgaaaacctgggaatgactacagcaatgacctgatgctgctacaccttaaaacgcctgctgacatcacagatggtgtgaaggtcattgatctgcccactgaggagcccaaggtggggagcacntgccttacctcgggctggggcagcatcacacccctnaaatgggaatttcctgatgatctccagtgtgtgaatatccacctactgtctaatgagaagtgcatcaaagcctacaatgatgaggtgacagatgtcatgctatgtgcaggagagatggatgggggcaaagatatatgcaagggtgactcaggaggccccctcatttgtgatggtgtgctccaaggcatcacgtcatggggttctatgccatgtggtgaacccaataag

SEQ ID NO: 10011 - DNA, 347 bp, Rattus norvegicus
aaggtcaagaccagcactactccgtgagcaccagtggggatgggcaggggaaaggggcttggcctggagaattgggagcccgccagggccaggactggcagaggactcggctgagggaccccaagagatgacacctttagcaggctactgagttctggactattcctcggggctgtcctgcatgtgccagaagtgggggtccggaaatcacagtccccttcatcgtggttcagaagaacctgtatcagtcataatcattcatccataaccagtactagttgtcatgataattagcctcatattttctatctagagctctgttgagcgcttagaaatcgctttcatga

SEQ ID NO: 10012 - DNA, 461 bp, Rattus norvegicus
  misc_feature (28)..(28): n is a, c, g, or t
  misc_feature (31)..(31): n is a, c, g, or t
  misc_feature (371)..(372): n is a, c, g, or t
  misc_feature (387)..(390): n is a, c, g, or t
agctgtgcagcctgatagccagacaccngtncagggaccaggctgtaccgagtagctggccatggagtctggctcatggaggccccccacaaccctaacatccagaggctgaaagaattggcagctgcctactcaaggaagcttgggtctgaagcctgcccagactgggctgggagtgttctcagagcctaaacacaggaactgagtcttcagctatcaataggccatggctagagctggggcgcactcttcgtccgctgccttcctgtttatgattaactctggatacctgggcaggtggggcagagtgagcagggaagcggcttcagcccctgagacgcagaataataactaatcagctagtttgtgannaaaaaaaaaaaaaannnnggtattcttcagatcaccgagctctcacctgcctggagaaccaagcgattatccctagtccacagcagaga

SEQ ID NO: 10013 - DNA, 325 bp, Rattus norvegicus
  misc_feature (276)..(276): n is a, c, g, or t
  misc_feature (287)..(287): n is a, c, g, or t
gtcacagacgggaacagttctcttcatgaatgaaggtcagagataagtgggtgctgccatggtggacaaaacgatgtcatctgggatggctgaacttctacgccaccagcacatcagcactgcagatgccttcgccatctcttggatgccctggtgaagccaacaactgtgagtactattcattgcccaggaaaacaggagggaagagattcagtgacatggggcagtaacaaagcagataaagtggctcgggaaatggctatgcaggagcctatnctggttacagncctgcaagagacagccactgggaactgggattggacta

SEQ ID NO: 10014 - DNA, 456 bp, Rattus norvegicus
aaatcttccttatagtagcaccttagattcagctcccagctactctggcattacccacaaaggtcaagacacggagtcctaagacatcatactaggctctaagactgttgcataagaagaaggatgaggagaagatggggaggaattggaaaaaccagttggacgcggaagtagacagtaaaacttctccacttcccagatctacatttcagcaagtattctgtctcagaggaaaatattcagattttagagacagcgattctagttcctgtgcttagtttggggagggatacagcaatattgtgatgatagtgctgatattgattatggtggtgatgtgatcgaaaactgtttttctctaatgctaactgatagtttaagtctctgcatagtctgttggtgttttacaagtggtttgatatacatgtcagattagctacacactcccatattgaa

SEQ ID NO: 10015 - DNA, 523 bp, Rattus norvegicus
  misc_feature (100)..(100): n is a, c, g, or t
  misc_feature (128)..(128): n is a, c, g, or t
aatatccacatttcataggcacatgtattccttccgtataaatgaagattctgactttctacataagaagatcaaaatatagtagataatattctatctncaaggaagatatgcactgtagttaacangaaaagttacagttacatataactgactcatgtggttgtctaacattcacaacatcccagccagccctttgttactatccttctatctatagctcaaggaatcacagtgaatacctcacagggttgactttgtatcagatctgttgttttaaacatttagaggaaaagaataatctctcttctggataggagaatgtaaaactagtgttctctgggagaaaatctcaggttgtatgcacagaactaatgagctagatagtacatcctatatagtacatatcacagatgtgttatatataaatatgcatgctgattctatttttaaattttaagaattatacatgatctgaggatgctgaagggaaaatgtatattctgtgcccatatggatgtct

SEQ ID NO: 10016 - DNA, 517 bp, Rattus norvegicus
gtgcacttaccctgtgatgagtcacattccgggtggcatagagaaatctagcatggaagacgaaggggccagagaatcactgaactttgctgtcagccagtacaatgaaaacaaacgtgacttgtacctgagccgtgtttttggaagtgaagaatgtccaaaagcaggtggtggctggaaccaaatttttatttgatgtgatcctagtcaaaacaacctgtttgaagacccaggctgacttgaccaactgtcctgcaaaggaccaggctggtcagcaggagcatgaattctgctctttcgaggtatatgacaccccctgggagaatgatatggccttgataagctccagctgtcacaatatataacttaatgtcaagtggcacagtgcagggtgcagatgtctctgccattgcctcatcactccagtggatgacctatcctagatgaatgcttaccagtaccaacatcagcagttgattagactgctgagaatatagagcccaagtatctttccctt

SEQ ID NO: 10017 - DNA, 404 bp, Rattus norvegicus
tcccatgtcaggagctgtgtactggggatgcatcctgtccccaggggcacaaatgctgcagcacggggtgtggccatgcctgccgaggagacattgagggagggcgggatggtcaatgtcccagaattctggtaggcctgtgtattgtccagtgcatgatggatgagaactgtcaacctggggaaaggtgctgtaaatcaggctgtggccgcttctgcatccggggactccggcccctccaacagctcacagactccaaccggacagatggctttaactctacattagaggctcaagtaccctagctgacctgatttgcctggagctccaggaagctgctggaaggctggaaggggtgacatcctggggtttgtgacactccctggagtatcaggccttctcct

SEQ ID NO: 10018 - DNA, 444 bp, Rattus norvegicus
atatcttcaaatttctttacaacaagttcagtcatgacacatatctcagcaacataaaaaatcagtcattcaccatgaacacatggggatttggtgaaattgaagtggttaaaaccaaatgtagaaagattgactctgacttctacaaatgttctttccagtgggaattctgtaacataaagcggactcctggagtaacaatatactatataacattgcctggaagtgtcagatgcaggaagctcctatctaaactggtcaactgtcccttcgaagaacaaacagaacagctgaagagagaaatatgctactttcaactgtatcctgattatattgagcaaaatatacgttctgtaagattcaattgttataccaaatgagactctgggactgactgggctgttacccaccacttgcagacgttgattctagttctggacctct

SEQ ID NO: 10019 - DNA, 408 bp, Rattus norvegicus
  misc_feature (78)..(78): n is a, c, g, or t
  misc_feature (82)..(82): n is a, c, g, or t
  misc_feature (86)..(86): n is a, c, g, or t
  misc_feature (89)..(92): n is a, c, g, or t
  misc_feature (94)..(96): n is a, c, g, or t
  misc_feature (98)..(110): n is a, c, g, or t
  misc_feature (113)..(114): n is a, c, g, or t
  misc_feature (129)..(132): n is a, c, g, or t
ggtcattctgggttacctagtgagtttcaggccagcctgggatgcctgagacgctatctcaacaaacaaacaaacaancaancaancannnnannnannnnnnnnnnnnnatnnatagatggatggatnnnntagatagatagataaaaatgaataatgttgagccttttgacttaattgatggcaaacgaagaggatgtgttgaagaccacctttattaatctacctttaaacacacagactggaatcaggaataagttcactgcctttaagaaggaaaagctgcagtttgctctcagggaaagcttttcttgttttgttttctccagtaaaaaagccttaggaaggtgtcttcactgatcagccatttgtatactagtgtcagtggtatcctaacatctccatatg

SEQ ID NO: 10020 - DNA, 406 bp, Rattus norvegicus
ttggtgacagcatccaatgcagcgtgctctattcaaagactcaagagacttccaaacgaaaagtctgatgaatgtacagatgtagacggtggcaagcacgtccttaacacttactggcagaagaactgtgagtggtgtttctgtgaaaaaactgcgatcacctgctgcaccaaaactcttatacccgtgagctatgacaaaaagaggtgtcagagacaattccactcagagaactgcacctatagtgtggtggaacggacgaacccaggaaagacctgtccagtcaatggctggacaatataaatgtgcttcttgggggcccaaaagtggaccaatatttgaacattgtatgaattaaagttaccaatcataacctcgcaaggaggtgacctacaatcccaagact

SEQ ID NO: 10021 - DNA, 519 bp, Rattus norvegicus
  misc_feature (187)..(187): n is a, c, g, or t
  misc_feature (434)..(435): n is a, c, g, or t
gcaccctgagcggactgagacaatcttgcagagatctgcctggctgcccctaggggaggcagaggaacccaagatcaagccaggctcacgtcagaaaccgagaattacaggctgatactctctccgggcaggggtctgagccactgccttgcccgctcataaactggttttctcacggggcatacgnctcattacttacttgaactttccaaaacctagcgaggaaaagtgcaatgcttgttatacagccaaaggtaactatcatatttaagtttgttgatgtcaagaggtttttttttttgtaacttcaaatatatagaaatatttttgtacgttatatattgtattaagggcattttaaagcgattatattgtcaccttcccctattttaagaagtgaatgtctcagcaaggtgtaaggttgtttggttccnngtgtgtgtgtgtgtgtgtgtgtgtgtgtgtgtgtgtgtgtgtgtgtaaggtggagagcgcctgattaccgcctgtggatgaaga
